United States Patent 11,242,544 (MICROBIOMES AND METHODS FOR PRODUCING MEDIUM-CHAIN FATTY ACIDS FROM ORGANIC SUBSTRATES) - sequence listing, part 4

SEQ ID NO: 184 - DNA, 22990 bp, Unknown
  Metagenome-assembled genome
gacgcgatcttctgtggcctgggaagcgacttcaacgcgcgtcgcggcgcggacaacttcacgtaccagacgtttgccgaggcgtgccgcgaggctcacctggccggcgcgcgcgtgtacgtgacgcagaacgtcgtgatcaagaccgacgagatgcccaaggcgctggcgctggtgcgcaaggcgtggcttctgggcgcggacggcttcatcatccaggactggggcctgctcgcggaggtgcgcaggctgtggccgcagatcgagtgccacatatccacgcaggccaacgtgcacgacgcgcgtgccgtgcgctggtgcggcgagctgggcgcggagcgcgtgacgctctcgcgcgagctcagcgtggcggagatcgcgaccatcgcgcgcgagggcgtggagctcgagggctttggccacggcgcgctgtgcttctgctactccggcgtgtgcatgctgagctcgctcagcggcgccaggagcgcaaaccgcggcctctgcgcgcagccctgccgcctgccgtacgacctggtggacgagaagggcaacgtcgtgggtgacgccgcgggcgtgcggccgctgtgtcccaaggacttctgcaccattgatgacctgcgccgcctgcgtgacgcgggcttgggctcgctcaaggttgagggccgcatgaaggccccggactacgtgtactccgtcatatccgcctaccgcgcgcagctggacgacctggccgcgggccgcgagccgggcgccgcggacgaggcggcgcgccaccgcacgctgcggcgcgccttcaaccgcgacttcaccaacagctacctggacggccgctccgacagcgacatgatgagctacgaccgctccaacaaccgcggcgagctggtgggcaccgtggtggcgagccgcgacctgggcagcgccaaggtccgccgcggcggcggcaggggagggcgcgaccgcttccgcaccgtcacgatggcggaggtggacgtgcgcctgaacgccccggtgggcgcgggcgacctgcttgaggtgcgccccacggacgacccctcgcagttcctcacgtcccacgcgcgcgaggacgcccgccccggcagcgtgatcacgctcgactgcgcgcgcccgatggcgcccggctgcccggtgcgcgtgatccgctccaaggccgccatggacgtggcggagcgcgctgccaagggcgacctgcgccgccgcctccccgtgagggtgacggtcgaggcgcgcctgggccggccgtttgccgtgacgctcgcgaccgcggcggcgctccccggtggcgaggccagcgtccgcgcggagggctttgtggtggagcccgcccgcaccaggcccgtgaccagcgaggaccttgcggagcacgtgggccgcatgggcacgagccccttcgagccggcctcgatcgaggtcaacctcgacgagggcgtgggcatgtccttctcgtccgtgcacaaggtccgcgcgcaggcgtgcgagctccttgagcaggcgattcttgagccgacgggcgagaaggtccgcggccttggcctgacgcgcgtgccggatgcggcggcgctcgcaggtgcgctgggggaggcgcgctcgcgcgtgcgtgccgagctggcgcgggaggccgcggccggccgcgtggacgcggccgcgccggagggcgaggtgtgcgccctggtgccgacgcccgaggtggctgccgccgcgctcgcggccggcgccacgaggctgtacgccacgcccgaggcgctcgacgttgcggccgcggccggcaaggcgtggccgggcgggcgcgagcccatcgcctggctggacgaggtctgccgcgagatcgaccacgaccgcctggacccgcgcgtggaggcgggcaagccgtgcggcgtgggcaacgtgtccgagctggtgctcgcgcgcgagcgcggcgcccttgccgaggtcaggccctgcattcccgtgcacaaccccagctgcctcgcggcgctggaggaggctggcgcccgcggcgtgtggctgtccccggagctcacgctcgaggaggcctgcgagctggcgcgccacgccgacgtgccggttggcctggtggtgagcggccgcacgcgcgccatgaccagcgagcactgcgtgctccaggtggccgaccgctgcatccacgactgcgcccgctgcgcgctgcgccgcaggcggctgtcactccgcacgcgcgacgggtcgctgctacccgtgcgcacggacctcaccggtcgcagccacatctacgccgcgcgcccgctggacgccacgccgcaggtgcccgagctcctgcgcgcaggcatcgcgcgcctcatggtcgactgcacgctcatgactcccgccgaggcatccgcccaggtcaagcgggccgtggccgcgcttgcggccgcccgtgccggccgcactcccgcgccgcgcgcgaagggcgccacgtccggccatctgttccagggcgtggagtagcgccgtcgccgcggggtgcgttcccgcggcgcggctcctgccgcctggccctggcgcacccgccgcgccctcacgaaaagactttgtgcagggatggtattcgcgcgacacaatgggtagacttgtcacaattgcaagtagcgtggtgggaattaaactgccggcaggcgccggcccgccgcggcaggaagggaagtgccagatggcagagaacactgacgagaagaacacccaggcgggcgccgacgccgccccggagcaggagcagaagggccccaaccgcgagctgctggaggccacgatcgacgtgatccgccagagcctgcaggctgacggcggcgacgtcgtgctcgtgaactgcaccgacgacggtgtcgtcacgctcgagatgcagggcgcctgtgcgggctgcccgctttcgacctacgacatgagcgagggcatcgagcgcatcctgaaggagcacgtgcccggcgtcaccaaggtcgagcccgcgatggcgtggtagtccttctcgcccaagggcccttggccttggccaaaggcatatgctagacaggaacgttttgtgtggcgcgaccctggcgcgaggcgttggggtcgcgcgtttgtggaagcggccagaaggaagatcgcatgtggcttaacgagctgtatcaccacctcaatccgatcgcgctgcagattgggcccctcgccatccgctggtacgggctcgcgtacttctttgggctgctgctcgcggccgtggtgatccaccgcgtggcgcggcactgggacatcgagctttccgtggacgacctcacgaccgtgatggtgggcatcgcctttggcctcatcctgggcgcgcgcctcttttacgtggtgttctacggcgacggctactaccttgcgcaccccatcaagatcctggcgtttaacgagggaggcatgagctttcacggcgggctggtcggcgcgatcgtgggcggctcgctcacctgcagaaagctggggatctccgtcctcaccatgtgcgacctcgccgcgatcggcgcgcccatcggcctcttctttggccgctgcgccaactttgtgaacggcgagctgtggggcaagcccaccaatctgccgtggggcgtcatgtttgacaagacgggcggcggcgccgtgtaccgccacccctcgcagctgtacgaggccctgctcgagggcgtcgtgctgttcatcatcctgttcgcgctttcgcgcaagaacaacccgccgcgcccacagggcacgttcatcggcacgtttctggcgtgctacggcgttttccgcttcctgatagagttcgtgcgcctgccggacgtgcaggtgggctaccttctggggaccaactggctcaccatggggcagtgcctgtcgcttcccgcgttcgcggccggcgtcatagtgctggtgctttcgcaccgcgcgcagcggccgcaggtgggcaaggtggacgccgtggggtaggctgccggcggaacggtgggtggccaacgttggccaatcgccttgcggcatcgcacaaattgcacgtcagaatccacgtttaggtaaaactacgccagatgtcacggttacgtgcccaaaagggctgctaaacgtgacatctggcgtagtagtccgataaccgtggaatccagcgtgaaattttccgtaaacgtgacgtctgacgagcgatttgccggcacccatctcccagtgcgttgcgtaacggtaaaaccaccgccatccacacgcaagtttcacgagtacaaaagaacctgctggtagaatcaaaggcacctaaataacctgagggcatggtcaaagctcataagcctaggcaaaaggattccggttcgaccccggatcagcacgaactatgctcacacagtggctgcaggcggcgccggcggacagcgggcgcggcatgccggcgcgggcgggtggttccgtcgcgcggcacggtgccggcagccagatgggatgccttcctggcttccaatcctgcgtgccctctcgaagcggaaagagggcagcatgcttttctcacatggccccaagggggacgccgaggcccggcgtaacgggggcctcacgctcagacatctggcaggcaggcgcgcgctcgcgctgatcctgggcttcgcgatggtcgcgagcgaggtgcccaccacggccctcgccgaggcggtcgactccgcgtccgccggctccaccgtccagtccgtccaacaggagcagggcgagaagaacggcaactccggctcgggcgcccagtcaggaaccgcggccagccagaccgaggccggcacctccgccggcaagtccaccggcaccgacgagaccggcacggctgccagcagctctggctctaagtctggcgtggccggcactgccgcgacgacctcaggctccacgtctacgtcgtcctccgcgggcaagtcctccgcggcgggcgcggcgggcaccacgtccacctcggctcctgccgccaagaccaacgccgtcgcgacgacctccgctaaggcacccgcaaaggccacggccacggcagccgctgccgccacggtcgtgcctgacacggcccacgtgacggacgccaacggcaaggagctctacacctctagcaaggtttccgtcggcgcgaccgtctccgtcaaggcgtacacctcggaggaggacgagtggggcgaggacgacgaggaggccgtcgccgagtccgcctacgccggctacacgttccagtggtaccgcggcggcaagtcctcctacacgcccggctcggctggctaccaggcaatcgacggtgccacgtcgcgcacctacgtcgcaacggccgccgacgcccacagctacctggcatgcaagatcagcttcgccaagcctgacggcactaagggcgaggtctggagcacgtccaccggcgaggtgacggacggcaagaccaagctcgacagcgtcaaggtctccggccaggcaaaggccggccagaccctttccgcaaagacgtacgtaaagaccagctggggcacggacgaggccggcgcggacgtctctgtcgcgtaccagtggctcgcggccgacctcgcagacggcagctacaccaagatcgacggcgccaccaaccccacgctcgcactgaccgacgcgctcgtgggcaagttcgtaaagctcagcgcaacctcgagcaacgaggtcctctccaacgtcctgggcccggtcgcggcgcagggcagcgcggaggacgaggacgtcctcacaaaggcggtcgcagcgctcgagtccgacggcttcagcggctatgcaccctcgccctcctacggcaaggactccaacgtgaacgacatggttcgcgcggagctcgccaagctggacgagaagtacgcgggcatccaggtcgtgacggagtccgtggagcgcacggccgaggccgaccccagccagaagggcggcatctccaccgacgcggcagacaacggcaaggtcacgttcttctcgctcagtcccgccaagaagaccgtcagcacctcgacgacgacgctcaggcagctgcgtcccacgttcaggctcacgtacggcagcgcgacggcttggtacaccccctccaagtacgtgctgctcgactgggaccagcaggcgatgtccgccgagctggacgccgcggcgcagagcctcgcgcccacgtacgccgagggcgactccgcggattccgtcacgcagggcgtgacgctgcccaacaagatcggctccggcgtaagcgtgagctgggagagctcggacaccgacgcgctcaagctcgacggctactcctgggacgacagcctgaccgcgacccccagcaggggcgcgcaggacaagcacgtcaccctcacggcaaaggtgagcttctccggctccgacgcgccgtccggcagcgttacgcgcacgttcgacgtcaccgtcaagggcgacctggacctcacgaagcgcgagcttgccgaggcgcagcagaagctggacgacaacttcacgctcgagaagctctcctatatatctagcgcggacggcaagtttgaccccgaggccgtggtgggcgacatccagctgcccaccacgcgcacgctgggcaccaggcgcctcgacttcgacgtgaccgtcaagtacaccgcgaccaaccagacgctttcggtcaacggctaccgcgccaacgtggtgcgccccgtcgagggcgccagcgacgcgagcgtgggcatcacctgcacgctcacgctcaaggacgacccgacgcagtccgtctccaagacaatcacggtcaaggtcaagccgctcgagtccagcgccatcgacgacgaggtggcccttctcgaccgcgtgagccagcagtttggcactaggctgctgggcggccaggacgccaacgccgtgacgagcgacctcaagctgttcatggaggcctacgaggacgcgtcgggcaacctggcctgggccgacaacgtgaccgaggccgacggcgtccacggcatcgtggcgtccgagctgcccggctacgatcccatgggctcgagcgaccagggccgtacctttgcctcgagcaactccggcgtcgtgagcaacgagacgcttcgcgtgaccaagcccgagtacaacaccaaggtgaagataaccgcaaacctcgcgagcgagaagtacggggcgtactacgcgcgttacaaggacgacgcgggagtctctgccgagctcaaggcgaagctcgccaagctcgccggcacgcaggtgagcaccaccgtcaccgtgagcggcaccacggggcaggacgcccccatgcaggtcacgggcacggtcatcgggccggacgcgtttggcacgaccgagacctgggccacctccaccgtcaagatggacggcggctccacggcgtgggacctctccaagagtctgttcaagagcgccggcctcacgtatgacgcgcaggacagcagctacggcgtctacctcaacaccatcacgtcgcccaccacgggcaaggcctacgggtacgaccagacgaccggccgctactggcagctgttcgtgaacggcgaggccgccagcgagggcgccagctccatcaagctttccgacggcgacagcgtcgtctggtactactccgcctacggcgacaagctccccacgagcgaccagaccaacgtgacggcctccgtcaaggtggtgggtcccaacgccgagggcaagagcgcgagctgggtgagccagaccgaggccagcgtggcctccggcaccacggccgcgcagcttaccaagacgatcctcgagcgcaacaacatgacctgcgacgatgggatgtacaccatcagcgcggtcacgggcgtgctgcccaacggccagaagtccctgggcagctcgcaggacgcggatggcaactggtactggtggcagttcttcgtcaacggcaagctcagcaacgagtatgccgccaagtacatgctgcagccgggcgaccagatcgagtggttcttcggcaagtacggcgaggaccttcccgagcaggacgtccccgtcacgccagacgcgacgcgtcccgactacacggccgagtggggtgcctacaagggtacggacggcacgggcacgagcacggccgacaccgctaccacgggctccaagctccagtggatgcaggacctgggcaccgcgggccagacgttccagagcgacccgatcatcgtgaacggccaggtctacatcgccgtcaagaaccagctccaggtgcgcgacgcggcgaccggcacggtcctgcgccatgccgcgctggcggagcgcgtggagtccacctgccgccttgcctatgcaaacggcatcatcgtggtgccgctgcacgacggccgcgtccaggcgctcacggccgatacgctcgccacggtgtggctgacggacaggctgccgcagtcgcagggcgtgtcgcagcagtccatcgcgaccccgcttatcagcaatggctacctctacctggggacggacgctcccaagtccggcttcagcggcggctcgctcggcggctacctgatggccatcagcctcaaggacggctccatccgctggcagtacgaggactccggcaccggctactactggtcgggcgcccagtccacggtcgcgggcatcctcgtggccgacgacgccggcaacctcacgctccacgacgcgtccacgggcaaggtgctcgcgtccctctcgctcggaacgtcctcgcgcgcgggcatcgtcgtggccgagggtagcaccgtggcctacgccgtgaccaaggacggcgtgctgcaccgcgtcaaggtttccacggacggcaagctcacggcggacggcacgtgcaagttcgacgagtacagcacgtccacgcccacgctcagcaacggaaagatatacgtgggcggcggcaacaagagcatgaacggcgtcggcagcatgaacgtgatcgacgcgtccacgctcaagctcctgagccatgtgaccacgacgaccgcgggcgagaagaacggcgccgtcgctggcgacgtcaagagcgcgccgctggtggtcaccaaggcagatggcacctacgtctacttcacgagcaacggcaacccgggcggcgtctttatgtacaagctgggcgataagaacgtcaccctcctgtacaagccggacaaggcccagcagaactacaacctcgcgagcgtcatcgcgggtgcggatggcagcctgtactttgtgaacgactccggctacctgttcaagatcggcaaccagagcgtcggcggcacgcttcccagccaggtgacgggcaagagcgcggtcgagaagaacgacaagcccacccctacgcccaagccaattcccaagcccgttccgacccccagccccaagccaaagcccaaccccaagccaaaacctggtgctggtaacggtggcggcaagaccgtgcagggcagcaagcaggccagttcggtcaagaccaccaagaccgtcaagggcaaggcctccccggcagacagcagcaagacgacatcgggcccgctggcgctcctcaagggcgtcgcgtccagcgtgatctccatcacgatcgaggacggggcggacgcctccggcaacgccacgggaaccacatccagcaagggctctggcaccaagctggggagctccgccggcaagtccgcgcaggcggccggccagggcgcgctcggaacgagtggccttcccatctggccgatcatcggcatggcactgggcgcggtggcgttcatcctggcggtgctgtggcgcaggaatgacgacaacaagaccgatgcgggggcaaggtaaatggcagatctcgactacaagtccgcaagcaccgccgcagcaggcggcagcggggcaggcaagccaaaggacccgcgtactccaaaccccggcacgcagggcgggggtgaccccaagcgcaaggtgagcccggcccgcgttgtcgtcgcggtgctagccgctgcgctcgtggcattctgcgcctggtccatgagccagtacgcgcaggggagggaccccctcgccttcgcgtccggctccgtggaagagagcggcaagtccgcgctgctctcggccggtaagaccgattcgagctcctcctcggcaaaggcatccgacaaggacgccgccaaggccaaacagattgacaaggacaccgtcaccaaggcactcgcgagcctcaagcttgggaagaccgaccttgccgtcaccaaggacgtgaccgtcgtcgtcaccaaggacggcatctgggtcgagcacgtgtcctccgcaacgggcgaaggcctcgtgacggacacgtcccgccgggcgctcgcgctcgcaaagtgggtcgcgcgccagggaggcaacgcaaaggtaacgtgggtcgaggaggactcaacgggcgtggtccgcatgtccgtgacgatcagctccaaggccgcggcgggcgtgagcaagaaggacgccgccacgatcctttccgccgcgagcggctacgcaatcgacaaggacacgtactcgcagctcaagcagccgtccttctcggcagagaagggcaaggcgacgcttcccggcggcggcacgatcaccgtgggcagcgaggctacgtccaaggccgaggcgacctcgtccagtagctccagcgcgagcggctccaacaacggcacgtccaacgggtccaactcgggctccggctcaaactccagctcgggcaacacgacgggcgagaagaacaacggtaccaactccacgtccggcggccagaattctgcaaagccgacagcgggcaagatgaccgtgtccgtctccatcaacggctcgtcgagccgggtgagcctctcgcagggcgcgaccgcctacgacgcgctgctcgcgactggcgcctccgtcagctcaggcgcgtaccccggcggcggcacgtgggtcacggccatcaacgggctgggcgaggacgcctcgcacggctggacctacaaggtaaacggaagcatgcccaacatgatgagcgacctgtacacggtgcatgacggcgacaccgtcgtgtggacctacgtgaccgttggggactagcgtggacgaggcgggccgcaggggtgcgctcgcgttcgagacctgccatccggtggtgcccgcggtgtacttcgcgggcgtcatcggcatcggcatctttacgctgcagcccgtgttcgcggcgatatccgtcgtgggcgcgctctgctttgcggtctgctgcacgggctggcgcagggcgctcgcgcagctgcgctggcagctgcccatggtcgcgctcgtctgcctggcaaacccgctcttctcgcagtcgggcctgacggtcctggccacgctggggcccgtcacggtgcgactcgaggcgctcgcgtacggcctgtgcatgggcgccagcctggtatgcatgctgcagtgggtggccaacgcggcgcacgtgcttacggaggatcgcctgctcgagctttccggcacaaggcttcccgtggtgaccaccatggtgagcatggctatccagctggtgccgcagctgcggcgccgctttggcgtggtcgagtccgcgcgcggcgcctgcacgtccgcccaagccccgcgcaagggcgggcgcgtgcatgcatcgaccgtgcttatggcatgggctatggaggactcgctcgagcgagcggactccatgcgcgcccgcggctgggagctgggcggccgccgcaccggctaccgcctggagccgctgcgcgggagcgacgtggctgccgccgtggcggtggggctcctcgcgtttgcggcggcgcttgcggcgtacgtggcgcaggcggagtggagcttctatcccaccatgccggcgcttcgcccgtggtggggctacgtgccgtttgcgctgctggcgctcctgcccacggcgcttacacttgtcttgcggctcaaagaggggaggctgggcagtgtcgaaaaccgatgagaccgatgaggctacgggtgcgggcgagaagggcgtgcgcccaacgtccgagcccgccctcgggctgaggggcgtgtccttctcgtacgcgaggcccgagggcgagcccgagctcgccgctggcgcgccgcttgtgctggaccacgcggacctgagcgtgccgcagggtgcgtttgcgctgctcgtgggcggcaccggctccggaaagacgacgctgctgcgcctgtgcaagccggagattcgccccgagggggagctttccggcatggtcagcatcctcggccgcgacgtgcgcgggctctcgccgcgcgagtccgcaggactcgtcggctacgtgttccagagcccggacagccagatcgtatgcgacagcgtgtggcacgagcttgcgtttggcttggagaacctgggcgtcccgcaggaccagatgcgccgccgcgtggccgagacctgctacttctttgggatggagccctggttccacaagcgctgcgcaagcctttccggcgggcagcgccaactcttggccttggcttccgtactctgcatgcgcccgcggctgctcctgctggacgagccaacgtccatgctcgaccccgtggccgagaagagcttcctttcgcttctctttagggtcaaccgcgagctcggctgcaccgtggtcgtggcgacgcacaaccccggccccatgctcgactatgcgagcgtggcgtttgcgatggagggcggccgtccctaccaggtgccgctcgggtcgctggcgggggagcccgatctcctgacccagggcgatgccactgcgccgcagacaactgcaagccctccgcgggcgtcgcgcgtcgtgcgcgcgtccggcgcgtggctgcgctacgagcgcgaggccccgtgggtgctgcgcggctgcgacctggagcttcgcagtggagaggtgcgtgcgctcgtgggcggcaacggctccggcaagtccacgctcatcatggccgtggccggcatgctgcgcctgcagcgtggccacgtgtccaacgcgctttccggctcgcaagcgctgctgccgcagtcgcccaaggcgctgctgtcgcagccaagtgcgagcgaggagctgatggagtggagctcgagcgcgggctacacgcgcgagcagatgctcgcgctcgcggagtcgtttggccttacggacgcgctcgaccggcacccgtacgacctctccggcggccagcagcagctgctcgcgttcgcaaagctgctgctcacgcgcccaaagctgctgcttctggacgagcccaccaaggggctcgacaacgcggcccgcagcctcgtggccacgcacgtgcggcaggcggcggcacggggtgccaccgtccttctctccacgcacgacgtggcgtttgccagcgcggttgcagatacctgctcgctcctgtttgacgggcaggttgcgctcacgcagcctgcggggcagttctttagcgagtcttgggtgtggcacgcatgagccggccgtccgtgcaacagccgcccgcggcccagcagccgcaggcacccgcccccgcatccgccccgacccccacgcccagcaccctcgcacgcgtcctgcgcgcgctcgaggtcccggcgctcgtcgcggtgccggcggtggccggactttgcgcctacctggggctttccgccaccggagggctcgttcttctcgtcacgctgctctgccttgcgctcttctttgcgagcttcgaggcctcaaagccggcgctgcggcagatcatgcccacggcaacactcggggcagtcgcggcggcggggcgcatcctcttcgcgcccgtgccggacgtcaagcccgtctccgccatcgccatcgtggcgggggccacgctgggccggcagagcggcttcatggtgggggcgattgcggcgctggtgtccaacttcttctttgggcagggtgcctggactcccatgcagatgtactcgtggggacttgtgggataccttgcgggcgtgctggcggatgtgggcgcattccgccacgggtgggtgctgtacgcgtatggctttgcctcgggcctgctgtacgggctgctgctcaacggctggtacgtgctgggctacgtgcgtccgctcacgtgggggccgatcctgacggcctttgcgctgggcctcccgctcgacgtgacgcattccatcgcgacggtgggcttccttgcggccatctggctgccgtggggaagggccattcggcgcgtcgtggcaaagtacggccttcgctagcggatgcctgccatggcggtccgccgcaacgcccccgcgggcactcccgcacggccctgccgccaatgcctgctagaatcgtgcgatagcatcgcgacggagggaaggtccgcaagtggccaagcacatggggcaaaagagcgtggagccgggcaaggcgcgcggccatggggccagaccccagtcggccacggcgtacggccagcatcccgtgaggcgcaccatcgtcacgcttgcggtggcgctcggcgtctgcgtgctgatcgtgggcctgggcgagctgggcatcctccactacccggagcagcccaagcaggagcccgtcgcaagcagcaaggccaagccggacaccctggacaacgacggcgcgggcgagaaggacaactccgccgccgcgacgcccgccataaaggacggctcctcctccgcggacggctcaagctccgggcaggcagccgcaagccccatcgtgagcgacaagctcgaggacatgtttgaggagggccaggtgcactccatccgcgtcataggcgacagcatcaccgcaggctacggctgcgacggctacggcaccgtatccgataccgacgtcacggtatacagcgggcaggagggtgcctacaaggagacggccaccaccgtgggctgctggaccaacgacttccgcgcatacgcgctgcagcacggcgtgacggacttcgtgaacgcgggcgtctccggcttcaggatgcagtacctggccgaggacccgtcctcgtggctgggcgacggcgcggacgtgatcgtggtcatgctgggcaccaacgacgcctcgcgccgcacggaggcggagttctccgcggacgcggagatcggcctcgccgcggcggcagccaagtgcaagcttctgatcgtggtgtccccgcccaacaacgcccgcacggacgcgacaaacaacttcagcatgcagcgcgttgaccaggtcctgacgtcgctctgcaagctcaagcactacgtgcacgcgtccttcctcaacacgctcgcgctctacacggccgactacaactccgaccagtgccatcccacgtcggagggttcgcacaagctgtgggctgccttcagggagcagctcgcgctgtagcggaagtagtatagtttgccatcggtttttgaccgtagtcccaaggatgagccccgttagcttccggttgcctgcatccaggcaggggtcgcaaggcggggcgaggggagaaggacgtgggcaagctaattgcacagttcgccaagttcggcgtggtgggcgtcatcgcgacgctgatcgactttggggtcctggtgctcctgcacgagaccctgggcatggacccgacggtcgcggcggccatatcgttctgcgtgagcaccgtcttcaactacgtcgcgagcatgcgcttcgtcttcacgcaccgcgacgacctcagcaagtcgcgtgagttcgcgatcttcgtggtgctgagcctcattggcctgggcatcaacgagctctgcatggtcgcgggccaggtcgcgttcacgagcgcgggcgtcgactacgcccacggcccgtactacctgctggtcaaggtcctcgcgaccgcgatcgtcatgttctggaacttcttcagcaggaagaagtggctggacgcgggggagtaacgcatcgcgccgcatcttgcgtacgtttgagatgacgaagtatttgcccggtggcctcggccggcgggctgttttcatacaagcgattggtgccgcgatgaagcattctttacaataaatgtaggaatcagattgaattgcgttgttgctggcagatatcttatttctgcagatttcaaatatattaacgtgtgtccttaagggtcctttagcgcactggttgagattggattggggtagcagttgcaattacgtaatacgaaattataatagaggggaagagagatggtgaaggtccatgatcgtgttacgaagagacatccggaactatcggtggcagggattcggagagcttgggataaccgcgtggctatggccttgagggagacgtctgaacaggacttttatatcgctatcggttttgacgaccgggggcgggaacttgagatggtctctgtggtggaagacgacggaacgatattgatttttcacgctatgacaccacccagcaagaagacacttttcgaacttggcatacgaggaggctcacgatgagggacaagagcggtagaccgatagacgacgcccggctcgacgagtgggcggatgcgttcgagaggggcgagtggcccgagggcaagaccacgcaggtaggtcggcccgcactttccgatggggagacgaagatcctctcgttcaggatcccggcatccaaggcggaggcctttgcgcaaaaggcgaagcgggagggcaagacgaagtccgaggccttccgcgacctcgtggacaggtatctggaagcctagcgttgcgcctgcgtcgagcgctccaatcctcaagcttcgtccttctcgcccgtgcattccgatgcaggacgcatccatcgtgtctgaaacgacgtccaggcgtctgaccccggggctaaaatgatgtggaaccagaaccatttttcgagccacggatggcgcgccgctccacccgtggcaaaacgcgattggaccgcaatgagaccatcgactttctttaggggcgctgccgcgtcgatcatcctttccgccacgctgtgtgcggctcccttgcccgcgctcgcggcggagtctgctggcgcgtcgaccgcgaccgaagccgcgaccgcgacccaggccgcgtcctcgaccgagcagacaaccgcaagctccgcaacccagcagtccgattcgcagcagacaactgcaacgtcggacacccagacgggcgagaagagcgacgcctcggccaccgcaaccaccacgcccacgacgaccgtgtccgccaccacgcccacgacgggcgaaaccgcaggcagcggctccacggacgcgacgtccaccacgtccaccacgcaggacaccagcagctccgcgacggctgacaccagcagctccgcgacggcggacaccagctcctccaccacgacggacagcagctcctcctcgcagacggacgcaagccagacgcaccccgcgaccatcgccaccacggcgcacgtgcagggcacgggctggcagcccgagtccgcccagggcaccgtcgcgggcaccacgggccagggcaagcgccttgaggcggtaaagatctccgtcaaggcgccggacggcaccacctacgcggattcggacgtccgctaccgcgcgcacgtccagaacgtgggctggcagcagtgggtgagcggcggccaggtcgcgggcaccacgggcaggtcgctcaggctggaggcgctccagatcgagcttcgcgacggctccgacctcgcgcgcgactacgaggtgtggtaccgcgcgcacgtgcagaacgtgggttggatggcgtggaccaaccagggtccggtgggcagcacgggacgcggcctcaggctcgaggccatcgaggtcatgctcgtccgcaggggagaagatcatcccacctcggacggcaccgcgtttttggacgggacgtacgtctccatcgcggggcacgtgcagaataccggctggaccgctgccacctcggcaaacggccagacggtgggcaccacgggcaagggcctcaggctcgaggcgctgcgtgcgcacgtgggcaacgcgtacctctcgggcgacgtccagatccaggcgcacgtccagaaccagggctggcagggctggacgtctggcggcggcaccgctggcaccacgggcaagggcctcaggatcgaggccgtgcgcatccagctgacgggcgacctccagcagcactacgacgtgtggtaccgcgcccatgtgcagacgctgggctggatgggctggaccaagaacggcgacgtctgcggcacgacgggcctcgcgggccgcatggagggcctgcaggtcgtgctgacgcccaagggtgcggcggcgccctcggccgcaggtcaggcggtgtccttctcgcaccttgacgcgcagcaggtcgagtacgcggtctccccggtcaacggccagtgggagtccaacgtgcagaacggcaacctcgcgggcagcacggggcagggcaaggcgctccgggcgttccgcgtccagagggcgggggacacctccacgctcgcgggcgacgtacagtaccgcgcgtttgtgcagaacaagcgctggctcggctggatgagcgacgacgcggaggccggcacctccggccagggcctcaggctcgaggccgtgcagatgcgcctcaccggcgagcttgccaagtactttgacgtctactaccaggcgcactcgagcgactacggctggctcgactgggccaaggacggccagaccgccggcaccgcgggctacgccaaggcgatcgaggcgctgcgggtcaagctcgtgctcaagggcacggacaccactgacaggaccacgcgcccggccgtggtgaagacgtccgtcaggaaggacggcaacacctggaaggtctacggcgaggacggctccgtctacaacctgggcaccatcgccatgaacacccgctacatcaaccaggtgtccgagggcgcgatcgagggctgcgaggccgcctcgctcctcatggcgctctggtccaagggctacctcaccaacgtctcgtacaagacgttcctcacgtggatgccctatgcgtcggacggcaaccccaaccacggctttgtgggcacgccgtacgtcaacggtccgcagatcgacaccatgatgatgcccgcggtcacgagctggggcgcccgctacgcccacaccaagaacatgacgggctgctccgacgaggacctcatcaacgagctggtgcaggggcatcccgtggtcgtgtggacgtcggtcttcttcaggcccagcaagctcgtgcattactggtggggcaactacaagacgcagaaccacgtcatgaccctgctcggcttcaacccgcacaccaaccagttctacgtggcggacccgtacatggccggcaaggagtgggtttcgtggaacacgttcatgcagacgtggcacgtgctcaggggcgcggtctccgtctggtagcggccgcggcaccccgggcgggcgagaagagcgtgccctcgtccttctcgcccgtgccagtttgcagcctttgcgaacgcgagcggtcccgcccgcgcggcgcttgcccatgtgcaccgttttgagtatcattcttgtgtttttgtcatcaccagaaggagtcgtgtatgtccggacactctaagtgggccaccaccaagcacaagaaggccgcgatcgacgccaagcgttccgcgctcttctcgaagcactcgcgtaacatcaccgtcgcagctcgtaccggtggcgatcccaacccggataacaacgcctccctcgcggccgccatcgcccgcgcgcgcatggtctccatgcccaacgccaagatcaaggcagccatcgacaaggcctttggctccggcgccgacgccgcggtctacaaggaggtcacctacgagggatacggccccgcaggcgtcgcgttctacgtcgagtgcctgaccgacaacctcaaccgcaccgctgccgacgtccgctccgccttcacgcacgcgggcggcaacctgggcaccgcgggctccgtcgcgttccagttcacccgcaagggctccatcgcagtggacaaggtcatcgtgtccgacgagaagaaggttcccgacaaggagaacgccgtcgacgaggacgagttcatgatggccgtggccgaggccggcggcgaggactacgaggacgcgggcgacaagtggatcgtctacaccccgtacgacaagatgcaggacgtgcagaagggcctggaggcccagggcatcgaggtcaagggttccgagctcacgatggttcccagcacccccacgcagcttgaccttgccgacgccaagaaggtccagcgcctgatcgaccacctggaggagctcgacgacgtgcagaacgtctacacctccatggaggtctccgacgaggtcgcggagcagctcgacgaggactagcgggtcctcctgcaacagaaccaaatggcgcggcggccctcgggtcgccgcgttttgtgagtggcggcaccaaccgaagggtggggaagcgtgaggaagcaggacatgacgcaggcgcaggccgagaagatcctcgacctgcccgagcgctacaccaaggcggacctgcgcaagcgcttcatggcgctcgcgcggcgctaccacccggacaacgcggccaccaacggcatcagcccggaggtggcccagcgcaagatgacggaggtcaaccgcgcgtacgccctgctcaagcccctgtttgaggaggactccgccgcaacgatccagcgcgacctggtgggaggcgacccaggccgctacggcgtgggcgtgcactttgaccccgcgggcaggcacgcgcgcgagacggcggtggacgactccctcttttgggacgagcacggtaacccgcgctccgcggtggcggagaaggccgcaaacgacgcggtcgacgccgcgccggggacgcatcggctccgtcgcttcctgctgggcccggtgttcctgcggctggtgttcgtggcacttctcgccctgctgtggtggaacacgtttcccttcgtgaacgggcatgacggcctggcgcagatcgcgcacttccatacgctgcgcgactggctgccgctcatctgcgccacgatctatcccacgtacctgctcgtgtacgagctgttcacgggtcatatctccggcgtggtgcgcgagggcctcaacggcatcgtgacgatagcgacgggcgtgcacgtggaggtgcgccgcagcggctcgtacacctccgagctcacgagcctgatccagaagcagtggtacgggcccctcatcctgccgctgggcgcgctgctcgcgagcatgggccttgcgcagcccgcgggctggcagcgctacgtgctgctggcactgggcgcgctcgtggtgcttgacgcgctcctctccacctttggcatgggcctggcggacagcatcgcgcgccgcatgggcaacgccgcggaggagtggtacgtgcaggcgcgcatggacatgctcaagcgctgcggccagtgggggagcggccccgccgcgggtaccgcaggcggccgtcacgcaaggtagcccgtccttctcgcccgtgtgctcgggtggcatctggggtgaatctctgtactttggggccattcgccccgctgggataccatgtcactagtagagtcttgactctggggcgtgcctgaccccatgaccatatgatgtggaggatcgaatgctcgacgacgccagctccctggtctccgtgatcgtgcctatctacaacgcgcagaagttcctgcgccagtgccttgacagcatctgcaaccagacgcacaaggggctggagatcatcctgatcgacgacggttgcacggacgactcgcccgcgatcatcgacgagtacgccgcacgcgacccgcgcatcaaggcggtccacaaggagaatggcggctatggcgcaggctgcaaccgcggcctccagatggccacgggccgctgggtctccatcgtggagccggacgactacctcgacctccccatgtaccaggagatgctcgacttcgcctccacctttgaccagaagatcgacgtcatcaagtgcccctggaccgaggtctcgctctgggacgaccccgacaccacgctcacggcgccgtgcccgctcgcctcgcgcatgatcacgagcgagaagcccttcaccctcaaggaccgccccacgctcatcgcgacgcacccctccatctggtcggccatctaccgtcgcgacttcctcaacgagaagggcatccgcttcattgagtaccctggtgccggctgggcggacaaccccttcctcatcgagacgatgtgccaggcggagtccatcatctacctcaacaactgctactacaactaccgcatcgacctgccggacagcacgcgtcaccacaagaccaaggacctcgtgacccgcccgttcgaccgctgggtcaccatgctcgacatcatgaagcgcatcggcgtcaaggacgagggcatcatcgcagcgcactacgaccgcggcttcacctatgcgtacggcgccgagtacgacgacggcgtggacaacccgctcgtggtggagaacgagaagcgtatctttggcatgatggaccccaggatcgtggagcgcatgtccgagctgccgctcgtgcgcctgcgccgctactgcgagctcatgggcaggcccatgcctaggcacgcggtcctcgccaggagcgcctacctgctgggcagcgccaaggccaccgtcgacgcctttggcgtcggcaaggttgccgggctcaccgtccgccacggcgtcatgaccgtgcgcgacaagatggtccacaacaaacagtaggagggcacggggcgcagctcgcctgtcgccgggtggcattttcgccgctcgtgcagtcgtatctgccctagaatgcacaggtgtgtgattcccttacaatccaagcaatatgagattttgctgggagggagtcttctcgtgcgagactaggcgagaagtgcgcctcccggtaaaaggtacgtccgaacggttccacatgactttctacttcacctatgcaatagcggccctgctcctcgtgattcccggctacctcatgctccggagcgtggggtttgcccgc

SEQ ID NO: 185 - DNA, 13979 bp, Unknown
  Metagenome-assembled genome
cttcgccctggaggccacccggcggaaccgtcgccaaacagagagccgggtgggctccagggcacattctccatttggcatgtggaattgtatcacctgggctgtcaggacagcctggaccggcccttattatcttgactgtcagattagttttttagaagcaatacgttatgatttctgaaagcataagcaacattgcgaccaatcttgtgatcgtggcacacacaagtgcgggaggggcgtcggacttccctcccgcacttgtctaacaactattgaattgttcttctcccctgtcgctacgcctgcgcggcggctcccatggcctcctgcacgcggacctccatgagctgcagcagctcggacaggtagatgaggtccatgcgatagacaagggccggggacgggtcggagcgactggcggcgacgcccgcaccagcgtccgagctggagaactcgccctccaggcgccgcagctcgcggacgaggccctcgcgcgtcgccatcatctgttggtacgtcatgccgtcaagctcgtcgataaagacctcgggtgccatcatgctcatcgtgtcctccaatccgtgcaagtgttgccgttacctcatgtgctgaatctggccccagatcaggggcgcatgccgtgtgcgccgggaccaccgcggctgtcgggaccgccggtgccgtcgaatcccccgcgctggccggcatagcgggggccgcggggaccatccggaggccagctatagccgcgcatgccatagcctctccagccagggccccagccccacgggcgatgccaaccgcaccacagggggcgtccccatccccatccgcccatgccgcggaagaggaggccgcgcacgagctggagtcccaccacgagcagcagtgcgaaaacgataatgagcagtagcatctggatcgcctcccctgtcgagttgcgtgtagtgaacgtacccaaccaggcgggacgatgcggcgccacgcgcggacgtcatctgtctggtgcaaagctcgaggcagattgaattcaagggcggtccaaagagtgatgcagcctagcgcagccgcttctccatggtgaagccgtaggaaacgttggcgcctagggcacgcgcaagggcgtcaccgtccttgttggcagcccttgcatagcccatacatctgtagaagtcctcgtcgggaaactcgtcagagtcatccacaagtacgatgacgctctccaggccagactcctttgcatcgcgttcacagcagctcgctagtgtcttgaacagccaagtcgaggtggcatcagccgtgcgcagctcctcagaccagggaatcacaacgccgctgtgcaggtcgtatcgcttcagactgcagacacccactggctccgcgactcccagcctcacagcaacgcgcgtccatgccgcacgaaggaacagatagctccctccgtcaggaccgacctcctcagcagaaccttggcacttggccagccatcgccacacctctttggtgctagcgtggccagcctccagcaggaccatgaggtccttctcggcaccttgccattccgcgactgcgtgggcatggctgacaaagcccagcgttgcgcccggtaaggcccccaacagcttagatagttgctcgttgccaagcgtgatcttgcgctcccgcgggaggccgcgcaggtcgagccccgcaagctcatcctcaacaccaacgagctctgcccagcgcgccgcaaggagaagcgcgtaggcaacgcagtccacgccatagcatcccagggcatagccgtcgtttacctctacgaggagcgtccgcctgtcatccgtcacaccaaggtctatggagcatccagcgggctcgctggggtcggcagcgtaggcggccacgatgtcgttcacgacggcgctatcgcattggacgtcaggatcgccgcggtagtgacgcacgcctgcaagctcaccgtagcggatgaagaggcgcttctcggacacgaacctgacgggctcgctgcagagcgcggggtagtcctcgccgcgcgcgaggtagtcgccaaggtcagacatgtcccggaccacggtcccggggagttccttctcctccaacggctttatgaacacaggaaggtccgcaggcttgatcttgccaaccgtagtgttccgcacccgccggcccaggaagcgcgacagcgacttgggatagtcgatcgagggcggcttgacgccgcgcatcgcgagggcgtgccccgtgacaagaagcccaccgatgactacgtcctcacgcctgccctggtcaagaacgtcattgctggagaagggcacgcattggatcccaagctcctcaaagccgcgctgcgccgtggcacactcctcgttccacggttcgccacgcatactgtgaatgtacgccctcatcgtcaaacctcccggcttgcaataacactccgcatcgcgtcggcaacgtggcgcacgtagatctgctgcacagcagcaatctgccccaggcccttggcctgggcggttgccgttatgccagcagcctcgaaccggctcttccaggattcgggcgcgctgcctaccatgtccttgttggcatgggcgcctgccacgagcatgaggggtctgagctgggccttcgcgtagccggctgccagcaccttgcggataactgcctcacagctggtatcggcaggctcgccctctatcgtgccgacaaagacgttgccgtaaccaagccgcgctgcctcggcctgcatctggtatacaccgcactggcctcgtgcgcggacccgtgacccacgagcacgacggcacagccgtcctgcgccgcggtcgctacgctgccgtagccggcgtctgccgcggtcgcgatcgcaaccgcatcggcaacggctcgcaggttagggttgacggagccggcgttggaggccgccatgcccaggagcggctcggcaatggcgatggccatcgcgttgcggaactggctcgctgtcgcgacgagccgctcgtactccgccccgcgtagcaggtgcgtcggcaggatgacgagcgtccgcacgccctcgtccgcggcacgttggagcgcctgcccgaggttgtcgaccttctcgcccccgtgggcctggatgcgattgatgatgggctgcgacgtgaacgcgcgacgcacggcccacctggggtacgcgacctggaccgcgcgctcgacggcgccgatgtcgtgcgcgcgggcgtcggcgtacgtggtgccgtagctggccacgatgatccgcctgtcgcattgccgctgtttcaaggccaaagctccttcccgcggggcgcgttcttctcgcctggagccattgtagcgagggccgtggcgggacccgatgcgtggaggctctgcggagggcgctcgcggggaggagggcacgaggggcctgccgcccacgagacggtgcgcgaggcagttgccttgttcttctccacaaactttgcgcttacgcgcgggccgcgcttcgtgctagggtgggttcaccacataagtagtcgcagacgtaaatgcatgcgcaaggcgggcgagacgaactctagggtttgcctcgcccgccttttttgcgccgcgaccaaacggaaaggaatgaacgcccccatgccaaccaacaagcgagagtccctggtcttcaccgtcatcatgtgcttctgcatggtgctctggatgagcatctacaacgtggcgctgcagcacggcggcctcaacggtcaggtggtgtccgccgcgtggctcggcttcccgctggcctacgtgttcgccatgctgtgcgactggttcgtggcgagcccgctggccaagggctttgccttcaggcacctggtcacgccgggcaagagctcgccccgcgccatgatcctggccatcagctcctgcatggccgtggtgatggtcgtcgtcatgtcgctctacggcgcggtcgaggtcagcacccacatggccggcggcgtgctcgccaacctgaggatggtgcccctgatgtggcttgccaacatccccaggaacctcgtgatggcgctgccctggaacctgctggtcgcgggccccgccagccgctacctgttccgccgcgccttcccggtgggcaccgtgctcgaaaggccccagggcacgctcgagctgtagaccacaaaggcaccaagcccaagcgaattaagggcgagaagaacgcgccctcgccgccgacggcggcaacaaaggggccacgttcttctcgcccaacgcgtttcaacgcgtttaccagcggatttgcgtttgtatgcatacgattatactactcgtaatcatacaaacttaaccgttggggatggcacgcatgaacaaggacgaggccctggcctttttgcgcagcacggtaaagccgtcgcttggctgcacggagcccgcctgcgccgcgctgtgcgccgcggccgccgcccaggagctgcgcggggacgtccgcggcgtcgcgctgaccgtcaaccccggcctgtacaagaacgggatgtccgtcgccatccccggcttcgactgcgtggggatggactacgccgccgcgcttggcgcgctcatcggttccacggccgccgagctgcagatatttgagggcatcacgccggaggtcgcggagcgggcgcgcgggcttgtggactccgggcgcgtccgcgtggacgttgaccgcgggcagaggggcatctacgcccggtgcgaggtgacctccgatggcgaggttgccgaggccgtgatccagggcgcccacacaaacgtggtgatggtgagccacaacggcacgattcgcttccagggggagaaggacggcgctgccggcgccgcggaccccaccgcggacctgcaacggatgaccatcgcgcagatcagccgcctggtggacggcatggggctcgaggagctggactggctcctggaggggatcggcgtaaacgacgccgtggccgagtacggcacggagcaccccagccccgtgggcatcgcgtccaccctgcagacggacctgggtaccagtgaggccgaccagatgatgcgcgccgtgggcgcggcgatcgagtcccggctggacggctgcccgcgctccgtcacgagcagcgccggggcgggcagcaaggggctggcgctcacgatcccgctgggcgtggcggcgcggcatgcgggctcttctcccctggagcttgcccgcgcgctggcctttgggcacctggtcaacagctacatcaacgcggtggtcgggaagctctccgccgtgtgcacctgcgccaccgccgcgtccacggcggcctcggccgcgctggtcaagctgtggggcggctcggaggagcagatgggcctcgccatccgcaacatgacgggaacggtttcaggaatgatatgcgacggcggcaagaccggctgcgccatgaagctggccatggcgacctctgccgcatacctttccgcgcggatggccgtgggcggctccgtcctgcgcgtgagcgacggcatctgcgcggacacgccggagcagtgcatcgccaacgtcgcgcaggtcgcaaacgttggcatggcggacgtggacgagcagatcctgcgcatcatgctgcagaagaagggcgaggcgggcggccgctagcgatgccctggcctgcgacctgtggaggacgtgtggagacactattaggatagattcttgttaagaaaaggcgttgcatcgtgtatagttccactaacaagaaagagtcctaataagagaaacgcaagaacacgttaggacctgacagaagggaacgaaccatgaacgccaagctcaacgcacttctcgccaacctcgccgtcgagtaccacaagctccagaaccagcactggtacgtttccgggcccgacttcttccaggcgcacgcgcagctcgagtcgctgtacgacgggctcctccccgcggtcgacgacgtcgcggagctgatcctgacgctgggcggcaggcccatcgcctcgctggcggaggtcctgcagcaggccaccatcgccgagcgcgcggacgagccgctctccagcgccgacgcgttcgctaacgtccgctccgactaccaggcgctcctcgaccaggtgaccgccatcaaggaggccgcggacgccgagtccaaccacctggtgagcgccaagatggacgagtacgtagcgagcctctccaagacgctctggatgctccgccagcaggccgcgtaggcgcgccgcctctaggcgagaaggaccagacgcatcagccggaacacactcccagctagcgaaggagcccgccgccacgtggcgacgggctcctcccttgcgcgtggctgacgggacagccgtacgctacgcagtgaccttccgaccccgctacgctacaattgccttggccgggcttttattccttcgggggattagagttcggccatttgcgtagccagcgtgaaagcgaggcgccatgctgcactgggcaagactgttaggggaccagtaccttggcctctgggctccgggaatcctgctgttcgctctccaggaagtgccctacctgctgatgcccctgtttcacctgcaatcgaacccgatcatgaacatgcccgagacgtcgccaaccctcgacctgctcgagaaggcccttggggtcgcgtgcatcgtgctgatggtgttcgtcgtccgcggggatgccatgctcttctcggcatcagacacatgggagaaggcctgcctcgcgctcgtggcgctgaccttggcggcaaactaccttggctgggggctgtacttcaccggccaccagagcaggctcgtgatgatgctgttcctggtcgccatgccgccgctgtactacgcggctatcggactctagcggcacaacccgaccctggcaatcgtaggcgtcgcgttcctcgcggttcacctcgcgcacgtgtgggggaacctgagcagcattgcgtaagcctcacgcgagcgagacacggcacccgcggcaccaccgcagagctcatccaaagtttatttggctcgtatgcaacgcgagggggcttgtgtgcgctttacgggagcctatggggcaactgaggacagatttcataagcatctgaactacagaatcacacacaaaccccctttggctgcaagcagtcggcaaaaagttccgcaacgccgatctgcccacatttgcagattgccgtcgcaacgagcctgccgtccagagaccaatctccccgagcccagggcttggctccattgcctcgatctgcacccagcgtctgccgcaacctcctccgtttcgctcccgaaggtattacggcgtggcacgtcagtcgccacacgcgaggtcctcccgcgccaggtcctccgcgcggtaggcggcgtatccctcgtaggcgtaggaggcgtcaaccccacgggcgagaagaacgaagctgtctagctgatcagagagagcctcccgcagcagcgccttgatctcaacgtcacgcacggggctgcgctccatagccaggaggtagtcctcgcgcccaacgcgaccccagtccacggtcaggccaagctcgtggcggagcatgtggtcgagccagatgcgaccagagcggccgttgccctcccggaaggggtgcgcgacgttcatctccacgtacttctccactatgtggtcgaaggtgtcctggggcatggccttgatggcatccagggcggagcccaggtacaacgtggagacaaagcggcagctgcccttgacgaggtcggctgtgcgcacctggcccgcgaacccgtagatggagccaaacagggcgacgtggatctgccgcagggtctcgaacgtgccgggctccagcccgtcgagcgtcccgtcgcggtagagggagagcgccgccagcttcgagatgcgctcctcctcatgggcgagttccacgtcatcggttatgccgagcctgtttggcagcgtcacggagacctcacttcccttgtggcagcaggcacatcttgctgggtcagcagggctcgcttgactggctgactgcgcgagccctagctcatgccctccattctagcgttgcaattcttataattgcactatcgatgaaaggagcatcatgcgctacgtagcctttggaccggaccgccgcaaggtctccaccgtgatgctgggcctcatgcgcgtggacgacgtcgacgcgaagaggctttccagcttcctgcacaccgccctcgacctggggataaacgcccttgacactgcggacatatatgccggaggcaagtcggagcggctgctgggagaggtcttttccgcggagccgggactgagagagaagttcttcctgcagacaaaggtggggattcaccgcacggagaagctcacgtacttcgacttctcgcacgactacatcgtgagcgccaccaaggcgtcgctcgagcgtctgggcctcccctacgtggactcgctgctgctgcaccgccccgacatcctgatggagccctccgaggttgcgggcgcgttccaggagctccacgcccaggggctggtgcgcgactttggcgtgagcaaccagaaccccgccaccatgaggcgcctgcagtcggcgctccccctgccgctgtgcgccaaccaggtacagctctccatcgcgttcgcgcccgcgtacgaggccgtcgtcaacgcgaacatggagaaccaggccgcctgcatgcgcgacggcggaatcttcgagtacgccgccctgaacgaccaggtcatccagacgtggtccacgttccagtacggctactttgaggggacgttcctgaacaacccccgctaccagcagcttaacgacaccctggacgagctggcgccaaagtacggcgtctccaaggcggcgctctgcgtggcgtggaacctgcgctaccccgcaaaggtgcaggccatcgtgggcacgatgaatccgcagcacctggctgacctggcctcgggcgcggacgtcgacctgagccgcgaggactggtatcggctctatctggcggcaggccgtcagctgccctgatgcgaacgcggccggtctgaggagtttacatgagtgcagatgttcttaccgtctcttccaaaggtcaggttatgctacccgcaaagctgcgtaaggaactcgcgattcagagcggagacaagcttgccgtctacgcatctggtgacgtcatcatgctcaaaaagattcaaatgcctaccgccgaggagttccgcaccagactggacgaagcacgggaatgggccaagtcggtcggctaccagaagtctgacgtgagcgacgtcatcaaaaccgtcagggcaaagaggcgcgcatgaggatagtaatcgataccaacgtagtcatctccgacaccttctttggcggcaatccgaggaatgagcctcacaatgcttggttgagtagtgagaggttctcggcctaagtcctcagttattctccaaacgtctgctcgttgactgggtgccgcaccagaggcgcagctcctcggaaggctcgccgcagaggccgcagttgcagcagccgttgcagatgaggtggctgccgcacgacatgcagcgcgtgcggtagcgcggttggtacaggcactcgggtggcagcggcaggcccagcgggtcggtcaggtgccactcgagcggcgcgcccacgtgctcgacgccggagcggtacgcctgctgcgcctgcacgtccttcctggggatgtggtactcgcgctccccaacgacgaagcggctccccgtctcgatgaaggcgaacgtcacgtcgtgcgcgcgacactgccgggacagcctctgcacccaacggaagtggcacggtcgaggatcctcgtaattctcgcccccgcaaatgacctgctctatgccacggcgccgcaccgtcaggccgtcggcagtccggtaaggctggccagcggcgttggcctccttggcctgatcggaggcctgcaggtagcgctcgatgtccacggggccgatgtacggcgcgcacatgatgcccttgtgggcggcaggcgttgccaataggatcggtatgcgctcgtccgcgcggcgctggttctcgcacgtgacgttgagcatcacattgtcccagccgtcgccccagtccgcaggcaggcactgcgccatgcgctccggtcgcttggtcagcaggtagaacttgacgtccgggcgcgcgtggatgatgctccacgcctcgtcgcgccacgggtccgcctctggcacgaagaagtccgagttcatgcatacgcggatgagctcgccgctcttcaccttgtacgcgccagaacggtcgcgctgcagcgggtagtcgaacgtggtcttgttgcgccgcaccacgccgccgttcagcccgcgggtcttgtccaggtggaacatgtagcatcgcgcacacccttcgctgatcttggtacagccgtgccagggattccagatgtcgtgcattgccgccttcgcgtcgagttacctgatgttggtcaatcttagcagctggcgtacgtaaatgcaaacatttgttcgtataattggtgctctgccagtagttggttgacgagacattaacgtcaattatatgatacgtaatatcaaattgcgtcttctatatacgacatgtgacggtatgaagcgacctaggtctgcaaaaacgaggctggcagccaagagcatcggcgagaacatcgctgcatggcgcaagctatacggcctgacctcgcaggagcttgcggacaaggccaacgtttcccgcgcaacaatctcgcgtttggaaaacggcgacccatccgtcagcctcgagacgttcctcaacgcatgtcgtacgcttcaaaccctcgacgcggtggtcgatgcgacggacccctatctgacggacttgggacgcgcacgagccagtcaggcgcttccacaacgcgtgaggagcaagagataacgccccgcagcgccgccataaagaaagaggcacacatgaggttcttcatagttgattgctttgcggaggagaagtacgagggcaacgagctgctggtccttcttgcggatcggcccgtgagcgaccgcgagcagcaggccatcgcccgcgagatcaacttctccgagaccgcgttcgtgtttggcggtaggcggcccaacggcgggtacgacgtgcgcatctggacgccgcaccgcgaggtcccctttgccgggcatcccacgctgggcacggcgcacgtgatccgcgaggtgctcgagggcggcagcgcggaccaggtgacgctcaacctcgccgtgggccagattcccgttcgcgtgcgcgacgacgtcctgtacatgacccagaaccagccggagtttggccccacgattgacccggcgattatcgcgggcgccttcggcctctcccccgccgacatccgcgcggacatgcccgtccagtgggtctcgaccgggctcgaggccgtgatcgtcccactcgccagccgcaaggcgctcgcacgcgccgactgggaccgcgacgcgttttccgcctacacccgcgagctccccgcctgctactgcaaccacctgttctacgtacccgacggcgacggccgcctcagcgcgcggtgcctgatggaggacctcgtggaggacccggcaacgggcagtgccaacggagacttggccgcctacctgctgcatcacgactgccttggctcggacgaggccgagtacgccgtcatccagggcgaggacatgggcaggcgcagcgtgctccacgtccgcgcctccgtcaggcgctcgaacagggacgggccggacgcgtactcgatcgaggtcggcggcggggtccgcgtcgtggccgagggcgactggcactagcgcccaaggtcagccgcgcggcgcggaagcccgatcttctcccctgctctccttgaggtagtcgatgtactcgtcgccccactcctcgatggcgtcgagcaccctcttgaacctgcggccgatgggcgtgagctcgtactccacgcgcagcgtgccctccgtgctcacgtggcggctgatcatgccctccaccaaacgttaaggctgcgtcacagacgccttctttgcattcgcgacgcagcctcgcacgagcatggcgacggcactgagctccatttgcaagcgcgggggcacgaaaaccctacaacgccaagacatatgctaagcgtcatcgtcggcaatgaattccaacacgtcgcccggctggcagttaaagaaggagcaaatgccatccaaggtggacagacgtatggcacgaatgtctcccgtcttgatgtgagacatgttgacgcgagaaatgccaacggcgtctgccaattcgcgaacggtacatcctcgctctcggagcaaatcgtctacatggagaactatcggcatgccttcaccatacccaactcatatctgatacgcgtttatcctcctacagagtatgatccgcctcatccaacaggaatcgaccgtaaccaaagacatgggcgagcacgaaaacaatccccggcgccacgaaggaacccacggaaaccacgatggctccctgcgacgaagcatcgaaaccccgccacatccaatcgctcaccacgctgccgtatccccaggagatgataagagatggggctgccccattggcaatgacctgcgccatcacctggaacacaagctcggcaaccgcgaggagcaaaagacacatgcctatgcggttgaggctttcctcgacggtcttcgtgaagggcgttcccgagtctacagtcgtttcgaatatgtgatgtatcccacgaagcacggagaaccagagcagggcgtcaacagctccttgagcgaaaggcagggtcgtcaccacatccgctcggcccagaaagagctgaacaagcaggtagaccagggcaacagcgagaatgagagcaatggcaagcagcgctctcgaaagtatgtcgaagacccttacccctcgcagccagtttcggttggccatgaacgcagggccttgttcctcatgccgaacatcatcggcttgcttgatgcgaacgcccatgattgccctccaactcaatttctggagaccaagatcaccagaaacacaatgtttgcggacatagcagtcgacaattcagttcgaggcctcactatgagtttaccgtcgaacgaaggatgtgtatcgttttttgatacactcctcgcgaacgtatgggaataacctgtgaacggaagccccactcggcatgagagctggagattgtccgaaccatacactatccgcaggcgatagtggaagtagcgcgcccgccagcatgaggagagaaagcgatgaacgaccagatcagagccctaattgcccagcacgagcagaagggtgacttcacccatgtagcaccaaccaaagagatgctggcgtctgcccagaggctactaggcctcaccatcccgcagcagttcgttgatttcttgcacgaatacagctacgggggaattggaggcattacgattctgggtgttggcttagatgggagcatggccttcctcgaagaaacactcagctatcgtaagtacggcctgccacacaaccttttggtagtcgagaactgcgacgagtggctctggtgtctcgactgcgattccggagaggtcgtctcatggagccaggccgacggcgacgatatattgccgggataccccagcttcgacgacttccttcttgatgatctccaagaggcgattgacagcctctagaagaagtctcgcgttatgaataagctgcctcccacttcctagacacgtgaaatgggaggctttctcatgcgaacatcgtccagacggttgccctgggatcagccgcgcagcgcgggagcccgatcttctcccctggcatccttgaggtagtcgatgtactcgtcgccccactcctcgatggcgtcgagcaccctcttgaacctgcggccgatgggcgtgagctcgtactccacgcgcagcgtgccctccgtgctcacgtggcggc

SEQ ID NO: 186 - DNA, 37137 bp, Unknown
  Metagenome-assembled genome
gctcgcgtcagcgcgcgctccaggtagtcccttgcgagtagctgcgcgcccgtgacctcgaagctcagcatgaagtcctcgcgccagccggcgagcgtgaggtccgtgccgcggtacgacacgtagcgcacgcacttctgccacccgccaaggcagcccgcgggcagtgccacctcgagcgcggcaaactgcacggagcgctcggtatccatcacgtccacgtacgagccgacgacaagctcgccaaagcgccgcgagtccgcaagcgcgcgcaggtatccggcatctatagtggcgagcgagcgcacgtacggcgccacgtcgccgcccgactgctcgagcaggttccccagcgcctgcgccacggtcacgctgccgccctccgcctcgcttggcacgatgcccgcgaggtccacgtagctcagcgtcgcgagcacgagcgcgtcggcctccgtgagcggccgctcgcgcaggctcatgtccccgcgccacaagaggtagtccgtgaggttcccgattccgtcgccagctgccatctctcccccgtcactcctggccaccgcgcgccgccgcggtcggccgacatcgccattgtggacatgatacgcgaaggccctcccccgccgtgacgagggagggccaacgaaggcggcacgttcttctcgcccgcatgggcatcgcccgctttgggcgagaagaacaccgcctgactaggtaagctaagccgctctggctaggccatgatctggcggaacatgtccttcacctgctcgggcgtggcctcgcgcgggttgccggggtagcaggcgtccgcgagggcgtccttggcgagctggtcgaggtcctcctccacgaggcccttgcaggtcttggggatgcccacgtcctcaccgagcttgcggaccgcggcgatcgcggcgtccgcggcctcctcgtcggacatgcccttggtgtcgacgcccatggcgacggcgatctgcgcctgcttgtgcgcggcgaccggcttgttgaactccatggagatcgggagcagcatggcgcaggcgacgccgtgcggcgtgtcgtagtgcgcggagagcgtgtgcgccatggagtggtcgatgccgaggccgacgttggagaagcccatgccggcgacgtactggccgagcgccatctccttgcggccggtgccgggctcgccggacttggcctccgcgacggcgtcgcgcaggttgtgcgagatgatctcgatggccttgtagtggaacatgtcggagagctcccaggcgcccttggtggtgtagccctcgatggcgtgcgtgagcgcgtccatgccggtcgcggcggtgaggccgacgggcatggaggccatcatgtcggggtcgacgacggcgacctcggggatgtcgttggtgtcgacgcagacgaacttgcgctgcttctcggggtcggtgatcacgtagttgatcgtgacttcggccgcggttccggccgtcgtggggacggcgatggtgaagacggcgtgctccttggtgggggccactccctcgagggacctgacgtccgcgaactcggggttgttggcgatgatgccgatggccttggccgtgtccatcgcggagccgccaccgatggcgacgatcgcgttggcgccggaggccttgaacgccttgacaccgtcctgcacgttctggatggtcgggttgggcttgacctcgtcgtagaggtcccacttgatgccggcctggtcgagcaggtcggtgaccttgttcgtgaccttgaacttgacgaggtcggggtcggagctcacgaagacgtggtcgtacccgcggcgggacagctcgcccgggatctccttgatcgcaccagagccgtggtacgagatgccgttgaggacaaaacgctcagccatgccatactccttcttgtcgaagtttacgtgccgatgaggggcgcccgccccgcggacgccagacccattgttacccaatacgcctggcgcgattcagaaaatgacgctcttctcgcccaacggatatcgcgttgctggggatttgcggaagaattcgcaagattgctaatacgagcgatccggccttagtagcaagcgacgccagctgactcgccgtggcgcatagcttggtctggccacgaaggcgcatcgggcctagtcgagcgcacgacgcggggccaacaacaggaggctccggcacagaacccaacgttccgcgcaggtcccggcgactgacgtgggatctgttacgaatcgacatgtggccctggcacagaacccactgcactttctgaatgctcgcaaactcgagcgagaactgtgccgagctcgccaaggccacgcacagaacccgccccacctaacccgaggtcgcaagcaacgccgggttatgtaccatccgagcacagccgaaaccgagtgcgaagggttctgtaccacgttttgcaagaattgaagggttctgtgtggcaccgatttagttcaatcacatataaccagaggtataagacgtgcctcatttttcccgagatcgccgccttggtacagaaccccgcagagctggagagcagtcgttccaggtggcacagaaccaagggcttcttgcgtgatggagcaagaacctctgggttctgtgccgccctgcgctgcatggccggtacagagcccaccctttctcacatcgccgtaacgtcacgaggcttctgtaccagtgggcggctcgttatcgcagcgggccgccttggcgcctacgaacatcgaggagttctgtaccgcccttggcggcccgagcccctctggttgccacgacccgctggatcgtttgcgttccagacaaaaaaacgcgcgccccagttgggacgcgcgcttgatagtccatatgagcggattctgtctctgtggctagacgggagagccgcacctggagaagctgctcacggagccatagccgatgccctggctcggggagaacgcctcgatggtgacgccaccgccgatgtagatgcccacgtgacccggacgccagaccacatcgccaggctgcgcctgggagatgggcttggtgcagaacgacgcctgggaggcggagctgtggttgatgctgatgcccgcgaccgagtaggcatacgacgtcaggccagagcagtcgaacgtgcgcgtggaggggctgcaggcggcccacacgtagttgccgccgaccatggaggtggcagcagcgatgacggtgttgcgccagttgccagagacggacgtcttgctgccggagttcgagctgttgttggagctcgagttgcccttgttcgagttggagctggagttcgacttggaaccaccgttggtggacgtgttggtcttggtcgagctggagctggagttcgtggtgctcttcgagctggagttgctgttcgtgttggtgctggtgctgctggagttggtgctcgtggcgccgttgtcagcggcgatgtagttgccgccgttctgggcagccttggcctgctgcgcggcagcctcctggcgtgccttctcctgggccgcggcctgctcctcctgcagtgccttctgcacctcagagctcaggctgttgacgtactcctgggccttcttggactgctcgttcagagactcgctctgggccttcttgtcggcaacgagcttctcctgggaggccttctgcttctcgagctgggacttctggtcggacagctgggtctgcagggtcttgacctcgttgatcgcctgggtgtccttctcgctcaccttgttggcgtacgtgatgttgctcgtgagcgtctcgaaggagtcggagccgaggaggatgctcagcaggtcggtgtcgccgtccttgtagttggcggcaacgcgcttgctcagcacggcctgcttctccttcagctcggactgcgtcttggtgatgtccgagttgagggagtcgatcttggagttggtctggtcgagctcgacctgggtctggttcaggtcctcggaggcctgctcggccttggagtacaggctatcaagcttggactgtgccgtcgcgagctcgctcttgagctcggagctggacggagtcgctagcgcgggaacggtcgcgccagaaaaaacgagcgtcgcggagagcgcggcagcaatggctttttgggctttattatgcttcaaaacccgcctctttcctacttcgtcgtggacaacatgtcccgacaattctagcatcgtacggacccaacgggccaaattgcccccgttcgggcgccgccaggcagggctgtcccagatgtccttcccgtgtgccagcggactttctgcagatggcaagggcgttttggcttcctaaacgtcccgtttggtcacgtggcagaagtgtgaatttgcagaaatcatgggcaggtcctcacgaatccgcagctaaaccctcacgttaccctcaagtagcgccacgcgacgcaaacggggagcccctccgcgggccgtccgcaagggcggatcggccgggcgagaaggactcccccacgcgtcgagaccgggcctcagcccgggccttgggccacccacggcccggaccctggctacgcctccagggcctcgcgcagcatctggttgaagagcttggggttgcccttgcccttgctcgccttcatgcactggcccaccaggtagcccacgaccttcttgttgccgtcgtggtactggttcacctggtcctggcagcgcgcgagcacctcctccacgatgggcgcgagggccgacgtgtcgctcacctgacgcatgccgcgctcgtccaccacgcgctccgggtcgtcgtccgtgccgtccacggcctcgagcacctcgcgtgcctgggcaaacgtgatcgcgtccgtggcgaggagcctcgcgagcgagaagacctgctcggcggagacgccttcgtgtccgggcagcaggttgaccatcacgttggcgacggtcgcctggacctttgccgcgtccttctcgcccggcttgacgagcgccacggcggactcgaagagcgccgccgttgcggggtcgccggcgagctggcgcgcgtcggcgggcttgaggccaaagtcgcgcacgtagcggtcgcgcttcgcgtgcggcagctccgggatgcgggcgcgggcctcgttgatgaagtcgtccgtcaggtcgaagggcgcgaggtccgggtccgggaagagccggtagtcgtcctcggtctccttgacgcgcatgaccacggtgcggtggtggctgggctcccagtggcgggtctcctggtagatgatgccgccctcctccagcacctcggcctggcggcagatctcgtactccagggcgtcgtgcaggctcttgaaagagttgatgttcttcatctcggccttggtgcccaggcgggtctcgccgcggcggcgcaggctgatgttgccgtcgcagcgcatggagccgctctcgagcgagcagtcgctaatgcccagcgtgcggaacgtctgctgcaggtcctccatgaagaggcgggcctcctcgggcgtgcgcaggtcgggctccgtcacgagctcgatcagcggcgtgccacagcggttgtagtcgataaaggattccgacgcgccggtgatgcggccctccgttccgccggagtggaccatcttggcggcgtcctcctccatgtggatgcgcaggatcctgatgggcacggtgtaggagccgtcggccgcgcgctccacgggcgtgccgtcgccggcggtggactcccactccgggcgctccgcggcgccctcgccctccacggagaggtcgaggtggccgtgcatgcagaacgcgaccggaccctgcgtggtctggaagttcttggccatgtccggatagaagtagtgcttgcggtagaacatggagtgcttcatgatctggcagttcgtggccaggcccgccatcacgatggactggatggccttgcggttgggcacgggcagcgcccccggcatgcccaggcacacggggcacacgttggtgttgggcgggtcgtcgtgggagaggcggcagttgcagaacatcttggtgtcgagcgtggtgagctcggtgtggacctccaggccgatgacggcctcccagtccctaaggacctcctggagcttcttcactacaggtcacctccccttccggcaaagtcgggcgcgacgggggcgccgccgcccaggcccaggccctggtccacgccgcgctcgatggcacgggcaaagcgcagcagcctgcggtcgctaaaggcggggccctgcagctgcgcggagacgggcatgtgcgattgcgtcgcgaggcccagcgggacggagatgccgccgttgccgcagatgttgttgctgatggtgaacatgtccgaggcgtacatctgcgtggggtcgctcacgtcgccaaagcgccacgccgtggtgggcgcgctcggcagcaggatgacgtcgcacttctggtacgcgcgggcgtagtcctgcgtgatgagggtgcggacctgctgcgccggatagtagtacttctcgtacacgccgctggagagcaggtacgcgccgagcatctggcggcgcttggcctcctcgccaaagccgtgcgcgcggctgagcgaggtctgctcggccagcgtctggcagtcgggctcctggtagccgtagcgcacgccgtcaaagcgcgcgaggttgctgaaggcctcgcacggggcgatcacgtagtacgccgcgatggcggaggcgatgttggggagctcgacctcgaccacgcgcgcgccctgcgacgcgagcgaggccacggccgccgtcagtgcgtcgcgcacctcctgcgagaggccctttgcctccatgagctgcggaaccacgcccaccgtgaggccctccacgggatcgtccaggtgctccaggaagtcaaccgcgcagttctgggacgtgctgtcgagaggatcggccccctcggccgtgagggcgttcatggccagggccacgtcctcgacccggcggccaaagggccccacctggtcgagcgacgagccaaacgcgaccacgccgtagcggctgaccgccccgtaggtgggcttcatgcccacgacgccgcagaagctggccggctggcggatcgacccgcccgtgtccgacccgagcgcgagcgtggcctcgcccgcggcgaccgctgcggcggaaccgcccgaggagccgccgggcacgcggcccgtgtcccacgggttgttggtgcggtggaacgcgctggactccgtggtgctgccaaaggcgaactcgtccatgttggtcttgcccacgggcgtggcgccggcgtccagcaggcgctgcacgcacgtggccgtgaacacggagtcgtagtttgcgagcatcttggacgcgcaggtcgtgcgcgtgcctaccaggtgcatgttgtccttaaaggccacgggcacgccggccagggggccgagcttctcgcccgccgcgcggcgcgcgtccgtgcgcttggccgcttcgagcgccaggtccgcggatacctgcaggaaggcctggacgtccttctcgcgcgaatctattgcgtcgagcgcggcctgggccacctccgtggccgtaaagtcgccctgcgcgacgcccgcggcgatctgcgccgcagagagtgagtcgaggctagccatcagaagtcctcctctgagtcgcccaggatggagggcacgcggaagtagcggtcgtgcgtggagccggcgttgtggagcgcgacgtcgatgggcagcgcgcggacggaatcgtcaaccacgtcctcgcccatcacgttggacaggtctccgatgggatggaacgttggctcgacgccgtcgaggtcatagtgggtgattggttcgagaagatcgacggcctcgttcatgtacgtcgtcatctgctcgagctccgagggcgtgagcgctatgcgcgcgtagtccgcgatctgcgccacgtcgtcctgggacagtgccatggcagccctccttgcggcttgcttgcggcttgcttgcggcttgcttgcggcttgcttgcggttgcatgcggttggcgtgcgtcgggcgcacgcttgcggtttgcatgcgacccatcatacgcaaacgcggcccgcgcgggagggcgcgcaggcgctcgcgcaaccgcaccgttacgttgcggggctagcggcggtcggtacggacgctagccgcggccggtcgggacgccgtcgcccgagtgccgcccgcggctcgtgccgaccacaaagcccgccgcgatgaccgcgaccatggcggaggccgagaagagcacggcctgcacgccgaaggcgtctgccaaaaagggcgccaccaaaagcggcagcgtgccggcgctgttcatgccgacgcgcatgacggaaatgacgcggcccacctgctcgaagctggcatagcgctgcgtgagcgtggtgcggatgggccccatggcgccaaagcccaggcccgtgaccagctgccccacgcacgcccacgcgatggagcccgttcccacgtagatcatggagcccacgcccgtgaccaggagcatcgcggaaagcagcgtgacgctgagccgcttggccggcacgcgcatggccagaagcgaccccgccgtgccgcccacgcccacgatggccgagagccagcccatccactgcgcgctcgcgtgcagcacgtcgcgatagaagagcgactcgagcgagtcgaacgcgccgtacgcgaagaatcccaggaagcccaccaggaagagcagcctgaggctcttgttggcaaacgtggcgcgcacgccctcggcaagggacgaccagaagccggcggatgcgagtgcgggggcgccgtccgcctcgcccgcggcgggggcgccgggagccgcatcgggatcgccgttggcagcagcctgcgagcggttgggcacgaccttctcgcccgtggcacgcacgagcgccagcgcgggcagcggggcaaacgcgagcaccgcgaagtccgcctgcgttggaaaggcggacacgatgagcccgccgagcgccggccccgcgacgacggcgacgctcgcggccgagctcacgaggctgttggcgcgcagcaggaaccggtcgtcggcgctgacgaagcgcgggtacgcgtccatggccgtggtggacaggccaaacagcgagcccagcagcgccgcgaccacgtagagcagcgggtagctgacgggcaggagccatcccgcgaggcccgccgcggacatgagcgcaagggagaagagcagcgtccgtcgcggtcccacggcgtctatcagcgggcccgcggctagccccgcgaccacgagcgccatgttgaggacgagcaccatgccggacacggcgaacgcgtccgcgtcgagcacgtacgtggcgcacccgatgatccccacgaagtacgtagcctggaagccgagctgcatgaagaagctcgcggccacgatccgggccgcggctccggagcgggcgttcttctcgcccgccgcgtccctcttgcccgccgtcatgaccgcaccggggcgtcgggcgccacgccgaggagccggcccatcagctttccgtacgtggccgcgagcacctgctgaaacagcgtgcccgccaccacggggaacatgacctgcgcgggaaagaactgcgccgcgatgactgccccgcaggatatgttgcgcatgccgcactggaacaccatcgcgacggtggacggcacgctctgccccatgcgcctcgccagcgcgagcccggccaggtaccccgtggacgcgaacaccaggatgaacgcgagcacgcccacgagctgtggcgtcaggtgcgtgaggtacggcgcggcccccgtggcgttggacgcgatcacgagcacgatggccacgcgcgccgccggcatgacgacgggcgagagggacgagcccgcccagccgcgggtgaggtcgttgagcagcatcccgcacagggccggcagcgcgacggtcatcacgaccgaaagcatcatggggccggcgtccacgtggacggcgtgtcccagcagaatctgcagcgtggccgggatggtcgccggcgccaggagcgacgacaccatgagcgtcgcgaggccctgggcaacgtcgccgccgtacatcgcgacccacatggtggatatggccgccacgggcacgctgtactccagcacaaggcccgtcacgaggttgggactgcttccaaacagggcctctgccagcacaaacgccacgactggcatcacgacggacgccaggatgatggtcgcgaccatgggcagcgggtggcgcacggcatgaaccaggttgtgcagcccgttggtgagcgccccctggaacgacacgagcgcgaacagccacggcaccgctggcttcaggcacgacagctgcgccgggaagacgcacgccgccacgacgcagccgatggcgatgggcgccatgtgcgccccgatgaacctaccaaacgcctgccacgtggtcacgatgctcttctccccctcacgcgggcgccgcatgccggctggccgccggctgtcggccgctgccagccgctgactgtcagccacagccgaccgcacccgtgcggtcaatcgtagcagacgccgccgactacgcagatgacgggtgacggccggcgcgcaggcgcgaatctgtggagaagggatgaaccgcgcctggagggatgaatgcgggattgatgggcggctcttctcgcccgcccgcggtgcctgcgcggaccgcgccccgtggccgaacgcgacgcatataaaagactggggcaaggcatgcgcgagccaagtgcaagccgcccgtgccatgatgcggcaatgacggtgctcatctcacataccacggcgccctggatcctgtgcagcccacggctgcgcgcggcgcttggcgcctgtcgcggggtcgtgacgctgggcacgccgcgcgagcttgcggaccgcctgccaaacatttgcaaggtgctaggttggaacgccgctggttgcagggcaatcgacatcctggtccggccgagcacgaaccggcgcaagacgcagctggcatacccgcacgcctggacgcgcccgcttcccgagggtgcgctgctgagcctctgcgacggggtggcggtcgcatcccccgagctgtcgtttctgcagatggcggagtacctcgacgtgatcgagctggcgcaactcgcgtgcagcctatgcggtgggtacttccccagcgcggacgagaggggctttgttgaccggcaaccgctcacctcgatcgagcggattgacggcttcctggcaaagctgcgcggaacgaggaacgtcacgaaggcgcggcgggccctgcgatgcgcccacgaccacgcgcggtcacccatggagaccacgacggcgatgcttctctcgatgagcaggcgccaaggtgggtacggcctcccaaagccgcagctcaaccaccgcgtcgagcttcccggggacgtcgccgccgctgctggcacgggccacttcacggtggacctcttctaccagcgggccggcaagcccagcggcgtcgccatcgagtacctggggcgcgcctatcacaaggacgtcgcgcgcgacatcacccgcgaactgctgctcaagcgggcgggatgccccgtggtcgacgtcacgatcagccaaatcgtccgaagcgacctgaggaaccaacttgttggcgacatcgcgcacgagatcggctatcgcctcaggaaggggacgccgcgcatccgcgagcgccgcaacgacctgctgaaccgaatcctcccccacccgtcgcagatctccccggacggaagcgtcacgtgggagaagccggcgtgggcactcccgccagagctcgcaacctagctcgactggcggtgggcgaatctgccaacgccgcggttccgccgcggaccgctcacggcacaaacagctttattagtatctagcgcgccaaccatcagagggcggcgcgcgcttttcggctgaaacactgcggagaacccccgtcccagccagcccaatcgccctgccaacgttggcgccgcgcgtacagaaccccaacgaccttgctacaacgcaagaatcctcaggttctgtgccggctacttcggacaagctggcacagaacccactggacgttgcacagccgcgcaacaatgagcggcttctgtgtgccctggctatcgtggcttccaattcaacggtgttctgtaccaacaaagattctagttgcagacttgatgtaggctgttacctgcagctatacgtttttgaacgaccacgcctcgcacagaacccgctggtcctaccgcacggatggtacagaacccacctcacccgtaagcgaccacccagggatggcacagtttcccagtcttcttacgtaggctcgcaaagtgaacggagatttgtaccgggctcaaggcggccgccacacagatcccccgccaccttgccatgcgttgcaacctcagcctggttctgtgccggccccctcaagctcgccacacagaaccccacccacatccaccaccccgcaaacctcctgcgggttctgtgcacgccgcccctccgccccacacagaacccgcacctcgcgccagccacctcccaccccaaattgccaccgcccaactatgaattgcctgtgacggcagaaaatcctccctggaagattgaaaacatcgcacatgtcggagtaaaatcccccttcgtaagtaggatttacgtcagggcgacgcgccagacgcgctgccaccccggcacgagtgaccagggacccgcccatcgcgagtcccggcaaagagagaggcgccatgtcacagctactcaacatctccggtctttcggcaggcacggaggagaaacccatcctccatgacatgaacctttccgtgggcgcgggcgagacccacgtcctcatgggccccaacggcgcgggcaagtccacgctcggccacgtcatcatgggtgaccccgtgtacaaggtctccggcggcaccatcacgttcgacggccaggacatcacggacaagacccccgacaagcgctcgcttgcgggaatcttcctctcctaccaggcccccgtcgaggtccccggcgtgcccctgtacagcttcctgcgcaccatcacccagatgcgccccgagctcaagatgaccgcgcgcaagttccgccagcgcgtcggcgagatctgcgaccagctcgacatgggccagggcttcctcacccgcgagctcaacgtcggcttctccggcggcgagaagaagaaggtcgagatgctccagctcctgctcctcaagcccaagctggccatcctcgacgagaccgactccggcctcgacgtcgacgccctctccgtcgtcagccgcggcatcgaggcctaccgccgcgagtgcgacggcgcgctcctcatgatcacgcacaacacgcgcatcctcgagaagctcgacgtcgaccgcacccacgtcatggtcaagggccgcctcgtggccgagggccccgcgtccctgatcgacgacatcgaccagaacggcttcgcgcgcttcgagcaggacggcgcggccgcccagaaggctgaggcgtagcaatggccgagaagagcaagaggacccaggtcgaggacgtcgaccgctccctctatgacttcgtgaagtcggaggagggttacgagcgctacgccgacggcctcacgcccgacatcgtccgcgccatcagcgccaagaaggacgagccccagtggatgctcgacctccgcctgaaggcgctcgagatctaccaggacaagcagatggcctccaactggggccccagcatcgcgggcctcgacatggaccacatctccacgtatgtgagtcccaagaccaagcaggccaaggactggaacgacgtccccaaggacatcaaggacacgttcgagcgcctcggcatccccgaggccgagcgtgagagcctcgccggcgtcggcgcccagtacgactccgagatcgtctaccacaacatgcgcgaggaggtcgccaagcagggcgtcgtctacaccacgatcgaggacgccatccacgacccaaagtgggagcccgtcgtgcgcgagtacttcggcacgctcatcccgcccacggaccacaagttcgcggcactgcactacgcggtgtggtccggcggctcgttcgtctacgtgcccgagggcgtgcacctcgactacccgctgcagagctacttccgcctcaacgcgcagggcgccggccagttcgagcacacgctcatcatcgtcgagcccggcgctgacctgcacttcatcgagggctgctccgcccccaagtactacgaggctaacctccacgccggcgccgtggagctcttcgtgaaggaccacgcgcgcctgcgctactccacgatcgagaactggtccaagaacatgtacaacctcaacaccaagcgcgccacggtcggcgaggactccaagatggagtgggtctcgggcagcttcggcagccacgtcagctacctctaccccaccacgatcctcaagggcgaccgcgcgagctgcgagtacacgggcatcacgttctccggcgccacgcaggacctcgacacgggctgcaagttcatcctgctcggcaaggacaccaacgtctccgcggacgccaagtccatcagcaaggacggcggcgtcaacacgttccgctcgtcggtcttcgtcggcaaggacgccaccaacgcccgcgccacggtcagctgctcgtcgctcatgctcgacgacatcagccgctccgacaccatcccccagatggacatccgcaacaacacggcgcaggtcggccacgaggccaccatcggccgcatctccgacgacacgatcctctacctcatgagccgcggctgctccgaggccgaggccaggaccatggtcgtcaacggcttcgcagacccggtctccaaggagctcccgctcgagtacgccgtcgagatgaacaacctgatcaagatcgagatggaaggggcgatcggctaatggcaagctacaccgccgaggagcccacggtcaccctcgagcgcgtcaacacgccgcccgcgcagacctggaactacctcaagacaaacgacataacgctcaccgtccccaagctctcgcgcaagggagacgtctacttcgcgcttccccgcctcttcgacaaggtcgagacgggcatgggccaaaaggttaccgactgggtcacctcccaggccgctgactccacgtacgtcgaggtaaaggcgggcgagaagaaccatgcccccatcgtcgtggacgttgactccaacgcgggcaccgtgcaggacgcgggcgtcctcgtccgccagggcgcgagcgccacggtcgtcgtggtcgcccacggcacctccgcggagccccagacgtccgccgcgctcgtgaggatcatcgtggaggagggcgcgcacctctcgctcgtggaggtcgtcgccaccacggacgcgcaccatcacctcgagtccgtcggcatccacgcggacgcgggcgccacgctcgacatccgccagttcctgctcggtgcgggcgtcacggcgctcggcacgtgcgcgacgctcgccggcgacaacggccgcgtcagcctgcagacccactacctgggcgagcacgagcagacgctcgacatcaaccacgtcgtgcgcatggccggcaagaacggccgcgccgaggtgcacgagaacggcatcctcaacgacagcgcccgcaagtcgctgcgcgccacgatcgacctgatccacggcggctccggctccaagggcaacgaggccgagaccgtgctcgtcaacggcgacggcgtcgtcaacaagaccatgccggtcatcctctgcgacgaggacgacgtccagggcaaccacggtgccacgatcggctccgtcgagcccgagcagatcgactacctcatggaccgcggcctgtcccgcgacgaggccaccaacctcttcgtgcgcgcgctgttcgacgacgccctcatcgaggcggaccagcccctggcccgcaaggccgtcttcgagcgcgcccagcaggtgctcggggccgaggtcgcccagaatcttctcgacaccctgggcctcgagctcgcggcagacgcgggcgagaaggacgcggacgcacaggcaaccgcaacggccacgaaggagagcgcggactgatgctaaccacccaacagcttgcagacatcgagcagaacccctacaaggcggacttcccgctgctcgcacagaaccccgacctcacgttcctggacagcgccgccacggcgcagcgcccggaggtcgtgctcgacgcggagcgcacgttctacaccacgatgaacgccaaccccctgcgcggcctgtaccgcctctccgtcgaggcgaccgaggccatcgacgaggcccgcaagaccatcgcgcgcttcatcggcgcggtggacgagaagggcgacccccagggcaaccagatcgtcttcacccgcaacgcctccgagtcgctcaacctcgtggcgcgcacgctgggacccaaggtcgtgctcggcccggacgacgaggtcgtcatcagcatcatggagcaccactccaacctgatcccgtggcagcagctctgccgtgccacgggcgccaagctcacgtacctgcgcctggacgatgacttccgcatcacgccggaggaggtcgccgccaagatcggcccgcacaccaagatcgtgtccgtcacgcaggtcagcaacgtcctgggcgtccagaacgacgtcaaggccatcgcgcggcgcgcgcacgaggtcggcgcctacatggtggtcgacggcgcgcagtccgtgccccacgtcccagtcaacgtgcgggacctcgactgcgacctcatggccttctcggcccataagctgggcggcccgatgggcatcggcgtgctgtggggaaagagcgaggtgctcgacgccatgccgccgttcctcacgggtggcgagatgatcgactccgtgacggagacggacgccgtctgggcgcccgtgccgcagaagttcgaggccggcacgcaggacgccgccggctccttcgcgaccaaggccgccatcgactacctcgcaagcaaggacatggccaagctcgaggcgcgcgagcgcgagcttgccacctaccttaccgaccgcctgaacgacctcccctacgtggacgtcatcggccccaaggacggcagcaggcacgtgagcgcggtcgcgttcaacgtgcgcggcgtgcacccgcacgacgtggcctcgatcctggacatgtccaacgtctgcatccgcgccggccaccactgcgcgcagccgctgctcaactacctcgaggtggagaaccgcgccacctgccgcgcgagcgtggcgttctataacgacaaggccgacatcgaccgcctggtcgaggggctggacaaggtctggtccatctttggcggcgccgtcgacacgaaggaggcgtagcatggaccgctccacaccggcaagcctgtacaacgcgcagttcatggaccacgtcgcccaccccgactacaagtaccagatggacgaccccacctacacccactacggcgtcaacccctcctgtggggacgagctcacgttctccgtcaagatcggggacgacggccgcatcgaggaggccgcctaccagggccacggctgtgccgtgagccaggcctcggccgacatgatgagcgacctcatggtggacaagaccccccaggaggccatcgagctctgcaagctcttcggccgcatggtcaggggagaagagacggacgattcaaagctcgcggccctcgacgaggccgcgtccctcaaggacgtgagccacatgcccgcgcgcgtgaagtgcgcggagcttgcgtggcgcaccctcgaggagatgctcgagaacggctccggcgagcctggctccaccgcgaccgccagctgcacgatgccgcctcacacccacgacgggcaggagtaggcaccatggcttccatgttctccacaaaggggcgctacgccctcaggatcatgggcgacctggccactcaccccggttgggtgtcgctcggcgacgtcgcgaagcgccagggcatctcgcgcaagtacctggagcaggtcgtctcgctcatgcacaaggcgggcttcgtggagagcctgcgcggcaagggcggcggctaccggctcacgcgcgagcctcgcgagtacacgcttggcgcgatcctgcgcgcggcggagggttccctggctccggtcgactgcctggactgcaccaacgaccacatctgtccgcagttcgagacctgtcccacggtcacgatgtggcgtgacctaggcaaggtgacggcatcgtacctggacagcaagacgctccaggacatagtggaccagatgcacgagcgcgcggacggcgctgcggaggagcctgcgagccctgcgcactagcgaacgcaccgtgcgccaacaagaacgacgcaccagcaaggggtcgccatgtcacacggcatggcgaccccctttcctatctagcgccacgggctgggcgagcgtctgaagccccccgacaagaatttttggacctcgtgcacttgaagggggtttgagggtacttttgcccgccccagacaccaagccaatacgggacaaccgacgttcagtcatgtcaattagtcattcgtaccagatgccgcggagcaagtcaccatcagtcgcccaaattgggtctcgagctccaaattccgcccgccaaagcaccctcaaaccccggccgcgtgcaacgcagtcggaaattccttccgcagacagctctcgggaatggacaggctcaaaccgcgccgttcggccaggcgcctcaggcagcacacccagccgccacagcccctactcctccacagcctgaacgtcccaggcatggttgctgatgaagttgtagcacgccatcgagacctgctcgtcatcctcacccagttgcaggacctggtcgtaaccaatcttcccgccagtggaaaggtcgatcaacgccctcagcccttgcgtggaaaccccaaagctgtccagactgccgttcgcattggcgtccgccacgagccacggccagttgggagcccagacctcgacatggtggtcgcctatcgcctggctgtacatcatggcgtagccgacgtctcccgccacgtccggctccgtgccgtccatgtagtacagctcggccagctcgcccttgtaggacgcggaggcgttctcgtatcccttggcataaatgacgaggccgtcagcgaccttcacgacgtccaccttgtcgcgccagtaggaaggcagcgtgcacctgaagtgctccgcctccaccacgtaggccgagtcgctcgtcgtcgcagacccaccgcccgagtcgttcgatccgttcgtggtgttcgaggttccattcgtctggttcgacttgtctgcggccccatcggaatccgacttgtccgagtcgtttgccttcgcgtcgcccgcggacttgccggacttccccttcgccttcggcttctttacgaccttctgcgccgcagtctgccccctgcccgtcgtggacgtcgcaatcgcatacacacccaggccggctaccacgacggcaagcacgatcgccgtcacgaccagccacttgggaaccgagcccttcggcttgccgccatggtcgccgtctccgctggctggcacctccgccgcatccgcgctggtcggcggcacgggactcgccgccgccccgtcgtccaaggcatccgcggcatcgccagcacgcgaccgcgcctcgctcaggtcgaacccgcattgcgtgcagaacttcgtgtcgtctggcagctcgctgccgcagttgggacagaacatcttgccctccgcatgcgtcacgcgggcggaccacacccgcagcgactttcaggtcctttgcaagaagtatgacccagcggcgcgccggcgttgcgtcgcattcggcgcgcggtctctgcagccaacccgccgcacccgccgcaacctcgcgccaacaagaaaggggccagcctcgcggccagcccctaaacgctctaaagcaagggagaagatcttctcccctatcgaacccctaacgggaggtgaggcttatgcccagcccttgccgtcggagccgaagtccttgatgaggccctcggcggtgtcgacgatggcatcgaagcccggcttcaggaacttgcgaggatcgtagttcttgccctcgaggtccttgccgctctcgacgtacttgcgcatcgcggcgtggaaggcaagctgcagctcggtgttgatgttgatcttggcgacgccgaggctgacggccttgagcacctgctccttggggatgccggagccaccgtggaggacgagcggcaggtcgccggtcttggcctggatggcggccagacggtcgaagttcaggcccttccagtttgcgggataggggccgtggatgttgccgatgccgcaggccaggaagtcgacgcccagctcggcgatggcagcgcactgctcgggatcggccagctcgccctcggcggtgacgccgtcctcggtgccgccgatgccgccgacctcagcctcgatggacaggcccttggagtgggcgagcttcacgagctccttggtgtggtcgatgttggtctggaactcggcctcgtgggagccgtcgtacatgatggaggtgaagccggcgtcgatgcacttgaagcagtcctcataggagccgtggtcgaggtgcagcgcgacggggacggtaatgttcatggagtcaagcatgtcacggacgacgtcggcgacggtcttgaagcccttctgccacttggctgcgccggacgtgcactggatgatgaccggggactgggtctcctcggccgcggtgaggatggagcgggtccactcgaggtcgttggtgttgaaggctgcgattccgtaatggccagcctttgccgcctgaagcatgtgagcagcgttaacgagcatgtgtacctccatttgacgtgatggacgttctcacttcagatatattaccgcgaaatttcccgcctaatccccggggcgaaagcttatgcggaattttgcccttctcgtccacttgtccccgatttgtatgcatttgccgcgcgggtgccgcgggcgagaaggacggcaccccaggtcgcggccccttcgggacgcgggcggcgctggcggcgcactgcagcgtccgttacggcttacattgacttcatgaagttgtggcgccgcgggggccgatgcctatagtcgggtaagcaattcttgagggatgcccgccgcgtggcgggcgcggctccgcgcggcggggccaaacacaggaagggttggtctttcgattggctttcgaccagatgaatcgccagtacgacgcggcttcggcggacaagacgaccgtgcagcccaggggctcgtaccaggcgggcggcgcacggcagacgggccaggcgggtggtacctaccagccgcagggctacggctaccagacgcgccagcaaagctatgcggcagacaagacgacggtggccccggcgggccaggcgggccggcgccccggcaggacgacggcgaccccgcgcgacgcgtacggcagcgcgtatcgcgacgcctaccaggcggaccgcacgcaggtggcgcccgcggcgcaaggcgagggcgacggcagccagccgcaagacggcaagaagggcatcctgtccgagttttccggctcggcggtcatcgcgagtgcgctcgcgtccgtcacgtcctttgcgctgcagtccaagatcggcctcgccggctcgctcatcggcgtgggcgtggccgccgcagcgacgaccatcgcgtcgcaggtctacaagggcatgctgagcgcctccgcagagaagctcaagggactctccaacgactcccccgccgacgacgcggacagcctcacgcagaacctgcgctccgacgcgggcaccacgcaggcgtgggccacgcccgtctcgcttgacgacgcggcccagaccgagggcgtggcggaatccggcacgcccatcgcgccgcagagcatgcgcagcgcggcccagaccaggcacggcaaggtcgtcaagcgccgcaccgccatcgtgctggcggccgccgcgattgccgccgtgctcgtgtacgcgctcgtcgtgaacctcgcgacggccggccagggcatcggccccaccaccaccgcaaccacgtcccagacgcagtccacggacagcagccagaccgactccacggcagacaaccagaagagtacggacgccaacgccaagtctgacgctaacaagcagaaggacgagaagggcgactccaagtcctccaacggcacctctggcacgagcagcacggactccggcaccggcgcgtcatccaactctggcaccagctccaccagcggcagcggcacgagctccacctccggcaccagctcgaccagcggcagcggcaccggctccaactccacctcgggctctggcaccagctccaactccggcaactccggctccacggacagcggcaacaccagctcaggcaccggcaccaactccggctccagcgacagcgactcgagcaccacgtccaactccggaaccagcacgagcggcaactccgccaagtccaccggcaccacgagcacgacctcgagcacgaactagttcttctcccccgcacgcgccggcggccggcgcggcgcaggcaaccgcaagacagacgccccaaccgcacgcgaacgaaaggaccccacatggaacgacccaacgcatggctcgactacacggacgcgcagctggacgacctgacgcgcatctgcgacggatacaagggcttcatcagcgcaaacaagacggagcgggagttctgcgcggccgccgtggcccaggcccgcgaggccggctatcacgacctgtcggagctcgtggagcagggcacggcgctaaagccaggtgacaggatctactgctccaaccacggcaagggcctgctcctgatcgagctgggaacggagccgctcgcgcgcggcctcaacatcctgggcgcgcacatcgactcgccgcgcctggacgtgaagcagaacccgctggaagagaagagcgagctagccacgctggacacgcactactacggcggcatcaagaagtatcagtgggtcaccatcccgctggcaatccacggcgtcatctgcaagaaggacggcacgaccgtgcccgtgtgcgtgggcgaggcgccggacgaccccgtgttctgcgtgtctgacctgctgattcacctctccaaggagcagcttgccaagaccgccgcggacgtgatcgagggcgagctgctcgacgtgatcgtaggcaaccgccccgtcaaggtgaacaagcccgcggccggcgcgggcaccgacgatgccgcggccgagaaggacggctccgccgacggaaaggcagccgcaaaggaggccgtgaaggcgggagtgctcgatcttctcgcccgcgaactgggcgtgagcgaggaggacttcctttccgccgagctcgaggtcgtgccggccggccccgcgcgcgacctggggcttgaccgctcgctcatcctgggctacgggcaggacgacagctcgtgcgcctaccccagcctcgtggcgcagctcgagtgcgaggcgccgcggcgcacggccgtcacgatcctggtggacaaggaggagatcggctccgtgggtgccacgggcatgaccagcaggttctttgaggacgcgattgccgaggtcatggagctggccggcgagggcggcgagctggcgctgcgtcgctgcctgcgcaggtcgcgcatgctgagctccgacgtgagcgcggcgtacgacccgagctacgcatcagtcttcgaaccaaagaactcctgctacctggggcacggcctcacgttcaacaagtacacgggcagccgcggcaagtccggctccaacgacgcgaatgccgagtacgtggcgctgatccgccgttgcatggacgatgcgggcgtgcacttccagaccgccgagctgggcaaggtcgacgcgggcggcggcggaaccatcgcctacatcctggcgaagtacggcatggacgtgattgactgcggcgtgccggtgctgtcgatgcacgcgccgtgggaggccacgagcaaggccgacgtgtacgaggcgtaccgcgggtacaaggcgttcctgcagctagactagctgcggattctagtccgacatagttgcaagtttgtggcgcgcggcctcccgacggggtcgcgcgcctttccgtttggggcgggcgagcgctgccggctggtcctggggatgcggcacagaacccctggctcgttacgaagggccgcaacgaacgcggggttctgtgcgggaccgaggggcccgatgcgggtttggaagggttctgtaccagacgtcacgaccggccgaatttgaggtaagccccctacctggcatttcttgttgattggcgacttcgacctgacacagaaaccgggcttcattgcgagcgcgtggtacagaaccgcctggtcctggcagggcatcaccccaggcggcacagaacccaacgaatctcgcgagggcccgcaaggaactcctggttctgtacaacactgcaagaccacctgatacagaacccctgactccttgcaagtcgtagcaatgagcacggggttctgtgcgggaccgaggggcccgatgcgggtttgggagggttctgtaccaggtgtcggtcgtagcggcttcagacacgcccgccccacctgcgatcatacgtttctcaaccacaaggcctggcacagaaccccagtgaccttgcagagcggtggtacagaactgtccgcttttggaggatgggtctccgagatggcacagaacccaggaatcctcgcgtggcgcagcaaggatcgccgggttctgtgcaccattccctgggagccgtgcacagaacccaccccacgtttcaactcgtcgcaaagagcggagggttctgtacgcgccgagacggcccattgcggcttcggaggggttctgtaccattcggcagtcgcgatgtcctttggggcagccgcctcaccagcgatcatatgtttctcaaccatatagcctggcacagaaccctcgcgtccttgcaacaaggtggtacagaacccgtctcgactggcaacgggtcagtcagggtgacacagaacccaaggcttcctacgcgatgtggcaggaatcgttgggttctgtgcggactttcgcggacgtcgtgagcgcgctggcacagatcccacagttcgttgcccggtgccgtaacgaacgttgggttctgtgcacgagccgcagcgctaggccagcgtgctcggcatttcgttgggttctgtgcacttgcggtcgcgccgcagccgctggcgccgcggccgccggcgtcgccgcctactcgtgctgctccatgaagcgctccacgcacgcgttgtactcgtccttgcactcgacgtgggcgttgtgcgtcgcacccttgaagagctcccactcgcagttggggatgcggtccaccacctgcttcgcgatgtagggcgtgcactcgtccgcgccgccggaggtgtagagcgtcgggatctcgatcttgtagaggtcgtccgttatgtcccagtggctgagcttgccggtgaccacgaattcgctcttgccctgcatgaagtggtagagctcgtcgccaggctcgtccgcggggcgcacgtacttggggtcgagctcgctgtcgagctgcttctgcacgtggcggcggtagtactcgttggacgccgcgaccacctcggggcgcgtgtagtcgccgtcgcggtcggcttgctccagggcctcgcgcatctccttgggcaggtagctacgcagacggatcgcctcctccagccacaggtcgagcgacgccggtcccgacgctacgaccatgctcgcgacgcccgccggcaggtgggtcgcgtactgcattgcgagcatgccgccccacgactgcccaagcaggtgcacgtggtcgagccccagcgcctcgcgcacgcagacgagctcctcctccgcaaactccgcgctccacttgtcgtacagcggcgggcacggcgactttccgcagcccagcgcgtcgtagtagatgacggcgcgcccgtacttctccgcaatgccatcgagcgacgttatgtaatagtgcgccgcgccggggccaccgtggatcgcgagcagcggcagcttgcccggctcgcactcgcccacgatccggtaataggtctggtagccggcaaacggcacgtagccctcgcgaatgcgcggcgcgggcgcgccggccgtgcgcgacgcctcgcttgtggtggtgtccttggtgctcatgtgcatatcccccgttcctgaatgcgcaggacctcgcgggcgagaagcccaatcctgcgtagttgggccacagtttcgtatcgtttgtctgttgatattagcgctccgcatgaacccaaacttggccgtatctatactgcaacctgtatgtttcgagtcgtctaggagaatcatgtctgcatcaagcgttctgtttgcggtggtctcgttcgcaaccgccatcgcagtgatctgtctgtgcatacgctggcggcgtctaagtgccacggaggggtatcggaggctctccgctagtacctatgtctgggccctctcctatgcaatacttcccatcgcgctgggcgtcctgtgcctgatgggctactacaagggaagcccgctcgcgccgtttttgctagcggcggccgtgttcgtgtgcgtgatgggcacgcttcaccgcgagaacggcaagacgttcctgcgcacggtgcgcgactttgtgggcgcgtacgcccccaggggaagcaggccgcactggcccaaggctcccaagttcatgtccaagcgctccgcaaagcaccgcgagcgccgcgaggcccgcgcggaagccaagcgcaagaaggccgaggccgcggcggccgcgggcaagcagcccagccgcctctccacgtgggcgcaccagacgctcgcgccgtgggccaagaccgacttcgtgcgcctgtgcgtggcggcgctgtttgccttcatctcgctcgagatctgctggcacatcaaccttcttaccatgaacttcctgagccgcctgatcgactgggccatgatcctgttcgcgatgaccgcgctgtacttcctcttccagcgtcgcagctggggcgccgtcgcggtggccgtcgcgtgctttgtcctgggcgttgtcgagtacttcgtcgtggtgctcaagggctccgtcatccaggcgggcgacatctacgcactgggcacggcggctgcggtctcggacggcctgcgcttcgactttggcggcacggtgctcctgggcgccgcggcgctcgacctgtcgctcctcgcgctcggccgcatcagcccgcgcgtgagcaacgcggcggccggcctcgactccgccaaggaggtcgagcccgacacctatgccagcacaaaggccgccgcaagcgaggccacgggcgagaagaacgcggccccgtcgcagcaggcatctgccagccaggacgccgcggccggcgccacgggcagcaagcccaaggccgcccgcaagccccgaagggtcgcgcgcgtggccatcaacgtacttctcgccgtggtgtgcgcgacgggcgcgtgggggtccacgcacctggcgtacgcgtggacgcagcttctgggcaccaagttctggcagccggtcatcgcgtactccgaccacggctttttgaccagcttcttcagcatgtggtacggcatgccgatcgaggtccccaagggctacaccacggccaaggccaagaagatcgagaagacgctcgccaaggagtacgacagctccgacgccgcgaagacgtacaagacggccagcaagcagttcaaccaggtaaagccaaccgtcatcttcgtgcagaacgagacgttctcggacctgtcgaagttttatgacctgggctacaccggctacaccggcccggagtacttcaactccatcagcgacgcgctcgcgcgcggcacgctcgacgtgtccgttgtgggcggcggcacctgcaactccgagttcgagttcctgaccggcaactccatggcgtacgtgggcaccggcaagtacccgtacaacctgtacaacttctccaacgtgaacagcctcgccaagcagttcaaggcgctgggctacggcaccatcgccatccatccaaacgtccccagcaactggaaccgcgacaaggtgtacccgcaactgggctttgaccagttcctgagcatcagcgacttcgagggcgcgcccgtgttccacaacggcgtgaccgacctctccacgtaccagaagatgctcgacctcataaaggcatccgacaagccgctcttcctgaccgacatcacgatgcagaaccacaccggctacgacaccggcaacatcccggcggaccgcctgaccaactaccagctcaagaacgtcaacgcgtacgagaacgctgagttcaacgagtacgtgagctgcatcaaggcgtccgacgaggacctgaaggtcttcatgcaggagctgcgccagctggacaagcccgtcgtgctcgtgttctacggcgaccaccagcccaacatcagctccaactaccttaacgacgccgtgtaccccaacgaggactccagctcgctttcccatcagctgcgcacgttcaagacccagtacctcatctgggcaaactacgacgtggccggcacccccgccaccagcaccaacaaggagattagcctcagctacctgagcagctacatgatggagctgatcggcgcgccgctgaccaaccaccagaaggccaacctgcagaccgcgctcaagatgccggagctcacgctcatgggctactctgacaccaacggcaactggaaggagacctccacggacctcacggaggccaccgtgagcggcagctccgacgcagccaaggcctaccgcgacctcgacatggtgcagtacctggagtttggctccaaggtcaagcactagccaccacagccgcctaaagacagacgcaagatgacgtccacaacggacacgcaacgcaaggccgccccccgcatgcagaagcgcgtgcggggggcggcccgcgccgttaggggcgatcttctcccccggctcctcccccgaatcgcgccgtgcctcgccatcgtggcggtgaccgcgctcatggtgggcatccaggcgggcgagaagagcgtgctcattggcacggacaccacctttcacttccagcgcttctacgacgcgtacatgcagctgcgcacgggcaggttcagctggttccagaccaacttcggcttccagcagtgcggccgcgtggtcaacgccgtgtacggcccgctcttcgcgtacctgatgggcgctgtgcttctggcgtccggcacgtggctgcgcttccagatcgtggtcaacgcagccgcctacctgctctgcggtctcggcatgtacgccttctgccggcgcgcccaggaggcgagccttgcatctgcctgcgcgacgcgcggcatgtcatacgcgggcgagaaggacggccccctcgccccgcgcgcggtgtccgtgcgacgcatcgttgcgtgcgccgtcgccatcgcctacatgtgcgtgggctgggaggcccgctggcagaccaactccaacatgggcgcctggggagcgatcctggccccctaccttgggcttgtctgcgtgaggatgctggtgcccggcacgcgccgccgcgacgttccggccagcgggcgccacacgggcacccgcccgcgcgtgggcgtgctgagcctcgcgctggtggtggcggtcatggcgcagatccacctgatgagctgcgccatgttcctgctggtgcttgtgccgttctgggtgctgggcatggtgcgcgccacgcgccccggcgagcgccgcgacatgctcctgcgcacgctggctgcggcgggcgtggccctggtgctcacggcggacgtgtgggccggcctggcggaactcatgctcaagaaccacacggctcagcccgtgggcatgatgctgggggcgggcgccctcggccttgacctggggctcttctccaaactgaccatcggaatcctgccgcttgcgctgctggccgtcgccctcgcgtgggcgtggcgccgccacgacgccgtggcgctgccgctcgcggccgtgggcgccgcattcctgctggtttccagccggctcgtgccgtgggatgccatcggcctggccgcgcccgcgctcacgcacacgatccagttccccgtgaggctcacggccatggcgtacccgctgctgtttgcggcgctcgccgtggcactgggcagcctggcgacgcagcccgaggccacgccggcacagcccgccgcgggcgagaagcccgcgcgtcccgcgcttctcccccacctcacgcgcccgcgcctcgcgctcgcggcgtcgcttgcgcttgcctttgccgcggtggtggcgcaggcgggctgcgtggcgtggatgtcgcgcgcgttccacgaggacttctcgtacgcccagaatgtcatgtacctgacggacgcctccgtggcggacctcaagcgcgcggccgccacgggcgagccgggccggctcatgggcatgatatccaagcgcacgcccgactacctgcccaaccacaacctgacggacgcccacggcctttccgcccagtaccaggtggaggtcctgggcgcgcacgtgacgggcgcgtttggccacagggttctggccgatggcgggctcgagctcacgtggaggcaggatggcgacgcgcgcgtgcgcgtgcccgtcatcacgtacacacagagccaggtcaccgtaaacgggaggcgcgtcgcggcagacaagctcaaggttgaccgcatcggcatgcccacggtgcggggccgcaagggcaccaacacgctggtcctgcgcttccaacccagcgcggcaacgtgcgcgttgcttgtgatttctatagtcgcgtgggtcgcgctcgccattgacgctaccatacggttgcttaaaagccgtatgtctattcgtaatcgtgcgtagcggccgcggccccgcacacccaagcctggtgccacaaccagacgccgaactgaggagagtcaaaccatgtgcaaggtcctttccgtcatcgtgccgtgctattttgagcaggagtgcgtccccaagttctacgaggccatgcaggccgtggcgccgcagctcaagggaatcgagctggaatattggttcgtgaacgacggctccacggacggcacgctgttccagatgcagaagctgcaggagcaagaccccgcgcacgtgcactacgtgtccttctcgcgcaactttggaaaggaagccgcaatgtactgcggcctgcagcgcgccacgggcgactacgtgaccgtgatggacgcggacctgcaggacccgcccgaccttctgcccaagatgttcgagtacatcgaccaggggtacgactgcgtgggcacgcgccgctcggaccgctccggcgagccgccgctgcgctcgttcctgagccgccagttctacaagctcatcaacaagatatccgagacagagatagtggatggcgcgcgcgacttccgcctgatgacccgccgtatggtcgacgcggtgctgcagatgtcagagcgcaaccgctttagcaagggcctcttcagctgggtcggcttcaagacaatgtacatcccctaccacaaccgcgagcgcgtggccggcacctccagctggaacctgcgcagcctggtgcaatactcgttcgaggggatcatcaacttctcaaccgcgccgctggacatggcgttcacggtgggcctggtgctctcgctcctcgcgttcttgggaatcatcttcctgatcgtgcgctggatcgtgctgggccccgtggcgcacaccggccacaccgcgctgggcatgctcatcctgtttgcgggcggcctcaacctggagttcacgggcgtcgtgggcaagtacgtgggcaaggtcatgggcgaggtcaagcagcgccccgtctacatcgtggaccaggagcgctaggctcggcccatcccgcgcacgcgggcgagaagaacggctcccctcggcagaaatgtgcaagctaggcagcgggcgcgctgggcgttgaacccggcgcgcccgctcttgtgcgcagataagtgcaagcttgcggcaacccagcccggcgaccgccacagccgttaccgcccgatgccgtcgcttccgccacgcgcgcccgcaatcgcacccagcccacgcgccgcgtacggcagcagcaggatgaaatacacgaacgtgtactgcgactttgcctcccacaccaggtggaacaggaacccgcccaggaagataaccagcagagtcagcttccgcgtgtcgccatcgccccacagtgcccagatacccaccacggccgcaaggtagatgacagactggtacacatccagcaaaaagtagaccacgtccgacgccgcgccgtggtacatgcccgcaaccagaggatggcgcgccgcaccctcgcgcacggacgcgagcgcgcgctcgtgaagctgggccttggtctccccgggatgggaccccaggttgccagcgccaaagtccagcgtggtccagaacgcctcgaacgtgggctcggcccactgtgacgctaccttgcccgcatagaagcgtgccgcacgggccgggctggaccacagcgcatgggcgctctgccgcgcgtcgcgctgggcggccacggtcatggctcgctgactgccgtgttcgcgcaggtacaggtcgcgcacgtagccgtcgtaccagccgggcgcgcgcgacgagtcgccgtgcatgcccatggcgatccacgccaccttgggcgtgccctcgccaatcgtcacgccctgccgggcctccagcaccgctgtcgggaccttggccgccagcgcgtatgccactacgcacgccaccgccggcatcagccgaagcgccttggcgtgtgccccgcgcccggcaaacgcgcgcaccacgcacacggccacgacccccagcacaaagatgagcgagttgagcttgaccacgagcgagaagaacatggccacaaagcccagggccagccgtgcgacgcgcggcgccgtctcggctgcggccgcgggggccgcgtccttctcccccgccgcaggggcgtcatacagcagcaggtagatgccaaggagcgccagaaagaggctcgggacggtgccgtaggcaaagcccgcgtacacgggcaacggcagaaagacgacaagcagggccgcgcagacgcgagacgtgcgcgcccccgcaaagattcgcgagcagaagcggcgcaccagcaccgcgatgccgccgcacatgagggcgttgaccactcggacgcccacgacggcaagctttccgccaagcacgcgatagaacgccgccgcgtagagcgtgtagccaatctggtgagggtatcgctgcaggtaggtgaggttgcgtagggcccggccgctcgccatgtcgtccgcaaggcccacgatggtgccggagtccccgcgcgcaggcgcgtacatgagcgccacccacaggagccccagcgccgtgaccacgaggaagagcacgccgtcgtaccagcgctcggagcgggacgcgcgggccgccgtcggctcgggcgcgggctcagccttggcactggcgcgcctgcgccccacatatgcgatcagcgcgacaaccgcgaccgcgcacacgcccgaggcgagcgcagccatcgggaagtttcgcacgagctccgcacgcgtgttgcccactcggtacgacgtcaccagggacgcaaaggccagcagcgccaccacaatcgcgcccagcaccacggccaggttgttcatcacctgcgcgaaccgctggcccggcgccttgcgcgcgctggccgaatccgccttgtctagctgcattggagcctcctgaatccccgttgcaaacgaatgcatgctagcacttgcgggtggccgcccgaccgccggccgcgtaatgcgcaggtacggtgacgcgcccgtcacgccccgcgccccactactacgcaaaacggcacggttaagcccctcaaaccaggcctaaccgtgccatcctgcgtgcaaatctcaagcgcgtcgaacctcgcccgtgccgcgcgccgcgccctaccccagcagctccagcaccttgcgcttgcagtccaaaaacgccggcgtcagcgcaaagtccgccggggaggtcccgtcgctcgggcgcggcacggccagctcggcctccacgcggctggggacgcccgcgcggggatcgccctgcagcacgtagatgcggtccgccatggtgacggcctcgtccacgtcgtgcgtgatggccagcgtcgccatgcccagctcacgcgacatctggcagtaccagctgcgcatgtccgtgcgggtcagggcgtccagcgcgctgaacggctcgtccagaagcgtcacgtcgttccccatcaggtacgtgcgaaggaacgccgcgcgctggcgcatgccgccggaaagctcgctcggccacatgcgctccgtcccggccaggccaaagcgctcgaacagcggctcggccttggcgcgggcgtccgccgccggcatgcccgccagcaccagcggcaggcacacgttgtccacgatccgcttgttgggcagcagcaggtccttctggagcatgtaactcacgtgccccggctggcccgtcacgtccgtgccgtggagaaggacgcgtcccctcagcggcgtggtgagtccggacagcgcgtggaggatggtcgtcttgccgcagccggagcggccgacgaggcacaccacctcgccggcacccagcgtgagcgacacgtcctccaccacgatgtgctcgccctcgtcccagctcagggtgaacccccgcgcctccagcgccggcaccgcggcgccgccagcgcccgcaccggcgccagccacggcgtccacgtccttctcccccgcgtcagccatgcgcgctaagcctccaggtagtccatggtccagccggagttcacgtccagcttgttctcgaccaggttcttgtcgttcagccactcaaagtagcgcgcccagcgcgacttgtcgataacgccccaggtcttggcgtcggactggtactgctttgccaggtacttcgcggatgcctgcaccagcttgtcactaagctcgggcgcctccttcaccaggatcttgccggcgtcggcggggtgcttgatggcgtactcgtagccgcgcttggccgcgcgaacgaaggccttcacgacctccgggtgcttcttggcaaaggcgtcgttggccgcgatgaccggcgtgtagaagtcgaacaccttgtccatgctcacaaagctgaagtagttgacggggtagttctggaccttcgcgttctgcacggcccagccctcgtacacccacacgcagtcgaacatgttggccttcaggcccgcgacctcgtcgtccacctcgtacggcacctgcttgagcttggagtagtcgccgccgtcggattccatcacctgcttgatggtggcctgctccacgggcatgttccacgtggcgtaggtgtggccctccatcttcttggcgctggtgatgccgtcagccttgcggctcatgatgccgctcgtgttgtgctggatgatggccgccacggcctcgatggccacggggttcttggagctcagcgcgttggcgatgtagtcctggtagctcacgcccagctgcgcctggccagagccgatcatggcctcggccgtgccgtcggccggctgcacgatcttgaccgtgagcccctcgtccttgaagtagcccttctcctgcgccacgtacaggcccgtgtggttggtgttgggcgtgtagtccaggcagaacgtgatcttggccgccgatccggacaccttcttgtccgcggtggaggcagacccgctcgcgcttgagtccgcgcccttgttgctgtacgcgccgcagccagccagcgccgccgtcgcggccaggacgccggccgccttcacaaacccgcgacggctcatgtcgcgctcgaaggcggccctgtgctccgccatggtatacggacgagaagagccaaaaccaaacttgccagccatcaacggccttcctttctttccgcacgcttccagggcatcgcgatgcgctggagccagtccaccagccccatcagggccagggacagaacggagatcagtatgatgaccgcaaacatgcggtcgtatgcaaaagacttgcggacgcgcgtcatgtacacgcccagcccgctgaagccgcccagccactccgcgatgaccgcgcccacgatggcgtaggtcgcgctgatgcgcaggccgctaaagaactggtccagcgcggcgggcagcttcaccttccagaagatctgccaacgggtggcgttcatggtgcgcatgaggtcgatcaggtccgggtccacgctgcggaacccgctcaccaggctcaccgtaatcgggaagaacgtggagatcaccaccagcaccaccttgggcgccaggccatagccaaaccacagcaccaggagcggcgcgatggccacggtcgggatggtctggctcacggtcacgatggggtccagcgccaggctcacggtctcaaaccggtccatcaagacggcaaccacaaagcccacggccgtgccgatgaccaggcccagcgccgcctccgtcagcgtggccacgctgtgcatggccaaaagggacgcgtccgccaccagcgcgtacaccacctgcacggggctcggcagcaaaaagttgggcacgatgccaaacgccaccacggcctgccacacgccaatgatcacggcggcagtcagcagcggcaccacgacccggcgccgcttcgcgcgcctgagtgccgctttacggcgagaagaacggtcctcctgccccgcgtgccctgccgttggctgcgcctccgttggccgcacctccgccggcgtcccaacctgcgacgcgccgtccttctcccccgttggctcggttgccacctaggccacctggcccttcttgtgggcaaactcgctgtccgtggggtggtacttgccgatcttgtggtccgtggacatgacgtcgccgtc

SEQ ID NO: 187 - DNA, 1024 bp, Unknown
  Metagenome-assembled genome
cggacgtgttgtacatcacgtcgatcttctcgctattctcgacctgtctctgtaccgaggcctgtgcgcgcatgtgatccttgcgcacgaccatcgtgaccttgttggcgaacttggtgaggaacagtgcctcttcggcagcggagttccctcccccgactacgaacacttgtttgcctctatagaacatcccgtcgcacgtcgcgcaatacgagactcccctgccagcaaactcctgctcgccctcgaagccagccttcctaggcgtcgcgccgccggacacgatgacagtctttgccaagtacgtgttctcggacgttaccacgacaaagccgtcgtcacgcttgctgatgccgttcacggactcgaggcgaatgtcgccgccaaggtccttaacttggttttgcatcgcgtctaccagcgagaaaccgtccgtgtgaggcacgcctgggtagttgtcgacctcgctcgtaaggataatctgcccgcctaccgcctcctgctcgagcactacattgtcgagaagtgcacgctgcgcatagatggccgccgaaaggccagcaggaccgccgccgatgatcacgaggtccttcttgatactctctgccatatttgcctcccttttcgctccttgtacgacgtgagtatacccagattttaaatcgcgcacaatataatcggccgcatataaaatatacacgaccgatcgaaatgctatgttggctgccgttctctgaccgctagtccgcgctcttctcctctgccgcctcctcggacttcacgggcagaatcaggttcatgatgatgcctaccagtgcagacgtggccatgccgggaagcgagtagttcccgatgggaatcgaaatgccagaggtctccattccgactcccaggatgatcaccacggacgcaatcatgaggttgcggttctcgtcaaagtccactttgttggtaacgagcatcctaaggccgttggacgcgataaggccaaacagcagcagggagacgccacccatgacgggga

SEQ ID NO: 188 - DNA, 4557 bp, Unknown
  Metagenome-assembled genome
ttggtgcgctgtgcgggcgaagggcgctagttcttctcgcccgcgttggtggcgtcggtgtcgttggaggcgtcgtccgagtcctcctcgggttcctcctcgtccatgcgcagcggacggaagctcgcggtgtcgccaccgatgacggagtgctcgacctcgacggcgttggcctccgtgtcgcgcttcatcttgtctgagaagatgtcgtcgtcctcggtggactccatgggcccctcgacgcgcttcatggcgccggagttgctgggagcgagcgacgcgacctcgctgtccgggacgcgcgtgagcctgtgctggcgcttggtgcgcgcgaacaggggcacgtactcgtagatgacggaggagttctcgaggccgtaccagcgggcgggcgagccgcagacgtggcggatcatgtacttgatctccatgatgcggcggttgaagccggagatctccgtctcgggcgtgaggaccttgcggacgaggcagaagcggaagtcgcccacggtggagtgctcgcggtagatggagtagcggtgctgctgcggggcgagctggccgcggctgacgaggtcggccacgatctggtacaggtacgtgttgacgcgctggttgaccttgaagccgaggcgcagctggaccttgaagaggaagtccgtgccgtagttgttgacgatgaactcgtgcgtgttgggctcgtcggtcaccatcacgttgaggaagtagtaggcgcgggcacgcttggggcgcttgtccaggattgagtagaggatgtcgcggtcgagcttgtcgggcgaggagtcgttggtgaggaagaccaggttgtccgcgatgatgggatacgtgtcgtcatcgcgcagctgcgcgatctggtcgatgtacttgctcacgggcaggtagacggactgcgtgtgctcgattgccgtgccgcggcgccacacgtacatgacgaagaagatgagcgtcgccatgaggacggtgaagtagccgccgtggaagaacttcgtgagcgacgagaagaagaacatgagctcgatcgcgccgaagaacaggacgaagagaagcgccagaccgtggcggttccagatcttagagatgtaggtgtagagaaggatggtcgtcatgagcatggtgaccgtgatggccaggccgtaggccgcctccatgtggctggagctcctgaagagcaggaccacgaagatgcaggccgcccacatgatgttgttgacgagcgggatgtagatttggcccttggtctgggaggggaagttgatcttcatgtgcggcatgaggttgaggtggatcgcctcgctcacgatggagaaggagcccgtgatgagcgcctgggaagcgatgatggaggccatggccgagaggacgacctcgaggaagcggaggttctcgggcacgatctggaagaacgggttgaggtcgggcgtggcggcgagcgccttggaggcgttgtgcgcgaggatccaggcgccctggcccaggtagttgaggatcaggcacagcttgacgaacggccaggttgcgtagatgttgggcttgccgacgtggcccatgtcggagtacagggcctcggcgccggtggtgcagaggaagacgttgccgaggaccatgaggccggcggcgttgatggagccgtcgaacaggaagcggatgccgcgcagcgggttgagcgcgcggaagacgttgaggtcgaggccgatgttgaggatgccggtgatgccgaggaagaggaaccagatggtcatgatggggccaaaggccttgccgatggccgaggtgccggcgcgctgcacgacgaacaggacgcacaggatgatgatcgtgatggcgacgacgatgttctggttgttgccgatgatcgcgtagaagaagtcgatcgtgcgaaggccctcgatcgcggtggtgacggtgaccgccggggtgaggatgccgtctgccaggagcgcggcgccgccgatcatggcggggaagatgagccacttgccgcagcggcggacgagcgagtacagcgcgaagatgccgccctcgttatggttgtccgccttcatggcgacgaggacgtacttgatcgtggtgatgagggtgagcgtccagatgatgagggacagcgcgccgagcacggtgtcctcgcccatcgtcgtgaggccgccgttgtccgccatgatcgccttgagcgtgtacatggggctggtgccgatgtcgccatagacgacgcccagggcgacgaggatcattcctgccgacaggggaatgcccgtgtacttgcgccgcttgactcgcgcgcccttgggcaaagacggcatgttggtgtttgacatagcgctccaatgtcaatcgagtccgatgtccgctagggccacatatgcgcttttatacccacgaagccgcgatggggcttgggtttgcggcagacgtgcgaaagccgtcgcgaacgacatacaacgcgaaatcctagcactgaacagggcagaatgctcgcggggcacgcaggtgacacacaactgggcaagtctgttccacctgcgtgacgcgagggcggtattgcatgacgagaggcttacggaagcgtgacggtggagacgccggcagcggtggactcgcggtggggctttgcatacgcggccgcctgggttgcatggcgggcgtagactgtccttcggaaatctgcaccgggcgggccgctgcgtggttagcgcggccccaggacgaaaggcacagctcatggcagaagagaacgctagcgagaccccgacgggccagacgcacacgaagatccaggacgccttcatgtcggttccggccgacgcggtgacgacgacccccgagccggcatcggccgacctgacgtggcgcggctccaaggagaccgagggcgaggagattgactaccgctgcacggccgcgcacctggacgtgcgctccgacacgggcaagctcgtgggcaagatgttcagcctcacctacgtggcactgggcgaggacggcagcgcgagttcttctcgccctgtgacattctgctataacggcggccccggctgtgcgagcgtgcccatcaactttggtggcgtgggacctcgccgcgtgaagacggacggcgtgagccaccttgcgtatcccatcgaggtcgaggacaacccctacacgctgctgcgcgagtccgacctggtgtttcttgacgcgctgggcaccgggttctcgagcctggcagccgacgccgacacgaagaaggtctttggcactgacggcgacgccgacgcgttctgccgtgccatcacgacgtggctcgaggagaacggtcgctgggggagcccggtgtacctgtttggcgagtcgtacggcacggtgcgcaacgcgatcctgatgcgcctgctgggcgagcgcgacgtgaaggtcgccggcgtgacgatgctctccgcgatcttcgattgggtgcaggtgcttgagggcgaggacctgtatcacctgggcatgacgccggtctacgcggcgacggcgcactactttggcaaggtcggcgcgggcgaggacccgaacaggtggtacaaccgcgcgctgaagttcacggaggacacgctggcgcctgcgctgctgaagggcgaccgcctaagccgcgagcgcgaggcggacatcgcctggcagtactccgagctgatcgggcttccgaccaagcacatccagcgctgccacctgcgcatcacgctggacgacttccgccgcaacgtgctgctggatgacgggaaggtctgcggcaggctggacacgcgcttctcgtccgacgcgccctcgtttgtgcagaactcgtccgagtggtttgcgggggaggacgccgcggacgacgccgtggagtcgagctggacgacggcgttcaggagcttcctgcgcgacgagctggggtaccacgcgccggctcgctacatctcgagcaactacgagcaggtgggcgtgaactggaactgggagcatcgcgagcctggcaggatggaggcatcctcctgccccaactttgcgacggacatcgcttgcgccatgcgccgcaacccgcacatgaaggtcgccatccttggtggccgctacgatgcggcgaccccgtactggaacgtgatgcatgacatgagctgccagttcctgggcgacgagctgaaggagcgcctggagtggcaccgttacggctgcggtcacatggcatacgtcgacgtgccgaccctggcgcagatgagcaaggacatggagggcttctacagcaaggcgtagagttcgattccaaacccggtgtgctggctatgaccggcacaccgggttttgcttgctaatggtattcattcccagtctcggccttgctgtctctgccgtcgaggtagttgatttactccgattgcatgaggcgggagattttgagtgtttcaagccgcccaattcgcttggctctagtcagctgcaccattgattgagggtctacataggtgggaaacactcaatgctcttgtctgccgtcaagtttgctggggttatgtgtgtttgaggttgtcggaggggattcataaa

SEQ ID NO: 189 - DNA, 5573 bp, Unknown
  Metagenome-assembled genome
cggccgtcacgagaggcccctcacgaagtcggcggcggattgcagctgcgcgtccgaggggtggccgcggaagtagagcgcgccatcggccacggggatgcccttctccaccagggcgttcttgatgaggtcgatggcgtgcctggacacccacgaggtggagaagaccgcggccttgcgcacgagcgcggggtcgagcgactcgaggtagcccttgaggtgcttgtcgatgccgtaggcgtacagggcgccgcccacaaagaggacgtcgaccgactccgtgagcgcggcgtttgcggcgtcgaccgacacggcctccgttccggctgcctttgcgaccgcctccgcgacggccttggtgtttcccgagcgcgagaagtacctcactgctgcgttcatgcattcctccggttctggttggcgcgcccggccgcggtcgtacggggcggtgccggcggggcgcgcgtttgacagttggcttatacccagcgcgtccgcccgtgcggcttgcctataatgtgtgcgttacattgcgccccaagggaggtccaaggtccatgctgcccgtcatcctgatagtgcttgccgccatcgtcacgctggtggtgctttcctcgcagctggtgtggggcctcgtgctgggaacgcttgccagcctggtgctagcggtgctttcctacgtgggctatcgcaaggtgagcgacgccaggcccacggagcgcgtgtgccccgcctgcggcagcacaaacgtgcggctgcgcgaccgcggcgtggaccccgaggcgtcgcactccggcttctgggacatcacgggcgccatcggcaacgtggactttggcgagctgattcagtgccgcaagtgcggccacgcggagccctacatcacgggcgaggcgctcgtgatggcgcgcgaggactgccgcaagcgcctcatgttctgggggtgcgtcacggcggtgtgcgcgctcttctcgctctggatgctgtttgtctgacgcggcctgacgctgcctgacgcgcgctgggtccgcgggggagaagaacggcccccgcgctagatgtcctcgtcctcgtcggtgtcgcgcacggccaggcggtactgcttgggcgtgatgccgcactcgcgcttgaaggtatttgcaaagtagggctggctcgagaatcccagcagggcgcttatctcgctcagggagtacttggtgtagtggagcaggcgctttgcctcgtccatgcggcggtagcgcacgtactggttgatggtgagcccggtctcctccttgaagtgcttggtcagaaacgacgtgctgcagccgatgcggtgcgcgagctcctcgatcgtggggacgttcgcgaggttgttgaccacgatcttgatgcactcgtgcacctcggggctgatgccgctgggcgtgcgcacgctgttgacgatggtggccacgtccatcagcatcgcgttgagcagcgtcacgacctcgacctcggagttggcctcctcgcatttagccacgtaggcggaaagcatctgcaagccaagcttggtgccgatgccgcccggaatggcgccgtgcaggaacgtctccgtcgcgtccacgatgaactcgtccttcgccatgcgcaggttgccgttgcccatggtggcggaaagctcgttcaccaggttgtcgtggtacgtctgcgttcccaggccagaccagatctcgtccacggcgccctcgcgcaccaggcgcgtgatgtcgttgcgcacgagcatgctctgctcgatggagaagctgtcctgctgccgcgacgcctcgcggtgcacgtcgttgacggcgtcgaggtcggtgatgtccgtgatcgggtcctcggaggtgttgttggcaagcaggtggaaaaaccccacgagcgcgctgaagcgaatgaaattgtagcgcgggatgcgcgccagcagcggcgcgacctcctcgcgcctggtgacggggatgcccacgaggttcatgaagtgctccagcacgagcccctggcgtcccagcgggaaggttggcccaatcacgaactccaggccaagcgcctcgctccgcacgtagccaaacatcgcgtcgtcgtgcgtggagtaggtggtgaagggcctctccaacgcgcgcagggggagaagaacgaacgcgtccggggtgatgtccgatgggaaccccgagctcgcgatacgcgtctggccccgccagcacgcgatggggatgccgtgcgacgcgaggaagagctggcagaggtgcgtcgccacctggttggggtcgagcccgcttggcggtccaagtgtggaaacgttaccagaatcgtttgcggtcgctaccatgtgcgctcctgtgaactaaaagtgagattaaatcagaatttacaactatgtggcaaaaataatattacacacgcccccgcgattgtgataatcaaacacgtcaatcgggcggacggtcgtgcaaaagcgcacgtagtccctatcgggggagcaaaaatgaggtatctcgttctcgtgagtcacggtacgtttgcacaaggtctccactctgtactgaagatgctcgcaggcgaccgcgacgaggtgctcagctgctccctcaaggagggcgaaggcgcggacgagtacgttgccgagctcaagcagaccatctccgtcataggtgagaacgattccgtcttcctgtttggcgacatcatcggcgggtccccgctgacgaacgcgatcaacacgatcacggaggccggcctgcttccgcgcacgcgcatcttcggcggcgtgaacctgcccgccgtgctgacggcggcgctctcgccggaggcggacgacgactcgctcgcggctgacgtggtgagcgagggtgccgccgcgctgcaggagttcgtcgtgaacgtcgaggacgacgacgaggacgacctgtagccgccacgggcagacctctggcagaacatgcgcgaagctgagtgaagtcgttcttctcacctgctgagagtcaaatagtctgaaactaataccttctaccttgccattctagtggtctttggtactgccaggcttcctaccggagcctgtgggggactgtacgcattttcgtgaaaggggagtacgtatgatttcgtttgtgcgcgttgacgaccgtatgatccacggtcagacggtgaccaggtggtcgctggagtatccctgcgacggcatcatcgctgtgaacgacgccgctgccaccaacccggtgctcaaggccgcctacaagggcgccgctcctgagaagaagatcttcgtctggacgatggagcacttcctggccaaggcccagaaggttctggactccgactccaggtacttcctgatcaccaagaacccgatcgacatgaagaagatcctcgtcgaccacaagttcgttccgtccgatgtcaagcgcgtcatcatcgggccctgcaacgatcgtcccggcgccgtcaagctgggcaacaaccagtccatcacccaggaggaggcgcaggccctggaggacatcacgaaggctggttacaccgtcgagttcgcactgatcaaggagaagtccattggcgagtggccgaagttccgcgatcagttcgacgtcaagtaagtctcgtcaccggaaacgaaaggcagagtgacacgtatggccattaacgcgttccaagccgctttgctcggcatcttcgcatgcctggcatcgctccctggcatgggcggcaccacgatcggtaactacaccctcggacgcccgctcgtcggcggcctcatcgtcggcatcatcctcggcaacgtgcagctgggaatcatcgtcggcgcggctatccagctcgtctacatcgcactggtgacccctggcggaacggtctccgctgacgtccgtgccgtcacctacatcggcatccccctggccatccttgccatcaaggcccagggcctcgaccccaactcctccgcggccgccggcctcgccgcttcgctcggcgccgcagtcggcaccctcggcaccgtcctcttctatggcaccgcgaccatcaacctggtctggcagggcatcggctggaaggcaatggagtctggcaactggcagaagatcaagaagaccatccccatggtcgacttcgtcctgccctggatcggccacatcctcttctccttcctccccacgttcatcatctgcatggctggcgctcctatggtccaggtcatgaaggactacctgcccatggacggcatcgcgatgaagacgctcttcaccgttggttcgctccttcctgccgtcggtgtcgcaatcctgtgcaagcaggtcatcgacaagccgctcgactgggtcatcttcggcttcggcttcacgctcgctgccgtcatgaagtgcaacctgatcgcatccgcgctgatcgcagtgttcttcgcactcatgaactatgagatccagcaggccaaggccgccaagcccgcaatcgccgatgcttcggctgccggtgctgttgacgacgacgaggaagatgaggacatctaatggctgagaagaagaagctttcccaagcggctctcaagaagagcttccgcaactgggcatacagcaaccttacctgcttctcgcaggagcacatgcagaccttcggctacctggtagctatgctgcccatcgtcgacgagctgtatgacaacgacgaggacaaggtcaagtcgctgcggacctacaccacgttcttcaacaccgagccgcagatcggcaccctggtcgtcggcctgaccgccggcctcgaggaggcacgcgccaacggcgagcccctcgacgacgagaccatcaacggcatccgcgccggcctcatgggcccgctcgccggcctcggcgactccatcatcgtcggtaccttcatccccatcctgctcggcatcgccctcggcctttccaccggcggctccgtgctcggccccctgttctacatcatcgcctggaacgtcatcatgtacttcggcatgaagtacgcgtacaaccagggctacaccatgggtggcgccgccgtcgaggcgctcgtcggcccgcagtcagctgcactgcgtagctccatcgtcatggtcggcaccatggtcatcggcgccgtcgccgctacgtggatcagcatcagcacctcgctgaagttccagttcagtgcgaagagcgcgttcgtccttcaggacaccctcgacaacatcttcccgaaggccttgaacttcttcttcgtgtggctgtgctggtggctcatgaccaagaagaagatcagcccgaccgtcgtcatgctcatcctcgtggtcatcgcattcgtcggcgtcctcgttggcttcttcaacccgggcctgaagtactagtacttggaatcgcggtctactgcgtgccgcacacactgggagggagtgtgcggcacgcggaacggcccccacaggcagccggcctcgtgcaagtttgcaggaggccggctttctttagggaccgatctacggatgccgtacgcattgcaaggccatccgcattcaagcgagtcgcatgcgcgtaagggcaactggcgggacttcggctatcctcttccaaggaagagaccgggag

SEQ ID NO: 190 - DNA, 12314 bp, Unknown
  Metagenome-assembled genome
gaccatgcagaactcctggcctggcttgaggggggcaccgcatttgggacagaacttaggcaacatggcactcctggcgacgttccgggaagattatgaacgaaggctgaagacagtatgtcacctcccatcatgccacatgcgctggcgttttggggagcacgcggaacccacacggccgtacgggcgccttgtacgggggaaccagaggttccctcagggggagaaggacggtcctacttcttggcggccacgctcagggtgacggtcgagccgatgtcggccgaggtgcccaccgagggcgcgaccacggccacggtcccgggggtgagcttctcgtccaccgtgtcgcgaccgcgcttgctcttgaggcccatgcccttgagcagcgctgtggcatcctcgtagctcatgccctccacgtccgggatggtgacggtgctcttgccgtcctcgtccgcggggccaccgttgtcgccgctcgggctcggtcccgcggacaccacgaggtcgatggacgacccgcgcgtcctcttgcttcccgcaaacggtgcctggctgatgaccgtgcccgcgggcacgctgctggagtatgcgtacaccacgtcgtcctgcacaaagaagttcgtcgcgaggatggcgttggcggcgtccgccttcgtcttccccacgaggttgggaacctcctgcgtcttctgcgtcacgacgcccaccacgatcgtgacggtcccgttgtgtgaggtcgtctcgccgtcggcagggtctgtcgccagcaccctgccgtcgtcgtccacgttctgcgtgtcctcctcgcgcacctccaccttgaggccgcgcttcttcaggagcgccttcgcgctctcctcggagtagcccacgacgtcgggcacctcctgcccggcaaagagcccaaagcacctcgtgagtatgagcgacgacccaaacagggctatggcgaagacgagaaggacgatgcgtatggccccgcggtgcctcttggcccagtcggacacgctctcgcgctcgtgcgaggcgtacgccgcgtgtggcttcggcacgtaggcgttgtcggacgctgccggtgcgtcgggggtcgtggccgcttccgtggtggttgcatccgctgcctccacgggcggagttgccgctggttcctccgtgcccttggtgatgtcgatgggggccgtcgtctcgggcgagtcggacgtggccatgtgtgcgggggcgggggagggcgcctcggacaccgctggtgctgccggtgccgccggggcggcgtgcttgggggccgcactgtcgggcgtcgagccgtcccgtgggggaacgcctgtgccaagcgggctggcggagctgtccgggtcgttgccttcggtcacgggatcaccccaaatcgtcacgaatcaatgtgcccattttaattcatgattgcgattatgcgaaggtggcgaaatgcgggcagtcccgcgtcgcgtcagtcgtccagcatgagccgcaggaccacctcgaggccctggcgcaggctcttcttctcgatccactcgccgcgcgtgtgcagcttggcgccgcgcacggtgccgatggtgttggcgggcacgccgagcgagagcgggatgttcgcgtcggtcgatgccggcttcaggtccggctcctggcccgtgacgcgcttcacgatgcgcgcgctgcgctccgtcatccgcttgagggcctccgcgtccacgccctgcgcgctcgggcgcacgcccagcgtcgtgacggtgaccttgcccgcctcgtcgcgcagcgcgagctctcggcggtgccgctcgatcacggcgttaaagaaggagcgcatgacctcgatgttctctgtggaggaggagcggaactcgaacttcgccatcgcgtgggaggggatggagttgatggtggtgccgccctcgatcttgcccacgttcatggtggtgtgggcgccgtccatcacgtcgatgggcgggttgatgcgatagaggtcctcgatgatcgagcagacctcctcgatggcgttcgcgttgccgtagtcgtggtacgagtggccgcccgtgcactccacgtcgatctggtagcgctcggacgcgacgcagacggatatgcactgcggcaggtacaggtcaaaggagaagtacctgtcgacccactcgcccacctcgccaaacaggtcgcgcgtgccgtccaggttgcccaggccctcctcgcaggtgttcgccacgatgaggatgttacccttgcgcgtggcgcgctcgcgggccagggggttctgcagcaggaactttgtcgccatcagcaggttgacgaggttcgcggtgtcatcgcccacgccgggcgcgtacatgcgctcgtcgtcctcgcgcagcggcagttcgtcctcgtccgcaaagacgacgtccatgtgggcggcgtacatcgtgagtgtgcggttcttcacgtgctcggccagggtctgcgcgtcgccgctcgccttgcgctccgcacgcgggttcgcgagcaggcagatcacgttcttctcgtcgtctatgcgaacgtagcgcgcgccgtgggcgtggagccatcccgcgatgaagctcgcgcgccgctcctcgtggtgcgacggcgcgggaatccgcgcgagcgtcctgagcagctcgagctcctctgcgtgcgagtcacgcacgtagcgcctgatcgcgttggcgaaaatgaggtccatctacatcgctctcctcacggcatccttccagccggccagaagtccattcacctcgctttcatccatggtaggcgtaaacacgtcgtcggaggacctcagggcgagaagttcatcggtcgagttccagaagccgcttgccaggcccgcgaggtacgcggcgcccagggacgtggtctcgatgttcttggggcggcggatgctggcgccgaggatgtccgcctggaactgcgtgaggaagccgttgcgcgaggcgccgccgtccacgttgagctcggacaggcgcacgccggcgtcggcctccatggcgcgggccaggtcgtacgtctggaacgccagcgcctcgagcgccgcgcgcgcgatgtgggcgggcgtggtgccgcgcgtgatgccgcagatgaggccgcgggcgtcggggttccagtagggggcgcccaggcccgtgaacgccggcacgatgtacacgccgccggtgtccggcacgctcttggcgaggaactccgtctcctcggccgtgcggatgaggtgcatctcgtcgcgcagccactggatgagggcccctgccacaaagacgctgccctccagcgcgtagtgggtcttctggcccgggggcgtcgccgcgatggtcgtcacgaggttgtgggaggatgccttggcctccgtgccggtgttcatgagcaggaagcagcccgtgccgtacgtgttcttggcctggccgggctcgaagcagcactggccaaacagggcggactgctggtcgcccgcgacgccgcagatggggatgcccgccgggacgccggggtagctcgtctccccaaagagcgaggcggagggcctgacctcgggcatcatggacgccgggatgccaaacaggtcgaggagctcctggtcccagcagccctcgtggatgttgtacagcatggtgcgactcgcgttggtggggtccgtggcgtgcacgaggccgcccgtgagcacccacacgagccacgtgtccaccgtgccaaacacgagctcgccggcctcggcgcgctcgcgggcgcccttcacgttgtcgagcagccacttgatcttgctggccgagaagtacgcgtccggaaggaggcccgtcttgcgttgcaccatctggcgcacctcgggcgtgccgcacagctcctcgatgatgggggcggtgcggcggcactgccacacgatggcgttgtggatgggctcgccggtgctggggtcccacacgatcgtggtctcgcgctggttgtcgatcccgatggcggccacgttctccgccgtgagcgcgtggcgggtcacaagctccgtcaggctgccgagctgcgagtataggatctcctgcgggttgtgctcgacccagccgggcttggggaatatctgcgggtagctgcgctggacgcagtcgaccatgcgcccggcgtggtccacgaggaccgacctggaagaggtcgtgccctggtccaaggcgatcacgtacttctcgctcatgcgacgtcctccctcttgcgcgtggccccggacctctggtcgagccaggccaggaccagctggtacacctcgggggcgtcgtcctcgttcaggatctcgtggcgcatcccctggaacagcctcacggtcacgtcggtggagccggccttgcgcgcgagctcggccgacgcggtgacgccgcggcccatgtcacccaccgggtcctcggcgccggatatgtagagcagcggcagcgcgggcgggacgcgccgcgcgcactcgggcgtgcagacctcggccgtgagctccatcagcgcggcgtagccgcccgcggagaacatgaagccgcaggcgtcgtccgcgatgtaggcgtccacgtttgtctggttgtgcgagagccagtcaaagtccgtgcggcgcgcgggcaccttcttggcgtaggagccatcggccatggcgtgcaggagtctgctcttggcgtcgtccccgcgcacgcgggcgatcaggcgcgccagggcgttgccaaaccgcgacatgcgcgggtccacgtagcccgtgccgcagatgacggcaccgtctatggcgtcgccgtggtgcgaggcgtagctgcgcaccacgaagctccccatggagtggccaaaggcaaagcacggcgtcccctccgcgcaccaggacatggcgagccgccgcaggcgctccacgtcctccaccaggtacgttgcgccgccgtgggcgggcaggcacccccagcgctcgcgcggggcgctgctgccgtggccgatctggttgtggccgcacaccaggtagccgtgtgatgcgagccagcgggcaaaggcatcgtagcgctcgatgtgctcggccatgccgtgcaccagcagcaccacggccgtggggcgctcgtccgattggtcgcgcgggtcgcgcttccaccacgcgtaccccctgaccgtcgtgctcccgtccgaggactcgaacgagacgtcgtacctcccgaccccaggaccggacatgtgcccctcctcacggctcgacctcgcatcggtcatgaagtatacgggcggtgtaaggcgcggacggcgccgcgtacgcgaagtgtcgcgagccatcgccgtgcggacgcgccgggggagaaggacgcgcgcccactgccgcggcgggccctagcgcgcgccgtccctgagcacgcggccgagcggcctgcccgagggctcccacgtggggatggcgagcgcgtccgcgttggtggcgaccacgacgttgttgtcctccaggtccgggtcgtccggcgagcaggggatcacgcacacgtgcgcgaacgttgtggcgagcgtggcgcacacgtcgcgcagcggctgcgagcgcctgccctcgagcgcggacaccacgttcgataggtagacgccgccgggcgcgagccgcgccgcgatggcgcgcgtggcctccaccgtggcgaggcctgacgcgggcacccgggcgccaaagcagtcgttcgcgatcacgtcgtaggcggcgcggccccggcctgattccaaaaacgcccgtgcgtcctcgttgtaggtgcgcaggcgcgaggcgtcctcgcccagccggtcgagcaggaagtagcgccgcgccagctcggacacggccgggtccacctcgaccacgtcgaccgtgacggcatcgtcgtgcgccacgaggtacttggggaaggcgtagccgcccccgcccagcatgagcgcgcgtggggaggcaatgcccagctccgtgatggcgtccgcaaagagccggtggtagggaaagacgagctccgcccagccctcgtccaggtaggtcgcgctctgccacgtgccggacacctccagcacgcgcacgggcacgccgtccgagtcatgcatgtccaccacgcgggcgcggccgaacatcgtgcgcgccgacgcgacgaccttccggtcgccggcgaggcgctcggccatggctgcgagccatgccacgagggcgtcctggggtcgaggcgtcatgttcttctccttaactgcgccgtgcgtgggtagaaactagcatagttgctttgcggcgcggctcgctggcgcgttgctgccgcgtgccgccgcgcgcgggcgggggactggaatcgcggggccccaagggctaccgtaggcggtgtcgcgggatcgtcccggcgccggcaggagggaatcaagatgtcgataggcctgcactgctcggactgcatcttcagttcgttctcgtacaacaaggggctggacaagtggcagggcgcgtgcagccgcggctacacgctggccgacccgcacgtgtacaccaagcccgacatgttcttcgcaaagcggccgcgcgacctggtgccgctcacggacccgtggggcaaggagtacctgcgcacggacaacatctgcaagcagttcctgcggcccacggacgccacgccggaaaagcgtcgcgagtgggagatgcgccgcgagcgcgaggcgggcgagaaggacggtggtttcgacgcttaggctggtacatggctcggtggtggaccaacgggtcgacgccatcgtgaacgccgcaaaccacacgctgctgggcggcggaggggtcgacggcgccatccaccgcgccgctggcccgcgcctgctggaggagtgccgcacgctgggcggctgcgccaccggcgaggccaaggccacgggcgcgtacgacatcacgtgggcgcgccacgtgatccacaccgtggggcccgtgtacagcgcgtcgcgcgccgggcagtgcaggcgcgagctggagtcgtgctaccggcgctccggcgagctcgcgctggggctgggcgacaggtccatcgcgtttccggccatttcctgcggcgtctacgggtacccgctcgaggaggggctcgaggtcgcgatcaaggagctcgcgtccctctcgcctaggttcgacctcgtggtgttcgcgctcttccgctctaacgaattcgagctcgcccgcgaggttgcggacgagctctatgggacgtacctcgatggcggccaggtgaccgtcaggacgtagcgggctgcgcgtgcggccccgccgtggcctaggagcgcgccttggcgccgccggggatctcgccgccgcagtgcgggcagcgcgtggcgccggccttgacctcctccaggcagtgcgggcacacgggggccgcggccttctcttcctccttcttggcgtgcgtgagcttggctgtggcctcgctgaagcggttcacgctcttgatgaggcagaacacgatgaacgccacgatgaggaagttgatgacggagctgatgaaggcgccaaagtcgatcttggtgccggggaccacgaggcccgagatctccgtcccgccgcccgtgaggaacgtgatgagcgggttgatgatgttgtccgtgagcgacgtgacgatgcccgtgaaggcgccgccgatgatgacgccgacggccatgtccatcacgttgccgcggctgatgaactccctgaactcctttacgaacttgctcatgcgctacctcctgggtcttgtgagctcgtcggtgtcgagccaaatggttatggggccgtcgtttgtgaggctgacctgcatgtccgcgccaaacgtgccgtggcccacgtggcggcagtcggcggcggcgatcctgagtaagcgctcgtagagccgcttgcccagctcgggcggggcggcgtccgtgaaggaggggcgcctgccgcggcggcagtccgcgtagagcgtgaactggctcacgacgagcacctcgccgtccacctgctcgagcgagaggttcatcttgccctccgcgtcgtcgaacaccctgaggtggaagatcttctcccacaggagctctgcctcgcgctccgtgtcatggggtcccacgccgagaaggacgaggaagcccttgccgcagcttcccacgaggttcccgtcgaccgtgacggaggcgccgctcacgcgctggaggcacgccctcactgctgcgcaccgtcctcgggctcggcctcggggagcctgatgccgtagatcgcggagaacttctgcagcaggtagtccgtgtagtacgacgcgtcgaacggcttgccgcaggcgtcttggatgagctccgaggagtccttggcgcggccgtactgccagatgcgggtgcgcagccactcgcggacgggtgcgaggttgccctgcgagagcaggccctcccagtccatcccctcggatatcatctggtggcgcagctgcgcgccgatggcgctgccgagcgcgtaggtggggaagtagccaaacaggccgtcggaccagtgggagtcctgcaggcacccgtgcgtgtcgtccgggacggtcacgcccaggtactcctggtacttctcgccccagacggtcgggacgtccttggcggttatctggcccgagaagagcatctgctcgatctcgtagcgcacgaggacgtgcagcgggtaggtgagctcgtcggcctccgtgcggatgagccctccctcggcgcggttgacggccaggtagagctggttgggcgtgacgcggccgagctgcccgcggaagtggctggccatggccttgagcagcgggcccgcaaaggcgcggctgcgccccacgtagttctcgaagaagcgggactgcgcctcgtgcatgccggcggaggtgccgcccttgagggacgtgtagttgtacgcggggttgacgccgcactcgtagagcgtgtggccgccctcgtgcagcatcgtgaacacgttggagacgacgtcgttctcgtacacgtgcgccgcgatgatggcgtagttggtcgtgagcgcgtccgagaacgggtgctccgtggacgtgacgaagagcgcgtcgcggtcgagcccctccaggtccacgaggtcgctcgcgagcgcccactggcgcctctcgtcgaagcggccctcgatcacggagcggtccggctgccagccgatgcgcctgatttccgcgtagagcggcacgacgatgcccttgacctggccaaagagctcgtcgtagaacctgcggtcgcagccgtgctcaaaacggtcgagccagacgtcgtacgggtcggccttggggttctggtggcgggcgatctccttggcggaggcgaccaggcggtcgaggtacggctcgaacgacgcgaagtcgttttcggccttggcgcggtgccagacgctgctggcctgcgcgaggagccgcgtgtgctccatctgcaggtcgtccgggatgccgaccatctgctcgcggtcgcgcgagaggaccttgacctgcgccttgcgcgtgtcgtccaggaggtccggcatggccttcaggcggtccaggagggcgcccgtctcggggttgcagagcagctccttgtcctcctgctccaggatggcctgggcctcgccgcggtcggacacggccttggccgggtcgatcgagggaccgtagcacgagatgccgatgcgcgcgtagcggtgcgcgtacaggtggcgctcgaggtcgtcgagggcggcgatgtcctccttggggttgcttatggcagccggtgccgggcgctttggcttgccgatagcctcgcggccgtcggagggctggggcgcgggggccgccttctgcctgtcgggggcggggccgtccgcggcgggggcggagccggcgctcgcgacctcctgctgatacatccgctccacggcgtcggccgcgccgaccggctgtgcgggggcctttgcctcgccgctgcctgcctgggaaccctccgcctgctgcgcgtccaggttggggccgcgctctatcttgatgtcgccgtcgtccaccggctcgccgtcgacgacgggcgccgggtcctcgtactcgtctttatgcgcgaagaagctcaggaacgagggaactgcgcccgtgcccgcggaccttcttgcgtcgggcttgcgcttggaatcatctgatgccatgttcttctccttggctgcgcggcctgcgccgcatgggtgggcgccgaccgtggcttgggtgctactgatgcacaagtctagcggtattcccgctgcccgtgagccgcgagtggttgcatttcgacgggacgcccacgtgggtcgcgggcgcgcgacgggcgttggggctcgcctgtcgacggcgtgcgattctgggcgagcgcggccgtccgttgcgcgatactttggggaggagaagatcgcgtccggcgggcgtgcgcccgcctcgggaaggagtgcccatatgagttgcgtcctgggaatcgacgttggtggtacgagcatcaaggcgggcctgttcacgcccgaggggaagctcgtggacgtgaagaagattccgacgggggccatcgacgacgagaaggccttcgccgaggtgtgctcgggcctcaacgcgctcgtcgtgggcggcggctacctgcccgacgacgtgacggccgtgggcctggacatcccgggaccggtggacgaccagggtcgcgtgggcatgctccccaatatcaggctcgacccggacggcctgaagctcgccatcaagcacgagtttgccaacgcgacgctcgccttcgtgaacgacgcgaacgcggcagcgctcggcgagctgtggcagggctccgcgcgcgacctgtcgagcttcgtgatggtcacgctgggcacgggcgtcggcggcggcgtggtgtgcggcggcaggctcgtgtccggcgcgtttggcgcgggcggcgagatcggccacatcaccgtcaacaagggcgagacgcgcgtgtgcggctgcggccgcaggggctgcctggagcagtacgcgtccgccacgggcatcgtctggctgtaccagcaggcgtgcaaggccgacggcggcgagcaccccaagcccgagcacgcgacggacaccatcaccgtgttcgacgcgtgccgcgacggcgacccctgcgcggagcgcgccatcgggcagatgtgcgacacgctgggctacgcgctcgcgcagatcagctgcgtgatcgacccggccgcgtacctcatcggcggcggcgtggcgggcggcttcgacctgtttgccgagaagctcgcggcctcgttcaggtcgtactgcctctccaccagcgcgagcgcgcgcatcctgccatgcagccttggcaacgaggccggcatgtacggcgtggcgtacgcggcgctggaggaggccggcaagcaggcaaagcagggggccgcggacaaggcggagtgagccccgcgcccgcgccgctgggaatgttaaatgaccattaaaccgtaaccaggcctgcaattggaatatttgtgttccttcatgcccgctcacggatacaattgaatcaagttaagcgtttggtacccgttgttgccaaaggagactgtaatggcagatttcgtaaaggcgtcccacgtatttgtcgctaaccccgcaaagaccgtagacgaggcactcgagttcttctccaagaagatggtcgagctaggctatgccgacgacgagaaggccgtgctggacgccttcaaggcccgcgagtccgagggcaccacgggcatgtcggacggcttcgccattccgcacgccaagagcgacgccattaagcaggacacggtcctcgtggcgaagttcgccggcgacatcgagtgggagtccatggacaagaagcccatcaaggtcgccattgccatctgcacgccggcgagcgagggcggcgccacgcacctgcagctcctgtccgacgtggccatcatgctcaccaaggagtcgttcaggagcgacctgctggcatccgacgacccggagaagatcgccaaggtcgtgaacggctgcttcgagtagcgcaacgacgcaagccagacatggggggaggggcccgaccgcactggtcgggcccctccctgcgtttgcgatggtggcgcggccgccccggcggtggcgcggccggatgcggttaggactcctcgttgcgcgagaagaactccgcagcgttctggaagaacatccgctccgcgacgtcctcgccaaagcggcctgcgacctgcgcgcggaatgcggggaggtctgacgcgccgcccagccaggacggggtcgcggacccgtcgaagtcgctgccgagggcgatgaccttctcgcccccaagctccaggaagtggtcgatgtggtagctcagctcgtcgaaggtgagctcgggac

SEQ ID NO: 191 - DNA, 2447 bp, Unknown
  Metagenome-assembled genome
gaatgaaattgacggtcacaatggaaaagcttataaatgcttcaacgtaattaactgtaattgcttgtttaataaaaagatggttgtcgtatgaccgaataaaattaatttttataaaaaaaggaagtctgatcatggataaaattttggtaacaatagtagctggtttgctagttggatttattgtttggtggttcttcggtaaacatacagctaaggaggttgcggcagatataacggataatagacaggatgtcaatgtgattgttagtggtggttatacgcctagtaccgtaattttgaagcgcggagttcctgcccaaataacctttaatcgtaaagatccatctagttgcttggagcaagtagtttttgaagattttggtatcaatgaatttttaccacagaataaggatcatgtgatcgatattgatacaagtaaatccggtgagtatgactatgcttgcggaatgaatatgtttcatggaaaagtaattgtaaaataagcaagcttattaaaaatattggaggtaatcgttatgacagataagaaacaaagcattatggtaatcgttgatggtggctatcatccagatgctgtagaactaatcaaggggatccctgcagaaatcacttttaaaagaatcagcgaaaaaggctgtgtcgatacaattgttttgccggaacttggtatcaaacgatttctgccaataaatgaacaacaaactttttcaattaatactgataaggccggcgaatatcaatttcattgtggtatggatatggcctacggaaaggtggttataaaatgaatataagaaatcgatttatattttctttgattgtttccactccaatattaataaatatggttgctagtccttttggctttgagttaccaggaggtatgtggacgcagtttctactgacaaccgcagtaatggctgtctctggtcgggcatttatacaaagtgcttgggcatcatttcggcaccaccatgctaatatggacactttagtagcgattgggactggaacagcctatttatacagcatttatgcaatgtttaataaccaagatgttttctttgaagacgcagcacttgttattacactaattctattaggacaagtttttgaagaaaatatgaaacgtagtgcatcaggtgcagtagctaagttactagatttacaggcaaaagaggcagaggttttgcgcaatggtgagattgtaaaaattccaatggcagaagttgttgtcggtgatattcttcgcgttaaaccaggtcaaaaaattgctgtagatggtgttattaccgagggtagttcaacaatcgatgagtcgatggttacaggtgaaagcatgccaaccgagaaaaaagttggcgattcagtgattggttcaacaatgaatagtacaggaacatttatgtttagagctagtaaggttggtgatgatacattattggcgcaaattgttgagatggtcaaaaaggctcaaacaagtcatgcaccgattcaaaaaaccgttgataaaatttctgatatttttgttcccgctgttctaattatcgctattctggcctttttcgtttggtatgttttacttggagctagtgtagtgactgccatgttatttactgtttctgtgattattattgcttgtccatgtgcactaggaattgctacccccacagctctaatggttggtacagggcggagtgcaaagatggggattctgattaagaacggtgaagtgctagaggcagttaatacgatcaaaacagttgtttttgataaaacaggaacaatcactgtgggtaaaccaaaggtgacggatattgttggcgatgagcaagcggtattgaatgtggcagccaatctagaaatttcttcggagcatcctttggcggcggctgttttagaaaaggctaaagagcaaggcatcactcccaatactgcacaaggtttcaaagcgattgagggtaagggagtcaaggcacaaatcaatggtaaagaagcctttattggtaatgataagttacttgataattataaacttaccgatcaattaacggctaagatggtacaactacaaagcgaagctaaaaccgtagtgatcgttggctacgataatgaaattatcgggttaattgctattcaggatgcaccaaagcaaagctcggctacagcaattgcggcacttaagaagcgtggcctacgtccggtgatgctgactggtgataacgaacgagttgctcgtgcaattgctgatcaggttggcattgatgaggtcattgctgatgttttacccggcgataaggctgatcacgttaaacaacttcaacaacaagcaccagtagcctttgttggtgatggtattaacgatgcgccagcattaacaaccgctgatgtcggcattgccatgggttctggtacggatattg

SEQ ID NO: 192 - DNA, 4238 bp, Unknown
  Metagenome-assembled genome
tgtaatcctgcggaagactccgaatgttgcgcaacatttcaggaatcggcggcaggagactacatgtatctgaaagcaggaaggggctaggcggactgccggtcacactcaggccaatcggggatgctcatgatgattaaacgcagcaatgggggcaagttaagtaagagcctgataggcaaggttcttcctgacacaaagaggggtatgaggcgcgggcgttcgctctggtcgttcattacggccattgtcgctatagcccttgtcggactgttcacgattggcgccggcgtttcctatgcggacacgacggatagcctgtccgagccggtccaccataagaccatagagaagcatctggtcaatggtgagtgggatgggacctatgatctcaagctcacggttcagggtgactccaagggaagcacggagtccaaccccgtcgacattgttatcatcttcgacaagtctggatcgatgaaagacggttttgccggaagtggcacgacgtcaaaattgacgatggccaagaacgccttgaccaacagcaagggcgacggccttattgacaaggtgctcggtagcaatggtccagacggggtgaaggtttctcttgtgaccttctccaatacggctacgagttccgattggtatgacaagagcaacgtcaataccttgaagcgcgcggttaatggaattcgtgctaacggaggcaccaactgggaagacgccttgataaaggccaaggcaaagctcgatgaagacaccactacctcaaatgaccagaagtacgtcgtattcctgtctgatggcaacccgaccttccgaatttcgaacggggttgcatatcttaaataccaaaattattctgatgcggacttgacgccatatgccaatcaggacaatgacggcgacacgccaacaggggtgaacggaaacggtaagaacgaagacttcgccggtacttataagcttgtttatgatgggtgggattcttactggaactactacgatgcttatgatgcgaacggtaataagaaaacgttccattggaactatgactcagcagtgactgccgccaagagtctcaatatggacagctcccacttctttagcgtgaaggtggctactgaagcgggcaagatggacaaccttgagaaggatgctacgaacaaccagagcgcgtccgcactcgacggcactacgcctagcaatctctcgaatgcatttgacagcatcgttactacgatcacccataaccagaaatacgcaaaggtgactatcaaggacgctctgtcaaatgatgccgaaatcgttccgaacacgactccgaccgtcagcaagactggaggcaaggacgctctccccacgggcaatacggcaactgtcgcaactgtcgatggaaagtcatcagtgagttggactattgacgagtccggaaccaacgacgatctcgagcccggggccacctatacgctcactctcaatgtgaggccaaagcaggatgcgtacgaccgcgtgatgaatggcagagtggacacgggtacgaacggaatcttctcgaacgacagcgccaacactagcctgacgtataagaccgtggcgtatacgaataacgacgaaggcacgctttcggaacagaagaccgcaaccccttacgagacgccagtaatggacgtgcctacgtccaccatcacagtttcgaaggtttgggatccggagaagagcgccctctcgtctgcaaccgtgaagctccagatgaaggtgaatggcgcctggcaggacgtcaaggatgccaacggcagtgtcaagactctgtcgcttaacagtgacaacaactggacggatacgtttagcgtcgtcgccggcccgactggctatgagtaccgtgttgtcgagacagatccggatgacgctaacacttggaccacttcttacgcgtacaacgcgagcggagagtcttcggcaagtaaggatggcattacccttgtcggatacaaggctcagaaagcgactgctaccgtcaccaacaagcagaacactgtgacgctgacgattaagaagtccgttactggcaacttcggcgatacgggcaagagcttcgacttcaagctgaacctcaagaatgcatccgatcaggaaatcatcgacgcggctaaggctaacaacaagctcagcggcggcccgggcggtgactataccttcagtctcaagagcggaacctctatcagcgttaccgttccatacggaaccaagtacgtggtgacggaggacgacccgaagaagggcacgaacgacactgtcgactaccagaccactgtgaccgtggacaacaagagcgacgccgtgtccaacaacgaccgcaaggcttcgtccgatggcatgacgaaggacacgaccgtcacgttcacgaacaaccgcgacgtcaagcctgacgtgggcgtggacctcggaagcagtgctccttacgctgctgcaatcggcggaatcggcattgctggcgttgcctggatgatccttaagcgtcggaacagccagggaatctagtggtatctggcatggggaaacactcaaggtcagaggcttactacccgcaggcgtacagaccgagccaagtggtccctgtcgcgagtggcgagtacaggccgaaggcggtgcgcaatggcaagaagccccagccggttcctagctacggcgcatcggaacgagagtcgcaagcagagtctccggagccactaaacgaggagcaacaggagcttctcacgtggcttaagacgatgaagttcaagcgagcgagattcggaggtgttagcgaggaggatgtctggaagaagatctcggagctaaaccgacgatacgacgcctgccttagggccgagcgagcacggtacgacgctctgctcgagtcgagaggaatcagggagtggcccaatgcttagggtcacggagaaaggcgggctcgcggaaggagtgattcaagcccgttgggcgaaggctagggaccgcgaaggatggctttcgctcatagggaagatcgcagtactagtcgtagtagtttgggcgcttttctcgtttgtcttctgtctgttcagggtgcgagggaacgacatgtaccccgcaatgcaggacggcgacttggttctcgcctggaggcttcaaggcacgtacaaccaggacgatgtcgtagtgtacaaggccgggggtaaggagcggatcggaagggtcgtcgcgaaggagggggacgccgtcgaccttacggatgacggacaggtaactgtcaacggcactccagaggacaaggcgatctaccagacggaagcgggtaaggccacgaagttcccctacatggtgcccaagggaaaggtgttcatcctgggggacttcagaacccaggctacggatagcagaaaactcggcgcgatacctaacgatgacgtcgagggagtaacgataggactactcaggaggcgcgagttctaagcctcagacagtttggtgaatagcgattctggtcgctttcatataagggaaacctttggaaggagaagaacatgaacgcaaagcttactaaggggctggccgctgcagccatctccgccgcgatgatgttcggtgctgctgtgccggcattcgctgcggatgcatcgactacttacaaggatcagggtacggttgagatcacgaagagctatgagctcgacggtcagggcgtttcccctgaggagaccttctctatcatgcaggatggcaaaggaactgttaccgacagcgatgctactactgcacccgacctggttaagatttcgaacgtcaagtttgcaaagggcgcggctggttccgccaataagactcagaacttcgtcgtcactcttccggagtacagcaaggtcggtgtctacacctacaatctgaaggagaccgtaggcaatacggctggtgttacttaccgtacggacaatatcaagcttgttgtaacggtgatcgagcagaatggtctcgtgagggtcgctgccgttcactgcgagaacgagggcggcgacaaggtctccagctttgcggataacaagtactccgctggcgagctcgatgtcaagaagacggtcaagggcaatgatgtggctggccaatcctagacacgcttgagccggagctaccgaaagcccgacaatgtgccgagaggcacgaagggagctttcggaccatgagcaggacgacgaggagaaggtacgacccgcagt

SEQ ID NO: 193 - DNA, 10008 bp, Unknown
  Metagenome-assembled genome
atctcgaccttggtgccggtgccgaggccagcggcgaggatcatcatgatggacttggcgttgacgggagcagagcccttgtcaaggtccttgatggtgacggtgctctggtactgcttggcgacctggacgaactgggaagcgggacgagcgtgaagaccagtcgggctgacgatggaaacttgcttggaaaccatggcgcactccttaatgacctttgcggccaaggcggcaggccccggcccaaaattgccttacgtggtgattatagtaacaaaaaacacacggggatggtcattggatgccaaaaacggcctttgcgatcgcgaggcgtgcacccgaccggccgtgttctaaactttggtatggaatatgggatgcgagggcgatgccatccgcgggccacgacggccacgggcatcgcgttgataccgaggggaaacgaatgtctgacgcgcgcgaccagcaagagacaccgacgaccgcgagcaccagcgaggcgaagaagtcgggcctcgagtatcccggcgccgtgcccgccagcgcggaggaccttcccgtcatcacacaggacgacatcgacgcaaagggcaaggacgcgggcgagaagggcgccggcaagggcggcagctcggccgactccggcaaccccctcacgggcggctttggcgccatccgccaggtccgcgccgcgtccaagcgccacgccagcgcgcgcgagcaggtcaagagcctcaagaccgagctcgagaaaagccagaagacgctcgaccaccgcaaccaggtcgagtccaactaccagaagatcgtgagcgagcagtcgaggcagctcgacatgcaggggcaggccgtcacgcgcgccgagtccgtcataagcgagcagggcgcccagaagtccgagctcgagaagagcctcgcccagatgaagaacgatcacgaggagcagctccgcccctaccgcgagctgatggaatcgaccaagggccgcgccgacgacgccgcaaagaccctcgcggacgcaaagcgccaggtgaagaccgccgaccagcagctgagcgacgccacgaagcgccgcgagcagaacgtcgcctccgcgaacaggtccgtcgacaactcgcaggagcgcctgcgcaaggccgaggcggagctcgacgcgctgcggagcgacgacggcgcctccccggcggtcgtccagaagaagcagagcgacatcgtggccgagcgcgcgcacctcgacgcggcccgcgccgagctggaccgcgccacgagcgagggcaagagcctggtcgacagcgcccagacaaacctgtttgcccagcgccatgccctggagaccgccgagacggccgcggacgtcgcgaagcgcgaggccgacgagcggcgcgaggagtacgagcgcctctacaacaaggcgatggccgaggagaagggcgtctctgacgagatcgcgaagcgcgaccgcgccatgaccacggcggacaaggagctcaaggacgcgcagtccaagatcgacgaggcccagaggctcctcgacgaggcgaacgacattcactcgacgcccgaggtcacggcagacctcgccgcgagcatccaacagggcaggcaggagctccagaagcgcatgaagaacgcccagcgcctcgcccgggacgagaagcacctgcgcgagaccacccgcaagcagcgcttcctctttattggcgccatcgtgctagccgtcctgatcgtggcgttcgtggtctggttcgtgctcaggacctcgtaagcccatcaagactcacggcacgtcgcacctctccgagcaaacgaagccccgctacccacggattcgcaggtagcggggctctttcgtcacaaggcccgttcgcgttgtcgcaatctctcaggcgtcgctcccggttgcgtccctacaccatcagcatggcgtcgccaaagctgaagaagcggtagcgctccttgatggcctcctgataggcggccatgatctgctcgcgcgacgcgaaggcggaaacgagcatcatcagggtcgagcgcggcacgtggaagttcgtgaccatcgcgtccaccacgtggtaggtcgaacccggcatgaggtagaggttcgtcgtggcgtcacgcctctcgacgatgtcgcccttgcccagcgtgagcgcggagtccgccgcgtgctcgaagcgcctggcaacgcagggctgctccgacacgggcgcctcggggtcgaaggcgctctcgagcgagcgcacggaggtggtgccgatggcgaccacgcggtgccccgccgccttggtggcgtgcacggcgtccaccacgtcctgcggcacgtggtagcgctccgtgtgcatgacgtgcttggtggggtcgtcctcctccaccaggcggaacgtgtcgatgcccacctcgagctcgacggtcttccactgcacgccagcgtcctggatcttctggatgagctccggcgtgaagtgcaggccggccgtcggcgccgccgcggagtgctcctcgtgcatcgcgtagacggtctggtacttctcgccgtcaccctggtagtccgtgatgtagggcggcaggggcacgtggcccgccttgtggatggcctcgtccagcgtgaggccctccgccggcgtgaagcgcaccaggcggccgccgcggttgtcctccaggtagtcgatcacctcgccggtcagcacgacgggccagctcatcggcgcgtggatgccgccctcgcggtactcgatcaccgcaccctgcttcaggcgctttccgggcttgaccaggcactcccacacgtggccgagcgggtccttatcctcgcggcacttgagcagcagcgtctcgctcacgcctcccgtgcccttcttgtggcccatgagcctcgcaggcatcacgcgggtcttgttcgcgaccacgaggtcgcccggctcgaggtagtccacgatgtcgtagaagtgcctgtgctcgacgctgccgtcgtcgcggtgcagcacgagcagcctgcaggagtccctcggctccgcaggctcctgcgcgatgagctcctcaggaaggtcgtagtcaaagtcgtcagtgcgcatgcgtctctccacgtcccttgcgcgcggccatccgagcggccgcgccagcgtttctcaacagccgcctatgatagcgcaccgacgcaccgcgggcgccacgcccagaaaatgcgaacaggaacggtggagaaggacgcgcgccccgtggcagaggcaccgccttcggaggcgcgcgccacccgctccgctcccctagcccggcaggtactccggcctgggcgggagctccctgccctcgcgacgcgccaccttggcggccttgcgccagtcgcgcgcgacatgccgctccatcgcggcctccgcggaggagaaccggcatccgcagtagttctgccggtacatcccaaggtcgcgcgagtcctccacggactccggatagtgcggcctgaagtcgcgccacaccgccacgagcccgttcgccttggccacggcctccagcacctcgtggcacgtgtcgaagagctggtacggcgacaccgccagcgtggtcgagacgtagtcaaagccccgctcccgcgccacacggcagctctccgcaagacggatggcatagcacgccctgcacctgcgctcgcggtcgaagcccgcgggggccacgcccctctcccatgcgtcgcggtcgtccgccgcgacgatcacgtccacgtgcgcgacgtcgcgcgcccacgcctccagcacgtccaggcgccggtcgtgctcggccttaggctggatgttggggttcgtccagcagatggtgggctcgaagccctccaaccgcaggtacttgacgggctcgagcgagcacggtccacagcaggcgtgcagcagcaggggtacgcgcccctccgcgcctaacgatgtgccgtccatgtcgtccattccgcctccgttcgcgcccgcagccgtcccgtcgggaagaactataggtaacatgggaaaaaagtccagactcgaggaggcccgtcatgcagataaaggtcacgttggacgagaagggcatggttccggacaggtacgccaagtacgcggacgccgcccacctctaccaggggtgccccaccacctcgttccccttcgaggtcgagggcgtgccgcaggacgcacgctcgctcgcggtcacgttcacggactacgactccatccccgtgtgcggcttcacctggatccactgggtcgcggccggcatcgacgcgtgctacgccaagggcggcaggatcgccttccccgaggacgcctccaacgcgggcgcctttggcatggtgcagggcaagaactcctcggccagcaggctcgtgggaagctccgacccgctcctgacctgccgctacaacggcccgcagccgcccgacgccacgcacgtctacacgctgagggtctacgcgctcgacgtgatgccacagctcgccgaaggcttctgggcaaacgagctcgtgcacgtcctgcgcggccacgtgatcgactgggccgaggccaacctgcccgcccgctcgtagcgcagccagcggccgctacctggtgtggcggccgcccttctcgccccatccctcggaccccgtgcggtggtacgggtccacgggaggctgggcgctgcccgtgggagcgggtgcgtcctttgcggccacaacctggtcgaacatgctcgacgtctggccaaagtcgctcgggagcaccacggtcgaggggcccttggcggcgtactggttcatcatgtcgatccactgcgtgaactcgaacagtcggttcgcctcgccctcgttcatctcggcgcccttgatggtgtcgattgactccttgatgccgcgcgcgatggcgatgcgctggtccgcgatgcccttgccctcggcggccatggcctccgccttggcctgcgccgcgatgaccgtcttggcgcgggcggcctcggcgtcgttctttgctgactccaggttgttcttggacgcgatgatgtggttcatggactcctggacctcgcccggcagcttgatgcgcgtgatgagcgtggtcaccagcacgtagccgtagtcgcgcatcttggcggcgaccacctcgtcgatcgcgtgtgcgatggcgtccttctcgctgaagacctcgtccagcgtgcgcgcgggaatctgcgagcgcagcgcgtccgcaaggtagtcctgcatctgccccacggggtcctgcagcgtgtagaagctcttgtagacgcccgagtcctggcgcgcgcccatgtccgtcgcgtccacgtggtactggatggacacgtcgagctcgatggtcacgttgtcgctcgtcttggcgtcgaacgtcatgtgctcgtcctcggtcatgaggctcacgtcgtgcgtcacgtcgatgaagggcaccttgacgtggaagcccggcccggcaaagccgtggaagcgcccgagccgctcgatgatggctacgtgctgctgccgcaccacatagccggtcgacagcacgagcacgacgatgatgacgagaaggacgatggttccgatcatggattcctcctagcgtaaagggtcagtggggtcgtgcggcggcgaccgtcacagggtgtcgagcgcgacctggcgcatctgcaccgcgccatgctcgtcgtgcgcgaggtagttgacgtgggtgaagccacagtcgatagccgtggccgccgccacgtcgaaggcgccgtccagcagctccttctggtgcgcgtccgcgctgatgaggatctctccgccaaagtcgtgcagggcgcgcagcagctcgtggcgcggatagagctccctcttgcggccgcggttgacggcaccgcagttgacctcgaaggggacgccctcccccaccaggtactccatggcctcgagggccggtcctgtgtagcgggggtcgccctcgtccagaaagcgggcgtcgtcgttgaagcgcgtcaccaggtcgaagtggcccacccacgtgcagtgcaggcggtcgtataccttggcctcgagctcgtagtaggcgcggctgagcgcgtagtagtccccgccgaagtaggtgtcgcacagctcccgcatgttgtccatgctgctgtccacggacatgggcgtgggcgagtccacgtccaggaagtgcgtggagccgatgacgtactccgcccccgggcagcacgctgggtcatatatgttatccagctccacgcccatgaggatgtcgagccggtcggcgtacttctccttgaggcgagagatctccgcgacgtacgcgggccagtccatgtggatgtccgggtccatgtgacccgagaacccaaggtgcgagaagcccttggcgattgcctcgagcaccacgtcctcgggcgtgtccgagccgtcgcagagcacggtgtgggtgtggtagttgcagttgagcatgggtcctcctgcctgccgcgggacgcgacgccgggtcgcgctgccacgagggtaccagaatcggaggacgtcaactacctcgccaggagttccgccccaaagggcgcgtcgcgcacaaaggcacaggcaggctcgcgccagattgcggccgccatgcagaggtcgcccgtgcatcccgcaaggtggatgacggcgcaggcccatgccaggagcggcacgcggaaggcgacgcccatcgcggcaaaggcaagcgtcagcaggaccgttggcgcgagcagcaccgcctcgaagcgccggcgcggcagcgtggccccgttggcgctggtgtagagcatgtagtccttgaagccaaagctcacgtgcacgtcgccgccgcccaggagcaaaaacgccgccgcatgcacgagctcgtgcaccgggagcgccaccacggacgcgagcaccaacaccagtagccaggcgaggccgatgcccttctccaccaggggcgccacgccggcaatcgagaggatccacgccacgaggaccgcgagcagccccacgcccaggatccaccaggacaggcgcaccatgcgctgctggagctcggcgtcgcccaggacgtccaccttggctatcacgcgcatgcgtcgcgccccctctggcggccgccaggcccgtagcaggcgagcacgtgcaggagcagcgcgcccaccacaaagagcgcggcgtagggcaccaggtagagcggatcgcccagcgcgttataccagtcctcgatgggcgtgccgtacgccggtccgctcacgaagccgaagttggtccccatggccgcgttgaaccacctgaagaagaccacgtaggccgcaacgaaggcgtagctcacgagcacgtcgcgcatgcggatggaggccctgccctcgcgcaccgcgcagagcgaggtcgagaggatcagggagtgctccatgaagccgcagaccacgggccaggtgtacggcgggcacgcgagccagccgggaaagagcaccgcgcagaggccgccgcagatcccgagcgttagcaggagctcgcgcaccacgtggcttgggtgcacggcgtaggcgacgcagaggtactcggcggcgttgcagaagtggagcggccaccacgccggcgtgaaggtgtgcgaggcgaccatgagcgcgtcatcggacacgagcaggcagattgcggccacggacgccaccctgagcgcgcggagcccccagcggccgtgggcccacgtcacgagcctcacgacgcaggcgcaggccacgagccacgcaaggtgggccggcccaaagagcgcgaaccctcccgacttgagcagcagcggctgcgccgtaaagacgccgtacttcatggcatgcacgtccttctcgtcccctaacgcccttctcgccctatataccccatatatgacgtcccgcgggcatccccatgggacgcgcgtcgcattcgactcaaaaggatagccgtccgccgcatggcgggcgttatgcgataatcagacggagtactggccgccccagggcggctcacacaagaggacagaggatttgcacatgtcttttgagctagacggcgcgaccgaggccgcgcgcccaaccttccccaagcgggccatcatcacgggcggcatgccctacggcaacaagaacctgcactttggccacatcggcggcgtctttgtcccggcggacttcttcgcgcggttcctgcgcgaccgcatcggcgcccagaacgtggtcttcgtgagcggcacggactgctacggatcgcccatcatggagggctaccgcaagaaggtcgagggcgagggctaccagggcacgatcgaggactacgtgcgccacaaccacgacctgcagaagcaggcgctcgactcgtaccagatctcgctcgacatctttgcgggctcgggcctcgaaccggccaagcccttccacgcggctctcagcgacaagctgatccgccgcctgcacgagcagggcgtgctcgtcaagcgcaccacgcgccagttctacgacgtgaaggccaagaccttcctcaacggtcgccaggtgcagggccactgccccgtgcgcggctgcaagagcgagaaggcctacgcggacgagtgcgacctcggccaccagtttgaccccgaggagctcatcaacccggtgagccagctcacgggcaccacgcccgagctgcgccccgtcgacaactggtactttgacctgccgcgcttccaccaggtgctcgaggacctcatggacgagtgggacgcggacccgcaggtgcgcgccatcgtcaccaagacggtacgcgagtccctggccgagcccgtgatctacatccagggcaagttccgcgaggccttcgacgccgtggcggacaggctccccaagcacgagctccgcgaggccgagaagggccagacgtcgttctcggtaaccttcgacaactgggaagaccgcgacgaggcccgcgaggtgctcgaggccggcggcgtgcgcttccgcacgggcaagacgctgctgcccttccgcatcaccggcaacatcgagtggggcgttcccgcccccgacctggacggcacgcacgacctcacggtctggtgctggcccgagagcctgtgggcgcccatcagcttcacgcagaccgtgctcgacgcggacgcgaaggctggcggcggccgctactccaccgacgactggcacgactggtggtgctccaaggacgccaaggtgtaccagttcatcgggcaggacaacatctacttctactgcgtggtgcagcccgcgatgtgggaggccctcgattggggactcacgcaggacatccccgtcgccaactaccacatcctcttcatgaacaagaaggcctccagctcgggcgccatcaagccgcccatggccgcggagctcctggactactacacgcccgagcagctgcgcgcccactggctgagcctgggcctcgaccagaaggctgtgtccttctcgcccaagccgtttgacacgtccgtgagccacaaggacaagaagaccggcgaggaggtcctggtaaaggacgacccgcgcgtggtcgaccccgccctcaaggagagcgccttcctcacaaacatcttcaaccgactggcacgcagctgcttctatggcgcggccaacgtctgcgactcgcacctgccttccgtcgagccgcacgctgacgtggtcgagggctgcgtcaaggcgacgctcgagttcgagaagtgcgcgcacgcctttgacgcgcacggcgccctcgcggtggcggaggagttctgccgcgccgccaacaagcgctggggcgacgcctccaaggccgcgaacggcgacgatgccgcctacgagcaggccctggccgacgcctttgccgagctgcgctgcgtgacgctgctcatgcaccccgccgtgccctccggctgcgagaagatctgcgaccacatgggctttgcgcgcgacctcttcttcagctgggacaacgccttcgcgacgccgggcgagctcgcgcagaagctgggcgagaagcccggggagcacgcgatcgtggccctgccgccgcggttcgacttcttcgagaagcacccc

SEQ ID NO: 194 - DNA, 1724 bp, Unknown
  Metagenome-assembled genome
taattagtgtctgctgattagcaaaaaatctttaaaaattgcctaaaatacgcgatttctggctcaatatagggtataatagatgcatggatttttgatatttcattcatcttttcgtgcagtttctgaataaaattttaccctcggagcattaaaatcgtgtataaagcaaaagataagtcagagtattctttttttgatttcaatcagccgctcgggatgcacatgaacccggaaaaccgctggatcaggctggcagagctcattccatgggatgaatacgaagaaaagtatgcttcccgtttcaagagtgatacaggaaatgtcgcaaagccatgcaggatggctctcggagcactgatgatccagaaacgtttaggcttctctgacagagagcttgtagaggagatcacagagaacccgtatctccagtatttcatagggctcccgggatatcaggagacgccgccgtttgatgcgagcacacttgtagctttcagaaagcgcatagatctcgacatgagtcagttcatgaatgacatcctgcttgaagaaaataaagcgaagcaggattcagagaacaaagacccgcatgataagaacgacaacggaagctccgaaggctctgctgcagtaggaagaaaatctgacaagactgaaagtcctgaagctgctgataaagatgtaaacagcggaacgctcataatcgatgcgacatgtgcaccctcatacatacgttatccacaggatttttcactgctgaacgaagccagggaaaaacttgaagatatcatcttccgtatctgcggagataacggactttacagaccgcgtacttactgcagggaggcaagaaaggattacctcaaccttgcaaaatgcaagaaacgctcaaagaaaaagatcagagcgacagtacgcaagcagctgggctatgtgagacgcgatctgggctacatcgacagatatatatcagacggatatgcacttctgccaaaagaagaaaagcttctagatacgatcagaaagctctatgagcagcagaaatacatgtatgacaacaagacgcataaagtagccgacaggatcgtaagcatcgcacagccgtatatcagacctatagtgagaggcaagacgaaatctcccgtggaattcggtatcaagttcgacctcagtatcgatgaggaccacatgggaaggatcgaaaagataacttttgatccatacaatgaatccgaagtccttaagagagccgtggaatcatacaaaacacggacaggacattatccggagcgtgttcttgcagatcagatctacagaacaagagaaaacagaaagttctgcaaagaaaacggcataaggctctcagggccaaagctcggaagaccgtcaaaggaactcagtgctgaagaaaagcacattgaatataaagacaatacagacaggatcgaagtggaaaggagcttcagcctcagcaagagatgctacggtctgggactcataaaaacaaagcttgaagaaacatcatacggctctgtagggctttccatctttgtgacgaacctgttcagaatcctgggcagggcgtctgacttattttgtgcttttttcaaggtactgtttttgaccacagatatgcggccgttatatataaatgcggaaattttttccgcggtataacctgctgattgctgaaaatgcggttaatcagcatacactaatta

SEQ ID NO: 195 - DNA, 1785 bp, Unknown
  Metagenome-assembled genome
gcgtcacgtacacgcgcgcgccggccaggtgagcctcgcggcacgcctcggcaaacgtctggtacgtgaagttgtccgcgccgcgacgcgcgttgaagtcgcttcccaggccacagaagatcgcgtctgccccggcggcgagcgccgccctgaagggtcccgggcccccggcgggcgccaggagctccgggacaaatgaagccgttctctcagtagttggcatgaagtctcgtttactacctatcatgaggattcggtgtctagtccaaatcacagcaagccggcaagtagagtcaggcgtaaaagcacctcatcgcttttcttctggcgatatcgaccggaagcgaaagccttttgaaaacggctaccttctgcagcattcttaacgacttcccgtagcctaggattaagttgatttccgtaaagtgcgtaaaaccgtcgaatctgctgtttgattttcggaagcttgccattcccgaagattttctgcacgcgatacttggcaagctgtgccggactcatacccgagggactcgcattgttgcccgtacgtcgatataggagatgaggtgtctcgtcccaaacgatagtgccgaaggcactagccacaagaccgaaccaccagtcatgtgcaaagacatcagctgatcctccaatagtggcaaggtcctttagctgacgattaaataccatggtatttccagaacaaatgtcctcataaaccattctctggccatctaaaccgatgcgattaagtcttgagcgctgcggattcttgcagaactcgtcgcaatagaacagttccgaacaatacaggactggaccgtctgaggacgattcccctattaaccttatagcagacgagagcttgccaggcagccaaatatcatcttgatcggcgaaacaatagtagtcaaaatcaccagccgcggacagcgcgtcaaaaaaagacctgacatatccttcgttttcgccacatatcagtgtaatgtcattacgttcctcatactgtttcagaacccgcagtgtaccatccttcgaaccgtcatcgcgcacgactactgaaagagcaggtatgtcctgtgaaagtacgctatcaagctgttcgctaacatattgttctccattgtaggtagacatcacaacagctacgctaggatagttcaattgctcccccaaccaaataacgcggcaaagcgatgttattcatgatacactcgtttgttcgttcccctggtgtatcatcgaaaagaccagacccccctaagaattggacaagttttgagtataatctccgacctaacttatacactctgaactggctgagtctgttcgacacgaattagcgttttctaccgaaagcccttgcctgatggtgttcccagcttagctgttcttgcccttccctatgccgccctctggttgattcccgagaagtaccagctcgccggggtctcgtatcccagcgactggtggatgcggcggttgttgtagtagcccacgaactccgagaccagccgctcgagctccctcggcgtcgagtactcgcgcgtcctcagccactccgacttgagcgttctgaaccacctctccatcagcacgttgtccctccagcgggccctgccgtccatgctctgcgtcacgtggctggccgccagcaggccgacgtactgctccgacccgaagaccgagccctggtcggagttcatgatggacggcgtcccgtgatcggcgaaggcccgcccgacgcacctcacgacttcctccgccctcatggtgtcggag

SEQ ID NO: 196 - DNA, 14066 bp, Unknown
  Metagenome-assembled genome
gcgcgccactccgacgccgaccgcggcgacacgctctcggggcaggtcgcccgcgggtcctacgggagcacaaggcgcgacctcatcgacatgccgcaaccgctctgggactactgggaggcgagggcctaggtcaatcgtggtctaacagagagtttccttttcgctaagaggatgcgcattgataaggttttgtgttattcggtcccactcttgaactggatggccatagtaaggtgattccatatgcatacctcgctcgttcggtggcttcatttttgtgcatcatgcggcagtaatgccacggcatgacacattgagctcatgatatgactctgcaagctgttatgcatccgaagagctggctcagcgattaagcaccagagcctgatgtattcagatgggaataaatcaacaaacacctttcgccgattccctcgaggcgagcacgtggagatacgtagctcacgcagtggcccggtcgaatctgagtggtgccaccagttagagcctttgctcaagaggtgacaaaaaagcggctgcaagcagcatgccgctcgcggtgaacgcccaacgcggctagataacggcgggtatccaagaatgacggccatcaatacgaggagataggagtcagcccatggcagacgagaagaccatggtgatggagagcggcaccgagaatcgaaaactcttttggggcgtcatgcccgagggcaaggcctacgtgcgcgagacgagcaagggcgacctcaccgagataatgttcgacgccgccgagcgcgagacgaccgtcacgtttgagccgaccgatgactactcgcttgccgacgtcgccgacaccgtggagggccacgccgacgactgcttcataaccgacttcgaggatgctctcacgctctggggcatcccgtatacacgagacgagaaggtcataccgcttgacgcatagaggccagccgacaaggacgacgatggcgacgcgccgcgcggaaacgcacggcgcgctttcgtatgaggagaagaacacccaagcccgaagccatacggcaaagtgaggagaagaaccctttcacgtcccaccgcccgccgcacgctcgccggagggtccggcaccgccgcgtgctcgtcatcgcgagttgcccgcgcccagcgcgggccgggccgtgcggggcgcgggcctccgcgcgcccatgggagtcttcctaacctggggggagcggcctgggcgcggggcttcgcgtgcgggcctccagcagccgcctgcgcttgccgggcttgcgccgcccgtgccagccgccgcccctggccggtcttcggcacggcccgtggcagccggcaagccgtctgccacgggcttcggcctcagccgaggccagggtcgccgtctgtcacgggtccccgtcgcaagctcggcaagctacggcgtctgcttccggcaccgcgctcagccccacgctcaggccgcataacctgcgagtcacggagggggcgcgcttcggcccgcgtcgcgcccgtccacacggcccgcgctgggcgctccatcatcgtcctcgtccgcacgcggcggtgccggacccatgcggggccgtctcggtgcggcgggcggtgggacgtgccgttgccgcaagtggcacgtacctgacggcgcaccatgttcgcgacgatccatcagcgacggcatccccggcacgggtgccccagacgaacctggaagcctaagaccgcgccgcgccacctacaagcgctaccgatggcgcgggtaacgtcaccgaacccgcgagccagcctccgcgccagtgccgcctgcagcgtccccgtaccagcacgaacggtactcctcgcgcgtcatgagtccggcggccacctccgccatgtcctgctgcttctcggaagccgtatcctggacgatggagtcgtcgtatatgacgcccacgtctccctcgttgggaaggcctacacccatgtagcgcgaacatgccatcactgccctggagacgtccacgagcgccccctgtaaggcgttctcgttcttcctgatgttgcgcatgagcgccgagttatccgacgacacctccgtggccgtcttcacgtacccgacattgtccgtgtcgaagtagttgacccccaggcccacgagatccccgagtacctgcagggccagcctgaacgccttcccctgcgcctcggtgcggagagccggtgcgaattccgtgatcgtgtcttcggtgctcatgaccttcctgaacacggtgcagtcgcccttgccaaaggggatggggatcctcttgccgtccgctgtcttctcttggtcgaacatgacgtcggagaggaacaccctcatcttgccagcgtctatctcgttgatcagtgcgtcgtaggcgagatcaacgctctgcaccgcatccacggcatcggcgaacacgctctgcccatagggggagaagtccacccgcgtgttgggcacggctggtctgacgatgccgaaggttgggaaagacgagcccgtgtccacctcgtcggccactcccggcaccgagacgattcgcccgtccttgtcgaagcacgccgtgcgaatccgataagccccgccatcgccaacgacgtgcatctgcagctggttgatgctttcgccgttgagaaacgcccgcgtgacaaaggcacactccctcacgccctcggaatcccagctgagaggaacgaccatgcgcgcgtcgtaatgccgaaccttgacgatcttcctgccaatgtccatccaaaccgcgagcgcccccgtgcccagcccgaacgcccgcaccacggtctcctgtgcccttccccaaaagttggaggaggagaagaacgactcgagccagtctgtgcacgtctggttctcgcaggcaatcgtcgtcttctcgtccaggagcaggctgccccactcccggcacacccgcatcgccggcatgatggtccgcctatgcacctggtacacccttccgaacccgtcggtgtccctgtagtcgtagaactccccgacggcccgcatccacgagtcccactcgcgcacgtggggctccatgtcctccagcgcctgcgtcgagtacccggccgccctcagatacgacctcacgcactccggcacccagtactcctcgccgccgatcccgtctcccgccatctgtcctccgctctctagagttggtcgagaagatcatccgtcccggtcacaggccctcgcgggcgtgcggaaggtcacggtcgagaagggcatggcggggaagccctgtttggcgattgggtgggcgagaaggacaaggggtcttttgcccaaccgccatcatgtatgcgagtccagccgcgcccgcgaccacgctgacgtcgagaaggccacgggtgtgtcgccccaacccctgccatccctgctcccgtgctccgtcgtcgctcttgtgtcattgcctggggaacgtctctcaacctcgtcaggcggccatgatcacgacgcgtagaaggtctcgtcctttgatctcattgtcgagaagccctatgggggagaaggacaaggtcaagacgtcgagaagccccttgggggagaagagcaaggctaagatgtcgagaaacccctacgtcccgcgcagcacgtcgtccatcacggcataccgcacggcgtcgatgctgtggtcgttcccgtccgggatctcgtccacccaggtgccgtcgcggtcccgctcgaactccttcaggcggaactcctcgtacgccagcgggcaccgcacggggtcgattacgatctccctcagccccgccagccactcgtagctcagtcgcctcatgttgctcttccgggcgggacgcaccctcagccccagctcgcgccgccacaccgccatcgactgcttgccgtccggcgtgtcgtccgcccatatcagctcgtcgtgctggtaggcatcgccgccgggctcgtccgcgtacgtcagcgcctcggccgccatggccccggtctcggccggcgtcttcctgttggccgagagctcctggaacaggaacagccgccgctccccgggcacccacccgcaccgcacgaagcgccacgggtccgggaaccacccccagtccacgccgtttcgcgtgcgagaaaagcctctgcactgcgcgtcggtgagccgtctgcccaccacgttgccgaacacggagccgccggtccccgtcacctcgcccaggtactcgctgcgccacgcgcgctcgtccacgtccctcaggtactcggcctcctccacgaagggcgcgcccagccactccgggtgcgtccccaccacgtccaggtagctcgagcgccgcacgagcgtgtccgagcgccgctcgcgctccagctcctcgcggttcacccagctccacagcgtccgcggcgggttatacgtgtagaagatccagaagtcgtccccgccgcgcctgagcgagttcagtatcgagcggaccgcgtcgatcccgtcgaactggtcaagctcctcgaaccacaccacggcggcgtagccgcgcccgaacttcgtgcccttcagcttcagcgggtcatccgccccgcggaacacgatccgctgcccggtcggcaggtacgtcagctccatcggagacacccgcgccctgaaccaccgttccagccccaactccgctatcgcccactgcacctgctcgaacacggagtcgcgcagcgtgttgctgaaccgccgcaccaccaccgcgttcgcctccggctttgcgaggacgagaaggactatggccacggacacgaagctcgacttcgtgctcccgcgcccaccgtgcagccagtagtgcgtgtgcccgtgcgccatcacgtcgcccagcacgtcgtggaacgccgggatcaccagctcgctcgcgtccaccgccgtcactcgtccccctcctcttccgagctcaggggctgatgagaaggccgagcggggcgagaagggccgccccctccgcctgggcctccgtcggcgccatcgttgccgtcgcccatggcggaggagaggtccagccgctcctgcaccggctgggcgacgacgccgagcacgatgcgcggggcgtcgccgccctcgtcctcgtcgcgccggcggtccgccttgccgtactcgtcggggtacttgcgctcgagcagccacgccgcggcggtccagtactggttgcgcgcgagcgccgccgcccggatcgtcgtcaggagcgtgtgcttgaactcggcctcctccttttttagtccctcgcttaactcgcgttgcagccggttcttcggctcgcccacccagcggtagaacgtggactcgtggatgcccagcgcacagatgatgtcgccgttggaaagtccgtcggccttcagcctgatggcctgatcgaccatctcctgtgtgagcttcgccctcctcgccatgccaggccacctcctccaaatctcggggtctcgcagcctgaatcatcggatgccgtcacaggctggggcgcggttggaaagccttgtctgcgaacatcgatatgtacgcaaaaaagagttcataaaaatatggacataaatatacagacgttatagtatgagcatgaagatgcgagcgatggaggttgggaggctgatgccgtgaaggaagagtacacggtcaaggagattgcggacctgcttggggtaagccaggtcagcatccgcagaaagatacagagtggcgagatcaagccccagcccacgccaagggggaaggatcccaacaaggcaacgaaaaaagtcggtgcttcggaccttttggactatctcaagaagcatccgtcgcagatagccgcgattacaagtggcacggtgatggtcgccgcgggaggcgccctctctggcgtcgcgttggaggtcatgctttcaagcctaatcggagtgattgcagcgctgccgtcgcgtgcgaaggtcgacgcggacgatttgagggtctcctctcaagagcttcgacgaattgtcgaacgcaagagggaggagcagcgtgagcagctcgatgctcttcagagcgagattgatgatctcgagaaaaggcttgacgaggtcgacacgaccatccttcgctgcaattgggtcatagatcagctcgattcggtggctggcgaaggggtcctcgtgggacctgaggggggcgagtgcgcgtcggatgccgatgcggcgagtgcgattgcaaagattgcgaaggcgctgacgacggcgacggatccgaagccagacgagcaggtgcagaagcctgagaaggaagagggggtctaagaatgatggagaacgagagctgcatgcttcctgtccagaatgccgcggaatactccaatccattagggcgggcgttctatagtcttggcgaagataacagggcgaacgtcatgattgtggctatcctcggcatcaccgtggtgcttgggttagcggtccacgggcgcgtgcccctacgggcgagccttggtaacgctgaggtggcaatcaactgtacctaggggttccacggttggagggcggagtcgggggggatcgttagccgacggccttttgaattggccgcaagtgaggcgcgtaagagcgtctcacttgcgcctgcttctgctcggcagcccgtacctcctgcacgtgcggctgttgcgctgccgctgcgcatcccgctcgcgcctggcctcggcgatcctccccgggtcctccgcctcggcccgctcgcgctccaggacctcggcgaaggccctctcctgctccaggtggtagcgctccgtgcacaggcggcacagccccgtctggcggttgattaccacgcccacggccccgcactccggacacacggtctgcaccgcgagcgagcagtggatcctgctcgccctgagctccacggcgtggagcgtgtgggcggtgccgcagcgccgctcgatctcgtcgcgggcgtaggccgcgcccctgaagctgcactcgcgcagcacgtcgtcctgctcctcgctccacctcacggtgcgcgccacctgccttcccgaagacgccccgcacgcggtcccacctgcgcgcacgcccggcgtcttcacgtcttcaccgggtctggggcgagccgccctcgcgcccgcgcccgcgcgcccgcgcgcacgaatcctcactagcaataaatcagcgaagacggtgaagacggggcagggattgcgccctcgaccggcgtcgctcccgtctccaccgccgtcttcaccgaggggtctccgccgaagacgccagggcgacgcccgtggcgtcccccgagccccggtcgaggagctcctccaacctcgcgttgtcgatgcacacgcagtagcgcctggtcccgcccttgaagcggcgctgcatcgtgaaccgcctgcccgagcccgtcaccaggacgccctcgtcgtccatgcggcgcagggtcttctggcggtcgtagttctccgcctccagggcgcggtcgaggaccgacgagagcacgcaccaggtgaaatcctcctcgcctggacggcgggatatctcgccccagcgctccatgcggtccatctccgccgagtcctcgaagtggaggctgttcctcgtcagccactcggccacgaactggatcgccttgaggtcagtgtcgcccgcctcggcgccggtcgagtttgcgagcgcccagcgtgccatctccagggcctgccgcacgcactcgtcccagtcagcgacgccgaacacgtagaacgaggagagggcgtccgcaagggccaggagcgccacgttgtccgcctgcgggtggcccgcggccatgccgccgacggcgtcgcgcaggcgcgcgtactcgtccgtgtaccacccggccgcgttgcggcgaagcgaacgaacatatgttcttcccgcggtgccgtgctgcgccgcgacgaggtggtgcatctcctgggcctcgcgcacgtccgagaagggctccgcgttcagctccagcgtgcggttggccgctccctgctgggtgctcccgcccacgatggggatctcgccggtcgcgatggtgaggcatttccacgagccggcgcgcatcatggagcggtcagagttcagggccccgcgctcgtgtccgagcgagagcgagtacaggaggtcctccacgacctggcgcttcgccccctgaccgcccggcgcgcccttgctctgcagctcgtccacgatcacgggtacgtcgtgcaggagcgcggccgcgcgcacgatcgacttcggcgtgtcggcgaaggtgcggaagtacgagtccgctccctcggtcgggtcgccccacaccgagcccgccgccttcagcgtcggcgtcttgccgctgcgcgagcggccccagagatacacgatgaaggtctggacgcccacgaccgacaccaggggagaggcgaagctggccgcaagcacgcagcggaaggcgggcgacgcctccctcgccggcgagacgccggcgacccaggcgtcgagcgtgccctcgggctccatgaacggccgggccttcacggcctcgtcgggcgacgggtcgaagcgcaccgccgtcgccccctcgccgcgctcgccgccagtcccgtccgcgtcgaagggcatgaacgcgccgagcggcccgtccgcccagcccaggtgcgtcacgctctcgtagcgggggcgcttccagccgaagcgcttctcgcagtccgtcaggtagcggatgacctccttgcagttcgaggacgacacgttcgcgccgaggggcgccagcaccccgatcaccttcgtctggttgaggaggacgtcgcgtcccacggcgcgctcgcggacgcccccgggcacccgcacgcgcacgagcgcgcgcacgtcgcgcgtgtccacgtccacgaggtcgcaggctatccacggtgcggtcgaggtcaccgtgtagcgcagctccccgtcgcgcccgacgacccagagcctgccgtgcgggtccacgtgccagccctccaccgagggggcgcggtcggggtcgaacgccggctcctccgcctcgggggacgtccgtgcgggatgacggttcccgcgtgggactgtcccgtcggacgaacatctgtttgtgtcacggggcgcgggcctgcccgccgtcgtcgcgacgccgggcctccgcctcctggggtcgtagaactccgtgcagccctccagcgcccgcgcgatcgtctgcgcgccgtaggtcgagtccccgcggcgcgagtcccacttgtcgcgcatcaggcccgaggagcggaacatccggtccatgcggccggcgtcccccgcgcaccagaaggcgagcgaggagcacagcgccatgtccgccgcggagtggtcgccgccgtaggcggacatgtcaccgtcgagcagggctccgatcgccgcgccgttcctgctcgcgcgcatgcggcgcacgagctcggcgtcgtccgggaggcccgcgtcggtcgcgcggccggcctcggtcaccgtcgcctgccgcccggccgcggccggtgacgcctcgatccaggtccggtaggcgcgctccacgacgcgcgggttctcgcccagcccggagttgccctcgaagacgttaccggtcacggtgaagaagcggtcgtggtcgtacatctccacgcagccgcgccggcagcgcgtggcgccctcgggcttggggccgcggaatatcaggtgcaggccgtcccccgagggggagacctcgcagtaggtgtgtgcctccgagaccacccagcggtaggcgtcggcgaggacgcctccgctcagcacgtggtcgaggtcgagcccggtgtaggcccggtcgggcgcgaacacgaagccgatgccggaggcgtgccagcgccccacggccgcgaccgccgtgtcgaagtcggaccaggtcgaggcgtcggtgctcgacgccatcctccccgtgctcgggttcacggggagcttcgtcgtgcgcccgtcgcgggactgggcgcgccagcacacccagcgaggctccgccctcagctcggcgggcaccctgctcagatccatttctgcctcccgtgcgagggggactcgggcctagtcgattccacggttgcgccccctcggctgacggggcccgcacccggcgcgccgggcgttcgggagcacgcagtcaatcgggatgagccagcggccgttcaccttgtccgccgggatgcggccctcccggatgccgcgcgtgatcgaccctacgtgctcgcccgtgagctccgagagcactcggggagtcaccaagggagggagatcgctgatgcccatgggtcgccttcctttctcgaatcatgcctttggaatggggcgggcgctgctggcgtgccacccgatggtgcaccattgcctcccgcgacgtgtaggttagcatagaaaatatcactgtgtgaggacgtccgcacatagtggtagaattaggcgacaaacgcttgtacgaattgtcatagtctgatagactttgttgcgaagtgttacgtcccgaaatcggcgaacggcatcggggcgccacggaacgtccacggagggaagggccatgtccagcaggctgctcgagatacgcaaggcggcggggtacgccacggcaagggagttcgccgaggcctccggcctggcggagtccacctacacgcgctacgagtcgaaccccgagaggatcccgctcaaggtcgcctgggacctcgcggaccggttccacgtgaccattgaccaggtggtcggtcgcgacaccgaggccaagggcgacccgcgcggggcgcagcagagggcgttcgacgcgctgtcgccgcgctcgcaggaggagacggccgacttcatggcctacctcgccgagcgcgacgcccgcagcagggaggcgcagtccgagagggcgaggcgcgtgtgggaggtcgtctcctcgcgcatcgagcgcgcctacctaggcagactctccgagaagccgggcgggcccgacccggtcctgctcacggggagcgacgcggagctgcgcgaggggttccggaacctcgcccgcgcgtgggtcgtcggggcgaagggaccgctcaaccggttcgcgccccaggtgcgcgacgaggaggcgctcgaggaggtcatggctgcctacgatcgcatgcacgggtcgttcgtggacgaccacggcatgctcgtcagctggtcgcaggaggcgggccccggctacgaggggggaggtctcgccgggaggtagcccgagaacgaaggcggcccgcgggagctggcactcccacgggcccgttgtccattccaaaggcatattccagaaaggacggtgacagtatatgtcatctcccaccaccacgcacacgcccgagggcgggggcggccccgtcgcgggcggcaggaggaccctgcagaggctcaggaggggcgccggctaccccagcgcgaaggtgttcgccgccgagctcggcatccccgagaccacctacgcccgctacgagagggcgcccgagacgccgcagtgcggcatccccatggccaacgcctgggcgatcgccgacaagctcggctgctctatcgacctcgtggtcggccgcgaggacatcgacaggccccgacccgtcaccctcgacgacagggctcgcgccctcacgcgcgagagccgccgcatgctcgacgactacctcgactacctcgagcaccgcgacgccgaggactcccgggcgaggcggtagccatggcagcgaggaacgggacctcgggcgggtccatcatccagcgcgagaaggacaggcccaagagcaggtgcaagaagtgggagctcagggtcccgattgggctcgacccccgcacgggaaagtacaaggcgaagtcgcgccgcttcaacggctcctacacggaggcgaagagggcgctgcgcgagttccaggacgaggtcgagggcgaccgcgtccagggcaagaccggctacaccttccagcagtactgcgagcgctatctcgaaatccgtgaggcgaagagggaggtagcgcccacgacgcaggtgcggcagcgctggcagttcaaggcagcctgtcgccacatcggccacgtaaagctcgagcaggtcacgcccacgatgctcagcgacatgtacatcgcgatgatgcggggcgacaccatgtccggcaagccctccagcggctcgtacgttaatcagatccacgacaacataaccctcgtgttcgaggcggcgaaggccgaggggatcctgatcgagaacccctgcgacaaggccacgccgcccaagatggacacgcgtcccaagaaggcggtgccgcccgacaaggcgcgcgcgttcatagactcgctcgatccgtcgaacccccacgagctcgcctggctcatagccgccacgatgggactcaggcggggagaggtatgcgggctgtcatggggcgacgtcgactttgaccgcagggtcgtgagcatccgccactcctacgacgagctcggtaacctcaagggcaccaagacgaaggccggcacgcgcctgctgccgctgcccgacatcacggccgagggactcctcacggcaaaggggctccaggccgagtacttcgagcgcatcaacgagtcgcggcgaaagaagggaaagaccggccccgagtggcaccttgagcagaccgacgagacgcccgtgattacgaccaagtacagcgaccgcataaagccgagctcgctgtcgcgatggtggtcgttggagcgcggcaactacggcctcgacgacttctccctccacgagctcagacacacctacctgacactcctcgccgagaagggcgtgcatcccaaggtcatgcaggagctggcgggccactatagctcgcagatcacgatggacgtgtacacccacgtcaacatggacgcgaagcgcgaggccgtcgcggccgtgtccaagctcttctgattgcgtcgccagttagcgtgccggacgggcggtcccgagcgacggggccgcccgtccgcagtcaccactgagtggcgccgccggtccccgccctgcgtggcagggattggcgggaggattattagtggcagattagtggcagcccaccccattggtctgacagacgtgctggtagattgagtgtttgcaaccgacgcaaatactgagtgggagtgattcggcccctatctcaccctgtcccactccgctgcgaaaggtactgttttcgcaggtagaatggcgaaagtgaagataaccggagtctcgctccgacgcactccatagcactccgcacgggtttattcgtaccagaattcgtaccgcttcgcttatcgacggataaaatttgatgatgccctcgggctcagaaaatgagcgccacgtcctcgatgggggacgtggcgctcttctcgtaggggagtaagaaactacttatcaaacttcccacgcaagctccgacgacaatgcgtgtgctctgctccttatggagccgccgagaaatgccctacaggaacttgtcgagctcgcggtcgaccaccggtttgcgtttgacatgcggctcagcgatgaagacgccatcgcgtatcacgtgcctgacgtggcgtagggtggtcaggtcctcaagcgggttgctgtcggttactatcatgtccgcgtgcttcccgggctcgagcgatcctgtcacgtcgtctatgcccgccacctgcgcattgccgagtgtggcgctgtgcagtgcgaacgctggagtcactcccacgtatctgcagaagtagacaagctcgcgccagaagtcgtactgcgtgatccaagggcagcccacgtcgtttccgagggctactggcgtccccgcctcgagtgcggctttggagcaggcgatgatgccctcgaagaccatgtttccgttgtacttctcgacctcggaggcattcgagaccgagcgatcgaacagcgcgtagggtagggcgggcgaaagcgtcgtgcagagcgctgcgccagtggtcttgaagagcccgatgacctcgtcatcgggcttggcgccatgctcgatggagtcgacaccgttccgcagtgcgaccttgagtccctcgacgccctccacatgggctgcgaccttgtagccaagctcgtgggagcgatcgcagaccgccttcgccatagcggggt

SEQ ID NO: 197 - DNA, 9094 bp, Unknown
  Metagenome-assembled genome
gtcgtcacgttcaagacggacagcctgccgctgtggaacttctcgcgcgggcagtttgagattgcgggctaccgcgcgctgtgggagtcgaccgacgcccgcgccgagcgcccgcaggaccccgtcagctggtacgagaagcgcctgagcgcgcagggcgcaacggtctacgcgatcgaggccacgccggacccggcgcgcgagcccaagctcgacgcggacgggcgcgtggtgcagaccaagccgctcagcctgatcgactacctgccagacgaccttgagtccatggactacatcccccacggcatgcagggaaccgtcatcaacctgcgcaacctggcgcgcaagggccactttgaccggcacctgtaaagccagccactagttgccgtttatctcgtccaaaaacgcctggccatagcgctcgagccgcttttggcccacgcccggcacctgtagcagcgcctcctcgtcgcgcgggcggcggcggaccatcgcgcgcagcgtcgcgtccgtaaacaccacgtagggtggcacgcccatctggtgcgccaggcgcttgcgcagcgcccgcagccgctggaagagctcctcgtcgccgtcggttgcctccagcgcggcgtcgcgggcgtccagcgcggccgaggcgtacgcgccgcggccaaacgtggcccccgtgcgagcgggccgcaggtagcggtcggccgaggcccccgtgcacacggagcacgagccgcagtcctccggcacgcccgacaggtcctgcccaaagtagcgcaggatgcgtcggcgcaggcaggtggtgctttccgcgtagtcgatcatctggttgagcagcgcgcggcgcgagcggtacaggcgctcgcggtccgcctcgggcacgtccggcgcggcgtcgtcgcggtcgagcagaaagcggcacgtgcggatgtcgccgcggctccacagcaggtagcactccgcgggctcgccgtcgcgaccggcgcggccggcctcctggtagtactcctccagcgacagcggcaggcccgagttgatcacaaagcgcacgttggacttgtcgatccccatgccaaacgcgttggtggcaaccatcacgcgcacgtcgtccatctcgaagcggcgctgcgcctccgcgcggtcctcgttctggtaccccgcatggtacgacgcggcggagacgcccgcgtccagcagctcctgcgcgatctggtccacctgcttgcgcgtgctcgcgtacacgatgcccgggtcgtccgggtgcgcgagcatgtagcccaccatccagcggcgacgctccttgggcgtgagcatgaaggagaagagcgagaggtttggccggtcaaaccccgtcacctgcaccgcagggtcatgcagcccgatgagccgcacgatgtcgtcccgcacgcggcgcgtggccgtagccgttgccgccaccacgggcggacgctccggcaggctggccacgaagtccgcgatgccctggtacgcggggcgaaagtcctgcccccactggctcacgcagtgcgcctcgtccacggcgaccagcggcacgcgcacgcccgacgcaaacgagcggaagcgcgggtccgccaggcgctccggcgccacgtacatgaggtcgtaccagccctgggcggcgcgggccatcaccacctcctgctggcgcggcgtgagcgtggagttgaggtagctgccgcggatgccagcctccttgaggccgcgcacctggtcgcccatgagggatatgagcggggacaccacgatcgtgagcccctcgagcatggcggcgggaacctggtagcacacggacttgccggcgcccgtgggcatgacggcaagggcgtcgcgtccctggagcagcgcctcgatcacctctgcctggccggggcgaaagcttgcgtagccaaagtggcgtcccagcgtggcgagcgcgtctgccatggtggggtgctcgtacttgcgtggggactcctgcctgtccgccatgctgccacctcgccctcgcgctcgcgtctgcgtccgaccgttgcccacggcgcgccggcgccgcacgcaccacgttatcacgaccgcccgcgggccgcccgccgccgttggccgaagcccgccccaaccgcgccaccagcgcggggccgcacccccggcgcgcgccgcggcccgtacgccacgggtttctcgcccgtgaccgcgggcccgatgcgcggaatgccccacgcgcggctggggtagactggattgtgtgtaactaggattggagcccgcatgaagaagaccaccaagaacgtcctttccgccatgggagccattgcgggcgtcgcggccgctgcgggcggcttcgagctgtggtcccgcaccaagtacgggcgctccggcgcggccaccgcggcggagggggccatccgcgccacgggcttccgcaacgtggtgctgggacgcgaccttggccgctacgacgactttgtggagaagagccgcgtccagaacgagcaggagtaccacatcccgtcgtggctgcacctgcgctcgctcgtgttcgaggagacctcggacggcatgaagatctatcacgtgggcaccacgggcaagaacgagcacgcggtgctctacctgcacggcggcggctacgtgtgccagatcacgccggcacactggcactttatagacaggctgtgccaggacaccggggccgaggttgtggtgcccatctacccgctggcgcccgagcacgactacgacgaggcatacaccctgctcacgagcctgtacggcgagctctgccgccgctacggggcggacgccatcacgctcatgggcgactccgccggcggcgcgctggcgctgggccttgcggaggccctgccccagaacaacatggagcagcccgccaacctggtgctcatcagcccggagctggacctgtccatgcgcaaccccaagatcgcggactactttgacaaggacccgatgctcgcgccgtggggcgtcgcgcagatgggcgacctctgggccgacggggacgaggtgagcaacttccgcctgagccccaagaacggcgacgtgagccagctgcggaacgtccttttgctggccggcacgcgcgagatctactacccggactgcgcggagtttgcccagaagctcgtaaccgcgggcgtatcctccgacctggtgatcggcaaggggatgaaccacaactggccgctgctgcccatcccggaggcacgcaaggcccgcaggcgcatagcggagtgcgtgctgcgcaaggtcaactgagccagcggcggggcttgcgtcccgcccgcgcgccgcgtccacacggtcgcacccagcccccgcccgcgcggcggggtcccttggctgcggcgtccgcgcatcacccgcgcaaaccgaatagcgccaccgcaccacactgcaccaccgcaccacactgcaccaccgcgtcacaaacgaaccaccggccgcccgcacggccaacactaggaaggcccatcacatcatgcccagaatcaccccaggcaacaagctgtacctgtatcgcctgttcaagacccagatcggcatcggcaagcaggagcgcgcgcagcgctttggggaggtgctggacgaggacgacatcgacccggaggacctgggctgcgacgacctgaacgcgctgctcgaggcgctgggcgacatgatcaagctcacggtgttcaagcgcggccgcgtgtacgcgacgctgcaggtcaacgaggagttcgagaaggccctggaggctgcgagccaccccgcacacaaggacaagtccgcgggcggcaagtcctggaagcacaacaagaaggcgtccaagctgcccaagccggcaaagccgcgccacaggaagcccaaggcgcagccccagcccgcggcggaggccaaggccgcagccgcgaccgaggcgcaggccgaagttgaggccacggcgcaggccgagcagcaggctacgccggaagagaaggcaaagcccgaggccgcagccgcgaccgagcagcagccgcaggcgacggagtccgcgggcgagaagaacgaggcccctcagcaggaggcggctgccaacgcggaggccacgccggaggctgcgcccgaggccgaggcagcacccgcaagcgagccggagccgcaggcggcacccgctcctgaggctgagcccgaacccgtacctgcacccgagcccaccccggagctcgagccggaaccgaccatcaacctcaccatcacgtacgacccggaggacgactcgcagcccgagccggaggacctcccagccgagggcagcttctcgttcgaggacgtgcgcccgaccgtggcggccaccccagccgcacccgcggaggagcccgcggcccccgaggacggcctttctcgccagtcggacctgccgcagacgatatcgctcgacgtgcactgcaaggacgagttcctgcgcgcgctgtaccagatgctgccgctcgacgtggacgtcatgagcgtgctggacgaggactggcaggtggcgcgctcgaccgcgctgctcaccggcacgcacagccgcgtcaccttccctttgcgctacctgcacgaggacgacggtcagcccgtgaccatcacgctcaagcgctccgcgcgcacggccgccggcaagcgctggagcgtcgcctgcatcgacggtgacgacggtaccggcgccatgcacgagcccgtgggaatcgagggtctgcccacgcaggacgagggcgcgtggagcgagctctgcggccccgtgcacgagctgcccgtcaagagccccatccgcgagtttgcgcagttcgcgatggtcggctcgtgggagtcgtacctcggcacgctcgccacgatggccatgcccgagcactgggactaccccggcgagggcgtcggccgcgccagccgctacggcatcctgcgcgagtacctgtgcgtcaccttccaccgcgcgcgccagacgggccacgtggcgcttgcggaggacggctcgctcgccgcgttcgacacggggctctacacccccttcagccaggacatttacgctgtctttacccccaacgcgggcgacatcgcctggaaggcggccggcttctgcgtggctggctccggccagatgggcgcggagctcgtggcaaagctcgacccgctgccccagcctgtcacctacctgcgcgagctttcggacgtggtgctcgacaccaaccgcctggtcgtattggatacggacgccatcctcatgcaccggctgggcgtgctgccgcgcaccttcctgcaagacgagctcgcggccagccccacggcaaccgagctgctcaacaaggcgaccccgggcgccccgggcaacccgctcatggacctcgcgcgcgccatcaaggcggatccgggcctgtatcgcaggctctgccgcgccctggacgaggcgctcaccctcacgctcaagcgcgcccgcgccagctaccgcatcgccgtgccggcctacgaccccacggcggacgcgctcaggctgctggtgccgctctgcctggtgagcgacgcgcaggcggactgcgcgctcgtgctcgcaccgcagccatccggcaactaccgcggcatcacgatcatgtcgctcgaccgagcccgcgtgtgcgcccgcaccgtgagcgcggagcagccggcgtggctcgcgcgtcccgcggcgtccgcgggcgagaaggactagttcgctactcggagcagatcgcgatcgaggcgctcgcgccgatgcggtccgcgcccgcctcgatcatggccagcgcctccgccttggtgtggatgccgcccgcggccttgatcttcatgcggtcgcccacggtcttgcgcatgagctccacgtcgtgcaccgtcgcgccaccggtgctgaatccggtcgaagtcttcacgaaggtggcgccgcccgcctcggcgcacttgcacgcgcgcacgatctgctcgtccgtcagcaggcagcactccagaatcaccttgaccgggtggccctgcgcggcctccaccacggccgcgatgtcgctcgtgcagtagtcgtcgtccccgctcaggagcttgcccacgttgagcaccatgtcgatctcagtggtgccgtcggcaacggcctggcgcgcctcggccaccttgccggccgtggagcacgcgcccagcgggaagctgatgcacgtggtcacgcccacgccggagcccgcgagccgctccgccgcgaacttggtccacgtcccgttgatggacacggtcttgaagtgccactcgcgcgcctcgtcgcacagcttggcaagctggtcctccgtcgcgttctgcttgagcagcgtgtggtccatgtactggttgagctccatcgtgcgcatcctttcgtctggctgccccgctgcggggcgcttccttccctctcgtcacgattagggtaaacgtttactcacccgcgcgtcaagaaggatttccgcccagcggcgccggccgcttcgggcgcatcgggcgagaaacccgcgccgtcccggtcgcggccctcagctatccgcaacaactcccccgcgcatggtggactcgcgccgcaccagctccacgggcaccagctcgcgccggccctccgccagctcgccgcgcaccatctggagcagcgtgtacgccgccagctcgccgatgcgctccggcgactgccgcacggtcgtgagcggcgggcgcccaaagcgcgcgagcagcacgtcgtcaaagcccaccacggtcacgtcggccggcacgcgcacgcccttctcgcccagctcgttcatgaagccaatcgcaagacggtccgtctcgcagaagacgccgtcaaagtccaggccgcgcgccagggcctcctccgcagcggcgtgcccgcccgcaaagtccgtggccggcggggtcagcacgtggtcgtcgggaaggaaaacgcccagctcagcaagggtgtccgcaaagctcttggtacgtacctccgtgatgggaaagtgcgccgtcgcgctcaccagcaggggccgcgtgcagccgctgcgcaccagctcccgggccgcaagccttccgccagccacgttgtcggacatcaccacgctcacgtgcggagcaagctcggccggacggtcgatgtagaccacgggtacgtcgtggcgcatggccgcgcgcacgtcctccagcgcgtttgcgctgatcacgccgcacacgcgctgcgccgcgagcgaggcgtagcactggcgctccatgtcgagcgagtggttggtgttgaagatcatgatggaaagccccgcgtcaaacagccgctgctgcacggtcataatcaggcgcgagaagaactcgttgctgatgttgggcaccaccacgcccaccaggtccgcccgctgctggcgcagtccccgcgcgagctggttgggctggtagcccaggcgctcaatcgcctggcgcacgcggcgctccgtatccgcggagaagcgcccgttctggttgatcacgcgcgacacggtcgcgacggagaccccggcctcccgggcaacgtccttaaccgtcacgcgcgccatgcgtcctccagccatctgcaagcaacggctcccatggtaccccaacgcacgcgcgcgtccgccggccggcccgggcgccgcggccaaagccatcccaaagcttaaatctgcgctacaaagccacggcgggacgcacttctcgcccaagcgagcggcgcaaagccgctagacttgggactcagttggtcagttgtcgagaaaaacgggcatccggaggacgcgatggcaaagattcagatgaagaccccgctcgtcgagatggacggcgacgagatgacgcgcatcatgtggaagatgatcaaggacgacctgatcgtcccgttcgtcgacctcaagaccgagtactttgacctggggctgcagaaccgcaacgccacggacgaccaggtcaccgtggactccgccaacgccaccaagcgcctgggcgtggccgtcaagtgcgccaccatcacgcccaacgccgcgcgcatgcaggaatacgacctcaagaagatgtggaagagccccaacggcaccatccgcgccatgctggacggcaccgtcttccgcgcgcccatcctggtaaagggaatcgagccctacgtcaagaactggaaggcgcccatcaccatcgcgcgtcacgcgtacggcgacgtgtaccgcgacgtcgagatgcgcatccccggccccggcaaggtcgagctcacctacacccccgcggacggcggcgagccccagtccgtcacggtgcacgagttcgcgggccccggcgtcgtggagggcatgcacaacctggacgacagcatcaccggctttgcgcacgcctgcttcagctacgcgctagagaccaagcaggacctgtggtttgccaccaaggacaccatcagcaagacgtacgatcaccgcttcaaggacatctttgccgacatgtacgaggcagagtacagggagaagttcgaggccgccggcatcgagtacttctacaccctgatcgacgacgccgtggcccgcgtcatgcgctccgagggcggtttcatctgggcgtgcaagaactacgacggcgacgtcatgagcgacatgatctccaccgcgttcggcagccttgccatgatgacctccgtgctggtgagcccccacggctactgggagtacgaggccgcgcacggcaccgtccagcgccactattacaagtaccttaagggcgagaagacctcgaccaactcggtcgcgaccatctttgcgtggacgggcgccctccgcaagcgcggcgagctggacggcacgccggagctgcagcgctttgccgacgcgcttgagcacgcgaccatcgccacgatcgagagcggcaagatgaccggcgacctcgcgcgcatcaccacgctccccaacccgcagaagctggacacggaggagttcatcctcgcgatcgcggacgagctcaagcgcgagctggcgtaacgggggcgacggatgcacgactacaggctgcttgcgctcgacatggacgggaccctgctcaactccaagaagcaggtgagcccggccacggcccaggcgctgcgcgggctgaccgacgcggg

SEQ ID NO: 198 - DNA, 1997 bp, Unknown
  Metagenome-assembled genome
cgggatccccggctccgactttggcgggtccggcgggaggaaccgcacctacacgtacaccacgagcggcaacggcgccgactggtccgagatattcgacaacatccggagcggcgacggcgcgtttagcgggttcgacttctcgtccatcttcggcggggcaggcgcccctggcgcggccagggcgaaccgtcccgtcaagggtggggatctcacgatgtcgatcgacatctcggccgaggaggcgttctcgggcgcgcagcgcaaggtgtcgtacaccatcccctcgacaggggagcgccagtcgcttaccgtgaaggtgcccgcaggtgccgtgaacggcggcaagctacgctaccgcggtcgtggcgagtacggcatgaacggtggcgcgcgcggcgacctcgtggtcaccacgaacgtggccgagcacccgctcttcaagcgcgatggcgcggacgtgcgcgtggagctgcccatcagcatgtacgaggcggccctgggcgcgcaggtcgacgtgccgacgccgagcgggcacgaggtcaggctcaagattcctgccggcacgcaggacggcaagacgttccgcttcagggaccttggcgccccggacgtgaagcacaagggaagtcgtggcgccatgtacgtgacggtcaaggtaaaggtgcccacgcacctctcggccaaggagcgcgagtccctgcagggcctgctcgataacgacaagcgcgactaccgaaaggacgttgagcgctatggcgcgtagtagggacgaggacgacaagaacaagccactgtacatgatcagcgtggcggcggagctcacgggcatgcacccgcagacgctccgcgtgtacgagcagaagggcctggtcacgcccgggcgctcgcgcggcaacacgcgcctgtactcgcagggcgatatcgagcgcctcaacctcatcagcaagctgaccgacgagggcatcaacctcgccggcgtggtgaggatcctggacatgcgggagcgtgccaaggagcgcgacaaggagatcgaccggctgcgcgaccgcgtgcgcgagctcgaggacgaggtccacgagttccgcatgagggagaagatcacggccctcgcccgttacgacggtgcgggaccggagcaggtcatgcgcggactcctttccaacgggagggatggcgacgatgacgcctgaggccacggccggcgcatcccgcacgcacaacctaaggtgagcccaaagggcgcgactccaggacggggccgcgcccttctcgtcccggggcttgtctttaggttctctttaccacgcgtagaaaatctatctaacagcgacttagatttgtgtatagtccccagctcacggggaataatgaacagtgataaatcggaatcccggaagggggcaacttatgaggtttgacaagtgggcggtgacggctcaggaggctctgcagtcttccgtgagcattgctgccgatgcggaggcaggtgaggtgaggcccatccacctgctcaaggcgctgctgcagtccaacgagcgcaacatacgggccatcatcgagcgcgtgggcgcggaccccgcgcaggtcgaggcgcaggtggacgacaccatcgcgcacgcaccgcgcgtgacgggtgacatgagccagatgagcatcagcaacgagctgcgcaaggttggcgacgaggccgagaagctcgcctccaagctcggtgacagctacgtgacgagcgagcacctgctctgcgccctcgcggacgagaagggcgacgccggatctgcgctgcgcggcgcgggcatcacgggcaagcgcgtgcaggaggcctacaacgacctccgcggcgacgagcgcgtgacgtcgcaggacaccaaggcgcagttcgaggcgcttgagcagtacggtcgcaacgtgacggacctcgcccgtcagggcaagctcgacccggtcatcggccgcgtcgaggagatccgccgcaccatccaggtcctgagccg

SEQ ID NO: 199 - DNA, 7527 bp, Unknown
  Metagenome-assembled genome
cgtgaacgcgccctgcggccgcacggccagcgcgacgtcgcgcatctgctcgggcgtctcggccatgtcgcggtcgaaccacagcagcatgtcgctgtagaccccgcccacgtggtaggcgatggcatagcgcaggcgcgggtcggtggagtccgagacccgctccgcgccaaaggcctcggtcagcgccgggagcagcaggtaggaggccccggcgcggtgcagcgccagcatctgcttcttgtacaggagcgtgacgcggaacatcagcagcaggtagctcgcgaggtcggtcgagccgctgcgacggaacctgctcacaaagtcgtacaggtagcccacatagaagcgccgcacgacgtcctccttgtcgcgaaagtgccggtagaacgtggtgcggtcgattcccgcgctgcgggcgacctgcgccacggtcaccttcgagaaaccctcgcgctccaggagggccagcagcgagtcggtcaccgcggcctcgatggactcctccgtcattccaaccttgcgcatgagtgccgcctcccacgggtcttgtcttgtctgggcgagaaggacgacaaagccacacccagcccaatgtgtcgcggacgcgggcacgtccctctcgcccgcgcctatagtctaaagcaacaactgttgcataagacatccggcagcgaaggagcacacatgaacaagcttgcggacgacctctaccagttctcgatctacatcccgcccatggacttcaccatccaccagtacctgctggccacccagcccagcatcctgtttgccgccggcacggcgcagcaggcacatgcgatcatcccgcagattcgcgaggtgctgggcggacgcgacctggactacgtgcttgtgagccacatggagtccgacgaggcgggcggcgtcttcgagctgcgccgcgccttccccaacgtgaaggtgatctgcgggcagctggccgcgcgcgagcttcccggctggggctacgacggcgcgctcgtgccggtgcagggcggtcaggtgctgcaggatgacggccttgacctgcggattgttgactaccccgccgaggttcacgaccagatgggcatcgtggcgctggaccagaggagcggtctgttctatagcgcggacctgttcctgcgctttggcaacggcgtcggcaagacggtggaggccagctgggaggacgaggtccgcgccatcgacgcgcagcgcgtgcccaacgatgccctgcgcagccagctgcaagagagcctgctcgagctgtcgcccaggttcgtcgcggtgggccacggcttctgcctcgactgcaagtaggcggaatctggggcggtgcggcatctggcgcggcggctacagcccaagcgcccccagccagccaaacagcctcacgagcggcggaaacgtgcgcgggtcgtgccggtagatcgtgaccgtgccgatcatgtgttgccagcgcgggttgtcaatcacctccatgtgggcaatcgggcggcccgccgccgcatcgagcgcccgcgcgaacgccatctggtgcgcgtaggggctcagcgtgtcgtgccggccctcgacggagaagaacggcggcagccaactgccaggctctgccccatcgccaccgttcttctcccccacgatcgcgacgggcgagaagggcagcagtgcctggtggatggcccctcggtcgtgcgcgtcgcacggcaggtccacgcacgagcgccacgcgtgtgccgtgggaagcgggcgcagctccaggtcgtccgcgtccacgatggccgcgctgctgacaacggccgcgacgcgccgctggtcaaagccgtggctcgccgccagcgcgcctgagtagcccagcaggcaggccagctgcccgccggcggagctgccgcccaccacaacctggggcgcggtgcagccgtgctcggcaagccacgcgagcgcggcacccaccccggcgtaggcgtcgtccacctgcgcgggaaagcgcaccccgggcaccagcccaaagccaaccgacacaaagcggtacccctggctgcagtacacgcgggccgcgtcgatcatggattccggcgtccccaccacaaagccgccgccgtggaaccagaacaccggcgcctcgtggcgcagggtggccggctgccacagcacgcagtgctgcagcctgccgggaccaaacggtatgcacacgggcccgcccgcaaacatggcgtcgccacgcagcgcgggcctggtggcgtacgccgcgggggtcgacgctatctcgtacagggtgcccatgaggcgtcacgtccttctcacccagtcgctatgcccgcttgatgcccagctcctgagccaggtagcggcccgtgacggagtccgcgcacgcgcacacctgctcgggcgtacccgcgcacaccacgcggccgccggcctccccgccgccgggccccaggtcaatcacgtagtccgcgttgctgatcatgtccaggtcgtgctcgatcaccaccacagtggcgccgttctggatgagcccctgcagcacgcccagcagcacctccacgtccagcgggtgcaggccgatgctcggctcgtcaaacacgtacagcgcgccggactggtcgcgacccacctggctggccagcttcaggcgctgcgcctccccgccggaaagcgcgggcgtggcctcgcccagcgtcaggtagcccaggccgatgtcgctcagcacctgcagctttcgcgtcacgctgcgcaggctccccaggcactccagcgcctggtcaacggtgagctccatcagccgcgggagcgacacgccggcaccatcggcatcgggggactcgtgcgccacgctcctgccgtggcgcagcggccgccgcacctgccaggccgcgtccgcgtagcgcgagccgcggcagtccgggcaggtaacctcaacatcgggcagaaactgcacgtcgagcgatatggtgcccgtgccgtcgcatgtggggcaccgcagcgaacccgtgttgtacgagaagtcgcccgccttcagcccgcgctcgcgcgcgtcgggcgtcttggcaaaggcgcggcgcaggtcatccatgacgccggagtacgtggccaccgtggagcgcacgttggcgccaatcggcgtggagtcgatcagctccacgcgcgtgatgcccgccgcatcgcaggcgcgcacgtgcgccgggcgagaagagcctcccgtcttgcccgcggcctgggcctgcagcgccggcaccagcgcctccagcacgagcgtggtcttgcccgagccagagacccccgtgacggccgtcatgcggcccacgggcacgtccacggcaagcggcctcaccgtgtggatctgccccgtctccaagtggatgcgcccctggtcaaacagggcgtccgccccgcagcgctcccgcacgcgcacggtgcgctcgccggagagaaacggcgcgatgcgcgaggcctcgctcttctccacctgggccacgctgccctgcgccaccacggtgccgcccttggcgccggagcccgggccgatctctatcaggtggtccgcatggcgcagcacgcgcacgtcgtgatccaccagcaccacggagttgccgtcggccagaaggtcgtccaccacgcccaggagtccgtccacgttggccgggtgcaggccgatcgagggctcgtccagcacgtacagcacgcccgtggtgcggttgcgcacggcgcgcgccagctgcacgcgctgcagctccccgttagagagcgtgttgctcgcgcggtccaggctcaggtaacccaggcccagctgccgcagacgcgcgatgggctccgccatggaagccacgatctggtgcgccatggccgccacctcgggcggcagcgtccgctccacgcccggcagccacgcggccagctggtccagcgtcatctgcgtggcttgtgccaggttgatgccgcacacctgcgggtcgcgcgccgcggcggaaagccgcgtgccgtggcagtccgggcacgggccctccttcagaaagcgcgcgatgcgcttgagggcgctttccgtcttggccttggccagcgcgttttccaccgacgccacggccgagtagtacgtgaagtccagctcggtcgcggtgttggtccccttgttgcgcacgaccacgtggcgcttctccgcgggcccgtggaacacgatctcgcgctcctcgggcgtcagctggttgaagggcacgtccgtgcgcacgcccatctcgcggcacacgtccttcatgagcgaccacatgagcgtgccccacaccaccacggcgccgtcgtctatggacttggtctcgtccggcaccagcgtggactcgtccaccacgcgcatggtgcccgtaccgccgcaggtgaggcaggcgccgtcgctgttaaaggccagctgctcggccccgcggccatagaatttctccccgcagacggggcacgtgatgggcttctccagcgccacgttcatgctgggcgggcagcggtggccattggggcacgtgtaggatcccacgcgcgagaagagcaggcgcagcccgttgagcagctccgtcgcggtgccaaaggtcgagcggaccccgggcacggcgggccgctgccgcagcgcgagcgccgccggcacgtgctccaccaggtcaacgtctgcccgcgcgctctgcgtgatgcgccgccgcgtgtaggtggagagcgcctccaggtagcgtcggctgccctccgcgtacagcacgcccagcgccaggctcgacttgccggatcccgacacgccggcaatgcccaccagctgccccaacggcacgtccacgtccacgttctgcaggttgtgcaccctcgccccgcgcacgcggatgcaggtaggggccttgttcttctcgaccgccaattgaaacccttccggctagactcgatatttcaataatctattccttgtcgagttcggccatcgtctgtctaaccgtatggtatgggccaaacaggttctttcccgtggccgcgtcacccatcgccgcaagcgtttcgctactaaatccatgtggattcgaaatgcctgacgggagttccccgcacccgttggatgtgctcggatccttctgccacaagtgcgcatggcgttcgtgttgactgttccgactcatctgccagccgccccttatgcgttcgcatcgatcacgccccaatgctagcaaattcatgtgttcgcataagtttgacggccgcacagcaaaagggcccgcctaagcgggcccaagccaaagcgttcgctgtcgagaagtacgaccctccgcgcaggagcctacacggaaagcatggaggcacgacgggcgtgcagggccttctcctccctgtcagagaagttcgcgatcacctcgtcgagggccgccagggcctcctgcttgtcctgcggcaggtgcgccctcaggaagatgctgctcgcagcggtgccggagaggtcaggttcacgcaaggacgggcgagaaacccggcccccaagcccccaccccagacggggcaaggggcacggggccgtccttctcgcccaccgcccttcttgcgcaccgttacacacctatatatctatgtttctaggattgtcagtacacaggaggccgcacatggacatcttggaaccactcgaggcgggaaggctctcgctccccacgcgcatcgtggtgccgcctatggccacgcagagcacggaggccggcctgccgggcgggcgcaccatcgcgcattacgaggcatttgcgcaaaacccgctggtggggctcgtcatcacggagcacagctttgtggaccccgcgggccgggccgacccctaccagatgtcgttcgcgacggacgacgtggtgcccgcccaggagcgcctgacggccgccgtgaacgccgcaaatccgcacgtgcggctgtttgcgcagctcaaccatgccaggctcaacacgtccgaggccatcaccggcagcccgttggtttctgccagcagcctgcgcacgcaggagggcacaagccgcgcgctctcggccgaggagatcgcccggatcggggacgagttcgcggcggcggcgcggcgcgtgcgcgaggccggctacgacggcgtggagatccactccgcccacggctacctgctgaaccagttcttctcgcccctcaccaacttcaggacggacgcgtacggcccgcagagcgtccagaaccgcacgcgcttcctggtggagaccgtgcgcaaggtgcgcgccgcggtgggcgacgactttcccgtgtccgttcggctgggcgggagcgactacgcagagggcggcagcaccatcgccgacgcggtggaggccgcgcggatcctggaacgcgagggcgtcgacctcgtgaacctctccggcgggctcaacgtgtacatgcgccgcggccacagcgagccgggatggtttgccgacatgtcggcggcggtgcgccgggccatccacacgccggtcatgctcacgggcggcgtgcgcacgcccgaccaggcgcagcgcctgctggatgacggcgcggcggacctcatcggcgtcggccgggcgatgctcaggaacccccgctggggcatgcagccgtaagacggcacgcaaggaggcacattgcgctcgcgcatgcgggtgagaagggcaagacaaaggagaagcaccatggcacggaaggttctggtggtggggacgagcccccgcctgcacggaaactcgaacatcctggcagaggcgtttgccgacggcgcgcgcgagacgggaaacgacgtcgagttcgtcccgctggcaggcaagcgcatcggcttctgcgtgggctgctggggatgcctcaagaccaagggctgcgtcgtcaaccacgacgacgccgaggtcgtggtgcagaagatccgcaccgcggacgtggtggcctttgccacgccgatctactactacgagatgagcggccagatgaagacgctgctcgaccgcaccaactgcctgtacaccgcagactacagcttccgcgacgtgtacctgctgaccgcggccgaggccacggcgcccgacacgccggagcacgccatcggcggcctgcgcggctggctcaaggtgttcaagaaggcgcagctcaagggcaccgtgtttgccggcggcaccacggatgacggcaccgtcaggggacatcccgaggtggaggaggcgcgccagctgggcaggggcgtgtagaagcgcgacgctacttccatcctctgcatgcgcgaatacgcgatatggcctctgacgccggatgcgcgttgccgtcaacggcatccttgtacccgcgcatgagaccatcggggattgccaactgctcctgcccggccaaggcttcgcgacagagagaatctggcgggcaaccttgcgtcccactttggccagcggcacccgcttctgaatgtactgcaaagccactcgctgagactgctggaaacacgcggactcctctctcccgctcccgtcgatttgaggatcagaataataccgcacgccactgtcgggaaagcagaaa

SEQ ID NO: 200 - DNA, 9424 bp, Unknown
  Metagenome-assembled genome
cgggcaacgtgtcgcccgacaggccaaacctcaccatcgcgggcgtgcgcacggtcttctcggccaccggcgaggaggcagacagcgtgatcgagcgcatcgtgacggaggcccgccacgacgtccgtgccgtcacggtcatcacgtccgacaacacgatccgcgccacggtgggcggcatcccggtcacgcgcctgtccagcgacgtgctgatccacgacgttgacgccatcgtggaggacgtgcgcgccgctaacgacgagcgcaaccaccagcgcctcacgctggaggatcgccttgaccccaagacgcgccagaagctggaccgcctcctcggccgcatctagccccctccgcaggggagaggggcaagggcagcagggcgagaagaacatggcccccacgttgtacccgcccaccgtatggatgtgatgtgccggcgcgcgacgtctggcgcaaacgcccgcctaacgatatgattcaatagctcgctggcgtagctcaatggcagagccctggttttgtaaaccagttgttgcaggttcgactcctgtcgccagctccagacattttcgcaggtcgcacggggtgtcccgtgcggcctgctttgcgtttctgggtgatgtgtgccagcgcgcgtaccagatgtgtgccaaagttgcaccccaaacccatgcgtcaagggccatggtccgcgtcggcaaacggtgccatttgtcacttgtgggatactgtccactacagacaaatgcaagatttgctctcgggggtgcttgtagtgataactggagcggtgaaggcaaaggttgatgacgtctggcagcgcatgtgggagggcggaatcaccaacccgcaggaagtcatcactcagctgacctacctcatgttcatccgctctctcgatgagcaggaacttgagaccgagcgtatggaggctttgggggtgccgggtgagcacctcttccccgatacctttacaaaggacgacggcagctcgattgctggctcggagctgcgttggaatgtcttcaaggatcaagctccggctaccatgctcacgaccattcgtgactgggtcttccccttcatcaagcagctccacgacgacacgcctttcgcgcggtctatggcggatgccacctttggtatcaacaacccccgtaccctgcagaaggcggtcagtggtatcgacgagctcatgagcggcttcgacgataacatggatgacctgggcgacctctatgagtacatgctctccaagctctcgaccgcaggtactaacgggcagttccgcacccctaagcacattcgggacatgatggttgccatggtggatcctcgccctggcgaggcgatatgcgacccggccatgggcacagccggttttcttatcagcgcttcggattggctgcgtacgaagcatgcggacgacatgcgtgacgaagactgggccgccttcagaggacgggctgacgagaaggacgcccggggacatgtgacccatccgggtcgccatcagttctctggtggcgagaccgatcagaccatgtatcggatttccgccatgaacctgcttctgcatggtgtggagcagccggacatccgtctcgtggactccgtgagcaagcagaacacggtgacgagtcgcttcgatcttgtgctcgcaaacccaccctttacgggcaatgtggataaggaggacattgccccctcgcttacggccatctgcgacagcaagcaaaccgagcttctctttgtggctctcttcctgcgtatgctcaaggtgggcggtcggtgtgcctgcatcgtacccaatggagtcctcttccgcactaactccaaggcatatcgtcagttgagacaggagctcgtagagcaccagcaactccgcgccatcatctacatgccgagtggagtctttaaaccctactcgggcgtcagtaccgccgtgcttgtctttacaaagactgacgcgggtggtaccgacaaggtttggatgtacaacatggagggcgacggttttacgctcgacgataaacgggacgtcgattcctcccatgatgatattcctgacatcttggaacgctggaaccatctcgacgatgaagagaagaagcgtgatcgcaagcagaagagcttctttgtccccaagcaggagattgtggacaacgattacgacttctctttcaacaagtatgtggagaccacctacgaacgagtcgagtatccgcctacgagtgagcttctctcagagctggaggacttaaaccgacagatggctgacgggttagcagagctcaggagcatgttgggcggtgaaggcaaatgacaagcaaactgccgtttggcggagagctggtacagttgggagacctatgcgaactggttcttggccagtcgccatcatcggagagctacaacacggtcggcaagggacttcccttctatcaggggaacgcggatttcgggaaagatcacccatctcctaagacttggtgcacagatcctaaaaaggttgctgagccaggagacatactcatctccgtgcgagcgcccattggagctatcaataccgcggttgaacgatgctgtattggcagaggcgtggctgccattaggccaaacgcagatgtagcgaaccctgagttcctgaaatttcagctcattgctcacaggacaatcctagaggcccagggaacgggcagcactttcaaggctgtcggaaagaaggttttatctgagcatccagtcacactttatccgatggacgttcaaaaagagctcgcacgacattttgcgtccatcataagctgtataggcgttgccgatgcgcaactctccgtactctccagcctcgtcaaatcccggtttgccgagatgttcggggacggggatttcccccgttttcgtctcgacaaggtagccgatgtgcaagggggacttactaagaataggcgtcgtgaaacactgcccatgcggttgccatatctgcgcgttgccaatgttggcccaactggaggcgtggatacaaacgaaatgttatctattgggcttaccgatgtagaggctaggaaaacactgcttaagactgacgatcttctattcgttgagggcaatggcagtaaagatcagatcgggcgcgtcgctatctgggatggctcaatcgatccctgcgttcaccagaatcatctaattcgtgctcgtctgtataaggacgtacttccgatattcgcattgacgtatttctcatccccagatggacgcaggcagataaccaataaggccgccagcacgtcaggtctcttcacgttgagcacaggcaagatcaagtctttggtactgccggtcccgccgctatctctgcagcacgagttctctgattttgccgctcaagtcgacaaatcgcgagttgttgcccagaaacagaaggagaaactgcagaccctttatgacagtctggcgcaggaatactttgcaatttaggacacgaccatgaacttcgcattcctccaggacatagcagagtacgagatgtttgctggcgcctgtattgacgcggagcggactttctcgacaagccccaccatgtgcgtcttggcttgccgcaaagctatggagctggctgtaaagtgggtctatgctgccgatgggaccctgaaggaaccttggcgagacaatctagccgctctcatccacgagccgagcttcaaacacgccatggatggggcgacctggagccagctccgctacatctggcagttgggcaacgaggcggctcacacaaagcgacgcatcgaagccaaggatgccgttgtggccctgcgcgggctcttcaacttcgtggagtggattgactactgctacggccctgcttgggttgagcggaagtttgatgttcgtgagatacctgcagttaagcaagcccttaccgagcggactatcaaggaacggctcgccgagagcgccgctaaggataagcgcattgctgagctggaggcccaagtgcgtgcgcttcagccccagtttgccgctgccaagcaggagcatccggctgatgacttcaaccccgatgacatacccgagtacgagacgcgccagcgatacatcgatatcgacctgaagtacgctgggtggaaccttgacgagaacgtcaagaccgaggtgcccgtccccggcatgcccaacgagacgggccagggctttgtggattacgtccttctcggaaagaacggtaaaccgctcgccctcgtggaggctaagcggaccatgtatgatccgctgaagggcgagcagcaggctcggctatatgccgactgcctggaagcccaatatggccagcgacccctcatcttcctctccaatggctttactacctactttatggatgacgggaatgcgcctcgtcgtacctgttcgggcgtattctcccaagatgaccttcaacggctcatgaaccgtcgcggccgggtggcgaaacttgcagacgtgcaggtgaatactgatatagcgggtggcggaaccaaccgctactatcagctggaggccatcagagccgtttgcgacaatatggaggctggccatcgcaagagtctcctggttatggccaccggcactggaaagacccgtactgtagctggactcgtagacctactcatgagggcgaacgcggtgaccaacgtgctcttcttggcggacagggtggctctggtgtctcaggccaagcacgccttccagcagtacctgcccgacgcgaccctctgcaacctctgcacgacgggcggcaagcgggaaagtgccgatgctcgcatagtcttctccacctacccgaccatccttaatgccgtggacagtgtccgcgacgagggcaaccagaggctgtttacggcagcccacttcgacctcattgtggtggacgaggcccaccgctcgatcttccggaagtacagggccatcttcgactacttcgatgcccccgtggtggggcttacggctacgcccaaggacgaggttgatcgcaacacctacgacttctttgaggtggagcggggcatccccacctatctctacgagtacaagacggctgtcgatacggatcacgtgcttgtgccctaccgaaacatcgaggttgacacgaccttccttactgacggcatcacctacgacgacctctccgaggacgacaaggaccgctatgaggatgactgggaagaggcccaaggcactgatccggcggatttcgtaccatcaagcgatgtggataagttcgtctttaacgagcagactatcgatttagtgttccaaacgctgatggacgagggcatacgtgtcaatgatggcaaccgcttggggaagaccatcatttttgcccagaaccgcaagcacgccgcccttatctgcgaccgattcgacaagctctggccggagttgggggcagcgggcttttgccgcagggttgtccatacagatgattacgcggacacggtcatcaccgactttgagactaaggagatgcccgtcatcaccgtctcggtggacatgatggataccggtatcgatgtgccggaggtggtgaacctcgtcttcttcaagcaggtgaagagtaaggtcaagttctggcagatgattggacggggtacaaggctgtgccccggtcttggtgtagttgaccgttcgggtgtgcattccgacaaggagtgcttctacatcttcgattggtgccgtaacttcgagttcttccgtcaggagaaggacggcgctgagggaaagatgcccgaatctctctcggccaggatttttaagcgacaggccgcaatcgttaaagacctgcaagatgcggctttttcagatgatgagcacagggcctggagagagagtttagtttctcagatgagcgcccaggtggcggcattgcgcagtcccctgcgggcgcctgccaagctgatgctgcgcgagattgataagttcgcacagtcgaccaactaccagtgtctaaatgacgcggatctcgcggacctgagccgggtggcaaacttagtagctcccactaccgatgacgtctgcgcgttgcgtttcgactcgctcatgtacgcctacgtgctggccgtcatggagggcggcaataccgacagcgtcagatcgcaggttgtgggcaaggcggtgcgcctgcaaaagaaggctacagtgccccaggtggaagccaagctggactatatcaagcaggtgtgttcggaggactacctcgcttctccaagcccgctgcgccttgaagagctgaggcgggaactgcgcgaccttatgaagttccttaaggatgaaggtcggggcaagcctgttgttacacgcatcaccgataccgtcgtggggcggcgtgagggggatgtcctttacccctctgaggattacgaagactacaagctcaaggtgaaccgatacgttgaacagaacactgacagatcggtgatctacaagcttcggcataaccagcccatgacctcgttcgagttcgaagaactgggaaggatattcacgcatgagcttggcagcgaaaccgattaccaggcagcctacgggcagacccccttcggaagactggtgcgtcagattgccggcctcgaccacgaggcagccatgactgccttcgcggagttcctaaatgacgaatccctcacccgtgcgcagatggattttgtacacaaggtcgtggactatgtggagcacaacggctacatggagctttccgaactgaatcgcgccccattcgaccagccgcagaagtttgtgcggctctttgacggcaagcatgcccagaggctcgtccagctcatcagcgcggtgaatgacaatgcggtaaagcccgctgtttaagtgggtaaggggcggatgtaagccgaggccatgcgcatagatgcgcgaagcgcgtccatccgcccgactggaggtgtggcccaatcctttgaggaggggtcatgtacgagggaaagcgcatagtcgagcaggtggagcggatgatggcgccctctcttaaccaagggcagcgtgagctgctgcgcgcagtgctcgttcactgtcttgacgatgaggcgatcgaagccgatgcgaaggcaaaggctacaaacggggcgatgctcgaggccttcctctcggccaagcgactggaaggttgctcggaacgtactatcggctactacacctctgtccttacagcatttctgggcggtgtcgacaaagggctgcgaggcgtgacgaccgaggacgtgcgcgggtatctcatcgcctatgggaatcgttcgggtgtctgtaaggtgaccgtggacaatgtgcgacgagtcatctctagtctcttttcgtggctggaggcggaggactatatcctcaagagcccggtgcgaagaatcaagaaaatccgatctccgaaaagcatcaagcccgtaatctccgatgaggaaatggtagccatgcgcgatggctgcgaagttatacgcgatctcgcaatcgttgacctgctcgcttctaccggcatgcgcgtgggcgagcttgttaggcttgaccgcgatgacatagattttgagggtagacagtgcgtcgtgcgcggaaagggtgacaaggaacgcagggtttacttcgatgcccggactaaggtccatctcagtgaatatcttgacgggagaaacgatagcaacccggctcttttcgtctctcttgacgcgcgtgcaaaccggctagagataagcggggtggagttacgcctccgtgagatgggccagaagcttggtcttgggaggattcatccccacaaattccgccggactatggctacgagagcaatcgacaaaggcatgccaatcgagcaggtccaggtacttttggggcacagcaagattgatacgacgctctgctatgcgatggtggaacaggaaaacgtacggcaatcacatcggcggtatatgggttgattggacactggcgtgggggtgccgatctggggcgttcgaaagcaacctaagcccaaaactgccgtttaacggggagcgggtgaggctagaccagatttgcagcaagggcaaatcatccctgcgcttgaaggacttgcagggtggtggcgaatatgccgtctatggagcttccggagtggctggtgctatagctacatatcagaatgataggccatacgttgccgtcgtgaaggatggtgctggcgttggccgcgcgagtctatgcgagccaaggacttctgtccttggcacaatgcaagcgctaattcccagcgaaagggtggattgctcgtacctactccatcttgtacggtcgcttcgtctgggttctggctacagcggttcgacaattccgcatatctatttcaaggactacgggaaacttgttgtaccccttcctccgattcccgagcaaaggaatattgctgggcaacttgacgcgttggaagctgcgatgcgggtttgtgacgagcaggcggccgttctttcgaaactcgtcaaatcccggtttgttgagatgttcggtgacccggcttccgctgaggccaaatggcccaagcgaaaggtctctgagttctgtgaactacacatcggcccttttggaagcatgctacataaaagcgattacatctcaggtgggcacccactcgtcaatccgtcgcatattatcgatggagcgattcgcgtggatgacaccttaacgattgacaatgagaaatattcgtcgttggaaccctatcaactgcatgttggtgacgttgtgctcggccgtagaggggaaatcggtcgttgcgccgtggtaaagcaagacgggctgctttgcggtactgggagcatgattattcggccaaacaaggattgtcgtagtgactttctgcagcgagcgctctccttcccgtcttttgcagaacaacttgagaatcgcgccgtcggagtaacaatgaagaatctcaacgcaaagatagtcggcagcgctgccatttccctgcctcccatcgaaaggcagaatgagtttgcttcttttgccgaggaggcagacaaatcgcgatttggcattcaaagagaaggaacgagtgttcttgactttaaggctccggtggtttggttaggggcggacgatgtgcgtggaggagagctccgatccaagagttgagcccactaaagggtcttaggtgccttgagcgtgcctcagctcgacccttgtcgccagctccagaagaatttggcgccaaaatcggaaaagattttgacgccttttcttttacgtgggcagttcttctcgcccaaagcgttgtcctacaccccctctgacctgcggttgtgcaggaaatatgagggggatacgcccggatgggtggaatgcgttgacaagttcgtttccacgtcgtaatatttcccccgcttgcaagggaagtcccaattgcaggcgagct

SEQ ID NO: 201 - DNA, 24557 bp, Unknown
  Metagenome-assembled genome
cgtataataaatattcgctgttcaggcagccatcggttgccagcttagctcagttggtagagcaccgctctcgtaaagcgggggtcatcagttcgagtctgatagctggctccatgtaaattcgcaggtcaacggctatggaggtcgttggcctgctttcttttgcgatgcgggccggcgcgcctacctgcggttggtctacggcctcccaatctgcccccggcctctagtccccaattcgtgccccccagcccttgcgccaagaagatcgttgcgtccttctcgccctgccgtgcgaggcgtttggtcgccagaccagttgcgcggcttgtcgatgcgacaaatctgggcgcgtgaccgttggccgccgccgtcactccccggataatcgagcggatagtcaaattgggatccctggctcgcggagccgggtggcttttggcagggggacgcacatggcagaaaaggcgcggtccaaggtgggttcctacgggctctgctttctggttgggggagtctacggcgtgattggccagctcataggcgtcgcgctcgagcctgtggtgggcgctggccttgcggccccctgcacgctactctgcctgggcgtgctggccgtcctgctgtacgtgccgggcatccaccagcggatcgctgcggtcagcgggtttggctcaatccttccgttcaacgggtttgcctgcggcattgcggatgccttccaggcgggctacgcggacggaggcggcgtgtccggtgggctgcgtggcgtcggaaggctcttctttcacgtgatcgtcctcagctccgtggtgaacatgctcgcgggcgtgctggcagccaacgtggcgcttcccaaggtcgccgtgccgcacgccgtccccatgccgatggcggtcgcggcgggcttcgtggtggcgggcctcgtttgcatcgccttccaggccgtgacggacgctggcggcttccaggtgccaaacgtgctgctggtggggcagtcgctcggcggcgtgctcacgctgtttggcgtcacggacgtgctggccgcgctcggcgggtactccttcaagatcctggtcatgggcgccggccaggccgtcatggcaaccacggcgctcgcgtgcggcggaagcgccctcatgctgctcgtcacctggggaacgttcttcgcgcttgcgctgtttggcatcgtggcggcgctgctcaacctcaggcttcgcgccaggtaggcagcgagtcccacgcgccgcgtgccgggcgagaaggaccgcccccctcgtcgcagccgtctgccgcgtccgcgcgaccgttcaaacaacagaccgatttcctttgaggcccggtgtctgcctgcaggcaccgggcttctcgtctgtctgccctgaccgttcgcgaccgtattgcaaccgttcagtcaaaatcaatcatcggaagtgacggaaaatgattgtaattgacggaaaactggtgcatactgcttggtagtgaaagggaggtgccagagatgcttgccacggaacgccacgacctcatactgcgcctcgtcgcggagcgggggagcgtcaccacgcccgagctcatgtccgcgctcgacgcgtcggagtcgaccgtccgccgcgacctggacgcgctcagcagccagcgcaagatcgtccgcgtgcacggcggcgcctgcgcaccaaagcgccgtcttgtggtgcaggattcgcccgtcgcccagaagcgtgcccagaacctgcccgcgaaggagcgcatcgccgcgtacgcggccgccctcgtgggtccggacgactttgtgtacgtcgacgcgggctcgtccaccatgcttcttgtggagcacctgaccgagacccgcgcgacgttcgtcaccaactcgctgccgcatgcccaggcgctgctcgcaaagggtgcgaagacctacctccttggcgggatggtgaagccggtgaccgaggccgtcgtggggccggacgccatcgcggctctggcgcgtatgcacttcaccgtggggttttggggcacaaacggcatctcgcccgacgcgggcttcaccacgccggagctcgaggaggcgagggtgaaggaagccagcctgcgccaggcacaagccgcgtacgtgctggcagattcaagcaagttcggccaggtctcgctcgtgacgtttgcgcagtttgaccaggcgaccgtcatcacggaccacgtcgacccaaatggcgcctatggcaacgcccccaacatcgtggacctagaggaggagcaccaatgatctacaccgtcaccttcaacccctcgatcgactacatcgtgaggatgccccggctggagcccggcgccatcaaccgcgtgacgtacgaggacatcctgccgggcggcaagggcatcaacgtgagcatcgtgctctcgaacctggggcacgagtcctgcgccctcggcttcgtcgcgggcttcacgggtgcagagatcgtccgcctcatgcagacgtccggcgccaagagcgacttcatccaggtcgcggagggcatgtcccgcatcaacatgaagatcaaggctgccgaggagaccgagatcaacggcatcggccccaagatcctcgagtccgacatcgacgcgctctacgccaggctcgacgcgctcaagccgggcgacaccctcgtgatcgcgggctccgtcccctcgatgctcccgtccgacatgtacgagcgcatcatgggcaggctcgacgggcgcggcatcaacatcgtggtcgacgcggagcgcgacctgctcgtgaaggtcctgggctaccacccgttcctcatcaagcccaacaaccacgagctgggcgccatctttggcgtggagctcgccacgcgcgacgaggtcgtgccctacgcgcgcaaactacaggagaagggcgcgcgcaacgtgctgatatccatggcgggggagggcgcggtcctcgtgcccgagtccggggacgtcatcatgagcgaggcccccaagggcacggtcgtcaactccgtcggcgcaggcgactccatggtcgccggcttcctggcgggctaccaggagagcgacggcgactacgccaccgcgttcaagatgggcgtcgcgaccggctctgcgagcgccttctctgcaaagcttgcgacgcgtcccgaggtcgaggcgctgctcaagaccctttagcgcttctcgaccgctttcattgcatggcatgccggccccacacgggggcgggctccgttgggcgcaccgggtgcgcccgtacgtaagagaggagagtcagacgtgaagatcacggatctgctcaaacccgagggaatcaaggtgggcgccacggccaagagccaggacgacgccatcgaccagctgatcgccctccaggacgcctcgggcaacatcagcgacaccgttgcgtacaagaaggcgatcctggcccgagaggcggagttctccaccgccgtcggcgacggtatcgcgattccgcacgcaaagacctcggccgtcaggcgagctggtcttgcggccatgaccgtgccgggcggcgtggagtggaacgcccccgacgacgcccccgcggacctcatgttcatgatcgccgcgcctgagggccagaacgacacccacctgcagatgctcgcccagctgtccaagctcctcatgcaccaggagtttgcggatgccctgcgcgccgccaagaccccggaggagttccgctccgtcatcgatcgcgcggaggctgagcgcgaggccgccgatgccgcaaaggcggagcccgaggcggttgccgccgccggatatcccgaggtcctcgcgatcacggcctgccccaccggcatcgcccacacctacatggcggccgagaacctggagaagaaggccaaggagatgggcgtcacgctcaaggccgagacccagggttccgcgggtgcgaagaacatcctgaccgcagacgagattgcccacgccaagggcatcatcatcgccgcggataagaacgtcgaccgtgcgcgctttggcggcaagcaggtcctctccactaacgtctccgccggcatcaacgagccggaaaagctcatccagaccatcctcgacggcaaggcgcccgtccaggagggcgccacggtcacggccgcagagaccgcgggcgagaaggactcggcctggcacgtgatctacaagcacctcatgaacggcgtcagccacatgctgcccttcgtgatcggcggcggcatcctcacggcaattgcgtttctgatcgaccagccgggcctcggcacggcggcgtacggctcctcgattcccgcggcggccttctttaagaccatcggcggcgaggccttcggcatgatgctcccgatccttgccggcttcatcgccatgtccatcgcggacaggcccggcctcgcccccggcttcgtcggtggcctgttcgccaagaccggctacagcatctcctacctcacgctcatgaacaccgatgccaaggcggccgccgcgtcctgcgtctctggcggcttcatcgcggcgctgttcgcgggctttgccgccggctacatggtcctcgggatcgagaagctctgcgaccacctgccagattccctcgagggcatcaagcccatgctcatctacccgctgctgggcaccctcgccatcggcgcggtcatgttcctgctcaacccgatcttcggcgccatcaacactgcactcaacaacggcctcaacagtatgggcaccaccaacatcatcctgctcggcgccatcgtcggcggcatgatgtccatcgacatgggcggcccgttcaacaaggcggcctacgtcttcggcaccggcgcccttaccgccggcaccacctccggccagctcgtcatggcgtccgtcatggtcggcggcatggttccgcccctggccatcgcactctccacgaccatcttcaagaacaagtggtccaaggccgaccgcgacgccggcatcgtgaactacatcatgggcctctcgttcatcacggagggcgccatccccttcgccgcggccgaccccggccacgtcctcccgtcctgcatcatcggctccgcgctcgccggcgcgctctccgcggcgttcggctgcaccagccccgccccgcacggcggcgcctgggtcattgccgtcatcggcaaccccgtcggctacctcgcggcgctcgccatcggctccatcgtggcatgcctgatcctctcgctctggaagaagccgtatcaggaggcctagtctctcgcatggcatagcgtccccaaagaggtggcggtcccttgtggccgccgcctcttcacatgggcgcgcccgttcgtcccgcgccgccgcacaagacgtcgcgccatggggaatactctcctcaggaccacgcgtcgccgatgcgccgtcaacgcaggtgggagggggcagacatgggttttcgctggccgtggaggcgcaaggcaacggcatccgtgccggacgaggtggccgccgcaaagcatgccggcgcgctcgcccaggacatcgcccgcgcgggagggggcgctccccaacggctccgcctgcgctacgcgggcaaggtgcaggccgtgggcttccgctttcaggcgcagctgctcgccaagagcgcgggctgcgtcggctgggtcaagaacctcgacgacggagacgtgctcgtcgaggtccagggcacaccatcccagctcgaggcgttccagcgcggcatcgaggacctctcggacagccctgacacctggatctcctgccaccttgcgtcaaaagaagtgctgccgctggcacagggcgagaaggactttcgcgtgcgatattaggcacgccctcgggctgccatccgccgcccgcagggaggctacagctcgtgcctgacgatgcgaacgtccgggccgtcgatctccatcgtcatgaacgtgcagcgcccggaccccggcttgggcatgagcgtgccggagttcaccacaagcgcgtccgcgggccctcccgcatcctcctgccagcggtgcgagtggccgtagatcaccacgtccgcgtcgagcgccgccgcgcgctgccgcagccgtaccaggcgaggggagcggtacgtgtgcccgtgcgtcaccatgatgcggtgcgtcacttcacctccgcgcatcggtgctccctggtggtagctaagcgcccgcacgcccgcgatgccgtccgcggcaacgtcaatcacgagctcgtccgccggatgcatgggctcgagcgcggcgtcgttgttcccatgcaccaggtagacgggctcgggaaggttcagctcgtcgatggcggccatcggcatctgcaggtcgcccgcaatcaagatggcgtccagggggccaccggcccgcgcagccaccaccgcgtcctgaaagtgcccgaccttcgtgtgtatgtcagagcagaccatgagcctgatcatgcggcctccaacccctcaaaccaaagtgtggctacagtgtaggcgcgaagcatgtcacagggatggcaggccatatcaagacgagaagagcgacacgtcgtggtcgatagtccttctcatccagaagctcttgtacgtgtgacgtgctgacctatccctgcgtcagccaagccagaaacgcggcctgaacaatgagcatggcgggaacccccaggtagaacgggggcttgcgtgtctcgtggtgcgcaaccctcatacccagaagacctcccgcagcgccgccaactgcggagcagctaagcaaaaccttctcggggacgcgccacgcacctctgacggctcttgccttgtccaggcagaaaagcgcaaaggtgatggcgttgattgcggcgaggtatgccagaagggtgtccgagccccatgcggtaagcgtgtccatgcgcaagattgtatcgcacacaccagctgtgacccatcatgcccatcaccttatcgcttgccgtttgtggtcgccgctgtgcatgcgaagatattcaagttggcaaaatggtatcaattagagttatcttgtatgtatcgacttacaatgtcagtctcggttgatgggagggacacatgtcgctctttgggaagtctgccaagcaacgcctggaacagtcaggctttacgattacgaagactctcttcgaggcaccgcggctttccatggtgccgtctctgtacatggacgagaatcaccgcaaatgggccatagtgctgcatggcatggagcccgccattcacgactacgaggatattctcgactgcaaggtgatagaaaacgaggaagtcgacgtccgaaaggacatgagccatcgcgacctctttgagagcgtgctcgaaaaccctgccgcggtggcgcgggcgaacgcaagcagaggaggcaagtactgcacgcgcatggacgttgcactgacggtaaggggaacgcctggacaggagtccaccatcggcataccccttatcggcagggaggtcctgcgtagttcgaagacctatgtgcttcttcgtcaaggggcggataaactgtgtgaggacgtgctgcgcatgagggatgcgagcaaggcttcgtcgtaggagagtacgttggtccgcgggaagattccgccggcagatgctgcggtcgagaacattcgaaattacattaatgtaaacggcctctctgagggagaaaagctgccctcggaacgagacatgtgcgagatgtgggggatatcgcgctctgcgttgcggagtgctatacgacacctgacgacgatgcacgttctcgagagtcgtcagggatcgggtacctacgtcgcgcccgcgcgccccatttcatactcaggcgtcgggaaggtcatgggctttagtgacaacgtccgtagcagtggacatacgccaagctctctggtggtgagccaggggacgtgcgatgcggacgcccacgttgcgaagaagatgggcattgacgtcgaccacgccgtcttcaagctcgtccgtctgcgccgtgtggatggtcttccatgcatgttagaaacctcgatggtcaacactgacatctgccccggtattggctcgcatgacttctcaagggaatctctctttgacgtgattcgggatggctattgtctggatatcgcccatggctgggacagcctctcgatttctaggctagacgagtgggaggcggacttgctggggggcaaacctggtacatccgtgttctttcaacagggtgtgagcagagatagcgacggcagatgcatcgagtattacaagtccgtcattcggccagataggtatacgttcgtcagtctctgcggatggcccgttgactctcggaaggcactttggtgacatgatggaaaacttggacacggataagccaaagtacatacagattcgcgaaatcatacgtgatgagatcgaagatggcctctacgagcccggtagcgccattccctcggagaacgatctcgcggagcggttcggaacgacacgcctgacggtaagaaatgccatagatgcactcgttgccggcggactgttgcgccgtgtccagggtaagggcgtttacgttatgtcggagcgactcggtgaggccgatgcgctcgagcttgtgggctttcgtgaaagcgtcagggagaagaacgcggtgccgtccgtcaaagttctctctaaggctcggcgtcctgcggggggcttcttctcgcatctcttcgagattggcgagaatgatgacattctcgcgattaagcgcgtgaattacgtggatgacgtgcccctgatgatagagcggacgtttattccaatctccctctttccgaaaatcgagtccgttgacgttggcgttttctctctttaccaagtctatggcatgtttgggcataccgtcgcatcggctgtcgagcacctcgatatggtcgagctgggaacgcgcgatgcacacctgctaggaatcgaggagggctctgccgtcatttcctacgagtgcgtgagctatgacgaagacggcaccgcgttggagttcgcgtcctcgtatcgtcgcggagaccttggcgggtactcagtaacgtattaatacgttagctataccacttaacaataattaaataccattcatcctaaatgagcgtgattagcccataaatggttctaaatatcgctaagttatcaatcaaatggttacaaaaagtgcgcacatgtaatcaatagataccaaaggtgaacgagtgagggcggaggacagcttatgaaggagaccgagaaggtcgagattgtttacttcgaccaggagggctatctggaggacggcaaggagctctacgaaatcggaaagcagatgaagcagttcgcagatgacgtttgcgacgaggggtttgaccacctcttcctactgggcgtcggcggcacttgggatgagtttctgcgcatgcagtatgtcatgaacaagtatgccgacgcaggccatcaggtaacgctcctccatgctgcagagttcaacgtgatgggcagtaagtccatgacgagtaattccgtggtgctcacctcgtccgagtcgggaaccactccagaggtcctgcaggcggtaaagacgctcaagcagatgggcgtgagggtctatgcgatgacaagggcagacggccccatcggacaggcagtgggagccgatcactgtgttgccatgaaaaacgatcatggtagcggcggatgtgagaagggctactatctcgcggattgcttcggcctgaggattctcaaccgtcagggcttcttcccgaagtatgacgagttcattgagcagagcaagggtttctggccggcgctcctcgacattcgcaagcagttcgagccaaaggcggaggcgttcgcgaagaagtatgcgcttgcgccttacacgatgttcatcggctctggtgcgctctggggagagaccatcctgtttgccatgtgccttctcgaggaaatgcagtggaagcacacccgctacatcagttctgcggacttcttccacggaacgctcgaactcgtggagcccggcattcccgttgtcctcttcaagggcgaggatgagtgtcgtgcgctcgacgaccgtgtcgacgcattcctcaagagcgggcgtaccggggatacggacgtgaccgtcattgacacgaaagagtatgcaattcccggactcgatagcgacttccgcatgattctctctacctacatcatctccgtgcttactactgatcgcatgtcaaggcactacgagctcgtcacgaagcacaacctcaactaccgtcgctactaccaccagttcgattactaagacgggttctgattgtatggcgtcacatcaggggttccgggcggctgctacgaactgtgcctacaggttctactcgcttgagtattttttctcctcctcccaaagggagggcttcgatgccgtcgaactctggtgcggctccatgcacttcttcatggactatgcaacgaacgattccgtgagccgcattgccgcattgtcaaaaaggagcgggcttcccatctgcgccgtctgccccgagcaaaacaaccccaaaccctcgaacgttgccgcacgcggagatgatgcgattcggagaagtcggcagtatttcaagcgggcaattgacgtggcggcggacttgggtgcaggaatggtctccattacgtctggctggggattcctggacgagtctcgagagacggcatgggatcgaagcgtgcgaatgctgtcgacactggggtcttatgccggcgagaggggcgtgacgcttgcgcttgaggcgcttcagccagaggagtcaaacctgtgcaattgcgtgcgggaccttcggacgatgctcgaggatgtggggagtgcgcacctcaaggtgctactcgacacgggtgcgatgtggcgtgcgggggagagcgtgcgagactacatggacgcattcggtaaggatgtcgtgcattgtcattttaccgatgcgagagagacgtctcacctcgcgtggggcgacggagtacgggatatgaggggcgatcttctcgcccttgcggaagccggttattcgggatgcctgacgtttgaaagtgttgacccgcgctattttgtggatccagccgctgcggaccgacagtcgctggcggcactaaagaggaatctggaggaatttgatacatgagcaggcagtacatcatcgcttctcatgcgcactttgcggagggcatctttgagagtgtgaagctcctggcgggcgaccgggatgacgtgagtgtgctgaatgcgttcgtcgacgggaacgacgacgtggaggcggcgtcgaggagccttgtcgagtccatgcctgatgacacggatgtcgttgtgctcaccgatctcatgggagggagcgtgaacaacgagttcacaaagctcatgctggcgaggccgaatgtctacctcgtcacgaacatgaacctgccacttctgctcacactctttctctccgatgaagatgaggacacggaatccttgctgaggcagcttgtctcgagtgacgaggtaaggccgaggttcgtgaatgacgactcagccatcgaagaagacgaggacttctaggctcacaactgaaacaagggggttcgaacatgattctgctgaccagggttgaccacaggctgttacatggccaggtcgccgtgtcgtgggtgcagggtttgcaggcaaattgcatcttctgtgtgggagaccacgtggcgaacgatcccgtttggaaaatgaccctcaagatgggcaagccagcgggatgcaagctcgtgataaaggatatggcccatgcaatcgaagccatcaattccggagtcaccgacaagtatcggatgctcatctgcgtgcagaccatcgcggaggcgaagcagctcattgacggatgccctcagataaagagcctgaacctcggaaacaccaaagggagtcccacgacgcgtgaggtggcgcgccaggtcttccttgagccagaggaggagaagattattcgcgaactgctggacaagggggtggaggtggagattcgtcctcttgcggacgatccgaagattgaaatccaagacgtactctagcggtcgtaagaatctcacagcaacatttgattaggaggagagcatgcttgttaaggcgatactgatttcgctcgtggcggcattcgccatgtttgattatcagctcggcacgctctacgcgttcagaccgattgtgacctgcccgctcgtaggtctcatcctgggtaatctgccggcaggtctcgccattggcgcgagcttggagcttctgttcatgggaaacatctccattggagcctacgttccgcctgacgagaaggtgggcagtatccttgcgtgcgcctttgccataacgttgggcaagggtaccgaggctgccctcgcgctcgccatgcccatcgcaaccatctctcttgccatcagcaacgtcatcaatggcctcatgcccgttatagtcgacaaggcggacgttgcggcggcgaagggcgacctgaagggtgtgtatgcggcgcactgggctatcggactcgtcggggtggtaaaggacgtccttctcgtcggatttgcctactacctgggcgccaatgcggttcagggcatcttggactggattccctccttcatcatggacggcttcggaatcgctgccaacatccttcccgcaatgggcttcgcaatgctcggccggctggtgctcaagcgtgaggtcatgccgttcttcttcctcggcttcctgcttgcctcttacatgaacgtgccatcgcttggcgtcgctctcattgcgatcatcatcggaatcgaaaagtttggccttttgaatcctcaggccaacaccgatagtccacagctcgcggcggaaggagatgatgacgatgacttctaatgaggccatggtttcgggacggggcgtttcacaggaggagaatccctacaagattacgaagaaggacctgataaggtcttccctcaacgtaggcgctctgggcatggagttctcctggacctactacaagcaaatgaacctagctttctgcctgatggtggcaggaatgctcaagaagatctatcacggaaggccggacgactatgcggcggccttgcatcgccatgcggcgttctttaatatcacggtgcagtttgcaccatttgtgggcggcattgcgatggcaatggaggagcgtgtagcccggggagagattgagcccgagtccgtcaacgacgtcaaggccgctctcatgggaccgctctccggcatcggcgacgcaatcttcctcactacgattcgcgttatcgccgctgctgtcggcatctcgctctgccaggcgggcaatgccgccggccctatcgtcttcctgctcatctataacatccctgccttctggcttcgcgtttggggtgttcagaagggctattcgatgggtgtgagctttctcgagaaagcgtctgagaacgggctcatgaccaaggtgatggctgccattggcatcgttggtgccatggttatcggcggtatgaccaaggacatgttctgggcgaccattcccgtacagattggtgaggcggttaagggcaaagacccgactaccatccagagcgttctggacggaatcatgcccggcatcgtcggcatgtgcgccttctggatatactactggcttctctccaagaagatcaacccgatgtggctcatccttggcaccatggtgctcggtgtagtcggtgcgttcttcggtttcctgggatagaagtgtcgactctgtcgctagctcgttgattatcgtagcgtatacataggacgagaagggcttccccgattgctgcgagtgttcgcggtgacggtgggaagccctttctttatatgcattttgagatgctgcctcatgccgaggcggatggggtgtcgagatattctcttctttctagaagtcctcttcttcgagtttctctaggacgaagtcgcgccatcccggcagctcgaacccaaccttgccgcgtccgcgttccccaatgacccccttctcaaggagacgccttctgtactgcgccgcatagcccgtgctcttgcccatgcgattggcgatgtcggcggtcaagcttacattcttgtctggaagcatggctttcacaaaggcgaggtcaccatcggaaagctccatgtaggtggtctccaatatgttggaccgcatctcaaactgagccgcctcgatgccgctcttagcggcgtcgaggtcaatgcggctgccgttgctctgtgtccacatgcggtatcccaccagctgcatcatgaaggggaagccgtcgattgcgcttgttgcggcaagcagtgcctcgtcggttatctgctttcctcccgcttcgatagtttcttttagcgcgacgcggatgtcgctgtcgggaatgcgcgtaagctgatggcgagccgctcttctgaggaaggatatcgacttgtcgttaagcacacgtgacacctggtagggaagaccagctgcaaggagtgagattcttctgccctctacaatgaggtgctggtagacggaggcgagctgcaccatctcgtcaaattcgggctgaagttcgtcgattgtgatgagaaggccgacgccgtgtggctccagctcgtccaaaagcgaggttaggcgagacctccagttcttgcccgctttattgctgtcgtcgtactcccatcccaggggcgcaacgccaccgatgccgatagagttgattcgtgccttctgcccctgcgcaagaaggtgcgaacctgatctggcggcttgctgaagtatatcttcgagcatgccggggaccgatgagacgcgcgcggtaatccacccacgctcttccgcctcgtctgcaagaagggtaaggagcgtagtcttacccgtacccctggcaccggtgaagatggtcgtcaggttcgggtctccggggccgtttacgaacgcgtcttcgatattctcaattacgtagcgacgtcctgccataaagggcggtacttgtccgaatccgggcgtgaatgggttattgagagcggccatgtgtcctcccaatcgcaaatctcatagtgtttcggtctatctctatggtatccggttcccttgatttcttttgtaacttttggcaaatttggtaacgcgtttacgcaggtagatatgcctatttgtcacaccgttggcagtctgtggcacgctggcggcccatcttggccgctcgcgcggtcgacgtgccccctggggaaacgacgcccgaccttggggtaagaggagaagtacgaacatctcaaggtttggagttcaccatggcagacatcaacgacgtgttcaggttcttcaagagcgagtcccccacgtacttccttgcgacggacgacggagggcagccgcgcgttcgcccgtttggcacggtcgacctcttcgaaggcaggctgtacatccagaccggaaagaagaaggatgtctatcagcagctgcttgccaaccccaaggcagagatctgcggcgtgagcggtggggactggtggcgcgtctcgggcgagctcgtcccggacgaccgcatggaggcgaagcgccacatgcttgacgcctacccttcgctccgcaagatgtatgacgaaaacgatgacaacaccatcgtcctgtacttcaagaacgcaacggcgcgcttctgctccatgtcgggaaagcccgccgtgaccgtggagttctagcaacgtttgatgtgcttaagtgcgctcgttctaggacgattgagctgggagggagcatgagctcgaagggttcagacccgatggaggtattcgttggactggcgcttcgcgtgctggtagcggccgtggtgctcggcgtggcgttccaggtgtgcgaagccatgggtcccgttgcccgggcaatcgcgtgcgcgtgcggcgtcgcggtcatggtgtcgctcccgctcatgaccgcgcgcatgctccttggtcccggcgtacggctcgacggccgcgcaaaggcgacgcttggggtgctattcgtgacgcttgcggttcccctcgtggcgcttggcatgggtggcaacctgaacggcggcagcgcggcggtcatggtgcttgtgccggaggtggcgtttctcgcctctcttggcagccgtcccggcgcgcaatagccgactccagacaaggtaaagattcgcgcccacagcgttgcgtgtcgcggggcgagaagtacgtgccgccacggtggccgcgtccttctcgccccgcgttttgtgacttgcggcactggcggacggtgcggcgcgaggggcgtgcccaagcggagtcggtgcgacgtgcgacgtccgaggcttccccattgacaatagcgtatatatacgatatatacagtatacccgcatgagcacagcggcctctgccctgatggaccgcgtgggagcttgggcggaagcttcgtgaaagaggggaggcgcgcgtgcagattgtcatatcgaactcttcggacaagccgatctacgagcaggtggcgtcgcaagttcgctcgctcatcatgtctggtgagcttgtggccggccaacagctgccgtcaatccgcgcactggcggcagagctgcgcataagcgcaatcaccacaaagcgtgcttatgcggaccttgagacccaggggttcatctgtaccgtgcccggcaaggggagttacgtggcgggggacaaccttgagctgctgcgcgaggagcgcctgcggcaggttgaggcgtcgctcgcgaaggccgtggaggacgcacgcctggcaggcatcgggaaggaagagctgcacgagatgctcgacctcgagctggaggaggaacgatgagcgcggtatcgaaggaacgcgaggcgaccatggggcgtccgtttcgcaccatggagccgtccggcgaacccgcggcgttggaactgcgccacgttgcaaaaggctttgacgactttgccgtgcgggatgtctgcctttcggttccctgcggctcagtcgtgggactcgtgggaagaaacggtgccggcaagacgacgctcatgcgcctggtacttggcacggcgaggcctgacaggggctctgttgtgctgtttggacaagacgtgactgtggcggggcaggaggcgcacgctcgggcgcgcatgcgtacggccacggtcgcggccgtgtgcccgtatcccggctatctcacgattggcgaggtagcgaccgtgtacacgctttcgtacccgacgttcgaccacgccgcgttcgaggctcttctcgaccgcatggacatcatgcaccaatccgagggcgcgcaccggccggtctcggcggggttgcgcgtgggcgacctctcgcgcgggcaaggcatgaagctgcagcttgcggcatgtcttgccacgggtgcggacctgctggtactggatgagcccacggctggccttgatcccatcgttcgcgacgagctgctgcagatgctgcgcgagcacatggccgcgcacccggattgctccgtgttggtgtcgtctcacatcacgggcgatttggagcgcctggcagactacatcgtgattgtggacgaggggcaggttgttctttcggccgagaaggacgagcttaccgacgtgatgggcgtggcgcggctgctgcccgcccaactggagcgcgtgctggacgaggggattgtgccgcgcggggaactgcgcgtgcgcgaagacgggcttgccggtgcgagcgaggtgctggtgcccgaccgtgctgcgttcgttcgcgcgtaccccgacatggtgtgcgaccgtgctgcgatagaggacgtgatgcggctggtcgtcctgggaaggagcctgtgatgagcaaggcgtatctgtactgcgactggtgctacatgaggtcaaaccttcgtgccagcctcaagtccatgctgctggtgatgctgattgtgtcgataccggtggtcctgggatccgcagacggcgttcgtaaccttgatgccaccatgctcgtgaacacgttcgcgtgcatggcgccgggaattctggccgtaagcggcatgacggggctcttttacgctgatgaggccgacggctggcaggaggcccggctgtgtctgcccgcaacgcgggcgcagctggtgggttcgcgctttctgctggctgcggttatagtgccggcagccactcttgcgggcgcactcgtgggcgtggcggttacggccctcacgcgccttgcgccacaggcgtttggcacgtggcgcctgagttcggaccttgcggtaggcgtgtgccttgatgcgatggtcatgcttgtggtaacgggcttccagatggcggtctacttcgccatgggagcgcgccgtggccgtgttatggggcttgtgcctgcgcttatggtggttatcgcgctagtggggcttacgggttccggtgttgccatgatggatgcgagcggtgggcccgccatgcccagcccatttgccacggcgctgtttgtactggcgtggcttgcggggagcgtatgtgcgtacctgctggcacttgtggtggcgcgtcgcgcgttcgcccgtcgcgaactgtaggcgggtccaactccgtatgacattacccttgcgcgcatgcaagaaaggcgggccccgtactgggacccgccagaggcgaacgccgtatcagccgtagtttgccgtgcgcggagaccttcgctcctgtaccgctgtcgtttcctagacggcgatcagcttgccatcctccatccggaagaccctgtccaccaggtcgagcacgcgctggtcgtgcgtcaccatgacggcggccttgttgcgctggtgtgcttcctgccggatcatctgcaccacctgcctgcccctttcggagtcgagggaggccgtgggctcgtctgccagaatgagcctcgcgttggtggcgaaggcgcgggcgattgcaacgcgctgcctttctccaccagatagctgcgcggggtgcttggtggcgacgtttgcgatgcccagctccccaaagagctcgcgcgtggctgtgcgatccgcgcccagcatcacggtgagctgctcctcggccgtgaggtagggcaggagctggtggttctggaagatgaagccgatctgctcgcggcgtagcttcgtccacgcgcgctgcggcaggtgcgagacggcgcgtccgcagatggcgacgtcaccctcgtccggggaaagcatcatgcccgcgatgttgagcagggtggacttgccgcttccggaaggtcccactacggctacgagctcgcctgcgccaacgcttagattaacgtggtctagcacgcaccgctgctcttctccgtcggcatacgacttcacgatgccgctcatgcccagtatcgtctcgctcactgaaaatcacccccgatgaccttggccgggtcaattcgcgccacgcgggcgacggatgccaggctgcttaggatcgaaaccgccacaaatgccaccagcacaacggccacttgggcgggtacgaggtagaacggcatggaggccggtagcgccgcgctcatggcggtggcgaggccgcaagcgatggctgcgccgagcgccgcgatcaggaacacctggctcacgatggtgcaagagaccttggccgtgctggtgccgatggccttcatcacgccaaactcctgctccttctgcatgttgatcacgaagaagaacacgccgatgattacggcggttatggccatgagcagccactcgaccatggtgatggtcatctgctccgccttgtagccgggaagtgcctccacgatctgcgccttggtgtagctttcggttccctttacgtgggccgcgagcctgccgctgatcgcgacggcgtgcacggccttctggtacatggggttgcccctctcgcccatggcgtcgaacgtatccacagagacgtacgccacagatacgtgtccgtacatcttgtccttcgtgaatccgacgaccttaagctttacgcctgaggacgagtcctcgacggtgtcgccaagcttgatgcccttatcctggaaggcgtcgtcgagaatgacctcgccctttcctgcggagaggcccgtgcccgcgtacgtcttgggggcgaggaaccccgcggggtcgatgccaaagtacgtgacgtcgatcttcttgtcgctggacgccttctgcaggtaggcgcgctggatgtcaagcggagtctgccggcttccgtactcgtcctgcagcttcttgtactgggcgtccgtcaggctcgatacggtgatgagcttctcggagtccttgcccagcacgaaggcgctggcatccatggtctcgatgccagaggacaccgcccttcccagaccgctcacgagtcccgaaaggaagagcaccatgaacatcatcagaatcacgatgatctctaccaggaggtacttcttccagttgtatgttagttccttccatgcaagtctcactgcatgcctagttccaatcgactacgccgtgcttgatgcatagcgaacaatcaaatagcgcgcaataataatagcgcttgcgcacccgatgcgaccgtcacgaccgaaggcggtccttctccccatgaaaaggacattggaagtatgctgttgtctggcaacgcatggaggtagattgcgaggtagcggatgtcgctggcgccgtcagtcatcgtggacgtgccctttcgcgaagagggcggcctcgtggaggaggcgctcgacggagtagattcccaaattgatgaccgggagctcactcccgaaggccgcgagctgcttaagacgtaccccacggtctacatcatcaggcgtcaggtgcgacaccagacaaagcacgagattcgtgaggagtacctcctgtacgttggcgagaccaactccatcgcgcggaggaccagggagcattattcggacgagaagacctatcgctcggaggcggcgcgcaatgcctggcgccagcttaacgagggcggctcgaggatgctggtcatcgggcaagaccactttaacaagtcgcttacgctcgacctcgagaacaccttcctgagctacctgcttgcctcgggcgcgaagcacgtcacgctggtcaacgggcgcggcaacccgcaggatgactattacaccaaggccgacctgcccgcgatcacctccggcgtgtggcggcgactcaacaggtaccggccgcagctctttcttgcggaggcggccatcagggactccgccatcttcaaggcgtcaccgtttcacgccctgggaccggagcagcttgtggtggagggcaagataatcgcgcgcctcgggcagacgctgcaagacgtgcgtcccactggggatgttgtgggcaacaatggcgaacctgcggtgcggaagggcgagctcatgatcgtggaggggctggcgggcaccggcaagaccgtcctcctgagccacctgttcctgcgggtcatgaacgagctgagcgctgatggccgacccatcagcgcgagcctgctcgtcaaccacgacgagcagcttaccgtctacaaccagatcatggtgcggctcggccttcagaacaagccggggaagatcgtcttcaagccagcatcgttcataaacgcccacagcaagggcgggtacgggacgggcctcgacaggcaggaccatcctgcggatcccgtggacgtggcgctgatagacgaggcgcacctgctgctcaaccagggcagccaggcgtaccgcggctcgcgcaacatgctggtggacatcatgcgccgggcccgcgtggtcatagcggtgtacgacctggagcaggtgcttcgcaagtcgcaggagctcgcccccgccatgcgcgcggcgctgttccccacaggtcgctttgccgatgactcggtggagtgcccacgcagggacgcccgtctgtgcaacttcgacttccacgtgacaaacctgctgctgcgacagcagttcaggatcgacgcctgcgacgaggtggtccggtggatcgacgacttcgcaaacggtcgcggcatcgggtgcattcccacggacccgccgcgcgaggggcatgagccctaccagataaaggtgttcgaaaccccctttgagctgcagtccgccatacaagagaaggcactcacgtttgacgaggggagcggcaagatcgtggacgccgagtcccacgggctctcgcgcgtgctggccacgtacgactggccgttctcgagcaagagaaagtcgaagtccggggcgtgggaggtccagatcttccgcgagcacagcgagtgggttgcctttggggaggacgacgggtcgctcccgcacgaggtcgaggttgccgttgcctccggcggggccggcgactacttccatatgccttggaactaccagacggagccccacgacgctcgggaggcggcgggcgagaagggcaaggcgtgggcggagcagccccacacgcttaacgaatgcggctccatctacaccatccagggcttcgacctcaactttgcgggcgtgatcattgggccctcggtctgctggcgcgacgggcacgtggagtttgacccctccaagagcaagaaccggcaggccatcaacggcagcgacgcgcccaaggagaacctgcggcacgagctgaacgttcttctcaagcgcggcgtgcacgggctctacctgtttgcggtcgaccatgagctcgaggagcacctgctcaagatgcagggtgcctagcagcctccgcggccccttgacttcttttgcaacttttggcatttttggcaaattttgcttttttggcaaatcggcatgctggtgtcggaggcggatgtacctgttgcgctccgaggggctctgccaaccgtggccgttcgctacctttggaagagccaggccagaagagcggcctgtgccacaagcatcgcgggaactcccaggtagaaaaggtgttttctggccttgtggtgcgcaagccgcatgccgacgaggccgcccagcgcaccgcctgcggccgagcagccaagcagtaccctctcgggaatgcgccatgcgccacgggccgcccgcgccttgtccacgcagaagagcgcaaaggtggcgacgttgacgagcgccaggtaggcgagaagggcgtccatgccccctgttgcaagagtactcatgcggaagattgtatcgccttgcggcgcggtgacataatggtctgcaggcaccgtgtgtgaggaggggcaatgggctccgggtagaaggatccgatggaggccctggtcgggctggcggtccgcgttgttgtggcagtgctcgtgttcgccatcgcgttcgagatttgcgagcagctggggacggtgtggcgcgccgtcgcgtgcgccgcgggcgttgccgtgatggcgtggctaccgctgatgggcatgcgcgcgctgtttggcccggaggtacgcctgggcggccctggctgggccacgtacctggtgttcatcgttacgctcgcgattcccctggtggcgtttggcatgcaggggagcatgaacggcggcactgcggcggccatcgtgctggtgccggcggtcgcgtttctcgcctcgctgggcaggggtgccgggtcgggacggtgacccaaagctgacgctcgccggcttgaaatgccaaaaacttttttggcataaaggcctcaacctcgctagctgcgcaaatgcgaaatggccccgcttccaaaaaagtttttggaatcggggccgttcgcgtggcggttgtgggtggcgctaggtctccggcgtctgccagacgtcgtcccacacgaggcggctggcgtagcgagtggctcgcgggctgcgggcgacggcgtcttgggcctgctgccggttgtcccagtagtgcatggggaagacgacgtccgcgcccagctcctccatgtaggcgaccaggcccgcgaccgggtcggtcaggcgcgggtccacgggcacgaaggcggcgtccacgtgggggtggcgccacgcggcggaggcgcgcctgagctcacggcggaagaactcgtccgaggcctcgttcttctcggcctcgcggtcccactgccaggagttgaggtcgcccgagaagtacagcgtccgcccccgcgcgcccaccaggaaggcgacgccctcgtcgttggactcgagcgtgcggacccgcagctcgacggggagcgccagggtcagatcctggttggggcggacggcgcgcacgtcgaggccggccggggcgttgggcgcgacggaggcgtccaccacgtacgtgacctgtggaaacgtgcgcggcaggctccagatgcgtgcgtcatagtggtcgtagtgcgagtgcgagacaaacaccacgagcggcaggtcgcgcgcgagcggcgggagcgcgcccgcgtaccagtcgaagagcaggctgcagccggggagctcgacggcaaagccgctgtggtagatgtgcgtgacgcgcatgggggcggggctcgtgggcgcgtcgcttgcgtttgcctgcgcggcgcccggctgtgcggccgtcacgagaggcccctcacgaagtcggcggcggattgcagctgcgcgtccgaggggtggccgcggaagtagagcgcgccatcggccacggggatgcccttctccaccagggcgttcttgatg

SEQ ID NO: 202 - DNA, 26669 bp, Unknown
  Metagenome-assembled genome
atgccgtcaaacgcgagcacggcgtcgctcgtgagctggagcaggcccgcaagcgtgccgctcacgctcctctcgcccaagccgtccaccctgcgaaaccccaggctcgcgttagccatggcacctccaaacgattccggtgccacctagcatacccgctcccgcggacgcatttcaatcggcacgcgcaggcgcggcgccacggcggcacctcgggcgcggcggaccgtacctactgcgtgatgcccagctcctccgcggggatgcccgtgaacccgatgctcgcgagcttgacgcgcacggggtcgcccgtcacacgcaccacgtccagcacgcggccgcccacgttggcgctgtacacgtagccgatgttgagctccgcgctcgcgagcttgttgagcgcaacggcaaagccgccgggcacgtccggcacctcaatcacgagcacgtcggatagctcgacctggaagccctcccccgcaagcacgctctttccctccagcgggcggtccacaagcagccgcacgcagctgaagtcgctcgagtccgccaccatgatgcccaggacctggatgttggcggcgcccagcgccctgctcaccctgatgagcatccccggctcgtttggaaggaacaccgtcagctgcttgatcatggcgcaccaccattcccctggtctggcgcttgtattgagaagagcgtacgcctcgagggttgcgcgtttgttatctgaaagttaagcgcgcgtcgcggctcggtacaaaaaagaggctcccttgcgggagcctctcaaaagttcgtggtgtcggaggcgggacttgaacccgcacgaccttttagtcagtcactagcacctcaagctagcgcgtctgccaattccgccactccgacatggcttggtgcgagagcaatactaacacgagccgttcgcgcgatgcaaggactatttccaaaaactttggagcgtcgcctgcgtcgcgcagccgttctcatcgcccgcaccgcgtcccctacttcgtgccgaggtccaccgaggaggtcttgatggggttcggctcggcaaagtggcacgcgcagaagtggccgggcgccacctcgcgcagctcgggaacgtccttggagcagacgtccttcgcaatcgggcagcgcgtgtggaacgggcagccggtgggcgggtcgatcggtgagggcgggtcgcccctgaggatgatgcgcttgcggctgcgctggacgtccgggtccgggatgggcaccgcggagaggagcgactgcgtgtacgggtggtacggcgtgtcgtacagcgtcttccagtccgagtactccatcaggtggcccaggtacatgacggccacgcggtccgagatgtgctggaccacggagaggtcgtgcgcgatgaacaggtaggccgtgccgaactgcttctgcaggtcggacaggaggttcaggacctgcgcctggatggagacatcgagcgcggacacgggctcgtcgcagatgatcagcttggggtgcagcgcgaaggcgcgggcgatgcccacgcgctggcgctggccgccgctgaactcgtgcgggtagcggttgatgtgctcggggttgaggcccacggtgtcgagcagctcacggacgtagtccatgcgcttcttggcgtcgggcatcacgttgtggatgatcagcggctcggacacgatctcgccgatagtcatgcgggggttgagcgaggcctgcgggtcctggaagatgtactgcatgttgcggcgcatctccttgagctcgcgcttcttcatcttggcgacgtccttgccgtcgaaaatgaccttgcccgaggtggggttgtgcaggcgcatgatcgtgcggccggtggtggacttgccacagccggactcgcccacgaggccaaaggtctcgccgggatagatgtcaaaggagatgtcctccacggcgtgcacgcgcttggcgttggcgcgacggccaaagacgccggactcgaccgggaactccttcgtgaggtgctcgacacgcagcagcggctcgccgttcttctcgaacgtcatttatgcctcgcctcccttcgcggctgcctcgcgcttgatggagcgcgaggtgggcggctggttcctcttgatgaagtcggggtcgttcgcgaagtggcacttcgtgtagtggcccgtcgatgtgtagaagggctccggcttcttctggtggcagatgtccttggcataggggcacctgggcgagaagggacaacccttcggggcgtggaccagtgacggcgggttgcccttgattggggtgagcgggctcttcttgtccttgatctgcttcgggatggagcggatgaggccccaggtgtaggggtgcatcggctcgtagaagatctcgtcggcggagccgaactcgacgggcgagccggcgtacatgaccatgatcttgtcggccacatcggcgacgacgccgaggtcgtgggtgatcatgatgatcgcgttgccgttcttctcctgcatctcctgcatgagctcgatgatctgcgcctggatcgtgacgtcgagggccgtggtcggctcgtcggcgatcaggatgtcgggctcgcaggcgagcgccatggcgatcatgacgcgctggcgcatgccgcccgagaactcgtgcgggtagtccttgacgcgctgctcggcgttggggatgccgaccatggtgagaagctcgatggagcgcttcatggcctgctccttggagtagcccaggtgcaggcgcatgccctcgctcagctggcggccgatggtgtagaccgggttgagcgacgtcatggggtcctggaagatcatggcgatgtcgttgccgcggatgtgctgcatctcggcctcggacatcttgaggagcgacttgccgcggtagcggacgtcgcctccctcgatccttcccggcggcatgtcgatgaggcccatgatggtgagcgatgtcacggacttgccggagccggactcgccgacgacgccgagggtctcgccgcggtcgagcgtgtatgagacgccgtccacggccttgacgacgccgtcctgcgtgtggaagtacatcttgaggttgtcgacctcgagcaggtgcgaaccctcggggacgggctggttcttgagctcgacccagttgtcattcttcttcttgcgtgccatggttatgcgtccttcatcttgacatcgagtgcgtcgcgcaggccgtcaccgaggagcgtgaaggcgagcaccgtggttaggatggcaaggccaggcatgatcatgagccagggctccgtgctcaggtaggtctggccggcctcgatgaggctgccccacgagggatcgggcgggacgacgcccatgccgaggtaggacagggcggactcggtcaggatggcgccgccgatgttcatggtcgcgtagacgacgatcgaggcgacggagttggggaagatgtggcgcgtgatgatgcgcaggtcggacgcacccatggagcgggcggcgtcgacgtagtcgttctccttgaccgtgaggatcgcggacctgaacacgcgcgcgatcgacggccatcccaggatgccgatggcgatgaacacgttctggatgcccgggccgatgactgcgagcatcgcgatgacgaacagcgtgtacggaaacgcgaggaagatgtccgcgaggcgcatgatgatcgtgtcccagatgccgccgtagtatgcggcgatggcgcccatgacgaggccgatgactgtggagatcgccgtggcgagcacgccgaccgcgagggagatgcgggcgccgtagatgacgcgcgagagcacgtcgcgaccgagctggtcggtaccgaaggggtgctttgcgctcatcgggaggcgcacgtcatagatctgcgcgttgggcttgccgagcgtctggggcacccagaggtcggcgctcagcgcgaggatgaccatgaagatgatccacacgatggcgatgatggccagcttgttcttgcgaaggcggttccaggcatcgccccagagcgtcctggtgggagcgctgctgtcgagctcctcctcctgctgattgggggcctcggcagagacctgcttgttcttctcgtacatatccttcttctcagtcatgcttccaccccctagtcgttcttcccggcgccgtacctgatgcgaggatcgaggaaggcgtaggagatgtcgacgatgaggttgatgaccatgaccacgacgacgatgaccgtgaccgagcccatgacgatgggccagtcacgctgcgtgatggcgcggtaggtctcgtagccgacgccgggccagttgaagaccgtctcggtgaggatggcgccggccatcatgccgccgaagtcgatgccgatgtaggtgacgacggggatgagggcgttcttgagggcgtggtgccagatgacgtccctgcgggagaggcccttggcgcgcgcggtcctgatgtagtcctggttcatgacctcgaggagctgcgagcgcatgatgcgtgccgtgtacgccgtggagacggcagcaagggtgatggcgggaagaatgtagtacacccagtcgtcaaactccgcgccgggtccgaccgcaccggagatcggcaggtagaacgcaccgcccgtggcgttcttgaggaagacgccaaagaacagctgcaacagcatgccgagccagtacgcgggcatggcgaccatgatggacgtcacgagcgttacgaggatgtcccagaacgagtatcgcttgagcgccgataccatgcccgcgcctatgccgacgaccgcctctattatgatggcgactatcgacagccgtatcgtgtacgggtacttgtccgccaggatggaggccaccgactggcccttgcgctggtacgacgttccgaggtcgccgtggagaagaccgttgacgtacagcacgtagcgcttccacatgggcgtgggaatcgtcttgccgttgctgtcgcgcaccggtttgccgttgctgtcggtctcgatcaggtggtacgtggcgcgaaggttgagctcggtctgcggatcgagcttcttctcgcctgccatcagcttgatcgggtctccgggcacgatgttctccaacgcgaacaggatcagcgtcacaccgagaaacacaggtatgaactggagaactcgtttgagaatgtactttcccatactaggaatccccttgctttgtccaacagatgcatatcgaatcccacggtgcaacccatgccgtcaagattcaaacattgctcagtatacctaagtaaaatattgttgccccccattgacagcgatttgaaagaagggttgttcaaatcgccatataggtaagcatcttaaaacaccacaaaaagtggggcatcggaagcccgatgccccacacaatgccatctatgttcgaactacaacacttctgcccgagttaggcgagcttggtgttggcgaggtcggccttgccctgcggatcgtagtagaggctcttgaccttgtcggaagcgacgtggttgtgagcgtagaacatgatggggatgaccggcaggtcggcagcgatgacctggttgacctcgcggtacttctccctgcgctcgtcgtcgtccgtaatctggcgggcggcgtcgatggccttgtcgacctcggggttgttgtacttggcgtagttgttatcagccgtgctgtagaagttggggtagataaagttgtccatggtcggatagtcggcgatccagccgaggcggccgacctggtagttgccaccagagagggcggtcaggtagcttgcccactccatggaggactgcttcaccttgaagcccacggcctccaggttgtcctggatgatggacatgatgtcctcgtggtctccgccggagttgtaggagagggtgatctccttgccggcgaggttgttctcgtcgacgatcttcttggcggcgtccttgtcgtacttcgagaactcccagacgtccttcttgtcatcgtcgatgatgctcgggacgaagctcgtggcgggcttgcggatgccctcgaagagcttgtcgatgatcttctgacggtcgatggcgagggacatggccttgcggacgttgaggtccttcatggtctcgtcctgcaggttgagcgtcaggtagtagatggaggtctcggcgccggtgatcacctggtgcttgggcgtgcaggtgtagccgtccttggacttgccgtacttcttctgcgtctccttgatgcgacccgtcgggatggacgtgaagtcgatgttgccggcctcgaactcgctgaaggcggtcttcgggtccttctggatggagaagtagatcttcttgatggaaggcttcttgccatagtagtcgtcaaagcgcttgacgttgatgtactggccggactcccacttgccaaccatcatgtaagggccgttgccgatgggcttggtcaggaagctcttgggatcgtcgagagcggcctggggcacaggtgccagtgcggggtggcagcagatgtacgggaagtccgccataggggcgctcagcttgacgaccagcgtgtagtcgtcagggcaggtgacgccggagagctccgtagcggtgcccttctgcatctcatcgtagccgacgacgggagcaaggtggtagttgatctcggaaggcgtggccatcttggggttgcagatgcgctcccagccgcgcttgaagctcttggcgtcgaccttatcgccgttgtggaacttggcgcccttcaccaggtggaaggtgaactcggtgccgtcgctgttggcctcccaggactcggcggccttcgggacaatctcctccttgtcccagtcatagtcgcagagggaatcgaagaggatgtgctcgacctgcgtaccctcggactcctgcgtgttgtaggggtcgatagcgacggggtcgttgatgtagtacttcatgctgctgttgctggacgagctggatccgctcttcttgccgcaggccgcgagcgcggtgagcgcgcttgccgccagtccgcccttcacgaaggtacggcggcccatcatgagcttgtctgccatgctttcctcctattgccgactttgcgcccaggtggcgaaacctagacgccctcgtcgggtgagcttaaggctcctttccgacgttttcgaatttagttcaatattcatgtcgatgcaattgctaatcagtgtgcggcacttataaagagtgaacgcatgacagcagtttggcatttctacaagcggttttcccgggaagcctgaaactgaacgccaaatgcgctttgtaaagagtttacacgtaggaaatattagaaactgaagtaggcatacatttgcggctttgcctttcatgcgcattgggcatcgtatacacaaataagagaagggcgccctccattgcggacgccccacgggtcacaaaaggatatgccagctgacgcaatgcctagccgatggtccccagcgggaaggtaagcgcaaggatgcaaatcgtcacgccaaagatgatggacgtgatgaccgtaaggcggtcgaggttcttctcccagatgccagatcccgcagtggagttgtacatggaggacgcgatcatgtcggacacgcccgtgccctttcccgagtgcatgagaatcaggatgatggtcaggacggcagagattgccatgacgatcagcaggaatacattgagtgcgcccacgtagttctccttaacaaaagactgacgtcagatgcgatgcgtcagcctggctcgcttcatacagtaaattaggatagcacaggattagatgagaagaacaatgtagtgtgttcttctcccccgcttcttcgcagttgacatgaaaagggcgccgggattgctcccgacgcccgcatgccaatcacgtcaccatgtcggcattgagttgcaagtaggtcgaacgaccgttacatcgcagccttgaccatcgcggcgaaggagtccgccttgagggacgcaccgccgacgagggcgccgtcgacgtcctccttctcgaggaagccagcgacgttgttgggcttcgcggagccgccgtagaggacacggatgccgtctgcggtctccttgccgaagatctcggccagggtcttgcggatggcgccgcagacctcctgggcgtcatcggccgtggcggtcttgccggtgccgatggcccagatgggctcgtaggcgacaacgtacttggaggggtcgtcgatcttcaggccctcggtgtccttcttgatctggtcgacgacgaactcgacgtgcttgccggcctcgcggacctcgaggggctcgccgcagcagctgatggggacgatgccgtgcgccatgagggccttggccttcttgttgatctcctcatcggtctcgtggaagtagccacgacgctcggagtggccgatgatgcagtacgtcgcgccgatgttggtcagcatgtcgggagcggtctcaccggtgtaggcgccggactcctcccagtagacgttctgcgcaccgagtgcgaagggagccttctcctgctcgatgacctcggcaacacccttgaggtcaacggagggcgggcagacgacgacgtccacgtcgccggtgccgtcggcaagctccttggcaagaccctgagcgaggacgacgccctcggtgtaggtcttgttcatcttccagttgccagcgatcatacggttacgcatcgagaagcgcctccactccaggaagtttcttgccctcgacgagctccatcgaggcgccgccgcccgtggagatccagctcatcttgtcggcaagatcgaacttgttgattgcggccacggagtcgccaccaccgatgatggaggtgccaccgttgctcttgacctcggccacggcgcgcgcgacggcctcggtgccatgcgcgaactggtcgaactcgaagacgcccatggggccgttccagaagacggtcttggcgcccttgatggcgtccgcgaagagggcctcggtcttggggccgatgtccatgcccatgcggtcgtcggggatgttgtcggaatcgacagcctcgcccttggcgtcctcaccgaagtggtcggcaacgatgttgtcgatcgggagcaggaccttgacgcccttctcctctgccttcttcagcatctcgccggcgcgctcgacccagtcctcctccttgagggaggtgccaaccttgtagcccttggccaggaagaacgtgtaggccatgccgccaccgatgatgagggtgtcagcggagtcgatgaggtgatcgaggacgccgatcttgctggagaccttggagccgccgacgattgcgacgaacggacgctcgggctcggcgaagatcgaggtcagggtgtcgacctccttctcgagcaggaagcctgcgactgccgggatgtaggcggccgggccgacgacggagccctgcgaacggtgggcggtgccgaaggcgtcgaggacgaagatgtcgccgtaggaggcgagcttcttcgcgatctcggggtcgttcttcttctcgcgcttgtcgaagcggacgttctcgaggacgaggatgtcacccggcttgacggcgttgacggcctcggtggccttctcgccgtaggtgtcgtccacgaacttgacgtcgtagccggtgagctcggcgagcttctcggctgcgggcttcagggagagctcgggctcgggaccgtcgcccttgggacggccgaggtggctcatcaggacgatgccggcgttgtgctccttgaggtacttgatggtggggatggcagccttgatgcgggtgtcatcggtgaccacgccgtccttcagggggacgttgaagtcgacgcgcatgatgatgcgcttgccgtcgacgtcgatgtcgcggacggtcttcttggtaaaggccatacttgcacactccttctatgttggactgattgcaagagaaaaggggcgcggccgcggcccgaaagctgctaaccgcgccccatagctacctcacggaagcgtcgactaggcgacgaacttctcgaagtacttgatggtgcggaccatctgagaggtgtaggagttctcgttgtcgtaccaagagacgacctggacgaggtactcgtcgccggcgacaggcaggacagaggtctgcgtggcgtcgaagatggagccgtgggtctcgccgatgatgtcggaggagacgatctcgtcctcgttgtaggccagggtctcggggatcttctcggcgtaggccttcatcgcggcgttgaccttctcgacggtcagaggctcagcggacttcacgacagcgtagagcagggtcgtggatccatcgggcacaggcacgcgctgggcggcaccgatgagcttgccgtcgagctcggggaggaccaggccgatggccttggcggcacccgaggaggtcgggacgatgttgcaagaggaggtgcggctacgacgcttgttgcccttgcgctgcgggccatcgagagccatctggtcgccggtgaaggcgtggatggtctgcatgatgccggactggatggggaatgcgtcgttcaggcccttggccataggagcgaggcagttggtggtgcaggaggcggcggagatgatgtcgtcgtcagcagtcagcgtctcgtggttgacgttgtagacgatggtcggcaggtccttgcctgcaggagcggagatgacgaccttcttggcgccagcctcgatgtgggcgtgagccttggccttggaggtgtagaagccagtgcactcgaggacgacgtcgacgccgagctcgccccacggaagcttggaggcatccggctccttgtagatggtgatctccttgccatcaacgatgatggagtgatcggtggactcgaccttgtggtcacgggcatagttgccgtgggtcgtgtcatacttcaggaggtacgcaagcatgtcaggagaggtgaggtcgttgatggcgacaacctcggagccctcgtgcgcaaacatctgacggaacgccagacggccgatgcggccaaagccgttaatagcaaccttaactgccattctttctcctttcgcaaggccgcccggggcccttccccgagacgaccacagcaaacttgcactgctacgcattttacccaattcctccgtaacaaaaaacgcaaagatgccttaaccgggaaaatgttttgccacataggggttgtccaccaattactgcgcatattttcggcaaacggtaggaaaaagcccatataagcgagaaggacgttcattcgccgctttaggttgcacacctatcggtggtccttctcgtccttctcgccctcgcgctcctccacgagctgctgcaggcggagcacgcgatgatacatggccgattttgaggatggcgggctgcaccgcttgccaagcgccgcgagcgagagctccgggttggcgcgcctgagcacgcagaactcgcgcagtgccggcggcagtgcgcgcaggcccacgaggcgttcggcgcgcgcgatgagctcgagctgctccgcggcggcgccggtcgagcgggcctggtttgcgatctctgcgttgacgcggcggttcacgtcgttcttgagcgacttgacgcgtcgcacgttgaggatggcctgggccgagcggcgcgcgcccatggccctgagcagggcctctatctcgtcgaagctcttgacgtagatggcgtagctcccgcggcggcgattgaggcgcgcgtccacgccaagctcccccatgatgcgcatgaggtcctgcgcgaagcgctcccccgtgaccgcgatctccatgtggaagtcgccgcgtgggtccgctatgaagccgcccgccatgaaggctccccgcacaaaggcgcgcttacagcagtcgcgctgcacgagccgctgcggcacgcccggcgtgataccgtggccgcgctccaggatgcccagctcctcgaggtcgccctcgagctgctcctgctcgggaatctcgatcaggtagttgcgcgtgttgtgcaggttggagtggcgcacggtgagcggggtctcgaggtcgaacagctcgtgcgtgagcttgatcatggtgcgcgccacggcacccgtctcggtcgcgacgcggatggagtagcggccgctgcccctaaaggacagcgtgccgcagacgcgggtgatggcggagagctcggcatacgcgcagcgggggcactccccctccacgcgggacagctcgtcctttacctgggccgtgaacgacatgtcgactccggggctagcgcttctcggccaacgcgaggtcgcggtgcgagagcgtgacgtggtagccctggccctgcaggtagcgcgcggtctcgttggcgatgacgacgctgcggtgctggccgcccgtgcagcccactgcgatggagagctgcgacttgccctcggcaacgtagccgggcatcacgacgtcgagcaggtcctcccacgccttgaggaagcggcccgtgacctcgttgttgagcacgtagtcgcgcacgggggcgtcgtttcccgtgaggttgcgcatcgtggggtcgtagaacgggttgggaaggaagcgcacgtcgatcatgaggtcggcctccacgggcatgccgtgcttgaagccgaaggagtagacgtggacgtcgagcagctgctggtccgaaagctcggaaaacgcgcggcggatccggttgcgcagcgcggacgtgcgcatgtgcgacgtgtcgatcacgaggtccgcgcggtcgcgcaccaccttgagctgcttgcgctcgcgcgtgatggcgctctcgagcgactcgccaggcatcgcgatgggatggcggcggcgggtctccttgtagcggcggatgaggacctcgtccgagcagtccaggaagagcagcttgaccgtgagctcgtgctcgcccagctggcgcaggacgtcgaacatctcgtcgaacaggccctggcttcgcaggtcgcacgtgacggccaggtggcgccccacgcccgtgttgatgcccacgacgttggcgatgtcgagtatcaggcgcggcggcaggttgtcgatgcagtagtagcccatgtcctcgaagacgtgcatggcctgcgtgcgtcccgagccggacatgccggtgatgacgacgatgtccggcacgcggtcgagccgtgccgccgtgcgcatctggtctgaggtccctgccaagtccgtgcctcccgtctgggcgcgagcgcccgcgaagcgttgggcgagaaggacgcgccgccttggccgtagccgcgccttcccgttcggcccccgaccggcagccgggcgcccctggctagaagcttaccccacggggccgcgcgtatccaccgcggacgggccctccacgccatcgcccgacgcggggacggggcacgcgtccttctcccccggcgccacgtccgcgcccgtggaggcgtccgcggcagacgcctcgtccttctcgcccgcggcatccgcgcccgcggcctcgcgcgagacggtcgcagtctcctcctcccacgcgcggagcgtctgccacacgtccgtggcgacggactccggtacgcccgggacggaggcgatctcctccacggaggcggcgcgcaggcggcggagcgacccaaagcggcgcatgatcgcgcgcttgcgcttggggcccacgccctccacgtcgtccaggatcgagaccgactgcgccttggtgcgcagctcgcggtggaacgtgatcgcgaagcggtgcgactcgtcgcgcacctgcttgatgaggtagagcgaggccgagcccgagggcagcacgaccggggtctcgtcccacgggacgaagacctcctcgtcggacttggcgaggccgcacaccggcacgttggtcacgcccagctcctccagctgcgtcatggcagccgtgagctgcggctttccgccgtcgaccaccagcaggtccgggtccgcgcgggcaaagcgctcgtccgcgcggctcttgggcgagaagcgcctgcccaggacctcctgcatcgatacgaagtcgttggcctcgggaaggtccgcgcggatcttgaagcggcggtactgcgccttgtcgggccggccgttggtgaagacgaccatggacgccaccgtgaacgcgccgtgcagggtcgagatgtcgtagcactcgatccgcatgggcggcgcgtcgagcgcaagggcgctttccagttggagaagtgcctggttggtgcggtcgtcggcgtatcccgtccgcaccatgtagcggttgagcgcgtggtgggcgttcttggccgccatgtcgaggaggcggctcttctcgccccgctgcggacggtgcagccggcacacgcggccgcgcttgttggtgagccactcgcccaggacgtccgcgtcgggaaggtcgatggagaggtccacctcggaggggatgtccgaggtctcgtcgtagtagcgcttgacgaagcccgcctggagctcgacctcgtccacgtccatgcccttgttgagcacgaactcgctcgtgcggatggtgcgtccctcccgcaccacgaagacgcatgcgcagctgatggtctcctcgcggtagaagccgatgaggtcgaggctcacgctggaggggaaggtgacctgctggcggtcgtccagggcgtttatgacctccaggcggtgcttgatgcgtccggcgcgctcgaactcgaggttctgggcggcatcggccatctggccctcgagctcctccacgatctggctgcgccggccggagaggaagttctcgacctggcgcacgtgggaggcgtagtccaccgtgttgatggcaccgcagcacacgccggggccgcggcccacgtggtagtcgaagcaggggcggccgcgctcggccagcaccatgttggcgacggagacgtcatccgggtggctctgcaggtagcggcgggtgcgcttccactccgcgcaggtggcgatgcatacgggcacggccttgcgcagcgtgtcgatggtctcgcgcgcagcatgggcgtccgtgtagggaccaaagtagcgggttcccttgcggtgcctctcgcgcgtgtacttgatggcggggaacgcgtccgactccgttatggcgatgtaggggtagctcttgtcatccttgaagtcgacgttgaagtacgggtggtactgctcgatgaggttgcgctccagcacgagcgcctcgtgctccgagcccacgaccacgtagtcgaagctgcggacgacctgcatcatgagcgggatcttggcacggtcgtccgtcaggttcacgtactgcagcatgcgggcgcgcaggttcttggccttgcccacgtagatgacctcgcccttggcgtccttccacaggtagcagcccgggctcgtgggaacctggttgacctgctccgcgatggagggcaggcccagcgcctcggggcgcggggcctgggtgtcaaggtcgggcatgtgcggggccgggtcctttatcgacatgggtcgcctgcgctccgccctagaacgaggtgtccgtgggctcgggatagaacttcgcgaacttgcggatctggttcttctcggtcaggtccacgtcgatgcggcggcgcaggctccagtccgcgtcgtagcgctgcgggtcgtacaccttgcccgcgcgcaccagggagtcgacctcggccaggagcgactcgtcgcgcacgtagcggcgcagcagcgatatggggaccagcgtgtagaggatggtgtccgccacgacgcgcggctcttctcccctgccgtccacgaggtcgagcgtggcgacctccatggggttcacgccgcccgcgaggttgtagaacgagttgcggccgatcctggggttgcagtccagaaagagctgacggcccgtcttggggtcgcgcttgatgtcgaagttggcgaagccgcggtagcccgcgtcggaaagcatcgcgcccgcgcgattccagagctccgggttctggcgcgtgatcatcgcgacggggttgcccagcatcgcgggggcgtggtcctcgagcagcacctgcgcgccgcccagcatgaggggcttgccctcgcgtcccacgtagatcgtgagcgagtccatgtaggtgtcgtccccgccgatgagctcctgcaccaggaactcgccggcgaagcccgcctcgcgcaggtccgcccacagcttgtcgagctgggcctgctccgtcatgtagtagaccttcttgaagcccttgacgatgtagcggtagtactccgcggacacggccggcttggccaccaccgggaaggggatctgcgtgggagcgatggggtccgcgcccgcgaggctcaccacgtccatctgcggcacgtcgagcccgtgctcgcggcacaggcgcgagaacgttgccttgtcgcacacggcgtcaaaggcgtcgcgcggcgggcagaggcaggtcacgttggcgggcaggtccgccttgacgtcctccaggagctcgatcagctggtcggtgttcccgacaaggaggacgtgggcgtccggccgctggcccgcgatctgggtgacggcgggcacgatgacgtcgtggtcgagcgacgcgaccgcgcgggcgtcgatgatgcgcgagtgctcgatcgcgccgatgaagccggtgttgagcgcgatggtggtcacgccaaaggcctcgtggaactcgcgacagagcgcgtaggcgccaatgtcgccgccaatgacgacgggaacgatgtcgttccttgcgggagccttgccttgttgcatcagtttgccccaactttcttcttgcgcccaaagcgggcgaggatggactggatggtggaggcctccggcgccttgaacaggacgggaagcccgtaggtcacgagcacggcaggcacgccggcggccacgcagtacaggatgctgcgcgacatggagccaagccagttgccaaagtgcgcgttgagcagggcgagaaggacgaccgccacggccgtgcccgcgacgccaaacgcaagcgagcgcacaaacgatgcgaacattgacctgaggccgatgggcccgagcgtgcggcgcaggttgaggtaggtcaccacgtcgatcgcgatgaagaacagcgtgctggagaacgcgacgccggcaaggccgagcctgctggtgaaggcgaagcagaagccgatctgcaccgcggcggccacgcacgtggcgatggtgaggaagaccatcttgcgaagcgaggagcagatcttctgcaggtaggtgctgacgccgtagaacggcagcgccgtggcgagccagccaaggtacaggatcgtgttctgcaggcccttggcgtcgaacttgcccgccgcgaggatcgtgatgagccccggcgcgaagatgacgaggaacatcgcgaacggcacgagcatgaacacgatgcgctccgtgccaaagcggacggcgcgcttgaacgactccatgtcattgttggccacgtagtcggacagctccgtgaagagcgcgatggtgatggggatcgcgaagacggagtacgggagcatgtaccagagcctcgcgtagtacgcgatggacgcgccggcagcggtgacctgcagggccgaggacgtctgcacggcgaccgtggggaacgacacgagcgtgagcaccagggtgggcacgccgatggagagcgtctccttgagcgcggggtcgtgcaggtcgatgtggaagcggatgcggatgccgtgccgcctgagcgacggcacctgcacgagcacctgcacgaggacgcccagggggttgccgatggccaggcacagcaccgcgagcgacttgttggtgggcacgagcagggcgtatgccaggaacgacgccgtgcacacgatgttgttgaagatgggcgccgcgttggaccacaggtagtcgcgctccgcgttgagcacgcccgagatgagcgagtcgagcgcgtacaggatgacctcgaccacaaagaacctgaagaggtactccgacaccccggcgtcgaagttcttggaggccgagaaggactgcgtccagatgatgaagcccgcgaagatccacgagagcacggtcacgatcgcgaggatgaccgtcacgatcgatatgaggttcgacgcgtagtcgtccgcacccttgcggccgaggcgcttctttacggacatgtacacgggcaggaacgccgtcatgatcatgccgcccatgaccagctcgtacagctggttgggcaggttgttcgcgacggtgtagcagctcgcgagcgccgtgacgcccagggcgtacgcctggccccacgtgcggaagaagcccgtgatgcgactgatgatcacgaggacgctcatgagggcggcggagcgcccgactgccgcctgggtcttcttggcggcgtcgtcgtccttctcgccctcggccgcatcgacgtcggtcgtgctcgcctcgggcccctcggcctccggcgcggcctcggtggcgttgcccacgatcttcagcttggacgtggcgtcggccagcttcgacgcgacggccgcggcaaagtggcgcgcgggggcgttggggttgctcacgacgaccctggggtcgctcgaactcgttcgtaggtgctttgccatgggtggcctatcgacgtgtggtgtcctgcgcgtgcgcctcgccggcgccggccgcgagctcgcggaagaagcagctgcggtgcccggtgtggcaggccggtccgggcgagtcgacctcgacgaggagcgtgtccgcgtcgcagtccacgagcacgcgcttgacgtgctggatgtttccgctggtggcgcccttgttccagagctcctggcggccgcgcgaccagaaccacgtcgtgcccgtcgtgagcgtgagccccagggactcctcgttcatccaggcgaccatgaggacctcgccggtccccgcctgctgcacgacggcaggcacgagcccgcgcgagtcgaacttgacgggggtcgccccgaacgaggtcagctcgaccttctcgcccgcgtacgcccttggctcggttgccgtgctgggggactgggatgcgtccatgtggtctcctatccgcgaatcttgtcgaggaccttcttgcccgcgagcagggacttgtagtagcgctcgcgcacggggaggtcgcggtcgggcgcgacgtgcctgacctccttgctgaacttggtcttgaacgtgttgagcgtcatgaggtcggggaacgcctccgagccgatgcccatctggtcgtagtcgacgcagcccatcctgccgagcgtgcagcactcgaagtagatgaggccgtccgtggcgagggcgcgctgcttgccggagcggctcgcgccgtagtagcgcacggcgtgccggccggagatggtggccatggtccacgtgatcacgcggccgtccaccctccccgcgaagacgcggcagtgctcggggcccaggcagcgcagggtgttctcgtaatcctcgatcggcgcggggacaaagccgtcgcgctcgctcgtctcgcgcatgacgtcgtagtactccgagaaggacttcgatgcgaggtcggtctcgtccgcgtaggtggcgggcgtctcgcgcatggccttgcgcacgtcgcggcggccgcggcccttcatgcgggcgaggatctgctcgtccccgccggtgaggtcgatcacgaccgtcgtgtcgtacggcatcatggagagcgtggcgtgcgtgacgtcgagctcgtgctcgaccgcgagccggacgaagacaaccttgcggtcgcgctcggacacgaagtcgcgcagcgccacgagggcctcgcgctcctcgtcctccgtcagctcgcggacccagacgggaccgtggtgcgagcgaaggtagtggtagccgtgcgtctcgtagtccgtgaacgccgcgacgcccagggtctcgtccccatccgcgatggcgacgcagccccagaacgtgcgccccgggaccgtctcctcgtagtcggaccacccgcgggtctgctctatcggaagctcgagaccaaggcggtccgcctcggcctcgaactggtcaaacgtgagttcccttgcctgcattcgctctccagccgtcagtggcaatcagttagcatcaagccattttaggatgctgccgtgacggctcgggcaaatgcgccgtagcttcataagtgccttcacaagttgcggccggggcgggcggtgctacttggaggcgggcttggtcttggatgcgacggccttctccacctcgcggtcgcggcgcgcgcccctggcgcgcacgaccaccttgcgggcgagcttgagcgagcggtagaagccgccgcggatcgggaagtcgcggtctggcgccacgtgcgtgacctgcttgcagaacttggtcttgaactcgttcaggccaagcagggtcgggctgagctcggagcctatggccatgaggtcgtagctcttgaccctgccgccctcgaacttgccaagggagcagcactcgaagtacagcagcttgtccgtcacgtgcttgcgcatggtcgccgtggaggaggcggcgtagtagcgcatggcgacggagccggagatggtcacgagcgaccaggtgacgaccttgccgtcctcctgcctgcccgcgaagaggcggcagtgctcgggacccaggatgcggagcatgtcctcgtagtcggacgcgggcgcggggtggaagccgtcgcgctcgcccgtctccacgagcacgccgtagtagtccgagaaggacttcgctgcctgctcggtctcgtccgcgcaggtgatgggcgcctcgcgcagcgccttgcgcacgtcgcggcggccgcggggcttcatgcgggcgaggatctcgtcgtcaccgccggtgacgtcgatcacgaccgtcgtgtcgtacggcacgatggagagcgccggctcgcagcagtcgaggtccgcgtcgacgcagcagcgcacgaagacctgtccttctcccctctcgcgcacgacggcgcgaatcgcctcgagcgccgcgcgctcgtcgtcgggcgtgggcgcctgcaaccagacgggaccgtggttggacctcaggaagtgatagccgtgcgtctcgtagtcgaagagcctaatgtaggcgacggccgcgccgtcacgctccagcctgtacgcgccccaggggcgacgtcccggcaccgttgcctcgtacctcgcccacacctcggtctgctcgatcgggaggttcaggcccgcggcctgcgcctccttgtcgaactctgcggacggcaactcgatggcacgcatgtcttgcgtggagctcatgacattccccctcggccggatagaccctcggcggagcgtgccgaccgatgcacgcctcgcccctatgggtccattctaaggctcctgcaagacggggagcgaacttgcacggtctggacaccccgcgcacgaggcgtaatcccagctgagaggcagccgcaagcaacctgaaagctatacggttagaagtccagtcgaacggggatgccctggctcgccatgtactccttcacctggcggacggtgtacgtgccaaagtggaagacgctcgccgcgagcacggcgtccgcctctccgtcgatgatgccctccgcaaagtgctcgagcttgccgacgccacccgacgcgatgaccgggatgggaacggcgcgcgccaccgcgcgcgtgagcgggatgtcgaacccgtccttggtgccgtcgcggtccatgctcgtgaggaggatctctccggcaccgcggcgcgcggcctcctccgcccactcgacggcgtcgatgccggtcggcttgcgcccacctgcggtgtagacctcccacttgtcacccttgccctcgacgtggcgggcatcaatcgccaccacgacagcctggctgccgaacgcggaggccgccgccgtgatgagtcccgggtcgcggaccgccgcggagttgacggacaccttgtccgcacccgcggagatcatggtccgcatgcccgcgacgtccctgaagccgccacccaccgtataggggatgcgcagctcctcggcggctcgcgacgcgagctcgacggtggtcctcctgtcgtcggaggtcgccgtgatgtcgaggaagacgacctcgtcggcaccctccatgtcgtaggcgctcgcgagctccacggggtcacccgcatcgcgcagccccacgaagttgacgcccttcaccacacggccgtccttcacgtccaggcacggtatgacgcgtttggtcagcatgtcttcctcccgtcgccctcagcgccgtctgggcgagaagtgccgcgtgcggcctccagcgcctcctccagcgtgaagcttccctcgtagatggcccgtcccgtgatggcgccctcgatcacctctggcccctctgccgcgagcgcgcggatgtccgcgaggctcgcgatgccgcccgaggccacgacggggaaccccgccaccttcgccacgtgccggtatgccgcgacgtcgattcccgtctgcatgccgtcgcgcgcgatgtccgtgaagacgaggtgcctgaagccgagctcggagaggtgcgccacaagatcgtccgagctcaggccctcgccctcgcgccagccgtccacgcgcacctcaccgtcgtgggccgcgacgtccgcgacgacctggtccgggaagtcgcgggctgccgcctccgcaaagtccgggtcgcgcacgagcgcggtgccgatggcgatgcgcttggcacccgcgtccgcaaggcggcgcaccgcctccatgtcgcgcacgccgccgcccgtgtccacgttgatcgaacccagggagcagatgcgctctatggcacggtggttcttctcgacggcatccttgtcctcgcgaaacgccgaggacaggtccacgacgtgcacccacgtggcgcccctgtcagcaaagtcgtgcgccacggcgacggggtcgtccgagtacacgtccacctgcgcgcggtcgccgcgcttgaggcgaacgaccttgcccgcaaggaggtcgatggcgggaaacaggatcatggctagcccctgacgatgtcgacgaagttctgcaggatcttgaggcccgtacgcgacgacttctcggggtggaactgcacgccgaagacgttgtcgtgccagacggccgaggcgaagctgcgcgtgtagtgcgtgcgcgccgtgacgaccgaggcggggacgtcgtccgccagtgcataggagtgagtgaagtagaagttcgcgccctccggcacgtcgaccaggagcgggcacgcgccgcccagctccgtgaggtaggcctggtcccagcccacgtgcgggaccttgagcgtcttggactcgagcctcgtgacagagccgggaaggaccccaaggcccggcacccactccccgccgaacgaggagtgctccgcgtgctcggtcccgcgctcgaagaggacctggagccccaggcagatgcccaggaagggcttgcccgcgttaatggcgtccaccacggcgtccgcctggccggtgctcctcatgtaggtgagcgcgtcctcgaagctcccgacgcccggcaggatgacgcccgccgacgagcggatgtcacgcgggtcgtccgattcgtacgcgctgccgccggcggcgttgatgccgcggacgacgctctgcaggttgcccttgtggtagtcgactaccacgatgtctcccctgaccatcagaggcttcccttcgtcgatggcacacccttcaccctggggtcgagctccacggcgccgcgcatcgcgcgggcgaccgccttgaaggcgcactcgaggatgtggtgtgcgttctcccccgcgatctcgcgcacgtggagcgtgatgcccgcgtcgcgcgcgaacccctggaagaactcgtggcccagctccgtgtcgaacgtacccaccttctgggccgtgataggcacgtcccagtacagctccccgcgaccgctcacgtcgattgcggcaagcaccagggcctcgtccatggggacgacgacggacgagaagcgcgtgatgccgctcttgtcgcccaacgcctgcgcgagggcctgtcccagcacgatgcccacgtcctccaccgtgtgatggtcgtccacccaggtgtcgcccttcgcgtgaaccgtgaggtcgacgagcgagtggcggccgagggcgctcagcatgtggtcgaagaacccgacgcccgtcgagatgtcgcaggcgcccgtcccgtccaggtcgatcgagaccgtgatgtcggtctcccccgtcttgcggcttaccgtggcagtccttgccatgtgctagacctcctcaagcagacacgagagcgcgtccaggaacgcgtcgttctcctccagcttgccgaccgtgacgcgcaggcagtcggtgagccctggcgcggacgagaagtcgcgcaccagaatcgagtactcgtcgcgcaggcgctcgcgcacccgatgcgcgtcaggcacccgtacgagcaggaagttcgccgcgctcggccacaccgtgacgccgcggcctgaaagctcctggagcccctgggagagccgcgagcgctcggccacgatcttctcgatcgtgggatcgaacgtcttgcgctccctcaccgcgacgagcgccgccgcctgcgagaagacgttcacggagtacggctggcgcaccgccgccatggccgccatcacgtcagggcatcccagcaggtagccgatgcgcgcacccgcgagacagtacgccttggagagcgtgtgcagtattaccaagttgtcatattttgcgaggagcggctccgcggaggagccctccggcgcgaactccatgtacgcctcgtcgagaaggacgacccccggacacgcctcgcagagccgcgccgtgtcctccacagagaagaggttgcccgtggggttgttgggcgacgtcacgatgacgaggctcgcgtccgcagcggcccgcacgagggcgtccgcgtccgcctcgtacgtcacggggtcgcggtcgacgtcgaccacctcggtctcgacgagctccgcatagaggcggtagacggagaaggtcggcgtgcagttgacgaggatgtgcccgctgccgccaaaggcaagcagcaggttgaagatgagctcgtcaccgccgttgcccacgatgacctggctcgggtcgacgccgtgccaggcggcgagctccgcgcgaaggtcgggcgagaggggctgggggtagcggttcgtggcaaccccgcggagcgcctcgtccaccttggcgcgcacctccgcgggcatgccgtaggtgttctcattcgcagaaaggttgaccctcacctgggagaatgccgggtcgtacggctcgagtgccgcagccgagggccgcatcacggcacggaacctgtcgctgataccttggggcacggtgccctccaatcatgtcccgcccagccgcgtcacgcggtgggcacgccgcctacttggactgtccgcccttgaggttgggaacgcccggttcatcaagcttacgcggccaggccgtcgccatcgcatcttggcacgcggcggaaacgtcggcgaaacgctccgtttgctcagccaggagcttacggcgcatgcccacggagagcgcgtgcgcccagaggccctctgcctgcgcgagcgcctggacggcggggccgtccgccttgaggccctcgggcgtgtacgagatgacgctcgagcgcttctggaagtcgtagacgccgagcgggttcgagaagaccgcagtgccaccggtcggaagcgtgtggttgggtccagccacgtagtcgccgagcggctccgaggaccagggtcccacgaagatcgcgcccgcgttctggatgcgacccagcaggtcgaaggccttgtcgcagtggagctcgaggtgctccggcgcgatgaggttcacggcgtccacggcggcgtccaggctggggcagctcaccacgaggccatgctcgagcgaggcgcgcgtgatctcctcgcgcggggactgcgccacgagggactcgacggctgcattgacgccttccacgaggtcgggcgcgtccgtgacgaggtagcaggtcgcgagcgggtcgtgctccgcctgcgccatgaggtcggccgcgacgaccacggggtcggccgtggcgtccgcgaggacgcagacctcggagggaccggcgaccatgtcgatgcccacgtcgccggagacgtagcgcttggccgcggcgacgtacgcgttgcccgggccgacgatcttggagaccttggggatggactcggtcccgtaggccacggcgccgatcgcctgcgcgccgccgaccgcatagacctcgtccacgcccgcgacggccgccgccgcgagcgtgtaggcggaaagcgagccgtcacgctgcggcggggtgaccatgatgacgcgcgggacgcccgcgacctttgcgggcaccgtgtccatcaggaccgtggaggggtactgggcgcggccgcccggcacgtagacggcgacggacggaacgggcgtcaccttgacgccgaggatcgtgccgtcctcgcgggtcgtgaaccaggattgctcacgctcgcgctcgtggaagtcgcggatctgggcgtatgccttcttgagggacgagaggaactccgggtcgaccatgtcgagagcgcccttcacgacctcgtccggaacgcggaacgagtcggggcaggcgccgtcgaacttgaggcagaagccacgcacggcctcgtcaccgccctcgcgcacggcgtccacgatcttctcggccgactccatgacctcgcggggcagggcgccctggcgctcgaggtctgactgctggagccgctggctcccggttag

SEQ ID NO: 203 - DNA, 9715 bp, Unknown
  Metagenome-assembled genome
cttgtgcgagaaaatctaagtgtctgtaggaagattttttctcttgtgtggtataagaatttcgttctgggtagaattcagaacgttggacaggtgcgggggagcaagttccccctcgaccaataggatgtgctgctagcacgaaagtgggaggttttgactatgactcttaagcctttgggtgaccgcgttctcgttaagcccgctcccaaggaggagaagaccgccagcggcctctacatctcttccggcgcgcaggagaagccgcagcgcggcgaggtcatcgccgtcggtgccggcaaggtcaacgacaagggcgagcgcgtcgtccccgacgtcaaggttggcgaccaggtctactacggcaagttcggcggcagcgaggtcaaggtcgacggggaggacttcctcctgcttcgcgccgacgacatctacgcgatcattaccgactagcctcggtagctcttctctgctaagaaattcctgacacggaggtacagataatggcaaaggacatcgtttttggcaccgacgctcgtgccaagctcgccaagggcgtcaacacgctcgctgacgcagtcaccaccacgcttggccccaagggccgctacgtggcgctgcagcgctcctacggcgcccccacgattacgaacgacggcgtgtccgtcgctaaggagatcgagctcaaggacccgatcgagaacatgggcgcccagctggtgaaggaggtcgccaccaagaccaacgacaccgtgggtgacggcaccaccaccgcaacgctgcttgcccaggtcatcgtgaacgagggcctgcgcaacgtcgccgccggcgccaacccgatcgcaatccgtcgcggcatcgacaaggccgtcgacgccgccgtcgccgagatgaagaagatgtccacggacgtctccacctccgaccagatcgcctccgtcggcaccatctccgccggcgaccccgagatcggcaagaagatctccgaggccatggaggtcgtgggcaaggacggcgtcatcaccgtcgaggactcccagaccttcggcatcgacatcgacaccgtcgagggcatgcagttcgacaagggctacatctccccgtacttcgcgaccaacaacgacacgatgaccgccgagctgcagaacccctacatcctgatgactgaccagaagatcagcaacatccaggacatcctgcccgtgctcgaggccatccagaagagcggctcgccgctgctcatcatcgcggaggacgtcgagggcgaggccctggcgaccctgatcctcaacaagctccgtggcacgctgaacgtcgccgccgtgaaggcccctggctacggcgaccgccgcaagcgcatgctcgaggacatcgcaatcctgaccggcggccaggttgccatgaaggagctcggcgtcgagctgtccgacatcaccgctgagatgctcggccgcgccaagtccgtcaagatcaccaaggacaacaccacgatcgtcgacggcgctggctccaaggaggccatcgaggaccgcatctcccagatcaagggcgagatcgagcacaccgactccgacttcgacaaggagaagctgcaggagcgcatggcaaagctctccggtggcgtcgcggtcatcaaggtcggcgctgctaccgaggttgagctcaaggagatcaagcaccgtatcgaggacgcgctgcaggccacgcgcgcagctgtcgaggagggcatcgtcgctggtggcggcgtcgcgttcctggaggccagcaaggccctggacggcgtcgaggttgccgacgctgacgagcagattggtgtcgacatcatccgcaaggccctctacgcgcccgtgaagaccatcgcgtccaacgccggcttcgagggctccgtcgtggtcgagaagatcaagggcctgcccgagggcgagggcctgaactccgccaacggcaagtggggcaacatgatcgagatgggcgtcctcgaccccgtcaaggtcacccgcaccacgctccagaacgccgcttccgtcgcgtccctgatcctcatcaccgaggcgaccgtctccgacgagccgaaggacaccaccatcgaggaggccatctccgcggctgccgcacagggcggccagggtggcggcatgtactaaggcgtagcgagcgcccataggcatcaagccaacacggcccggacccaaggaggctcgtccccctgggcccgggcctttttgtatgcgtctgcggccgtggcgccgtcgtgctgtggagcggcgcctaaagcggtacaattgcagctcgtggaagaagggggagacatggcaggcaagcgcgacgttatcgacgacctgatcgacatccagaacgactggaaggccgtcaagaacccgttcgggggcatcgcggattccctcgcggcggacccggactcgcagaacctgtacgacccgtccaactacaaggagcgcccgcgcatcagctcgctcttctgctttgacgtggcctccggcgacatgaaggcctgcaccaggtgcctggacgtctgccccgtgaacgccatcaccatcacgaagaacggcgtcaagcttgcggacaactgccgcaagtgcggcctgtgcagcgccgcgtgcccgacggaggtcttcgtggcgtacaacgtgacgcccaagagcctgtacgacaagatctcccagatcgcgagcgagtacgagcagtgctacgtcacgtgcacgcgtgcgctcggccgcatccccaaggacaacgaggtcctgctgccatgcgtcggcgcggtctccaaggagacgtggttcgcccttctcgccgaatacaagaacatcagcatctacctgccgttgggcatctgcgacaagtgtcgcaccacgacgggcgagcgcgcgttctcggacgccatcgccgagggtgaggagctgagccacggggcgatgggcctcgaggtgagcgagaaggacatgacgcacgagcagacgcgcgagttcaagcgcggccagttcatgtcgtccatggtgagggcgggcgcgtccgcggtctccgccacgaaccccatggtcgccggcgcggcggccgtcgcgaacaagatccaggcccactccgacaagatggtggagctccagaactcgctcgagcgcgccgtgggcgccaagacgagcgagcgcgaccgccgcatcctgacgcagggcaggaagatcatgctcacgaccctccaggcgcgcaacgccctggccaagggctttgccgatctcgaggtccccgcgtgcgacccgacgctctgcacggcctgcggcgactgcgtcgaggcgtgtacgcttcatgcctgcgacctcgaccacgaggggcacttctccgtcgagccggcgtactgcgtcaactgcggcgtctgcgcgaaggtctgccccgagggcgccctcaccatgaggaagtacgatacggcggacctctgcatccgcgacgaggaggcggagcgtcgcaagcgcgccgccgagaagcagaaggccaggatcgagaagaccaaggccgagggcaagaagcagcttaaccgggtgctcgatgggctcgagcgccttgcggacgattaggaaccagagccgcccgagcggctggacaagacggagatgaggacgtgtcactttcaatcggcatcgtaggccttcccaacgtgggcaagtcgaccctgttcacggcgctcacgcgcaagggcggcttcgcggcaaactatcccttcgcgacgatcgaccccaacgtgggcatcgtggacgtgcccgacgcgcgcctcgacaagctcgccgagatggtgcaccccgcgaggatcgtgcccgcgagcgtcgagttcgttgacatcgcaggcctcgtcaagggcgcgtccgagggcgagggcctcggcaaccagttcctcgccaacgtccgcaactgcgacgccatctgcgaggtcgttcgctacttcaaggaccccaacgtcatgcgcgagaccggcaggaccggcgccttcgtcgacccggcggccgacgtcgacaccatccagaccgagctcatcctcgcggacctcggctcgctcgaccgctccatccccaagctcgagaaggaggccaagcgcgacaaggagatgaagccgcgcctggacgtcgcactcaagctgcagtcctggctgaacgagggcaaccgcgcggccacctgcgacctcaccgacgacgagcgcgccgccgcgcacgacctcttcctcctcacgatgaagcccatgctctacgtggccaactgcgacgaggaccagctgcacgacgatctcacgatcgacggccagaaggccatccccatctgcgccgaggtcgaggcggagcttgccgacctcgacccccaggaggcgtccgagtacctggagtccatgggcctcgagcgctccggcctcgagacgctggcgcaggcggcataccacctgcttggcctgcagagcttcttcaccgcaggccccaaggaggtccgcgcctggacggtgcgcatcggcgcaaaggcccccgaggccgccggcgtcatccactccgacttcgagaagggcttcatcaaggccgaaaccatcagctacgatgactacgtgagcctcggcggcgagcagggtgccaaggaggctggccgcatgcgcatggagggcaaggactacgtcgtccaggacggcgacatcatggtcttccgcttcaacgtgtaggagccgcaggcaggcgcaagccagcatagacatgcaataaaaacgggcgcccttctcccctgggtacggtgggggagaagggcgccttcctttgcttttgcttgctgctggggtgacggggcgtgccgactagttgcccgtggacgtggtcgtcgtgcccgtcgtcgtggccgacgcggtgcccgtggccgtcgcggtgccgctcgtccagtcggtgccgaacacgaccacgacgtcgacggagctgtcccagttgccgtcgttggcgacgggcgccacgctgagcccgagcgacttggcgacgccggcggcgttggccgcggagtcgccgttgtagtagacggcggtcttgctctggacgctcggggcgtcgttggtgctggtggtgaagcccgcgctggagagggtcgatgcgcccttgccggccacgcccgccgtcgtcgtgccgttgagcacgagcaccgtgccggagtactcgggcgttacggtcgtgccgctcgaggacgagtcgtcagagctgccggagtcgtcggaggtggaggtgctcacgcccacggagcccgcgacgcccgccgtgaagtcctgcgtggagctgctgtagggcggcaggcccttgtccacgcgctccatgatcttggcccacgcgtccgcgtcggccacctcgtaccacgtgttgttcacgtactcggaggtggtggggcactggccggagtagatgtccttgtccacgtcgatgccggcaaagttcgtcgcgagcgaggtgatggagcttaccgtcatgtccgtcgtgacatagccggcgagcgtgttgaccgtggatacgatcgtggcggcgcccgagctcatgaccttcttgatcacggcgccaatcagcatgcgctggttcgcggcgcgatagaagtcgccgccgccgtagctgtcgtacgcatggcgcgcgcggcccagcagcgccgctgtcttgccgtcgagcgtctgcttgcccgcgggcaggtcgagcccggtgtatttggggtccttcacggcgacggggaggttcacggtcacgccgccgatggcgtccaccacctccgcaaagccgtccatgtcgatctccgcatagtgtgaaatgctcacgccggcaaacttgctcacgacctcggtcgcataggccgccccgccaaacgagtaggcggcgttgatcttctgggttccgtggctgcccatgtcgatcatggtgtcgcgcgggatggagatcagcgtgaccttcttgttgcgcgggtccacgcgcgcaaggatgatcgtgtcggtgcggtaggcgctgtagtcctttccgtactcggcgctgtccgcgcgctcctcgtccttgtcgatgcccagcagcagcatgtagaacgggtcgcccgggtccttggtctccaccagggccttgcggagcttcgtgtccacgcccgcgttgatcgtgctgttgatgtggtggatgtacgccgccacggccacgccaccagagacaatcactgccaggatcgcgacgagcaccgtgcgcaggacgtggtgacggccacggcgcctgcgcttctcgatgtactcgcccgcgccctttgcccttgagtagcgcggtgcgttggggttcgacggcacttccgggcgagaagaacggccctcgcggccggcatggccaaatcccgcatgcgcggtgcgggcggacttgtcgcgaccggagccggcgttaaacccaaacttccgagacgacgcgccgctgctcccatggcccgccttggggacgtcgggaagcggggcctggatctgcccgtccgcggcaccggatgcctgcggtgccttcgcgctgtgcttacccacgtctcctccttgtgcgacctccgcgcaacgtcggcgcgggcgccgcgtttatgactgatcctgtcccagcaccacaataacgtcctgggagtttccgtagcttccgtcgttggcgactggggtcacatccaggccaagcgtcttcacgacgccctttgccttggcgagcccgtcgggtccgttgtagatgacctccgtggtcgtgacgaggccgttggcgttgccggactgcgcctggaagcccgcggcggaaagctcgctcgccttctggcccgcaaggccgttcacgccggagccgttcagtacggtcacgctgccggagtactcggccttggtggagctcgagctggagctggagtccgagtcgtcgctcgagctcgagtcgtccgtcgtggtcgtggtgctgccgcccgaggccgccacgcccgcggtcgggtcctggtcggagctcgagtagggcgacttaccggcgtccacgcgcttcatcatcttctgccaggcctcgtcgtccatgatttcgtacgagacgccgccgatgtacttgccctcggtgggggcgaggccgctcatgatgctcttgctggtgtccatgccgcgcatctggctcgcgagggacacgatgtcgctcgcgctcatgtccgtgttcaccatgtccgccatggcgttcacggtcttcgtcatggtcgagaggctgctcttgagcaccttcttggcgacggcggtaatgacggcgcgctggttggcggcgcgatagaagtcgccggcgccgtagctgtcatatgcgtggcgcgcgcggcagagcagtgccgcggtcttgccgtcgagcttctgcttgcccgcgggcaggtcgagcttggtgtagttggggtccttcacggccacgggcagcgtcacggtgacgcctcccaccgcgtcgaccacgtcctccatgccgtccatgtcgatctcggcgtagtgggatatgctcacgccggcgaccttctccaccatcttgacggcgtagctcgcgccgccgatggagtatgccgcgttcagcttctgcgtgccgtggctgcccatgtcgaccttgaggtctcgcgggatcgagaccatcgtgaccttcttcttctgcgggtcgatgcgcacgagcatgatggagtccgagcggtaggcgctcgagctggagccaaactgcttgctcgagctgcgcgagctgtccttgtccacgccaaggagcagcatgtagaacggctcgccggcctccttggtggtgagcgtgctcatgagcttgttgtcgaggttgcccctcaggcgcgagttgaggttgttgacgtaggcccagactgccgcgccacccgcaacgatgaccgcgagcaccgtcacgaggacgaccctcaggatcctgtgagtcctgcgcctgccctgcgcctgcgcatagtgcgcgcgcgacgagtggcgagagagggagcgtgcgtccctcaggaggtcgttgtccctcatgttccttcgcgccaaggcgattccttccgttggagcggcgcttgacgaaagcccaaccaattaatattacataccgccagctaacaccttacgaagtccataaagtgcaaggcaatccctaaaaaacacaaggcaaccggccgtcccgcagggcccagggcgagaaactctgttcttctcgcgccaagcccctccgtgggcggcatgccggcgccagtcgtggcatgatagcttgtggctttctttaacaccgattgcggaggaatccatgcagaacaacaggcccaagcagttcgtggctgtcttcgactttggcgcacagtacggtcagctcatcgcaaggcgcgttcgcgacctgcacgtgtactccgagatcgtcccgtgtgacatctccgcggacgagctcgcggccatggccccctccgccatcatcctttccggcggccccgcctcggtctacgcggacgacgcgcccgacatggacgcccgcgtgttcgagctcggcgtccccgtgctcggcttctgctacggccagcagatcatggccgtcaagctgggcggcaaggtcggccacaccgagaagggcgagtacggtcccgccacgatccaccgccagggccagagccgcgtgctggacggcacccccgacgagcagaccgtctggatgagccaccgcgacgccgtgtccgacgtgcccgagggcttcaccatcacgtccaccacggacacctgtcccgtcgcctcgatggaggacgcctcgcgcaacctcttcgcgacgcagttccacccggaggtccgccataccgcctacggccgcgacatcctcaagaacttcctcttcaaggtctgcggcctcgagcccaactggaccatggacaacatcatcgacgagaaggtcgcggcgatccgcgagcaggtcggcgacagcaaggtgatcctcgcgctctccggcggcgtggactcctccgtggtggccgcgctcgtgcaccgcgccatcggcgaccagctcacctgcgtcttcgtcaaccacggcatgctccgcaagggcgagcccgagatggtcgaggaggtcttccgcaagcagttcaacgtgccgctgatccacgtgcacgcggaggagcgctacgcaaagctcctcgccggcgtcacggacccggagcagaagcgccgccgcatcggcacgcagttctggaaggagttcttctccgtcgcccagaagctcgatggggtcaaatacctggcgcagggcaccatctacccggacatcatcgagtccggcgcgcgcaagaccggcggcaaggcctccacgatcaagagccaccacaacctgatcccgttccccgagggcgtgcacttcgacctcatcgagccgctcgaccacttcttcaaggacgaggtccgcgagctcggcgtgagcctgggcctgcccgccaagatggtctatcgccagccgttccccggccccggcctggccatccgcatcatcggcgaggtcacgccggagaagctcgccatcctcaaggacgcggacgccgtcgtgcgagaagagctggacgcctacaacgagcgcctctaccaggagacgggcgagcgcaactccgagcactcctgctggcagtacttcgcggtcctgcccgacatcaagtccgtcggcgtcatgggcgacgagcgcacctaccagcgcccgatcatcgtgcg

SEQ ID NO: 204 - DNA, 18336 bp, Unknown
  Metagenome-assembled genome
atcttgcaaccaaagccggaaaggtggcgcaccacggtcgctccgatgcggcccgtgccgatgacgcccaccgtggaggtgctgatgtccttgcccagcttaccgtgcaggccaaagtcctgcgcgagcgagtggcgcgccagcagcttgaccttgcgctgcgccatgagcagcagcatgatggcgtagttggccacgccctcgggaggatagggcgcgtttgccacgcgcatgcccagctcgcgcgcgtgggcgacgtcgatgtgctcgtagcctatggtgcgcgttgccaggttcttgacgccaaccgcgtggaaggcatccagaaggtcggcgggcatggggttggtgatgatgcagagcgcgtcgtgcccggcggcgaggctggcgttgtccagcgtgggatactcgctcgtccaatcgaactcgaagccaagctggcttgcggcttccttcatgtagccaagctcgtcgtactcgcgcagtgcataggcaaacagcctcataagaagatcctccccgggtggttgacggcccgccgtggcacccgcagccgcgcacgccaccgctggcgggacgcaggcgcagggcgcgagcctgacgccgcggtctgccccgcggcacgtggcaccatcttagttgacgcgccgctccgcacgcgaagcgtgcgcatccgttaacgttggcaggctatgcaccgccgttcgtcgcgaacgcatcccgttcgtcgcgaacgcatcccgttcgtcgcgaacgcatcccgttcgtcgcgccccgcctggcggcgtcgggcgcgactcactcaccgcaagaggtaccgttgcaagaaggacggcacgctcttctcgcctgcgtatattgattattgtcaatacgttgctagaatggacgcatcgattatcgtctatgtttaaggagaagaaccatgcactctgtcgaagtgttcgatcccgccatgtgctgccccaccggcgtctgcggccccagcgtcgaccccgaggtcctgaggatcgccggcctgcttgaggcgctggcgggcgcggggtttggcgtcacgcgacacagcctctcgtccgagccgcaggcgtttgtgcagaacgccgaggtcgcagccatcctaaaggagaagggcgtcggcgcgctccccatcacgtacgtggacggcaatctgctgagctcgggcgcctacccctccaacgatgaactgggcgacgcgctgggggtgacgtttgtggagcagccagccacaagcggatgctgctgcggctctgacggcgacgcggcggacgccccggcagacggcggatgctgctgcggctccggctgctgctaggaagggggcgtgtccaccatggccaactcaaacgcgacgtttgcggccaccgtcagcggctccggcgcggccggcggttccggcgcaaccgccgacgcgccactgagcgcaggcgagctcgcgccgtaccagtacctcttcctcacgggaaagggcggcgtgggcaagaccagcgtgtcgtgcgcggtggcgtgcgcccttgcggacgcgggccggcgcgtgctgcttgttacgacggacccggcgtcgaacctgggcgacgtgtttggacagccaatcggcatggagcccacgcccatccccgcgtgcccgggactcgaggcggaggaggtggaccccgtgcggctggcggcccgctaccgcgatggtgtggtcgcgccgtaccgcggcgtgctgccagatgacgccatcgccaacatagaggagcagctcagcggctcgtgcaccgtcgagatcgccgcgttcgaccggtttgcctcgctcctctcgtccgcaaagatagcccaaacgtacgacaacgtgatctttgacacggcgcccacgggccacacgctcaggatgctggagctgcccagcgcgtggacgtcgtacctcaaccagaacacgaccgggacctcctgcctgggccagcttgcgggcctgggccagcggcgcgacgcgtatcggcgcgcgatggaggtgctgcgcgacgccaattccaccgcgctcgtgctggtatcgcgcccgcagacgcttgcgctgggcgaggccgcacgcgctgccgcggagctttatggcgtgggcatccggccccggatgctggtggtaaacggcgtgctggcccagcccggcgacggtgttgcgcgccagatcttccgcgcgcaggccgaggcgctcgccgccatgccaggcgggcttgccaacgtgccgcgccacaccgtgccgcttcgcgcgagcgacgtgacgggcgtggagcgcctgcgcgcgctgctgggcgcacccgacagcgcgcaggcggcgcccatggacgcggcgggcgcgggctcaacggccgcgggttcgacaaccgcgggcgagaagaaccacgctcccgacctgccgggccttgacgcgctggtgaacgacctgttccgccgtgacgtgcgcgtggtcatgaccatgggcaagggcggcgtgggcaagaccaccgtggccgtccgcgttgcccaggcgctgagcgcgcgcgggcgccgcgtgcgcctcaccacaacggatccggcggaccacctggaccagtttgaccttgcgggcctggccgtgtcgcacatagaccaggccgcggagcttgccgcctaccaggacgaggtgctgcaaaaggcccgcggcaccatgagcgaggtggacgtgcgctacgtgcaggaggacctccgctccccctgcacgcaggaaatcgcaacctttcgcgcgtttgcgaacatcgtgtcgcgcgcgcaggacgaggtcgtggtgatcgacaccgcccccaccggccacacgctgctgcttctggacagcgcccagagctacggccgccagatagagcacaccggcggcgacgtgccccaaagcgtgcgcgacctcctgccgcgcctgcgcgacccgcgccagaccgaggtagtgatcgtgaccctgcccgagaacacgcccgtgcgcgaggcggagcgcctctccgccgacctcgaccgcgcgcgcatcccgcatggctggtgggtcgtgaaccgctgtctttccatgtccggcaccacggaccccacgctttccgcccgcgcgcaggccgaggcgcgctggatggaccgcgtgcgcaaggcctccgcccgcaaggtggccgccatcgcgtggcaggcgccgggtgtcgcgcccgcggcggacggccccacggacgggtcccccgacggccccgcgccggatggccccaccgtcgccttcgtgtgcacgcacaacgcctgccgcagccagatggcagaggcgctcgcgaggcagctgctgccccgcggcacaaagatcttctccgcgggaacaaagcccgccagccacgtggacgagggcgccctcgcggagctcgcgcgccgcggcgtcggcacgagaggcctgcaccccaagccgctttcccagctgccgcgcgtggactggcttgttaccatgggctgtggcgtgtcttgccccagcctgccgtgcgcgcaccgcgaggactggggcctgcaggaccccatgggcggctcgccccgcgcctaccaggactgcgcggacgccatcgtctggcacctgcgcgagctgggcgagaagatcgcacgcgcctaggttgcgccgccgcgcgggatgcaacaccgcttgggcgcgacgccgggcttgggcgcaacgccccgcgggggcacaacggaggtatggatgggaagccacatgacagacgaccagctgaggacggtcttcaaggcgctcgcggatgcgcggcgtctctcgatcgtgcgcacgctccagcgcgacggagaggtgtgcgcctgcaacctgctggatggcctgggcatcagccagcccacgctgtcgcaccacatgaaggtcctgtgcgacagcggcctcgtgcggtgccgcaaggacagccgctggtgccactactccgtggatgccgcggtcgcccgcgaggtgtccgcggcctttggcctgcttgcggatgccgctgccagcgcgtgcggcgatgcgtgcgggcacgatggctcgtgcggctgcgactgtagcggcaactagcgcgaccaaggcgcctcaactaccagcttgcacatgtcttgccgcggcgtcacctgccgcggcaaatttcgtgtactccaagtacacgatttcgcaaaatttcgtgtatcccgagtacacgatttttgttcttctcccccaattgcttgatggcggtcgtgggggcgagcaaaacggaaaaacggccagagaccgaagcctctggccgtttgaagttcgtggtcgggttgactggatttgaaccagcgacctctcggtcccgaaccgagcgctctaccaagctgagccacaacccgttagcgaaaatactctagcagaactgcgcaccttttccaaccgtaattgttgcgcaagaccaccaatccttcgcatcttgcgccgcggcggccacgcgccgcgccgcgcgccgcgtctcgcagatgccaaacacgcagctgcccgagcccgtgacctgcgccgcaagcacgccgggctggcgttcgagccacgcgagcacgtccgaatcctccggcacgatccgcatggccgcggcttgcaggttgttgtggagtgcggccgccacggccatggcgtcgccgtcacgcagggccgcaagcatgggctcgggcgaggctggcaggctgggcctggcgtcaaacgcgcggtacgccgccgcggtggatacgccgtcgcgcggccgcaccagcaccacgggcaggcccggcagctccgggaacgactccttcaccacgtcgccggcacccaccaggtacgtgggtcgcggttcgaggaataacgggacgtccgccccgatggagcgcgcgatcgcggcaaggcgctcttctcccccgggctcatctgcgggcacgccgcagagttgtgcaagggcgagaaggacggacgcggcgtcgctggaggagcctcccaggccgctctgcggcgggacgcgcttggtcacctccacgaggaccggcgcagccacgtggaaggcctcgcggaaccgggccgccgcctgccacgccgtgttgtgcgtggggtccacgcccacgtcctcgctcatgcgcagcagcacgccgcccggcgcctgcgcggcctctgcggcctcgggagcgtccggcgcgggcagcgccacgcgcacgcggtcgcccaccgcgagggcgatcatgacggaatccgcccggtggtagccgcgctcgtcgcggccggggtggatgcccaggtggaggttcaccttgacgggggcgtcaagcgtgacctccgcgctagagccgctgctggtcctcaaagccaaagtccagaatgcgctcgcccgtgtcgggatcgtaaatctcgaccgcggaggtgagcacgtccacgtactggtaggactggcgggccttgcggccgcggcgctcctccacctcgaccacgaacagcgtgggatagacgcccacgagggtgcccgtgcgctcgaccacgcgcgagcggcccatgttggcgcgaacgcgaaggcgctttcccttaagagccgtgagttcatcccggatttggtctaccctattggcgggcggaacctcaacttccatctgtacctccaaacgcagcgtctggcatttggctgttgactgccgcgctgccttgtgcaatgcaatgttccagtatatggcataaagggaacgtccacgtaaaacacggtatttaggagcgcaaatgagcacaaacaggatcgaaagggtgctggacaacctccaaaggcaggggctcgaccagatgctggtgtgcgaccccatgtccatctggtacctgacgggctactacacggagccgtacgagcgctttctggcgctgctgattgcgcgcgagggcgacggcgcccgcaccgtgatgttctgcaacaggctgttcccggacgccacgggcgccgcgcagaagctcgtgacgtttgacgacacgcaggaccccgtgcccctggtggcggccgagctcgacccctccaagcgcctgggcgtggacaagaagctcgtggcaaactggctgttcccgctgatggacgcgcacgcggccgccggcttcgagcttgcctccgccgccgtggacggcgcgcgctccatcaaggatgccgaggagcagcgcctaatgcgccaggccagccacaccaacgacgaggccatgaactggcttgcggcccaggtgcgcgagggcgtgacggagcacgagatcgcggcgggcctgctgggcgagtaccgccgcctgggcgcgcagggccacagctttgcgcccatagtgagctttggcgccaacgcggccgacccgcaccacgagccggacggcaccgtgttccacaagggcgacatggtcctgtttgacgtgggctgcaagcaggactcctactgctccgacatgacgcgcacgttctttacggccgagcccacggcgcaccagctcgaggtgtacgagacggtccgccgcgccaacgaggccgcagaggccatcgtgcgcccgggcgtcacgtttgcggaaatcgacctgacggcgcgccacatcatcgaggacgcgggctacggcgagtacttcacgcaccgcctgggccaccagatcggcctggaggaccacgagccgggcgacgtatccgccacgcacgacgagcccgtgcaggccggccagtgctttagcatcgagcccggcatctacatccccggcgacattggcgtgaggatcgaggacctggtcatcgtgaccgaggacggctgcgaggtgctcaaccactacagccacgaggccacggtgctggaggtctagagcttgagcgcgaggtcctgcagggcgtgaaagcgatggctgatcgcgttcttctcccctggcgtgagctccgccatggtcttgcccggcgtgtcgttgggaaggaagagcgggtcgtagccaaagccgccgtcgccgcgcggctcaaagcccacgtagccctcgcagtcgccgtcgccgcgatagacgccctcgccgtcctcgtcgcgctccaccatcaccacgctggagtggaagcgcgcggtgcgcttctcctgcggcacgtccgccatcaggcgcatgagcttctggttgtttgcggcgtcgttgccgtgctcccccgcccagcgggccgagaagatccccggcgcgccgtcgagggcgtccacgcagagaccggagtcatccgcgaccgccatggcgaggcccgtctcgtccagcgcggccgcggccttgatgtaggcgttgtcataaaacgtcttaccatcctccaccgggtccgggtagttgcccagctcgcccagcgccacaaagcgcacgccgggcaggctcttgctcaggatcgcctcgatctccgtcaccttgtgggggttgcccgtcgcgaccacgacggtcttcgcggggtcgagcgcgctgatgtcgattgccatgttcttctcctccaaatgccctgctagatggcctggcggttttctcatttaacacattaggttaattgcgtttaacacaatatgttaattggacttaacacgatgcgccgggcgagaaggacggcggcccttgccgcggcctactcctggaagcccgtcaccttgtcttgcagctgtatgagctttgcaatacctgcctggcccatgtcgagcagcgcgttgagctcgtcgcggttgatggtcgagcgctcgcccgtgccctgcacctccacgatgccgccctcgcccgtgcacaccaggttgaggtcgacctccgcgtggctgtcctccgggtagtcaaggtccagcagcagccggccgtccaccttgcccatgctgatggccgcgacctggcccgtgagcggcatgtgctttagcttgcctgcctccacggccgcctgcagcgcgtcgtgcagcgccacccacgcgcccgtgatggaggcggtgcgcgtgccgccgtcggcctggatcacgtcgcagtcgcaggtcacggtgtactcgcccagcttgtgcatgtcgcacaccgcacgcaggcttctgccaaccaggcgctcgatctccatcgagcgacccttgcggcccttgtactcgcggcgcgagcgcgtgttggtggaggcgggcagcatggcgtactccgccgtgacccagcccgcgcgggcgcccttgcgccagcccggcacgccctcctctatggtggcggtgcacatcacgcgcgtgttgccaaactccgccaggcacgatccgtccgcgttcatcatcacgtcgcgcgtgagcttgacggggcgcatctcgtccgccgccctgccatagctgcgctcgagggcgccttcctgctgctgggccatgttcttctcccctacctttgctttgtctgccgttgtctgccggcttgcacttgtctgccgttaccacaaggccccgcaccgcggactgcggatacggggccggatgctctctggtggacggtgagggattcgaacccccgatcttgtgcttgtaaggcacctgcgctagccgctgcgccaaccgtccgtgtcatgcgtggtgagtttatcacaccaacccgcccggcgctaaaggcctgcgtttggccgtatactttcccacatggataccattactcttgcgcacatagcccagcttctgggcaccaacgggcttctttcccgcacgagcggcctcgacgggaaggttgccgatacctgcgtcaccggcgcagactgcgactcgcgcttcgcagcacccaaccacctgttcatctgcaagggcgcggccttcaagcccgcgtacctcacgtccgcgcttgcggctggctgcgttgcctacctgtgcgacgaggaccacgccgccgagctcgcggccgtggcgcccggcacgccgcagctggttgccagcaacctgcgccgcgctatggccgtggcctccgccgccgcgtggggccacccggaccgcgacatccaggtgctgggcatcacgggcaccaagggcaagtcgaccgtcagctacatgttacgcgcgatcctggactccgccgcaggtcagagcgccacgggcgacgccgggcgagaagattgcgcccacaacgccgcgatcctgggctccatcgacacctacgacggggtcgagagcttcgagagcgtgaacaccacgcccgaggccccggacctgtggcgccacgtgcgcaacgccgtgagctcgcacctgccttaccttgtgatggaggtgtccagccaggcgctcaagtacgaccgcgtggtggacctggggctggacgtggcctgcttcctcaacatcgggcgggaccacattagccccgcagagcaccccaactttgaggattactttgcgagcaagctccggatttttgaccaggcgcggaccgcggtcgtgaacctggactctgccgaggttgacacgattctggaccacgccaagcgctgcgagcgccttcttacgtttggctgcacggacgccgcgcgcgaggcgggcgcggacgtgtgggccaccaacgtgcgctccggcgagggccaggtcacgtttagctgccacacccccagctgggagggcgacgtcaccgtcagcatgcccggcctctttaacgtggacaacgcctgcgccgccatcgccatgtgcgaggtgctgggcgtcccgcgcgagcagatcgtggcgggccttgcgcacgtgcgcgtgcccggccgcatggagctgctgctcacggacgaccccaaggtcacggccattgtggactacgcccacaacaagctgagctaccagcggttctttagctccatcgtgaaggagttcgccggccgcaaggtgatcgcagtgtttggcgcgcccggcggcaaggcctacgagcgccgccaggagctgccgcaggaggcctccaagtgggccgactacctcatctacacggaggaggacccggcgcacgattctgttgcggatatctgccagcagatgagcgacgccacgcccgccggacagccgcacgaggtgatcctggaccggcccgccgccatcgagcgcgcagtcgaccttgcgtttgactgcccggagggggccatcgtctgcttgctggccaagggtgacgagacccgccagcacgagggcgacaggttcgtcccgtgcgagccggacggcacgctcttctatcgcgcggccgagaagcacggcgcgcatcctcgcaactagctttatcacgcagcggcgccttgccccccagggtcgggcgccgcctttttgtgcagacagtcgcaagacaggaaggtggctcaccacatgccaggactttcgctccccacgttccccacggacccaaaccttgttcccgaggacatggccgcgcgcttctcgcgcatcaaatatgtcataaccgacacggacaacacgatggtgagccatggccaggcgctggcctccacggacggaacgccctccatcgagctggcccagacccttgttgacctgcgccgcgctggcgtgagcgtgatcccgtgcaccggccgcaaccgcgccatgatccgcgaggacgtgcgcatacttggcatgcctggctggataggcgagatgggcggcatcctgtgcctgcacgaggggcgcgagagcgactggcgctacttcacggcggacatgccgtacgaccccgcctgcggcgtgaccccgcacgacctcatcatgcagacgggcgccgtgcagcgcatgctcgagcgctggtacgactgcctggagctctataacgacaacaacattggctaccagtaccgcgaggtgacggttgccttgcgcggcgccgtgatcgaggacgaggcgcaggccatgctggacgagagcgggcttccgctctacctggcggacaacggctttgtctcgcgcatatctggccagacgatcctgccgcgcaacccggacgggacgctcgagggcgtgcacacgtaccacatcacgccgcgcgggctggacaagggaagtgcgaccaagcgctacatcgagctgctgggcgtggacccggccgaggtcatctgctgcggcgactcgcctgcggattgcaggatggcgccgcactgcggcacgtttttgctgatgcgcaacgggatcgagaaccccaagagccagtccgagctcgccaactgcggcaacgccttcgtctccgcggaggacgcgacggacggcttctgccgcgccatgcagacgatcctcgcgatcaagcgccagtcgtaggggtgggcgcacgcgggggggcacgctgcggccaagggcgcgcgttcttctcccccggtaaaggcaactgcaagacaggctcgcaacacgcgacggccgcacccgggtggatgcggccgtcgcgttgcacgtatgggaggagccggcgccgccgaaagggggaggcgacgccggcggggtgcctgtcttgcgcctagctgaggtgccagatctccttgtcgtactgctcgatggtgcggtcggacgagaagaacccggtcttgctgatgttcaccagggtcttgcgcgcccaggccttgcggtcctcgtagtccttgaggacctgcttcttggtcttgcagtagtcctcgaagtccgggaacgtcatgaaccagtccttgttgaggagctcgctctgcaggcgcgtgaggttgacctcgtcgccctgcgcgagcatctccttggacgtgaggaagtcgacggccgcggcgagctccttgtccttcttgtagtaggccttggggtcgtagtcgccgcgcttgtagcgcgcgatgacctcgtccgagctctcgccaaaggtgtagatgttccccttgcctacgaggtccgcgatctcgacgttggcgccgtccatggtgccgagcgtcacggcgccgttgagcatgaacttcatgttggacgtgccggaggcctccttggaggcgaggctgatctgctcggagatgtccgccgcgggaatcaggcgctcggcggccgtcacgttgtagttctcgatcatgacgacctgcaggtacttgctggcaacggggtcggccgcgatgaccttgctcaggcagatgattgcgtggatgatgtccttggcgatggtgtaggccggggccgccttggcgccaaagatgacggtcaccttgtgcttggggagctcgtcctcatcgtccagctggctgatacgcaggtactcgcggatgatccagagcaggttgagctgctggcgcttgtactcgtgcaggcgcttggactgcacgtcgaagatcgagtcggggtcgacggcgtcgccctggtgcttctgcagccacttggcaaaggcgcgcttgttggacgccttgacgctcacgagctgggacaggaagtcatcgtcgtccttgagcgggagcaggccctccagctcctcggccttggtcttccagccctcgccgatcttggagctgaccagcttgttgaggccggggttgcactcgaccatccagcggcggaacgtgatgccgttggtcttgttgttgaacttctggggatagatcttgtagaacggcgcgagctcggaatcctccaggatcttggtgtgcagggccgcgacgccgttgacggagtggctgaagtggatgtcgatgttggccatgtggacgttgttccacttgtcgatgatctgcacgaacggctcgtcgtacttctcggccacgtaatccgcaagctgcttgatgatgggcacgagctgcgggacgaccttctgcaggtagtcgagcggccagcactccagcgcctcggccaggatggtgtggttggtgtaggcgcaggtgtcacgcacgatctggatggcctcgtcaaaggcgatgccgcgctcgcccagcaggcggatgagctccgggatgaccatcgtggggtgcgtgtcgtttatctgcacggcggcgtagtccgcgaggtcgtgcaggttgctgccgcgctcaacgcactcgtccagcatgagctgcgcggcgttgctcaccatgaagtactcctggtagacgcgcaggatgcggccggcctcgtcggaatcgtccgggtacaggaagagcgtgaggttcttggcgacctgcgtcttgtcgaagttgatgcggttcctgatgatgcgctcgtccacggtgtccacgtcaaacaggttgagcgtgtcgcacttgctgtggtagccggtcacgtcgagctggtacatggtcgaggtgacggaaaggtcgccaaactttacggtgtagtgcttgggcgtgcggcgcatccagctctcctgaccccacctgagccagtagtccggcgactcgtactgcttgttgttgtcaaaactctgcttgaagaggccgcagtggtacgcaaggcccacgccggaggcgggcaggcccagcgttgcgcaggagtccaggaagcaagccgcaagacggccgaggccgccgttgcccagggagggctcgttctcgaactcctccatgtccgcgatgtcgcggccggactccgcgagctccgcgcggacctgctcgtacaggccgaggttgatgaggttgttgctcagcagcttgccgataaggaactcggcggaaatgtagtacaggcgcttcttgccctggttgtagcccttctcggccgcggcgtcgacggtgaggcgcagcagcgcgttgaagagctcgaggtcggtgcactcggaaatgggcttgcccgcgtaggaggcgacggtcttggttgccatgataacgtcccttcaggtcatgtctgacgttacaagcactatagttgcgtcgcagcgcccaaatctagcaccatacgcgcagccattaacactataatgacctcataacgcaaacggactgacgcgtttgtggcctgcaaccgtttgcggacgttgcggttacgccggcggaattgccgggcgtggcggcgcggccgcgggcgtgggcggcggcagacacgtgcaagaggggaccgcatgggcgagaaggacgagcgcgacgcgggcgagaagagcgagcgctttgaggactacgagcactaccgcgagcgcggcctgcacgaggtcccgggctttgcgtacaacacgtacctctgcaccatcccgcaggactttgaccacgtgcccacccactggcacgaccagatggagatcgtctacgtcaagcgcggcagcggcaccgttgcaattaactttgcgcgcaagcccgtgcacgccggctccatcgtgccgatcctgcccggagagatgcactccatcgagggcgacccggggtcgcgcatggagtacgagaacatcatcttctcgctggggatcctggacagccaggagccagacgactggtgccgcagccacgtgatagagccgctgcgccagggcaagctcgcgttcgagcggcccgtgccggaggggacggagttctacgagcgcgtgcgctgggcgctcgacggggcggacgcggcctgcgccgtgcgcgcgccgggctactccatggtggtgaagagccgcctgtttatgctgctagacgccctgtacacctttaggcagaaggacgccccgcaggcgcccgacccctccgcggagcgcgtgcgcgccgtgctgcgcgaggtgaaggagcactacgcggagccgctcagcgtggagggcgccgcggagctggcaggttacagcaaggcgcacttcatgcgcgtgttcaagcgcgacatgggccagaccttcagccagtacctgacggagtgccggctcacggcggccgcctaccaccttgagatgacggacgagcccgtgggcgccatcgcgcgttcgtgcgggttcgacaacttctcgtacttcaaccgcaggttccgccggcgctttggcatgacgccgacggagtttcgccacgggcgcggcgcgggcgagaaggacgacacgccgggcgtgccgcccaccgtcatgcccgcgacgcccgggtccggcgccggcaacgccgcgggcgccgccacgcgcgcctagcccagctgcgccatgagcgcctcggcctccgcgcgcgtggccaggtccaccttgaacgccgtggccgatcccgtgcagatgcccatgcgcagcgcccgggccaggttgccctcgccctcgatgtagccgcacaggaacccggccaccatggagtcgccggcgcccacggagttcaccacgctgccacggggcgccgccgagcggagcacctcgcccttctcgctcacgaggaccgcgccctcccccgccatggagacgagcacgttcctggcgccgcgctcctgcaggcggcgggccagcggcacggcctcgtcctgcgtgcggacctcctggccaaagatggcgcccagctcgtggttgttgggcttaatgaggaagggcccgtacggcagggcgtccagcagcaggtcgagctccgcgtccaccaccgtgcgcacgccgcggccggccacgcgcgcgagcatgcgctggtacacgtcgtgcggcaccgtcgcggggacgctgcccgccagcacgaggaagtcaccctcgcccagcccgtcaaggcgctgcagcaaggcggacaggtcatcctgccccaccgcgggaccgatgccgtttatctcgctttcctcgcgggcgtgcaccttgacgttgacgcgggtgcggccgcggtccaggcgcacaaagtcgcagtccacgccgcgatcggccagcatgcgctcgacctccgcgcccgtgaagccggccacgaagcccagcgcgcgcgagggctggcccaggttcttgagcaccacggacacgttgatgcccttgccgccgggcagcatgtcctccgtgcggacgcggttgacctcgcccagcgcgaggttgtcgaggctcaccacgtagtcgatggacgggttgagtgtcacggtgcagatcatggcgtaccccttgggttggcgggtttcttgcggctggctgccgcgccggcgcgcggtcgcgggccagccggattgtgtgcgtcaccagtatacggacggccggcgcggcgcgtcaccattggcacacatttggttcgcgcggggcggcaaactcggctaggattttgtcagattgacttgcggcgcacgcggcacgaagggagcgcacggcccgtggcatttgacccaaacgacgaggactaccagcggctcagcctgcagtttgcgcgctcgctcgacggcggcgacgctggctccgtcgtgcgcgcgtttgcgagctttggccaccgctttgcgcaggaccacgacagcctgccccagaccgacgaggaccgcgccttccacctggtggcgcaggccacgatggccatcgactaccagcttccctttacggaggacgacgagcaggccaaccgcctgatcgagcgcggccatcgcctgctggacgaggccctggcccttgaccccggctgcgccgacgccctgcgcatgaagcgcgcgtccgaggtcgcgggctttgacgcgtacttcgacttcctccacgaggtggagaaggacgtgcgcgactgctgcgaggagcgtcgcaagcgcgcgctggccacggacgagggcgagcgcgccgagctgggcgccaaccttgccatgcgcccctacctgcggtggctggccatggaggccgaaaaggccctcatctgcggccgcaaccgccagtgcctgcgcatttgcgagcgcgccctggaggtggacccgcaggacatggccgacgtgcgctttaccgcggcgctggcctacgccaagcttgaggacgccgccgggctcgaggcgcttgccgcgcgatccgccacgctgggcgtgccgcgccgccacgagggcgccgacgcctggacgctgctcgcgcgcgtctccatcgcgcacagccgccatctgccagacgaggccacgcgcctgatgcgcactatactggacacctacccgcacgccgcggccacgctcagcctgcagcacgagcttcccgacggcgtctttagccgcctggccgtgccgccctacagtgaggacgagctgatcctggcgacgtccgaggccacggtcctctttcaggagggtcgcgaccgcagcgaccgcggggcgctgggatcgtgggtcgcggacgaggcagaggaactcgaccccgccgacgtgcgcatggtccgcgcgtacgagaggggcgcgggcgcaaagcagggccacgcccgtcccggcagctcggacggggggcaggcgtgatggacggtcgcgaggagctggtgctgaggctggccgcacggcgccgcgccaagctggggctttccgacgcggcctacgcggagctgctgcttgcggtgcgcgaggaccccaacaagttcctggaggacgacgctgacgccgccttccgcgtggtggccaacgccgtggacgcggtttccaccgcgcgcgaggacgacgacctgctggacgacggtgagttctaccagacgcgcgagaagcgcctggcccgcatgcgccgcgagtgcgaccgcgcgctggcgctggaccccgactgcgtggacgccatgctcctgcgcgcgctggcggaggacctggacccggacccgctgctcgaccggctgctgcagatcgagcgcgacatcgagcccgcggacggcgccgcgccgaccggggccgctgctggtacgggcgctgccggtgcgggcgcgagcgagaccgcggacgcctggcttgacgtgctcgggcgcggtcggctgcgcctaaaggcggccatcgcgcgcacctgcctggactccgcccgctaccgcatggcgaacgagaccggccaggagctcatcgcgctcgcaccctcggacgcgctcggcgcgcgccacacctgcgcgctcgcgctcgcgcggctggaggacgagcccggcttcgacgcgctggacgccgcctttggccggcgcggggacagctgggtgcagatcggccgcgtgatcctcttctacaagctcggccgcatgggtgcggcccgccgcgcgctccgcgggttcgactcgctctgcgacggaggcgtctacgcacttctccgcccggtcatggtcgacacctatctgccggaccgcccgaccgccgcgccgtacagctttgacgaggcgacgctcgccgtgcacgaggccgaccccatcatcgtggacgtacccgacctcgtgacgtgggtgcagaaccagcccgacatgctggccgcagccaagtcgtttgcggataaatcgggacttgactggtaggcggcgcgccaggcgggcggaaggcccgcgcgtctggtatactgcagtccgcgtccccatcgtctagtggcctaggacaccgccctttcaaggcggtaacacgagttcgagtctcgttgggggcaccatcgcatgcgcgagcgcccgtcggcagctgcctggcagcaccggcgggcgctctttg

SEQ ID NO: 205 - DNA, 7230 bp, Unknown
  Metagenome-assembled genome
cgatcatgttggtcgtgacgatgacctgcttgtcgcccctcgcgatgatgtccgcgaggaaggagttcgtcctcgagatgtcgaggaagatggagtctccgctgtgaatctcgaggtaggcgcgctgtgcgaccgccatgcggccagcgtcctcggggtcgacgagtgcctccaagggggaggacacgctcttctcactcgttttgatactttgtgtgactacggaagccgggatgcttgtagcaccaccgtagacgcggatgcacttacctgctttcgcgagtgcttgcaggtcctttcgaatactgtccgaccccacgtcaaagcgttccgcaagcttatcgacctctacccttccatggaggtcgataagcttgagaatttctgtcctgcgctcttggcggaacacgtgtctttgcctcccccgcagatgctggggcatatcgttaagatgtggcgaaactagaagaatctggaagaattatcatacaaattgggtcggctcacggacatcaagtgaaggtcataaggcggcccgtacaagaattccagggcggttcccttcggacctgcaaatgatgccataaggagtaatcatggccctcacaatgaaagatatgctcaagcgtgagaatgtccagattgtcgagtcctgcggagactggaaagatgcagtacgcatcgctgttcagccgctagttgacggtgggtatgtgaagcccgagtacatcgatggcatcatcgagaatgccgataagcttggcccttattttgttctcgtgccagatttggctctcttgcatgcacgtcctgaacagggagtaatcaagaagcagctagccatcacggttctgcgccatggtgttgagtttaaaaagggcgaaccttgtcgcgtactggtcacgcttgcagcagaggattccgactctcacattgacgtcatgaaaatccttgccaatatgtttgctgatccagcaataataaaggcagccgctacagccgaaacaccggatgacattttcaagctatttattgaattcccctccaactagttgcatggcggtggaaatgctactggaggtttgatttgcaatttaggagcagattgaagcttgctctcatataagaaccgtaaatttcgatgagaacaaactatccgcaatagcaaagtgactagagtgtcgattcctgccaatttgtagtgcactccagaacctcacaggagggagatagtggattgccctcaagctgggaggctaatgcacgaaatgcaaacacaccctcctcatgcacgggctctattatcgttgtgatacttggcgttacgagggatgtccactcggtattgtcaattccaaggacgccgattcgggatggtatgaggtgcgtgcagggctttagcgcctcgaaaatccgattaagcgcccattggtgtgggcaaacaaccagtgtttttttcgatgggttgatgttgtactgaaagtagtgcgccagctcgctttggctgggcgtttcatgggttatagaaacaacgctgcttgacatatctgctgccgaggccgcatccataatgccctgcagccgctcgagtcgagttcgggcgcccgctgaatctgccgccagaatgacgcagtcttcataaccacgcgcagcacactccgtgacagagctgtaaaaggcatcgtagagattggtttttacccagctccccttcatgtcgaagggactgtaatcataaaaaaccacgggtttcccggcctttgacaagcgatcacggatagtgcgaacctggcctgtcggctggatgataaagccgtcaacgcccaaggagagcatcttctcgatacagaggttttctgatttgggatcaaacgctgtatcgcaaacaattatctggtatccgccctgattggctacagactccatccccctgaggatctctccggcccagtgattggcgatgtcgcaaatcaatacagcgacgacacctgtcgctttgtttgagagcacccgtgcttgcgcgttcgggacgtatcccgtttcttttatcgtctgcgctatttttgagcgggttgatgcactcattttgttgaaatgcccgttgagatagtacgaaactgtcgctgttgaaacgccagcgagtttcgccacataagtaatgttcacgctcttcgtcacgggcaccccccgagttttgccacctttttagaagttaggcccttggcggactgacttcacccctcattcggcatgtggtaaaaacattccgccgaaaagtggagaaaaagcttgactgtgtgtgcaatccgtgaattgcaacgaaatcaccatagttaagtagttaaccaatttggttacatttagttataaatagcgcgtcaacaggcccttcgccgaatctcgctttgaattcaagaattccagaacaataatgccattagttcaaggacagggatgccgaaagcgcgcgcggcaaaactcgtccgggaggattgttcgcgtaggaggggagtgccatgaagattgttgctgtttgcgcatgcaccgtgggcatagcgcacacgtatatggcgcagaaggccatcgaggacgagtgtgccaagcgtggcttcgagtataaggtcgagacccagggcggtatgggaatcgacaatgagctcgacgaggatgagatcgccgacgcagattacgctctgctcgccgtcgatgtgggaattgagggcgacgagaggttcgacgagaagcgcgacgagggcaagtgcctcaccgttggatcagctgacgccatctcgcatccggatgaggttatcgacaagctcatcgctctctagtttcgaaggtacagatttccgaatattgaaaggagttaagagatggctgatgctcaagcgcccgcaaagcaaaagaaaggtttcttttcgaactttggtaaggacctgttgaaggcgttcaacactggtgtctcgtacttcattcccgtcgttgttatcggcggtgttttcctcgcattctcacttgcttctggtaccgctggcaagagcggtatggtggtcaccaatcccttcatgaagaacctgaacctgattggtatggcaggaatcaacatgatgattcctgtactggccgcctacattgcttactctcttgctggtaagcctggtctggcacctggttttgttctcggctacttggtgaacaaccctgtcgcagttggaaagaccaatgtttccactggattcctgggcgccatggtcatggcagtggcagtgggctacttcgtgcggtggatgaagacttggaaggttaataatacaattcgtactattatgccaattcttatcatccctatcttctcgaccctcgttctcggccttttctatatctacgtgcttgctgcacctctgagcatcgttatgaactggctcacctcggtacttggtagcctgcagggcggatccgcaatcgtgctcggcatcgttattggcatcatgaccgccttcgatatgggtggccctgtcaacaagactgcctctaccttcaccatggctctcatgaccgccggcgtgtacggccccaatggtatgttccgcgtcgcagtcgcagttcctcccattgcttgcggcatcgcatcttttgttgcgaagaacaagtttgatgacgctgatcgtcagatgggcatctctgcaatcttcatggggtgcatcggcattaccgagggcgccatccccttcgcggttaaggactttggccacatcatcccgggcatctgcgcgggttcggcagtcggagcagcgcttgcggcggcccagggcattgagtgctatgtcccccacggcggattcatcgttgctcttgcaactaacaacattccgctctattgcctggatatcgttatcggctccatcgttgccgcggccatcattgttgcaatgaagcccaagctggattctgctaagtaatcctgacaatagtcgacccaacgtgaaactgtatcaactgtatcaatagtttgcagtgaagcggatcgccccgcgcagtcgagagtgaccgtgcggggcttattttgcagccgctcaatccgaaaaggagaaagaaatgccttacaccaagctcactattcatgacgctgtccaggggttgcttaagcttcaggacactggcgaccacgcgacgctggtcggcattggccccatgtcccccaatcttctccaggccgcttttgagctcgcgaaggaagaagattttcctctgatgttcatcgcctctcgtaaccaggtcgacaaggatgagttcggtgctggctacgtgaatggttgggatcagaagcgattcgctgcggacattaagaaggttgcggatgaagttgggtataccggtccctactatctctgccgcgaccatggcggcccgtggcagcgtgacgaggagcgcaatgcgcaccttcccgaggacgaggcgatggagcttgcccgtcggtccttcgttgcagatatggaggctggcttcgatttgctgatggtcgatccgactaaggatccctaccagattggcaaggtcattcctctggagactgtccttcgtcgcaccatcgacctcattgactatcttgagaagtatcgccgtgagcataatctgcccgaggtggcctacgaggttggtactgaggagactaatggcggactgactacgactgcaaagtacgaagagttcatctcgcagctcaagcctgaacttgagaagcgtggttgcccgatgcctaccttcatcgttggacagacgggtacgcttaccaggctgacggagcaggtcgggcactacaatttcaagaatgctcgtgagcttgctgacatggcaaagggttatggtgttggcctgaaggagcacaacgccgactacctcgacgatgtcaccctgcttgagcacattccggcgcatgttacggcttccaacgtggcgccccagtacggaaccgaggagacgcgcgcctatctgaagctctgcgatgtcgagcagctcctcgtcgataacgggctttgcgatgatccctctgacctgcgcaacacgcttctcgttaaggcaatcaagaccgagcgctggcgcaagtggatgactggcgacgacgtcaacctccaggtcgacgacatccttaaggacgagaaactctcggctgagattcttgacatttctggccactatgccttcaacgaccctgaggttaaggagcagattgcgaagctctataagaaccttgcagctcaggacatcgatggacagcgtttcgtcgtcgagcacatcaagcgtccgctccgccagtatgtcgtgggcctgaatctcaagggcgttaccacgcgcatcgagaaggccctggcggctgagtaaccatagggcgtgcgttctcgctgctgcctttagagcaaatgagcgtgcagattaggagaaggacgagacatgaagttctttatcgacacggcggacctggacgagatcaagcaggcgtcggactggggcatcctggccggcgtgaccacgaacccgtcgctctacgcgaagaccggcggcaagctggccgacttcgaggaccacatggtcaagatctgcaagatcgtgggcgaggacgtgcccgtctccgcggagtccacggccgagaccaccgaggacatgatcgccgacggcgagcgcctgagcgccctggcgcccaacatcgtggtcaagctgccgatctgcgaggcgtcgcttcccgccacgcacaagctggcctccgagggcatccgcgtcaacatgacgctcgtgttcagcgcgccgcaggcgctgctggcggcctcggccggcgcgcgctacatcagcccgttcgtgggccgcttcgacgacatcggcgacgacggcgtcgagcagctctccaaggtgatcgagtgcgttaagaactacgactacggctactgggagcaggagggcggcccggagatcatcacggcgtccgtgcgcacccccaaccacgtgacgcaggcggcgctcctgggcgcggacatcgcgaccgtgccgttcggcgcgctcaagaagtgcctgcaccacccgctgaccaccgagggcctggcgaagttcgcggccgactgggcgaaggtcaccggcgaggctaagtagaaaagtctatgtaggtggcggcctcgttggctttgtgtcggcgaggccgcctatacatctagatagaaagtgaaaggggcgatgatgagctttatcgagccaaagcaggttttcatcggcgaaactctggagagtcgtgatgctgctctccgctttatttctaagaaggcagctgagcttggatttgctgattcggaggaagaagcatacgaggcatttcttgcgcgtgaggcagaggatgctactggcatgcagtggggttttgcgattccccacgctaaggctgacgcaattcataaagcaggcgtcatcgtgctgaagatgacaaagccagttgagtggccctcattcgataatgagccagtcgatattgctatcgcacttttggtgccaggaagcgaggcgggtaccacgcatctccagctactatctaagacggcccttatgctgatggatgacgatttcagaggtttccttaggaagagtaacgatgctcaagcaattgcggatgagatgaacgctaggcttgagaagtagcgatacgcgaatcatagctaggcgctgggaggcgttatgaacgatacagaactacgagcaatcgcccgtgaggtccgcaagggcatcctcgtgggcacccacgcggcgaagtccggccaccccggcgggtcgctgtccgcgaccgagatcatgaccctgctctacttcgaggagatgaacgtcgaccccaggaacccgcgcgaccccaagcgcgacaggttcgtgctctccaagggccactgcgcgcccgcgctctacgcggtgctcgcgcagaggggcttcttcccggtgggggagctggacacgctcaggcacatcggctcgaggctgcagggccaccccaacatgagggacaccccgggcgtcgacatgtccaccggctcgctgggccagggcatctcggccgccgtgggcatggccatcgcggccaagcactggggcgacggctaccgcacctacgcgctctgcggcgacggcgagatcgaggagggcgaggtctgggaggccgccatgctggccggcaaccacgccctcgacaacctctgcgtgatcgtg

SEQ ID NO: 206 - DNA, 2140 bp, Unknown
  Metagenome-assembled genome
actgcgggtcgtaccttctcctcgtcgtcctgctcatggtccgaaagctcccttcgtgcctctcggcacattgtcgggctttcggtagctccggctcaagcgtgtctaggattggccagccacatcaaaccgtcgttgatgcagatgacctcgtagttgtcaagcgtctgccccatgagagaagctaaacacttaggaagatacttctcgaccttgtagcacgggacaataatgctgagcttaacctggtcggcagccatttgcattttgaactcctctatctgattgccacgacaataagtgggatattcctgttgaccttgcccaactcactgggtaaacagctctgcacttacgccatcaatagccgttgtgctgctactgtttctggccatctttctcagcttgcgtctcgcgccagtccatctcgtcttttgtgtgtagggcaagctcctgtgctagttgctccgtcttgtcagtcaaacgcgacacatcgcacgacaagttgaacagctttacaagcatcagcatgatgatgatgcaaaacacgaagttactaggcgagagaaaaccgagcaaccttgaaaagaagaacgcaatacccgggaaaatcgcaaacagcagcatgagcacagcgcacagcacccagtaaactgagtctgccacacgaatcttactcttgcgtacacgcttgacaacaatcgaaagcgcaaacaaagcgccgatgataagaaccacacgaagtacgggagacatccgttatcccctatctaaaccattggaacagaagcagcgacagacaagtgcgtgccatgtacgaaatggcactgaagctatgtaggtagctagttccaccctgacgctcacgcatctgcgcgggaatctcgacaaccttagcgcccttgcgaataagtagtgagatggtatctggttcaggcgagatgtcgaagtcgcgagcatacttctgaatcatggcacggttatacatccgcatacccgatgtaggatcggtgacgatctgcttcgtcgcacatttaataagcgcggtaatcaacttcgcgccagtgccacgtgcaccctgggcaccaccgccggctagattccgagacgctatgacaatgtcggcgccgctttgctgcatggcctttgccatctgcggaatgtactcgggtacatgctgcccatcggcatcgaactgcaccgcggcatcataaccgtgacgatacgcgtatttcatgccggctttcacgccggaagtcagtccgcagttcactggcatgtctatatgattcaggtgcagctcgtcacaaatctgtggcgtgcgatctctcgagccatcgtttaccaccagatagtccacgtcgggacaggtcttaacgagctcagagaccgtatcagccaggcattcctcctcgttataggcgggaatgatggcaaggactttcacgttttagctcccatcaacgggtcggcttgctgagttcaagcatataaaaccaattaatcctatttcacgcactcgacgagaacaaggacgtcgcgtcttcactataaaaaaggcgcgaagcagtccgtcgcttcgcgcccatagcgggtacattcaacagatgtcagccggcaatgcaactgtttgcgagcgtcattgtcacgcaaggatttacggtagctctgaggccaccctacaccagcctcgcccagtggcgcttgccggactgcaggacgcagccgggcgagaagagcgtgggatccacgttgtagctcttggcggggacggccttgccgtcgatcttgacgccgccaccgtcgatcaggcgacggccctcgcccgcggacttggcgatctccacgtcggccaggagcttcgcgaggtagaccttgccctcgtcgttgggctgcaccagcgagaacgggaactccttgatgtcgtccggcacctggttcttcttgaactgcgcgtcaaacgcggcctcggccttctggccctcgccctcgccgtggtacaggtccacgatattgcgggcgagctcgcgcttgagcttgtacgggtcggccgtgccgtccgcaaaggcggcgtcgatcttgtcgacctcgtccacgggcagcgtggagcacaggcggaagtagcgcggcaccatctcgt

SEQ ID NO: 207 - DNA, 5244 bp, Unknown
  Metagenome-assembled genome
ccagcgcccgcgtccgctacgaaagcagcatgcggtcgttgtcgagctcgccgcccgagacctcctcgaacttgcggagcaggtccggcacggtgagcttgctcttctcgtccccgcgcacgtcgaagatcacgtggccctcgtgcatcatgatcaggcggttgcccaggcggatggcgtcgtgcatgttgtgcgtgaccatgagcgtggtgagggagtcctgctcaaccaggcgctgcgtgagcgagaggaccttggccgcggtcttggggtcgagcgcggcggtgtgctcgtccaggagcagcagcttgggacggcgcagcaccgccatgagcagcgtgagcgcctggcgctggccgccggagagcaggccgaccttggaggtcatgcggtcctcgaggcccaggtcgagcatcttgaggcgctcgtggtagtcctcgcgctcctcgcgcgtgatgccccacgagaggccgcgcccctgcccgcggcgcgccgcgagggcgaggttctcgtctatctgcatgtcggctgccgtgccgcgcatcgggtcctggaagacgcggcccaggtcagcggcgcgcttgtgctccggcaggcgggtcacgtcgcggccgtcgatctggatggtgccgccgtcgggcgggaagacgcccgcgatgcagttgagcagcgtcgacttgccggcgccgttgccgccgatcacggtcacgaagtcgccgggctcgaggtggaggtccaccccggtgagcgcgggcttctcgttgaccgtaccgcggttgaaggtcttggtgacgttggagagcgtgagcatcagcggtcagctcccctcttgaacgcgcggcgtgcctggctgcgctccacgatgacggggatcacgagggcgagcgccacgatgacggcggagaagagcttcatgtcgttggcgtccatgcccatctggagcacgatggcgcggatgatgaagtagatgacggaacccacgacggccgaggtcaggcggctgccaaacgcctgcagcttgcccggcgtgaggcggccgagcacctcgccgatgacgatggcggccaggccgatcacgatggcgccggtgcccatgttgatgtccgcgtacttctggctctggcacaccagggcgccggaaagccccacgagcgcgttggagaggctgagcgcgatgagcttggtcacgcgcacgtcgatgcccagggcgcggcacatgtcctcgttctggccggtcgcgcgcatggcggagccgatctccgtgccaaagaaccagtagagaaggacgacgcacagcgccgcgaccgtgatcccgatgatgagcgtggctacgttgttggacacgccgagtgcgctcgccacgcgcgagaacacggtgtccacgccgaggagcggcgtgttggacttgcccatgacgcgcaggttgatggaccagagcgagatctgcgtgaggattcccgcgaggattgcggggatgtcgaacagcgtgtgcagcaggcccgtgacggcgccggcgacggctcccgcgagcgtgcccagcaggatggcgaccacggggtcgagccccatgttgaccgaggccacggccgcgacgcagccgccgagggcaaaggagccgtccacggtgaggtctgcgatgtcgagcatgcggaacgtgatgaagacgccgagcaccatgacaccccagaggatgccctgcgcgacggcgccggacagggacagaagcattaaggattcccccaaacctaggaagacttgaggaccgagaggtcgacgcccacggcctttgcggtcttctcgttcgtagcgagcgtgcactccttggcgctcaggtactcgatcggcatgtcgcccgggttcttgcccttcaggatcttgaccgccatctgcccggccttgtagcccagcttggtgtagtcgatcccgtacgtggcgaggccgccgttgtcgaccatgcccttctcgccgcagatgacgggaagcttgttctcgttcgcgaccatcgacacggtggacatgccggccgcgatggtgttgtccgtgggcgcgtagcaggcgtcgaccttgccgaccatggactccacgacctgctggatctcgttggagctggacacggagtagcgcacggccttgagcccgcgcttcttggcggccttgagggccagcttgacctgcacgtccgagttggactccgccgtgcagtacagcacgcccaccgtcttggcgttggggagcagcttgaccaggaggccaaactggtcgtccacgggggtgaggtcggaggtgccggtcacgtttcctccgggcttcttgttgctcttgaccaggccggacgccgcgaagtccgtgatggccgtgcccacgacggggatgtccgacgtggcgcccgcgaccgcctgggcggccggcgtggcgatggccaggatcaggtcgtcgccgtcgttcacgagcttggtcgcgatggtctgacaggcagactggtcgttctgggcgttctgctggtcgatcttgtacttgaggccggacttcttgagcgcgctcacgaagcccttgttggcggcgtcgagcgcgtcgtgctcggtgagctgcagcacgccgatcttgtaggtcttgtccgagctgccggagctgccgcatccggcgagggtaaaggcggtcatgcctccaaacagcgcgatggcatcgcgacgggtcatgcacttggtcatgttgacagcctccttagggttggggccgcggggtcgcggcacgggtgtggtgtcagccaatcctaaggttgcctaggcgcgcgcgggccgccttgccgcaatcgattacatgttcgtaactgccttggcgcgagtggcagatgtggggtgggggctatgctcccagctcttcctccacgtatgccctgaaaccaggcagggcaaagcgcacgacgccgcgggccacctggtctatcacgccccctgcgagcagcctaccgcgatacttcgaggcataccggctctcgactcccatgcgttgcgcgatgtccgcaatgcggctctccttggtgtcctctagcattgcctcaataaagcgcaggtcaacgtcggatagctccctataggtaggtgcgaggatgtgcgaacgaaagtcctcctgcgcgtcggcggcaccctgccttgcctctgccgccgagatggtcccactcagctcggatgcctgccagcatctgaagcccacgagctgaagcatgtagggatagccaccaatcgctcgcgtgcagctatcgagcgcatcgtcggtcacgtccctgccgccgattgccaccgtctccttgaaggcattccgcacgtcggcatcgggtatgatgccgagcttgtgctgctgggccctgcgcaggaaggacacgctcttgtcgttgagcagcgcgctgatgttgtgggggaggcccgccatcacgagggcgacccggcgctgctcccgcacgaagagctgatagacggccgctagattgaccatttcgtcgagtgacggcacgacctcgtccacggtgatgagaagtcccaagttcgcgtcctccaaggtctggaggagtctccccatccgcgtgcgccagttttccgccgccgtgggggacgtggaccagctggcgcttatcggtcctacgcccaaccccgtgagctggggaagcgtggcttcacgcttgcccagcaccttctggcatgcaagacgggtctgctcgtaaatgtcctcgagcattcccggcattgccaccacgtgtacggcgacccagccgtcctctgccgcctctttggcaaggtaggtgagaagcgcggtctttccggacccacggggaccgatcaggatgctggacaggtttggattgccgcgaccctgcgcaaatgcctcgaagagctccctcttgatggactcacgtccagccataacgagcggaacgctgccaaattcgggtgtgaacgggttgatgggaggcatcgccatggctcctttcgccttgttcgcctactttcgccttgttcgcctattttcgcctttttcgccttcacaggcaagagcaggtagatggcctgttcaagcgagctgtacttcctcgcagtcccaatgggtaaggtacaagcatgcggtttcgcaatgtgacgcacccgtgaatcccaaacaaatctaaccctcttagataatctcccgagcacatggggtaggctcttctccgttagctaagggtcttagcaaaggagaaggacgtggaggacgagaagaacgctcctaccgcctgcgacggcaccgtgggcgcaccggccgcggacggggactgcccgtacatgggcgcttccgctggcgacggtgcgtacgtggaacttgcgcacgggctcctgtcggaaagccgccggctgcggatcagcctgggcgccgccgcgcgccgctgggacggtcgcggccgtttggacgcgctgcacgtgctgcaccatgcggagggcgagctcacggccggggagctcgcgcgcaggtgccgcgtctcgacggcgcgcatggcgcagacgctcaaccagctcgagggcgagggtctggtcgagcgcacgcagtccgcgagtgaccgccggcgcacgatcgtgcgcatcacggacgcgggggaggccaagctgcagacgtactttaccggcgtgaaccgcttcttcgcgcggctgctgggcaagctgggtccggaggattcccgcgagctcgtgcgtatcatcgggcgcctggcggacgtcgcgcgcgacgccacggacgagggaggcgatgccgagtgaggctcgtgaggttgctgcgcggtcacgtgcgcgaggtggcggcggtgcttgcgctgctcctggtgcagtcgctgtgcgagctgtcgctgccgcgctacatgtccgccatcgtgaacgtgggcgtcgtgggctccaaggccggaaacatgtcctacctgggccacatggcccttgtgatgttcggcttctgcgtgggctcgctcgtggcgggcgcgctctcgggcctcgtcgcgtcgcgcgtcgcggccgcggtgtcgcgcgacctcaggcacgacgtcttcaagaaggtcatgtccttctcgcccgcggaggtcacgcgcttctcgcagtcgtcgctcatcacgcgctgcaccaacgacgtgcagcagatccagaacatgatcgtcatcatgctgcgcatggtcgtgttcgcgccgatcatgggcgtcgtcgccgtggtgcaggtgctcaccatgggcggcggcct

SEQ ID NO: 208 - DNA, 14839 bp, Unknown
  Metagenome-assembled genome
gtgcgccgcgcgctctggttgctgaatctttccttgcgtcacgtcggtatgatacagcttgcggccgccgtcccctccgcgaacccgcaacgccacgagttcgcacacaggacgacggccgcaccgccaggccaccacggcccggcacctacgtcagctttttgcgccagcctacttgctggccttcttgtactcgtccatgaacgagccaaacatgctgcccatcttgcccagctcgcggccgacggcccgtgcggcctcctccgacccgctcttgggagccgccttcctcttggtctgggcggggcgagaaggactcttcgccgcgggcttgggcgccgccttggcagcaggctttgccttggctgcggcagacgcggtgccctttgcctgagaggccggcacgtacgtcttgggctcgggcttggtggccccgtccttctcgcccgcgatgcgcgcgggctcctggggagcgctcacctgcacgtcaggcgcctcccttgcgggaagctgctcctgctgctcctgctcagattcggcctcgttctctgcctgggcctccttgatggctcgcttggccttgcccagcgccttgcccagcgcaaacgagcccttgtcgatggcctccgatgcgacggcgccggccttctcgcccgccttcttgccggcaatcttggccttggcgcagccctcgcccgccgcggcagccgcaccgccgctgagcttgaggtttgccgccgcggggtccacgatcatgtagcccttgctgtagccgcgcaccatgctcgtggggatctcgagcgagcccaccagggattgcgccacgctgccgtcgcccacgcagaacttctgcaccgcgccggtcttggggtcgaacacggcgttgttgacgtagcccagctcgcgaccgttgctcgtcttggcgtccatgcccgtccacatgatgcaggcgtcccagtcgatcccaaggcgctcgcgcgcgcggtcgtccacgccgtccttctcgtccgtaagcagaaggcccttctccacggtgccaaacgcgtcgcgcgccatgaagaagtccggtctctttaccatgcctgcgatgtccgggcgcttgacggtaaagcccacgaccgtcgcgccgtcgggcgagaagaccgccatgtgcaccttgccaagctttgccagcttctcctcgcccttgcgtgtctgctttttcttgaagaccttcagtcccacgatgtcgccaacgcgcagcatccaaccattcccctcaggcgggcggcggccaacgcctgcccgcatcatcaaaacggacgcgaccgtgcgtcagcacggaccgcgtccgaaagcgtaagactcagttcattcgtggcgctactcggcgtcgtcgttgacgacctcgacgtgcacgccctcggccttggactcgccggccggcgagacgaccttgtccgtcgcggagttcacgacgtcctgtacctgcgcggacgtggtggtcaccgcgtcagacagggagtcgcgaagctggtccatgcgctcgcgggccaggtcgaccttggcgcggagctcgtccgccgtcacgtccatgccgggatggacgttgccgatcttctcgctcaccacgcgcgaaccgcgctcgtaggagtcaacggcggtgtcccaggcgtcgttcatggcgtcggccgccatggccctgctctccgcgccggaacgcggcgccagcagaacgcccgccacggcgccgatcgccgcaccaacgatgccgcctgcaatgaatccaaatgcgccctttgcgctcatgtcgtcctcctttgtaacctggcacgcgccagtcgtacttgccagcctcttgcgtttgccttccgcacacgtggtgaccactggacgccgcctgcgcaggtttagtctatcgtaccctttggggctctggaatatgcccgtcgctctgcgagctgccgtcgtcatcggtctgcggcgcatcgggctccgacttgccgtcgtcctcctgggcgagaggaacatccgcctcgcttggcgcgtcctcccaaggcgccacgtactccggctgggccgcctgagcgggctgggcgtccgccgtgggctccggcttcgcctgggcctccggttccggctcgggcaccggcgccggctcgctctcggccgccgcaggctccggcgaagcaacgggctcgggctcgcttgcggcctcggccgcgggcgcgtccttctcgccctgctcggcctctgccggtgcgggctgggcttccgccgccgcagccgcgggtgccgccttgggcgcgggctcctccggacgccactcctcaacggccgcgtcgggcaggtcgcgcgacgcctggacggcctcgggggactccttgccctcatccggcatcatgaccgtggtgcggcgctcggcctcgcgggcgacctcctcaaacaggcggtcctcctcggccttgcgcttggctgcctcctgggcgaggcgctccgcctcgatgcgggccgtctcctccttggcgcgtgcctcggcctccgcgcgctggcgctcctcctcggcacgacggcgctcttcctcctcgcggcggcgctgctcctcctggcgctggcgctcgagctcctccgcgcgggcgcgggcggtctcctcggccttgcggcgtgcctcgtcgatctcctgctcgcgcgcggcgatctcgcgctcgcgggcctccagggcctcctggtactcgcgcttcacgtcctcctgcagctcgccgcggaccttctgcacgtagtccgtcgcgggctcgtcgcccagcgaggccaccaggttcttgaggccagacacgatggcgtcaatgtcgggcacggggtccccgccgccgctgtaggcccagtccaggatccacgcggcgctcgagagcgcggcaacggtcagcacgtcgtccttgcaggatatctccacgtcaaaggcgcggtcgtcgccctccagcgggtaggtgcggccggaggtgatgtcgccggccatgtcggtctgggccagcagctccacggtcacgtgctccagcaggtgcgccagctccgtattgcccatgcacgccttgaaggtgtcgcccgcgtcgcccaggcaggtatgctcgattatgtgcggcatcaggcggtacacgcgcgtggtgccctgcaggtcctcgctcgtcatgagcggggcgtcgtctgccacgcgcacgcgtgcggtaaggttctgcggcccaatctctacgcgctggatgtctatgagctgtgccatgcgaaaagcccctccgcctcagtcactcgtgtgcgcctccattgtagcgataccagatggagcgccttgcctaggactcgccctcggtcgcgtcgtccgcgtccttctccttggaccttgcatcgcccttgtccttggggcggacccggtccttgatgcggtccatcggcttgtcgccgggcttgtccttgggcttgtccctctcgtcctgctgggcgtcgtcgtccgccgcgggcgcctccggcgcgggaggctccggcgccgtcacgcgcagcatggacagcctgcgtccgcgcatggactgcacgcggaaggtgtagccgtccttctggaacacgtcgccggggcgcggcagcttgtccgcaagctccagcacaaagccggcgatcgtctcgtactcgtcgttgtcctcgatcggccagccaagctcgatggcgtcgtcgatggagaaccggccgtccacgagccactccctgtcggacagctgcgtcaggtacttgttgtcggggtcgaactcgtcctcgatctcgcccacgacctcctccacgatgtcctcgatcgtgatgatgccggccgtgccgccgtactcgtccaccacgatgaccatctggtcgtgcgagctctgcatctcggagaggagcgggatgatgtccttggtgtccggcacgtagtccgcctcgcgcatgtgccgcgacacgggctcgtccttcttgccgttaaggatcgggccgatgatgtccttgatgtgcgcgatacccaccacgcggtcgacggagcggtggtagatgggcaggcgcgagtagccggtccggcgcatgacctccagcgtgtcgcccagggtcgccgtgtccggcatgagcgtcatgtccacgcgcggcaccatgacctcgcgggcgatggcgtcgcccagatcgatcacgtcgtggatcatggacttctcctggtcggacagctcgtcggagtccgtcaccatgtagcggatctcgtcctcggagacgtcctgacggtcgtccgcgctcttgatgtgcagcaggtgcgcaaggccgttcgcgctcgcgctcgtgagccacaccagcggcttcgcgacggtcgcaaacccgtggatgggcccggccacgctcttggagaccttctcggcgtccgccatcgcgatccgcttgggcacgagctcgcccaccacgatggagaagtacgagacgatcagcgtgatgagcacggtggccagcgcctccgcactgccggcgtgcatgccaaagcccacgagccacgtggcgagcgggccggacaggctggtcgcggcaaacgcggacgagaagaacccgacgagcgtgatcgcgacctggatcgcggcgaggaagcccgtggggtcgtcgatgaccttcgcggccttggccgcccgcgcgtcaccatcctcggcctcgtggtcgagcagcaccttcttcgcagtggaaagggccatctcggacatcgagaagtatccgttgaccaacgtgagcaatacggtgacggtaatcgatagtgctatgtccatgcgcgttagcgcaacctcctagccagacgctttgcgccgaccatgcgagccggcacaccgcagacgacgtgtcgcgtatgcacaattctacccgagcggggcacgtccatgcgacatcgtggcggcccaagcctccatattggtcggcatttgcggcgaaagcccacaacggagcgtccccacgggtcactccaaggcactcccaggcgcctcgtgcatccctgggcgagaagaacgccgccgcacgggcaagcccccacgcgcttgtggcacgcgggggctcgcggggagctcgctcttctcgcccgtaggctcttctcgcccgtaggcccttgcccgtggggcgggacccgtgcgggacctacttcacgaggtcgatcacctgctggcgcacgccctcgaggtaggcgtcgtcgggcagccagttgcgggcgatggtgcccagcggcaggtcgaagccgatgccctcgagctcggccgcgatgttcttggggcccagcggcgcccagccgtagctgccaaacgggatgcccacgcggccctcgttcttgggcgaaaggcccttcatgtacgtgacgaactccgccacggtcggcagcatctggctgttgagcgtgggcgagccaacggccacgtacttggcgtccaggaacaccgtcatggcgtcggacacgtggttgtccttcaggtccatcagcgtcgcgggcacgccggccgccatgaagccgtcggtgatggcgtgcgcgatcttgtccgtggagccccacatggagtcgtacaccacaagagccttgtcctccagcttgccggaggtgaagacgttctcgtacgcgtccaggatgtctgccacgtggctgcgccagcacacgccgtgggccggcgcgatgatgtcgatcgcgtccgggccgagcttgcggacggccttcacggcgttggccgcctgcatgcggtacggctgcacgatgttggcgtagtacttgcgcgcctggcgcatgacctcgggcaggtccacctcgtcgtcaaagcggcccgtgctcgcgtagtgctggccaaaggcgtcgttggagaacaggatcttgtcgtaggcgtcgtacgtgaccatgttgtccggccagtgcaccatcggcgtctgcacaaacgtgagcgtgcgcttgccgatgttgagcgtgtcgccggtcttgacgcccttgtagcccaggtcgtggtagtgggcggtcagctccttgacgccctgcggcgcggaggcgtagatctccacgttgggcgccaggcccttgatcgtggggacgttgccggagtggtccatctcgacgtggttgcacaccaggacgtcgatcttggacgggtcgatcacgctggacaggcgggacaggaactcgtccttgaacgtgacctttgccgtgtcgatgagcgtgaccttctcgtccaggatcaggtaggcgttgtaggtgatgccgtcctcggtcctgtagccgtggaagctgcgcgcgttccaatccagcgcaccgacccaatagacgtcgggcttgatctgtactgccgtgagcatgtctgcccctctcgtccgacgcatcgcgtggccgcaccgtcggccgcatgcgcgacgcgttgcctttgtgctttcccccaagatgatacgtcaggcgcgagcgggcgagaagaactagagcagctggatgccagccccctcgcaggcggcgcgcgtctgctcgtcccagatcgaggcctggacctcgcccacgtgcgcctttgcgagcagcagcatgcagaggcggctctggccgatgccgccgccgatggtgtacggcagctcgccgtcgagcagcatcctgtggaacggcagctcgcggcggtcgtcgcaaccggcgagcctcagctggcggtcaagcgactccgggctcacgcggatgcccatcgagctcgcctcgagcgcgcagcccagggtctcgtcccaaaagagcaggtcgccgttgagctcccagtcgtcgtagtcgggcgcgcggccgtcgtgcggcttgccggagcgcagcttcccgccgatgccgcggatgaacgtggtgtgatggtcgcgcacaaagcgctgctcgcgctccttgggctcgaggtcggggtacaggtcctccagctcctgcgcgcccacgaaggtcacgtcgcgctccagctccacgtcgagctgcgggtaggcccacttgacctcgtccagcgtgccgcagatggccgtcacgatgcggcgcaccacggactccaggtactcgggggtgcggtcctccaggcggatgatcttctcccagtcccactggtccacgtagatggagtgcaggttgtccagctcctcgtcgcggcggatggcgttcatgtcgcacacgatgcccttgcccaccttgaagtcgtagcgcttgagcgccaggcgcttccactttgccagggactggaccacctccgcgtccttcccgatggcaggcacgtcaaagcccacggggcgctccacgccgttgaggttgtcgttgatgccggtggacgggtccaccacgagcggcgccgtcacgcgcaccaggtgcagcgccgcgcagagctttgccagaaacgtgtgcttgatggtctctatcgcgcgctgcgtgtcataggtgtcgagctgcgactggtagccatcgggaacaatggtcatgcggtcctcctccataaggtatggaagcgaatcttacccccgcgggcggggcgcccggcccctcgcccacccctcgttaagccacttgcaacctttgggccaaaaggccccgcgggcgagaagaaccgtccttctcgcccgcggggatagcgggaatgtgactggcctgccgctgtggcgcgggtagcccgtggtgcgacgctacttctggccggaggcgcgacgctcctggtactcctccgccagcttctgctgcacgtcgtgcgggacctgctcgtagcccttgacctcgagctcgaactcgcccgtgccgcggctcaggctgcgcaggcgcgtggcgtagtccgtcacctcggcgtacggcaccgtcgcgtcgatcgtggtgaagccgctctcggccgcgccggacgcggcctccatgccctcgacgcggccgcgcgaggcggacacatcacccatgatggagccggcgtagctgtccggcaccgtgaccttgaggtgcgccatgggttcgagcagcacgggctcggcctgcgccacggccttctggaagccgatgcgcgcggcggtcttgaaggccatctcgttggagtccacggggtggtacgagccgtcgtacacggcgaccttcacgtcgatcatggggtagccggccaacacgccctcgcgcatggtctcctgcacgcccttgtcgattgcggggatgaagttcttgggcacgtggccgcccacgacctcgtccacaaactcgtagccgttgccggggttgggctccacgcgcagccagcagtctccgtactggccggcgccgccggtctgcttcttgtggcgaccctgcgcgcttgcgacacggcggatggtctcgcggtacgggatggcgagcttgacggtgtgggccgaaacgcccgcgcgcgcctcgaggcggtcaagcagcacggacacctgcgcttctccaatggcggagatgacggtctggcccgtgtcctcgtcgcggctcacactgatggtcgggtcggcgtccgcggccttctccaggaacgcgtagaccttgccctcgctcccgcgcttgtccggctcgatggcggcgcggtagagcgagttggggaagcgaaactccgccgcctcgaccttgccggtgacggagagcgtgtcgccggtcatggcatccagcttgggcaccacgcacaggtcgccggaggccacggacttcacgtcctccatgtcgtgcccgcacatgcggtacaggtggcccaggcgctctgccttgcgcgtgcgcgcgttcacgagctccgtgcccggcgtgaccgtgcccgcgagcaccttgatgaaggacagcttgccgttctgcgggtcctgcagcgtcttgaagacaaaggcgacgggcctgtcgtcatcgggcgagatgtcgagctcctcgccgttgaccagcggcacgcggccgtagtccgccatggtcgggaaccactccgccacgtcgctcatgagggatatgacgccctcctcgcgcacgcacgagcccgcgaacacggggacgatcacgcggttggcgatggccttgcccagcaggccctcgagctcctcctgggtgatctcgccgccgtcaaggtacttcatcatcaggtcgtcatccgcctcgacggcgagctccaccagctgcgagcgcgcctgctgcgtggcgtccgcgaactccgcggggatgtcctgggcgacgggctttccgttctccaggtggcgggcctgcatgtgcaccacgtcgatgatgccgccaaacgcgtcgccggagcccatgggcatcgtgaccggcaccaggcggttgccgtagcgctcctgcgcggtgaggagtgccgtgtcccagtcggcgtcgggccggtcaagacggttgatgaagagggcgcgggcgatgtccaggtcctcggccgcataccacaggcgggtcgtgatggtcccggggccggcggctgcgtcgatcacgaagacggccgtctcggcggcggaaagcgcgccataggcgtcgcccacaaagtcggggtagcacggtgcgtcgaggacgttgatgcgcgttccctcccactcaaccggggctatcgtggtagagatggaaaatccgcgctcgctctcctcgtcgtcgtagtccagcgtgggcttggtgccggcgtgcccaccaagacgggtcgtcttgcccgtcaggtgcagcatggcctcggccagcatggtcttgcccacgccgccttggcccacgagtgcgaggttcttcactttcccagtgctagtagccatggttcctcctcgagccgcatcctgcggcgaccccgccacgctcgcgacggcagtcaccgcgctatgtagagccacgcataaaagcgtcgtggactcaccatacccgtacgcgctcgggccaagcctcatgcatcgggcaaacgcaagcgccgtacggtggacgtgtgcgcgggcacgaaaggccgtggttcggggagaaggacgcgggcacgcggtggcgacaggccgccaggagcgcccgtagccggcgtgtctaccaggtgtagccgccgtacgactcgaacagccgcttgaaggccgggagcgacgtctcgatgcactcgtcgctcacgcagtagctcaggcggaagtagctgcggcacgcgaagtcacgcgagcccaccacgtacaggcgctgctcgttggccgcgcgcgcctggaaggcgtcgtcgtcgggctcaagcgcgcggacccacaggtagaacgcgccctcgggatgcaccacgtcgtacccgatgtcctccaggccgcccagcagcttcttgcgcttgcggtcgtactcttccaccggggccggaaggtccacgcacttctctatcacgcggttgaagaggctgttcataacggtggcggtcacgcgctgcgcacccaggatcgcgtcgtacacgcgctcggcatggcgcacggtgcccggcacccatacgtagcccacgcgctcgcccgcgagcgagagcgacttggaccagctgtagcacacgatcgtgttctcgtagtactccgcgatccaggggttcacggcgccgtcgtacacgatctcgcggtacggctcgtcggaaagcaggtagatggtctgccccagctccttgcacttgcgtcgcagcagagcggccagcgcgatgattgagtcgcgggtgtacacggcgcccgtggggttgttgggcgtgttgatgatgatcatgcgcgtcttggggttgatggcctcctcgatcgcgtccaggtcaagctggaaggttcccggctccgtaggaacctcgaccacgttgcagtggtacgcctgcacccacatgcggtactccgcgtagtacggcgtggggatgatgacctcctcgcccgcggtcgtggttgcggcgatggtcgagctgatggcgcccgcgcagcccgcggtcatggcaatctcgccggcgcgggcgtgcgcgtcgaacctgcgattgaggttcgcggccacggcctggcgcgtggtcaggtagccgttgttgggcgggtagccgtgcaggtcgatggaggcatagtcctccagcgccgcgcggatggcgtcgttcacctcgggcctcacgggcacgttggggttgccgatcgagtagtcccagaagtcggtcacgccctgctgcttgagctccatcgtctgctcaaacacctcgcgaatggccgatttgccagccccaagatcatacatgagggaatcgacgccgtctgccatgcctgttcctccgccccgtgtcccatttctacaaccacgactagcttcgggtacggatgtttcgcctttgattcaagcccccacgcgcgaggttaaatctgcccatcgggatggttaccgccaggcgtgcggcaggggtcgcgcggacgagaagggcctggcaccccagctggggcaccaggccttgaatgcacgttcttctcgcccgagggcgtgtgtgctagtcgacgatcgcctcgttctgggcgtcctcctcggcgatgaccttggccttgaccgagatcttctcctgggacatggcgtcctcgtagtgcttcttgccgtcggggtacatgttgagccacagctccttggccttgggcgcccagtcctcggcgtactgcttggtgcgcgcgcagacgtcggccgcgggctccggcttcacgtactcggtgcacttggcgttggcctcgtccacgaacttggtgagcatgccggagttctcgagcatggggcagggctccagcaggttgtcgttccaggggtagtacttgcggtacgtctggaagatcggctggtgcaggcagtcgagccagttgccgttctccttgaagttgacgttggagtagtggatgaagacgcacggctcgacgtcgccacgggcgttgacgtggcagtacacgcggccgccggcgatgcagccgcccacgaactcgccgtcgttctggaagtccatcgcgaagatggggtagccctcgtcgccgatggagcggacccagcggatgcggttgaacatgtactcgcgctgcttgaccgtgggcatgaggtcggcgttggcgccctcgcccaccggcatgtagtggaagtaccaggcgtagcggcagcccttgtcgatcaggagcttgaagaactcgtcggagctcacgcgctcggtgttggcgcgcgtgtagcaggtggaggtgccgtacagcaggccgtgcttgtgcatgaggtcgaaggcgtccatgacctcctggaacgagccctcgccacggcggccgtcgttgacgctgggctcataggactcgagcgacacgctgaagacgatgttgccgagctcctggaccttctggcagaacggctcgtccacgagcgacgcgttggtgaagatgttgaagaggctggtgttgtgcttctcagccagcttgaggacgtcggccttgcggaccagcggctcgccgccggtgagcatgaacatgtgggtgcccaggtcctcggcctggctcacgaggctgtccatctcctcgtaggtgaggttgaggcggttgccgtagtcggccgcccagcagcccacgcagtgcttgttgcacgcggaggtcgggtcgaagaggatgatccagggcacgttgcactggtacttgtccgcgttggcggtggtgttgcgcaggccgcggaacgcagcctcgtagccgccgttgaggatgaccgtcttgagcacgtgggggtcggtctcgtcgatcacattgaagaggaacttctcccacttggagccgttgcgcaggcccttcctcaggccgcggacggcgccgggcgaggtgtccttaaggagcttgccggccatgtcgatcaggtggtcgatgttcttctcgcggtcgtcaccagaggcgctggcaatgatcttgtcaagcaccacgctgaacgccttgcgctctgcggcgtgggcgatcttggactgcattacgcacttcctctctccctgggggtccggggatggctccccgttttttcgactcccattcaaaaactcagcctagcttactactacccaaaacgtcgcgcaacgcacacgagcgctcatttgtgactaagttagtaccgtctttttgggcaccagaacaacgtgggcgagaagaacgcgggcccatcgttgcagcgggaccttgagccccagcctggcgcggctgcgcggcacggtccgacgcggcgcggcccggcgtgcaggttcccggcagaagccagcgaggggaaccgccggagcggctcccctcgccctgtcatgcctactcgtcagccttcaggccgttgcgaccttaggcctcgtcgttgtggcgcttgcgcgcgacagcgatcgcgattgcccccgcgccgggcgtgccgagcgcaatcggcagcgcggcgtcgttggtgtcgcccgtcagggggactccggagctcgacttggcgcccttggcagagcgcgtggtagcggcgccggacgtgccggacgcgcctgaggtgtcggagcctgccgaggtggacccgttcttctcgcccgtgcccgtatcacccgtggtggcggaggcgtcggccttcttgacggtgagcgtgccgagcttgtaggtcacctggtagttggcctcgcgggccgtgccgtcccacttgacggtcgcggtgttctgcgagctgccgacctcggtctgcgtgcccgtgacggagaggcttgccgtctcgccgttcacgaggccggagatgctgcccttggccgtgagcgtcttgccgttgtaggcgcgcgtcgcggactcggtcttgaccgtgagcgccgccttgttgatctggtacgtgaggtcgaccgtgccggtgtagttgccgataccggtcaccctgaccgtgacagtgcccgcgttggtgaggtcaccgctgtaggtgagcttgtagtcggtgcccttgacgaggtccttgcccagcttagcgtccttgacggtcacgtcctgcttcttctgctccttacccgtgtaggtcgcatccttgagggagctgaaggcaaagcgcttgtcgccgttgggcttgctggcgtccaggagggcgtccttgctgagcgtgattgcgttgaccgtgactgttgccgtggactcgacggatttgccgttcacgtcagtcgcggtcaccttgtactggtaggttccggccgtgtccgtagagggggtgagggtcgcgccggtggaggcgctggccgcggcaggccttgcgccagccttggcggagcttgcggaggtggcgtccttccaggtcttgccgccgtccgtggagacctgccacttgtacgtcacgttgccatcggcgttcgcgacgtcgaccgtaagggcatcggccttatcgcccacctcataggtggcatccttaagctgcttggagatgctcatggggaagtcaaccgtgaactgcatcgaggtcgagccggcatccgtggaggcaacggtgatgcccgtgtccgtcttggcggaggggtcgtcggagccgttgtagagcgagagcttgctcgcaccgtaggccgcgttctccgtcgcgttgaggaacggcgcgtacaggttgggcgtgccggcggtcttctcgaagtagttctccatgatgccgggacggcgcgtcttcacgttcacggtgttggcaacgctcgagtcgacgcccggcatgcccgggtagccgcacttggtggcaacgccgttgtcgatgtgccacaccacgatgccgccggtcgggttcttgatggtgccgtcgccgttcatgtacatgggctccatgcccgcgtcgaacgactcgtactggcggttctcgatcaggtagtactcggtgtcgctcaccttgatgatgtagctcttgtagcctgcggagtccgtctcggaggtcgcggtgtaggtgccgtccttcgtgatctcctcgggcgtgatg

SEQ ID NO: 209 - DNA, 6369 bp, Unknown
  Metagenome-assembled genome
ttcctcgtgcaggcacccgtgttcgccgtgtgcgacggcatgggcggccacgcagccggcgaggtcgcaagctccatcgcggtccagaccattgcggagaacgcgccgctccatgcggacgacgtgctccttggtgcggccgtcgaggcggcaaacaccaaggtgatcgagggtgcccgcaccggcaagggcaagcccggcatgggctgcaccgcctcgtgcgtgcttatagagaacaacaaggtcgccatcgcccacgtgggcgactcgcgcatctatctcctccacgccggcgcgctcgtgcggctcacgcacgaccactcctacgtcgaggagcttgtggacgcgggcgagatcaccgcggacgaggccagggtgcacccctcccgctcgatcatcacgcgtgcgctcggcaacgacccggacatgtacgccgaccacttcacgctcgaggtgacggccggcgaccgcatcatcgtgtgctcggacggcctctcctccatggtggaggattccgagatcgaggacatcgccgtgtcgagcgtcgacccgcagaccgcggccgacaacctcgtctcggcggcgctcgaggcgggcggccacgacaacgtgaccgtcgtcgttgtcgacgtgctggatgacggctcccaggaggtgcgacgcgcataccgccgccgttggatcaggggcagcatcatcgcggtcgtcgtccttctcgccatcgtggcggcagccgtcgggctctacgtcagcaactcctggtacctgggagacaacaacggcaccgtgggcatctactccggcgtgccgttcgagttcctcggcataaagatgagccacctggtcgacacctcctccgtgcagacggaggacctgccggcggcggtgcagcagagcctcaaggacggcctccccgtcgactcggagcagaccgcccagagcacggtcgagagctaccgggaccagatagacacggacaagaccgacgccgccatcgcggcagaccgctcgaaggccaactcggactcgagctcgagcgactcctccggatcggacgactcttccagcacatcgaggtgacacagttgcagaaggcaatcaacacgcgcaggaacacggagctcggactcctcattgccgcagccgtccccgtcatcctcctgtatgccatgtacgtcgtgaacatgaaggtcacgctgtcggtctcgtcgctcgcggtgcccatcgggctcttcgcggcgttcgccgtcgcgcacatcgccgtgaggcgcttcgcgccggaggcggacccggccatactccccatcgtcttcctgctttctggcatcggtatcgcgttcgtgacgcggctcgcaccaaagcttgccgtaagccaggtgacctggctcttcctctccgtcgcggccatgatcctggtactcgccctcgtacccagcatcgaggcgctctcgcagtacaagttcaccatgggcatcatcggcgtggcgctgttgctgctccccatgctcatcggcagctcccgcggcggctccaagctctggatcatcatcggcccgctctcgttccagccgggcgagctcgccaagatcctcatcgtcctgtttctggccgcctacctggccgagaaccgcgagatgctctcggcctcggccatccacgtggggcccttctccctgccgcgcctgcgcatgctcgcgccgatgctcctcatgtggggcatgtcgctcctcgtcgtcatcttcgagcgcgacctcggcagcgcccttctcttcttcacgttcttcgtgatcatgctctacgtctgcacgggccgcgtcagctacgtgctgatctccgccgtgctgctcgccatcggcggcgtcttctgctaccacttcttcggccacgtccgtacgcgcgtccagatctggctcaacccgttctccgacccgtccggcaagggcctgcaaatcgtgcagtcgctctactcgctcgccgacggcggcctcgtgggctccggcatcggcaagggccttcccacgctcatccccgtcgtcgagtccgacttcatcttctcggccatcggagaagagatgggcctcctcggtgcgtccgcggtgctcatcggctacctcctgctcgccgtcaggggcctcgccacggccgcgcgcgccaagtccgacgtgtccgcgttcaccgcggtcggcctcaccgccgcaatcacggtccaggcgtttctcatcgtgggcggcgtaaccaagctcctgccgctcacgggcgtgaccctgcccttcatgagccagggcggcagctccctgctcgcgagcttcatcatcgtgggactcctcctcaaggcaggagacgagggcaccggccgcgaggcccagatcgagctgggcgccgcgcgcaacgtctctaagtctccggtcgagaagggcctgacgtccgtggtgcacggcgcccatgcccgcgccagcatcggcctcgacacgcctgagtccggcgttctcggccgcgtcgcgctcggcaacaggctcgtctcgctcgtgacggtcttcggcctcatgttcacgctgctcgtcgcgaacctcacgtacgtccaggtgttcaaggcggactactaccagtcgctccccaacaacaaccacaccatcgccaagtcctcacaggtacagcgtggcgcgatcatcacgtccgacggcgttacgctcgcggagtccaccaagcagtccgatggctcctacaagcgcacctacccacagggcaacatggccacgcacacggtgggctacctctccacccagtacggcgcctcgggcatcgaggcgaccatgaacgagaccctgaccggccactccgactactccacctggtcgagcgccatcaacgcgctcgccggaatcgagacgccgggctcgtccgtggtgctcacgctcaattcgcagatgcagcgcgcggcggaatccgcgctcaacggcaagcgcggcgccatcgtcgtgctcaacccgtccaccggcgcggtgctcgccaaggcgtcgaacccctcgttcgactacaacaacatctcctcggccatgagtaccaacgacgcgggcctcgtggaccgcacgactcagacgctctacacgccgggctccacgttcaagaccgtcagcctggccgccgcgctggattccggcatcgccacgctcgacacgagcttcaccgcgccggcgtccatcatgatcggcggggccaaggtcaccaacatcaacagcgagagctggagctatctcaccctcaagaaggcgtacgcctactccgccaacaccgtcttcggccagctcggcaccaagatcggcgccaagaacctcgtgagctacgccgacgccttcggctatggccagaagctcggccaggacttctcgaccgtcgcctcgctcatgcccgacccggcgcagatgaccgagtgggagacggcatgggccgccgtcggccagcccgttggccagcacacgagccccgccggtccccagacgacggtcatgcagaacgccgtcatcgcggcggccatcgccaacaacggcgtcgtcatgaacccctacgtggtcgaccacgtgctctcgcccgagggcgcgacgacctccaccacgaagcccaagtcccttggccaggccatctcctcgcagacggccacctcgatcaaggaggccatgctggacgtcgtggagaacggcaccggctacggcgccaaggtgaacggcgtcaaggtcgccggcaagaccggcaccgcggaggtcagcacgaccacgtcgaactcgctctttatcggctttgcaccctatgaccagcccaccgtcgcaatatcggtctgcatcgagggaaccagtggagaggatatggtcggcgttgccgcatcggtggccggccaggtgctctctacctgcctgaacgtgcagtcgagcggcgctggcaaataagtgctcgttgtgcattgacgagggtcggttcggtctacattagaatgttgagtgtcgcgggttcgcgactgttttgggagagacggagagacgatgtctgaaagagttcttggcggacggtacaccgttcaggacaggataggcactggcggcatggccattgtctaccgtggactggacgaggtgctcggtaggacggtcgccatcaagacgatgctgccgcagtatgcggcggacccgtcgttcgcggcgcgcttcaagcaggaggcccaggccgccgccgcgctgcagagcccctacatcgtctccgtgtacgactggggcaaggacggcgacacctactacatcgtcatggagtacctgcgcggcaccgacctcaagagcggcatccgcaagcatggtgccctcgacagcaagaaggtcgcccagatcggcagccagatcgcccaggcgctctccgtcgcccacaagcacgacatcatccaccgcgacatcaagccgcagaacatcatggtccagcccgatggcaacatcaaggtcatggacttcggcatcgctcgcgccaagaacagccacctgaccacggacaactccgtgctcggcaccgctcactacgtctctcccgagcagacccagggcaaggagcttggccccaccaccgacatctactccctcggcatcgtcatgtacgaggccgctacgggtagggtgccgttcgatggtgacgacgcgatctccgtcgcgctcaagcaggtgaacgagcagcccgtccctcccaccgccatcaaccccgccgtcgattccgcgctcgagagcatcatcctcaagtgcatgcagaaggaccccaaggaccgcttccagacggccgacgagctctatcacgtccttcgcgactaccttgccggcaggctcgccgccgtcgacacggccacgtccgtgctgcccgccaaccccgtggttcccgcaatcgggaccatcggctcgaccggcaacacccagagcctgccccgcgtcgagaccgcagagcacatcaggccccagtccgcgacgcagcgcgcgcaggcagaggccgacgccgccgcaaagaagcacaagcaccgcgtcgtgctcttctccatcctgggcattgccgcgctcatcgcggtgatcgtgggtcttgtcaccctctataacgcgaacaacgcgacgcgcgaggtgccaaactacctcagcatgacggagtccgacgccctcaaggcaatctcgagctcggacttcttcaagcgcggctccgttaagcgccagtactccagcacggtcgcaaagggcctggtcatcgaccagacgcccgactccggccgcaaggtcaccaagggcacacagatcagcctcgtcatctcgaagggacccgccccggcagagacggtaaaggtgcccgacctcacgggcatgagcccgtccgaggccgagaaggccctctccgcggtcggactcgttggccaggccggcgactccgtctacagcgagtcggtcgacgtgggcaaggtcgccgcgcagagccccgagggtggcaccagcgccaagaccggcgacaccgtcacctaccagctcagcaagggcaaggagtccgtcgacgtgcccagcgtcaccggccaggacgagagcaccgcaaccgcgacgctcaaggccgcgggcttcgcagtggacgtgaagtacggcaacagcgactccgccgacaagggcacggtctacaaccagtcccccaccggcactgccaacaagggcgccacgatcacaatctacgtctcgaacggccccagcacggtgagcgtgcccaacgtcgtcggctccaccgccgaggacgctgaggccgcactggaggccgagggcttcaagtactccctcacctaccagaacagctccagcgtcgcgcagggaaccgtcatctcgcagtcctctacgtcggccaagagcggtgccacgatcacgctggtcatctccaacggaccgagcaccacgaccgacagcacgaactcgaacggtagcaacagcaacagcaactcgagcagcagcaacagcggctctacaacaggaaaatcgaccaccgcgactcctagccaatagtggagaagtgcagcaaccatagctgcagccatgacgtagcagaggggcgaatccagtcgggtgcgccccttttcgtatgctggttgctgacaatctccaaccgcaatagttatctattcctgggcacgtgagactaattcgtcactagacgcggcccgagccatggccccgcacctaccaatttggcacacatttggtatgcgctctggtacacatcgcctataaaagagaagcaggccgcgcggaatttgccgcgtgacctgcttaaactcaatggtgaccccggtcggattcgaaccaacgacaccaggtttaggaaacctgtgct

SEQ ID NO: 210 - DNA, 4830 bp, Unknown
  Metagenome-assembled genome
cgggcacgccacgagtcaagcggccatagggcctgaacgaagtgaaggccagggacttgagtccctggccggaactctagggttataccctaagagcaaaccacccgctatgcgggtggtcatgattgcgctgccttgcggccggatgacgccgcgtcctacgccgtcttgctcacgccgacgagcttgctccagccggtggggtgcatcgcgaagccgtggaccttgggcgagtagccacagaccgtcttggcgtgcgagatgggcagcacgggcaggtcctgggtgagcttcttctcgagctggaggtagatgtcgtcgcggtcgtcgccgtcgggcgtcgcgaggcccttggccacgagcgacttgtactcgctgtcgtcgtaggcggacatcgtggcgttgctgccgctcgcaaagaggctcatgaagttgtcggggtcgccgttgtcgccggcccagcccgcaaaggccaggtcgaagtactcctccgtgcgcttggagcggaacgtggtccagtcgtacgcgttgaccgtgagcttgacgcccaccttgtcgaggtagccctggacggactccgcgagcgacttgccgccggccgggttgtactgcatggccgtggtgtaggtgaggcaggtcagctccgtcacgccggccgcggagagcgtggccttggcggcatcggggtcgtagtcggggtagctcacgtccttgtcgtacggcgcgaggaactcgggcatgagcgagtgcgcgacggtggcgtacttgccaaagagggcgctcacgatggcgtccacgtcgatcgcctggcagatggccttgcggacgctggcgtccttgagcttctcgctcgcggtgttgaagaccatgtagctggtgttgaggccgtcggtctccttgaccgtggagccgcccttcctgacggtgggggcggagctcttctcgatcgccgtgatgacgtcgacctcgccgttgccaagggccgtcacgcggtccgcggactcgggcatgaccctgaagacgatgctcttgaccttgggcttggtgccccagtagtccgagaaggacttgaggatgacggtcgagcccttctcccagctgctgagcttgtacgggccggtgccgcagggcgaggtggagaggttgccattgtgcttcttgagcgcagtgggcgacacgatgggcgtgccgagcgccatggcgaggttgcgcacgaacggcgtgcaggccgcgcgcagcacggcgaccacggtgtgggagtccttggcggtgacggacttgacgcccgtgccggtctggtccgtgccgaagaccatctcggcgtagcccatgtcctcggcacccttgccgtccatctggcgctcgaagttggtgaccacggcgtccgcgtcgaagtccgtgccgtcgtggaacttgacgcccttgcgcaggtggaacgtgtacgtgaggccgtcgtctgacacgtcgtagctcgtggcgaggcagggctccgggtcgcacgtggtgcccttgaagcggaagaggccctcgtacaggttggcgcacagctcgagcgagccaaagtcgttgacgcgcgcggggtcgagcgcctgcgggtcctcgttgagggcgtacgtgagcgtggacgcggtgccgctcgaagagctcgtgcggtgggacccgcatccggtgagggcgcccgcccccaggagtgcggcgacggttgcgcccgacgcgaggaaggaccggcgcgtgagcgcctgaggcgtgttggtggtgcccatgggtatcagctccttaggaatggtgttttcgcatggtaccatggctaatgagtcgactggtaagacattgtgtaaccagccggttatcgtttggggcgataaccgtgtcccgaccccgacgcgacgcgaggagctgccatgggacttgtggtgagaagcgcgagcactgccgacctggacgcggtctggggcctgttcgaggcatcctgcgcgctgcagacgccggaggaccctggcccggactggcacctgggcgtgtaccccacacgcgaggggctggcggcgcgctccgccgcgggagagctctacgtgggcgagaaggacggcctcgtgcgcgcggccatggtcctgggtgcgggggaggacgagggctacgccagcgccccgtggacgattgtggcgcggcccgaggacgtgcgggtgctccacctgctggtggtggacccgtcggcgcgcgggcaggggctgggcagacagatggtaggggaggcgtgccgcattgcccgcgacggcggcggcagggtcatccacctggacgccctggagggaaacgacgccgccgagcggctgtaccttgcgtgtggctttgtgcgggcgtgcgttatggccgtgcactacgacgacatcggcgacgccaggaccacgctgctggagcgcgacctggcgggcgagggcggcgccgaggccggggactgacgcggcggcaaagggagtgcgggcttctcgccagcgccgtgactcgcccggcgctagccgacggtggtggagctggtctgcctgagggcggagctgccgccgcacatcttgccgtgcgccgcgttgagcgcgtccagcacgggcaggagcgagtcgaagtcggacggcgcgtccgagagcaccgcgatcgcgtagtcgccgcagtcggaaaagacgatggcgccctcggccgtggcggtggaggcgagtccctcgttcgtggggtaccagcccggctttgcccagacggtgtagcggctgcgcagcagcgcgcccagcgcggagtggttggtcctggcaaggcatccggtaaggaggctcgcgccggcctcgcccgaggtaccgtagcggtagatctccttccagcagttgagcatgcccgtggcagatatgtgcgggtagttgtacgtgtacgcctcctgtgcggcctcgggcgcgcggctcttgagccagttgccgtacacggtgtagccgtaggtcttgagcagcgcgcggaacgagtcgttgtcggaatcgaccaggcacttggtgatggtgtcggagctggacgcggcaccgccgttggtggactccaggatggccgtgcagtagatggccttgatgctgcttgcggggtagaacttctggtccgcgttgtagctgacgccgcggccggtcttgaggtcgaccatgctgaagcccaggtggtagccctttgccgtgaacgcggcgacggcgtcctccaggtgcttgcacgtgggcgtgttggcaaagccgtccggcgcggtcacgctgatgccgccggacgtggtgaacgtggtgaccttggcgctcgcgctcgcgtcgagcgcggacgtgtcctcggagggctgggagctgctggaggagctgtcgtccttctcgcccgcggagctcgaggcgtccgtcgcggcggtggtgaccttggcgcttgctgccgactttgcgctggtggaggcgtcggtggagctcgcggcatccttcgtggcggcgtgcgtcgcggttgggaacagcgccccgcgcacctgcggcacgagcgcgaccgcggccaccgccgccgcgaccagggcgagaaggacaatcgccacggccttgtggccgcgccgtgggcccctctcccgtggcgcctcgtgcctgccgtgccttccgtgcgcctgcggcgccgcatgccttgccgtcaacgtgagcccccttgcacctgcctggcgcgcgccccgcgcgtcgcatcgcattcacaagagtatatcgccgtgctgccggcggcaggcatgcgctagactgtgcgggtcgtcgcgcgcgggccgcgcggcgcggcgtgacggaacgcgaacgggggagtcggtgcgcatgggtacgacgcagggccagacgggacgcggcgcggggatgaggctcctctcgcccgcgggaggtccggagcagctgcggcaggccatccactttggggcggacgaggtctacctggccggccgccagtggggcatgcgcgcgcggagcaagaacttcgaccgcgagcagctggcctgggccgtgggcctcgcgcacgaggcgggcgtggccgtgcacctcacgctcaacacgctcatgcgcgacgcggacgtggacggcctgcccgactacctgcgctacgtggactcgatcggcgtggacgccgcgatcgtggcggacctgggcgccatggcgctcgtgcgcgagtacgcgccgcacgtggagctgcacatctccacgcaggcatccgtcatgaacgcgctcgcggcggagcagtacgcccgcctgggcgcccgccgcgtggtcctcgcgcgcgagatgcgcctgcccgagattgcggagctgcgccgccggctcgacgcggacggctttggctcgctcgagctcgaggtcttcgcgcacggctccatgtgcatggccgtgagcggccgctgcctgctgtcgagcgagcttgtggggctggagcgcggcgcgagctttggcgcgtgcacgcagccgtgccgctggggctggaacctggtggaggagtcgcgcccagacgagcgccgcatgcccgttgagcaggacggctcctggagctacatcctgagctccaacgaccttgccatgctgggccacctggacgacctcgcggctgccggtgtcgccgcgatcaagatcgagggccgcgccaagggctcctactacaccgcctgcgtcaccaacgcgtaccgccacgtactggacggcgagcccgcgtccgcctggatgggcgagctcgacgccgtgagccaccgcccgtactccacgggcttcttctatggcaaccccacgcagaaccccggccgcgtggagtaccagcgcgacc

SEQ ID NO: 211 - DNA, 11845 bp, Unknown
  Metagenome-assembled genome
tggttccgataggaagtcaataatgagtccagttcttcgtctagtgcttatcgttggcgcagtcatcgcactcgcaatagtcattcgctccgtacggaagtgccgcatgaccgttgcagactcagtctattgggtcgtatgtgccgtattactcgtcatctttgcggccttcccagggattgccttcttcttcgctaggctcctcgggttcctctccccctccaacttcgtcttctgcctcatcatcatgctcatgctcatcaagctcttcaccctgtcaggtcaagtctcaaggcttcagaacaaactggaaagcatgtcgcaggaggtcgcgctgaacgagaagagtcgccaagactcttctcgccaataagcaccgccttctgaattctcgtatcgctaccgataagcatcatcgatattgagttcacaatagcccgtggcatcaaccacgggctatttcattcggctagtagacggcagctatttcctacgcgcagccaacagcctgagcgcaagtcggaaagcccagtcggggcagaatctcaatagaatctcgtaccgagcgattgttggcgagcaattccggagcttgtacagcttgcgaacggacttcgtagacctggcctgcgcaaactcccagatggttgctgcatgcgccgagtccgggaaaagggccttgaacgccttggccgtctcgaccctcgaagcgacccgtattcgataccagtcttccttgcaagtaatgtgcgtcatggcgccagagacatttgatccatgccggcgatactgaacgagaggtttgtcaataaagctgcaacgaccaagctcacttgcccccagcgtaagccaaagatcatgagcggtatgcgaggggaaaggaacgagctttttcgcaacatccgtacgaattgcaagcgccataccgataccgtaacaagacgaagccgcacgaaccgttatatcatcgccggagttccagttcacctcagcctctgaagaatgagcgtgcctgtagctttcgcaaataacattgttgtcttggtcgataatcgatcgatcgcaaatgcagagcaccgagttctcttcgcgaaacgtcgaaagggtctcctctaccctgttgggcagccaaacgtcatcttggtcgctcagaaagatgtactcggaatttgcctgccttaccagttcctcaaacgacttaacatatccaaggttctggctaccgtgaatgtatttgagtgggacaccatctatgcagtcgcgaatctgttgttcacggtcgatgtccgagggatcgtcattgcgcacgattagacgtagcgaggcatcgctcttctgctttgcgatagagcggagctgctgctcaaagaagtctttctcaggacgatatatcgacatcaagacatcgacacaagtggaagcactgctcactattatcctttcaacaccaggacatcaacgccaactggcgcggacattcgtacgctttatagtcaggtcttaaccaaagtagaaatcataacccctgacttcacttatatcttcctcagcatccccgcaatctcccgcacgcgctttttataggcgaagaggtagcaggcgtacgctgcgcagtaaccgagaaatgcgatgacgccgggcaggacttcggtcatacagatgaagactatcgtgaggacaacttcagaaatggcgattgacgactcaccgacttcgaatcttttcgaaatgaagtgctctgaatagatgcttctgccgataatggcaatgaccgcggcagagattgccacgtacacagactgaaggacgtaagtgccaaaaagcaccccacaagcactgaacgcgacagtcacaaggttaatgtagagaagtctcgactcctctctcatcaccttaaacatggtcgtacaggtgatatccatcttgctgtcaaagacgcatatcgggagaacgaacacgaagaatgacatgctcttcgcatactgtggcagccataaaagaagcagccacatcattgggaaatatagggcatatactgcaggaaacataaggctcagcgtgtccctggcatgtacatagaacttcttaatctcggagtacttgctttgcttgagcgaggggaacagaaccatgctggcctgagacacgaatgctgtatagagcgacagcagcgagagagcaaacgacagctcaccgaacgtcttgattccccactttgcgtcgattgcgaaccggcagacacccacgatcagtccggatgcgatgttcgcaatcatgagctttgagccgacacgcacgctggcgatgctctcgcgcaacgcgatgggccaaccttcaaaaccagatttagggaactctctgacttggtagcagcaatatatcagctgcaccgtgctagagaatatgaaggcgatgacataaggttcgaaagtcttcacgcgaagggcgagaagcagaacgaggggcacaaggaaaacgcccctctcaaccatggtcgaataagacgatagcttcgtctcgttcattgcctgcaggacatacataacgtatgacgctgcattttggacaaccatgaagatggcggtgcagattaggacaaacacccttgcggcgccaaagcctgatgcagccgcaaagcaggagactgcgatggccaccagcgtttcaaacaccactgaaacaatgaactgagaatagataaggctcttgtctatctcgtctctcgccttgccgccgttgatcaggtagacgccatcgttcaggcccaagtggaagaaccctacataccccgagtagaaaatgaagagctgccagtatccgtattgcgttacacctagaagcttaggaataagcagcgattggataacgcccatgacaagagacacgccttgagcaagaaatgcaatcgacatgttctttattacgaagcgtgcgttcattatctccctaaccaatcgtttcagccgattgcgcccatactgtgcggccgtctaccatcgtgaagcgaatcctaataaagctacccgtcagatctcagcagggcaataacgcagttccaagatacagagtcacctgcaacacgaggtgagacacaaaatggacgagcagaacttcaagttattccggctggcccttttgcatgagttcctctgggaacttcatcgccaagaccgtgatgaactggccggccttcctcaacaacccactcttccaaactccagcccgcatcaatagggcaaccctccgaggccaagcggagttcggaatggccagaaacgcctgaagtgactctcgatcatcatctgacaactcggaaccgaacgcaccattacaggcatcggctctcttcatcatatccagcacgctcgttttggctgatttcacactggtcgtcaaaattgacttcaccaacgaaatcttgcttgcccctatttgattgttggagtgctgtctatatctgatagtcgcgagtggcacatagccaatatgacctgtgccagccgctaccaaagaaacccaccagtcatgcactcggaccccaccattatttcgatacttattgacaaggactcgaagtctcttattgagcataatcgtgcatccaggtgcaaccgcagagaccagtaggtccgtaagcttaactcgagtcggatcgatttctaccatgcgatcaaatgactcagagatgacatttagggattcatccacaacttccagatcagtgaacaccatcagtggtgcgtcaggaaattccgcctcaagctccctcattttttctaaggttacttccaccttgttaggcagccatacatcatcctgatcgcaaaacatggaataatccgagtcactttgccgcagcagacacataaagttctcgtaactaccaccatgtccgccacgattatcagcccattggacacgagcatcatcgttcatttccgagctaacgatatccctcgtgcggtcagaagagccgtcatcggaaacgagcatcctccaattacggtacgattggctcttaaccgactcgatttgctcgcgcacgtacttttcgccattatatgtggccatcaaaatatcgattgatccgtaatcgcagctgctcgtcaatttagcccctcatgatgaagaattacactggcatcgagttttcgtcagcctattgtcaaaccatgcgaaaaccaaatacgatttggtaacgcatccgccattgctacgcctgctccattattagcgaggcatctaggcgtccctgattcccagtcgcaccgcaatggccctagtgcactcaaatatcctacgcttcgcaatggcgctctcgaggtgcctacgtggccaatagccgaccgtagtagaaacgtaatcaaacttattctcgtaagccctcattaatcgtctcagcgctcggtaatacgtatcattgatttttccccttgaggaaaggtggttcacgtccgcggagaggacatatacgttgtgattatgagcgagagcatataggcactgctcgactccgtagaagtgccagttatcgcaaaccacctcatcgaagtggtgtcccagccaggtttcgcgaggaagaatgatcacgcattcatccacggtttccacttcaacggaatcgccgttgaacaaataagcaggagaataagctgcctcgtgttctccatgagttattgtcatatacagctttttattaatggcacccgcgacaccaccgacatcgccaggtttgagtgtcgaactggcagcctttaccaatctggacaggctatcggaatgcttaaatctaatatcttgatggcagaagagtatcaaatctcccgagctcatatttgcaccatagttcagtgcactagccgcactgccgaatcgcccttgcgaattgtcgataaataccttctcgacagccatgtcctgctcgtcaagtgagcaatcgaggtaacggagcttggccttgctggtgtagcagcagacaatcgataccttctgactttccaagcttttctccccactcatgcgcactaagtcttttggactgtaaagacgctctttgttgacgtcgaataattcgttcagtgattaatagaaccccatcagtaggccgacttttatcctcagcaaggcctctggagaaggcagccagtagcagtcactaccagagaatctgattcgcgaatcgagcgattcgtaataatgtgagaacgacccgagcatttctaggtactcgggcttcacatagtcctcgtaccccttgagaaagagttgggttgctgttgaattcacgcgctcatgcggtttgacggcaagcttgagaagcttcatcacttcacttggcgacttgggattgagtgtggtcttgccgaccacgttctgcccggtaatgcgtctcttcatgtacgcatgctcggtgtccgcgattacggttccacagaacctgccaaccatatgaatccagacatcgtgtatgcgggggaagtgctccggacggtacgagcgaaccacctggacaagggccctgttgaagaccatgacgcagccattgatatagttcctcagcagaaccgtaccagggtggttctcgcactcggcaaactgatagagctccctcgtctccttgtcaccttcgacgttaatgaggtcggagtagtagagaatgggctccttgtcgttgtgctgagcttggatagcgtccactccagccctgagcttgtttggcatccacacatcgtcctggtcggagaacgcgtagtagtcgtagctatcggccccatcctcgtagagcatctgcatgaagttgtccccgacgccgaagttcttggcattacgcgtcacgatgacgttgggatggctcttggcataggactcgcacactgtaagcgtgccatcgggcgactggtcgtcgcagatgcgaagggtgacgtcgacgccctcctgtgccaggatcgactcaatctgctcgccaacccaacgctcgccgcgataggtcgccatcattacgaggacgcgtggtctttcgctcacgttccagtccttacatcatcacgacgcgcaagcgcgtcattagctaacggtagaaaaatgccggaaccaagtataagctacctgattccagcaccttcgtacgtctgttgtcgcagctcaatcccccatgtcctcgccaacgaaacatcacagcgagagcatgaaaccgagcctactggccctgcttggcgtacttcgcctcggttgcctccttggcgggacgccaccagtcctcatgcacgcggtaccacgcgatggtctggtcgaggccctcggagaagtccgtgtggatgggcttccagccgagctcggtctccagcttggtggggtcgatggcgtaacggcggtcgtggccgggacggtcgcggacccagtcgaacgcgtcggcaggctggcccatgcgctcaaggatggcctgcagcacgtggatgttgtccttctcgccatttgcaccgatgaggtaggtctcgccgatacggcccctggtgaggatgtcccagacggcgcgcgagtggtcctcggtgtggatccagtcgcggacgttctttccgtcgccgtagagcttgggacggatgccgcagatgatgttggtgatctgacgggggatgaacttctccacgtgctggtaggggccatagttgttagagcagttggagatggttgcgcgaacgccgtacgtacggtgccaggcgcggacgagcaggtcgctcgaggctttggaggagctatacgggctcgagggcttgtaggggtcgtctggacggaagcggcggggctcgtccagcgcgaggtcgccgtagacctcgtcggtcgagatgtgatggtagcggacgtcgtacttgcgcgccgcctgcaggagccggtacgtgccgacgacgttggtctggatgaacggctccgggttgaggatgctgttgtcgttgtgggactcggccgcatagtggacgatcgcgtcgtggccgggaacgagctcgtcgaggagcttctcgtcgcacacgtcgccgacgaccaggtcgacgctgccctcgggaaggccctcgatgttcttggggttgcccgcatacgtgagcttgtcgagcaccgtcacgtggcactccgggtggttgcgcgccacccagcgcacgaagttgctgccgatgaagccgcagccaccggtgacgatgatgttgtgcggctcgaacgtttcttcagccatcaagggctccttgtcagttgtcttggttcctacttggccagggtcgcgacgtactccgcgagctgctgctcccagtccctgggggtgaagccggtcgtagcgatcttgtcgagcgccagggtcgagtagcgcgggcgcggcgcgatggggccggcggcgcttgcgtagtactcctgcgtggagacgggtttgaccgcatccgtgttgccattacgaagctcgaacaccttggcggcaatctggtaccagctcttggtggcaccagaacccgtgaggtcgtacgtgccgtacggggcggggtcggcggatgccgagccgtcgcggtagcccaggaggtggaagatgcccttggccatctggtccgtgaacgtgaggcggccggactggtcgtccacgaccgtcacgacgttgagcgaatcgttggggtccgcgacgcggtccgagagcttggccatggtcttgacgaagttgtggccgtcgccgatcacccacgaggagcgggcgatgtagtggcgcgggcacgcctcgacggcgagatcgcccgcagccttggactggccgtagacggagagcggtgcgagaccctcgtcctccgtgtgcggctgctgcgtcccatcaaacacatagtccgagctgatgtgtaccatcgtgatgccgtgctccgcgcacgtgcgtgccatgagcgcgggacccgtggcgttggccgcccagcagaccttgcgaccctcgggggtctcggccttgtccacggccgtgtaggcaccgcagttgatgaccgtaccgtagaggtcccagtcgtacttggcgtagtccttggggttggagaggtcaaacgtgtcgatgtcgcagaagtcgaaggtgtcgatcacgcccgtctgctccgcgagcgcccgcacggcacggccgagctgaccgttacagccggtcacgagcgtgcgtggcgccttcatcgggacgacgtccttgagcatggggtggtgcttatcggcctccgagagctcagcctgggacagcgggatgggccactggatatcgagcgtgggatccgcgaggttgacgaaggtgtaggtcttcttgagctccgcggaccagtgcctgttgacgaggtacgtgtaagccgtgccgtcctccagcgcctggaaggagttgccaacgccgcgagggacgaagatggccctggaggggtcgagcgtggtcgtgaagaccttgccaaaggtcttgctcccctcgcgcagatcgacccatgcaccgaagacggagcccgtggccacggagatgaacttgtcccacggctccgcgtggatgccacgcgtgacgccgcgcttagcgttgaagctcacgttgttctggacgtagcggatgtccgggatgcccagggcgcacatcttggcgcgctgaaagttctccttgaaccagccgcggttgtccccatggaccgaaagctcgacgaccttgagccccgcgatgccagtctcggtaacggacaggtccttctcgaattccatttgctctgtagcctccgtctagtcgtcgtacctgcggccggggacgatcttgccctccgccacgacgcgcaggtgcttgccgtagtcactcttgccgtagcggtccgcgcagtcgagcaggcgggctcgagagatccaaccgttctcgaaggcaatctcctctggaacggacacgggaaggtcctgcgccttctccaccgtgcgcacgaactgcgatgcctcgtagagcgactccatcgtgccagtatcgagccacgcgtagccacgtccgagcgtgatgacgtcaagggagccgtcctcgaggtacatgcgattgagatccgtgatctcgtactcgccgcgggcggaggggcggacctttgccgcgagctccgtgacgcgggcgtcatagaagtacaggcccgtcaccgcgtagttgctcttgggatgggcaggcttctcctcgatggagacggcgttgtagtccttgtcgaactccacgacgccaaagcgctcggggtcgtccacacggtagccgaagaccgtggcgcggcccttctccgcagacgcgacggcgcgacgcaggtgacgcgagaagccgttgccgtagaagatgttgtcgccgagcacgagggcgcaggcctcccccgccacgaagtccgcgccgatcacgaacgcctgggcgaggccgttgggctcgggctgctccgcgtaggagagcgacaggccgaagtcagacccgtcgccgagcaggcgctcgaagttgggcaggtccttgggcgtgctgatgatgaggacgtccctgatgcccgcgagcataagcgtcgacagcggatagtagatcatcggcttgtcgtacacgggaaggagctgcttgctcgtgaccgtagtcagcgggtacaggcgcgtgccgctgcctcccgcgaggatgattcccttcaattgacgcctccacacattgtcaggtcgcacaatccacccattgatgatagcaatcataaactaccgtcgttggcgcaggcagttcacgggccgttcgccacggaaccagttgattggcaatcagcggatgtagctttttcagctggcgcccttctagcctgttaagtgaagtggtcgcagaaaggcaatccatttgctcgccaacaaaaggctcttcggctggaatagacgatatgcagcgaggcagttggcaactcactcgtgaaacaggaggtctcggagcggcaatttgggtttgacgtcggcagtcggcgtgccgcatccgcatgagatcacacctatgaccacctaagtcagcgagcgcgttcaacgcgtactcgtgctatccagcttcagactgcgaaggaggctcaaggacgctggcatcgagtgtatgattggctccgcctcgaaggtgcccggagtcactggcaacatgatcaaggccgaaagccgcgacgtaatcttcctgtcacgcactcgatatcgacgccgtcgcctagaccgtcgcgcccactgaggcggctcacgacctggagcgaccttgcctgttgacagacagcactacgcgtcagtcgagctcgacgtcgactatgtagcgcgggcgccccttggtctcgaggtaggccttgcccacgtactcgcccgtcacgcccagggacgtgatgatgaggccgccgacgagccatatcgacaccatgacgctgccccagccggccacggcgtgcccggtggcccagctcacgatggtgtagaccagcatgacgacggcgatgaggatcgcgacgatgccgatggcggtcatcacgtgcatgggctcgatggagaaggacgtgaccccgtccacggcgagcgcgagcatcttcgagagcgggtacttggactcccccgccatgcgctccttgcggctgtagaagacctggtcggtcctgaaccccagggcgggcacgatcccgcggaggaagaggttggcctcgcggtactgggacagcgcctcgagcgcacgtctgcccatgaggcggaagtccgcgctgttgtacacgacctccgtgccgagcctccgcatgagcctgtagtaggcctgcgccgtgtcgcgcttgaagcccgtgtcggtgtcgcggttgttccgcacgccgtagacgacctcggccccggcggcgtacttctcgaccatctcgccgatgacgcccacgtcgtcctgcaggtcggcgtcgatggaaatcgatatgtcgcagccgcggtccagggcgtccatgaggcccgcgtagaccgccctctggtgcccctcgttgtgggcgagcttgatgcccgtgaagacgcggtccgacccgtggaggcccgctatgatcctccacgtcgagtccctggagccgtcgtccacgaagacgatgcggctgtccggcgagacctcgcccctctcgaccagggccctcaatgtgtccgcgaggatggcgctcgactgcgggagcacctcctcctcgttgtagcaggggaccacgatgcagagcatcgggacgtggtcgcgtggttggggtgggattgcgttgaggtgcctgctggtgtccatgatcctccaggccgtcatcatctgcgggcggcgtccgtgcgccgcgcgctctggttgctgaatctttccttgcgtcacgtcggtatgatacagcttgcggccgccgtcccctccgcgaacccgcaacgccacgagttcgcacacaggacgacggccgcaccgctctggccaaccactgtttaacgacagctgaaatcatgccaccgttcgaccccgatgcccgctaccatgattatgtgccgcaaacgaaactgcgtcacttctctctcctaaagtacgcgctatgcagcgcaccatccaagtccagaaaggcacacatttgatcatcccgcacgagcgcctcactacctcgcaagacgaggtggacgtcgcgagtaccagtacgcccatctcgttacatgcaaatcaaaaagaacacgcaaccggcaacgaccccaagccctcctccgtgtccgaacgtacccagcgcacggcagccatcgttgtattggtgatagcactcatcgccgtagccacactattggttgcgctgcgtctggaagacacccacgtgaaggtcctcgcacaaagtggctattctgctggctccgccgc

SEQ ID NO: 212 - DNA, 9449 bp, Unknown
  Metagenome-assembled genome
aaatacaaacgaaaggttaggttctacgatgttccacaacgcttcgcatgacgcatgcgtcacgcgcaggtccttcctgctcaccggggcggcaatggcggcgacgctcggtctcgccggctgcggctcctcctccaacggctcctccaaggacgactcgaagagcggctccgcgggatccgcaagctcgtccaagtccctctccggcaagctcgtcgtgttcgcggccgcctctctcacggagtcgctcaccgctgccggcaagatcttcatgaaggcgaatcccgacgtggacatcacgtacaactacgactcgtcggggaccctcaagacccagatccagaacggcgccgactgcgacgtgttcatctccgcggggcaactgcagatggaccagcttgacgtcaaggcgaagcaggaccacgaggacggcctggacttcgtcaaccacgccacgcgctttgacatcctcgagaacaaggtctgcctctgcgtgcccgacaacaaccccaagggcatcaaggactttggcgacatgtccaagaagctcgagaagcacagcatcctcctctgtatgggcaactccgacgtgcccgtcggccagtacacgcagaagattctcgcgtactacaaactcgacgagcaggcgctggcaaacgcgggctgcatcacatacggcagcaacgtgaaggaggtcgcctcccaggtgagggaggccgccgtcgactgcggggtggtataccgcaccgatgccgtgtccgaggacctgaagcaggtcgaccaggccaccgagaagatgtgcgggcgcgtcgtctatcccgctgccgccatcaagaccgccccgaatcccgaggtcgccaaggcgtttctcgccttcctcaagggatcgagggcgagcaagtgcttcgagaaggtcgggttcaccccgctcgcggagggctaggtcgggatggactggtatccgctcctcaactcgctgaggatcgcagccatatcgacggtggtggtgtacctgctgggcatctggctcgcacaggtggtggcccgcgcgccgcgcctggtcaagggcgtgctcgacgtggtgctcacgctcccgctggtgctcccgcccacggtcgtgggctatctcctgctcgtgctgctcggccccaggcgcccgctcggcgcctgggccatgcgggcgttcggcatccgcctgaccatggtgtggtactcggccgtgctcgcgacgatcgtggtgagcttcccgctcatgtaccgtacggcgcgtggcgccttcgagtcgttcgacgagtccctggccgacgcggcgcggaccctgggccgctcgaacgcctggacgttctggcgcgtcaagatgccctgctgcaggcagggcatcgtggcgggcgccgtactcgcgttcgcgcgcgccctgggcgagtacggcgcaacctccatggtcgccggctacaccccgggcaccacggccacggtctccacaaccgtctaccagctctggcgcacgggaaacgacgccctggcactcaggtgggtcctcgtgaacctcgccatttccgccgtggtcctcgtcgccatgaacatggtcgaggaccgctcgggctacggcaggcgccgccgggccgtccatgcggccgcgccggccgacgcttccgccaccgggggaggcgaggcatgatgtcgctcgacgtggacatcacgaagcgcctctcggacttcacgctgcgcgtgcggtttgtgacggatggtccccaggaggtccttgccctcctgggcccctccggttgcggcaagtccatgacgctcaagtgcatcgcgggcatcgagaggccggacggcggccgcatcgtgctggacgggcgcgtgctcttcgacgcggagaagggcatcgaccttcccccgcagcgccgccgcgtgggctacctgttccagagctacgcgctcttccccaacatgaccgtcgagggcaacgtccttgcgggcgccgcgggcagcacgaaggacgagcgccgtcgccgcgcggcggaggccatccgccacatgcgcctgcaagggctcgagcggcggcaccccgccgagctctccggcggccagcagcagcgctgcgccatggcgcgcatcctcgccagcagcccggacctcatcctgctcgacgagccgttctccgcgctcgacggctacctgcgctggcagctcgagatggagctgaccgacgtgctgcacgagttccccggcgggacggtgttcgtgtcccacaacagagacgaggtctaccgcctgtgcgacacggtctgcgtgatctcgcggggcaggtcggacccgcgctgcaccgtgcgcgagctcttcgaggcgccgcgcacgctcgcggcggcgctcatatccggctgcaagaacgtctcgcgggcgtcgcgtgcgggcgaggggctgcttcgctgcgacgactggggcgtaaccctgcgcacgacgctgccgtgcgaaggtgccacccacgcggggatacgggcgcactacttccgcgtgggggaggcggccggccggaacgccatcccctgcatggtggaccgggtgatcgacagcacgttctcgaccatcgtgatggcgcgcacgcccgggggcgcccttctccgctacgaattggagaaggacgaatgggcgcggttggaacggactgcggtggagcacgggaggctcgtgctcgccatcgaaccaagagacgtgatgccgctcgtggacggcgacgcggaagggaggtaggagatgctggacggctttgggcgtgatgtccgctacctgcggctctccgtcacggacaagtgcaactgccgctgcgtgtactgcatgccggcgggaggggtcaggctgctgcggcacgaggacctgctctccttcgaggagctcgcggagatcgtggcggcggccgcgtcgctcggcgtggagcgcgtgcgcatcacgggcggggagccccttgtgcgtcgcggcatcgtcgacctggtgcgcatggtggccgaggtgcccggcatccgcgaggtcgacatgaccacgaacggcacgctcctggcgccgctcgcccgtccgctccgcgaggcggggctcacgcgcgtgaacgtgagcctggacacgctggaccccgtgctgtaccggcgcatcacgcgcacgggcgagcttgcggacgcgctcgcggggctgcgcgcgctggacgaggcgggctttgcgaacaccaagctcgactgcgtgctggtgggcgggctcaacgacgcggacgtgcgtcccgtggcggagctcgcgcgcgaccgcgatctgagcgtgcggttcatcgagctcatgcgcatgggggagtgcgcgggctggcctaccgagcgcttcgtgcccgcggaggaggtgctgcgccagctgccggagcttgagcccgcgggcagccagggcgtggcggagctgtaccgcgcaccgggatggaagggcacggtggggctcatcaggcccgtgacccaccgcttctgcgcggggtgcgaccgcatccgcgtgtccgcggagggacgggtcaagccctgcctgcactccgcggaggagatatcgctccggggcctgcacggagacgcgctggtgggggccctgcggcgggccatcctcgcaaagccggcgcgctcgcacatcgacgttgaccacgcaagccagtccgcgcgtggcatgagcaggataggaggctgagccatggcgctcactcacttcaacgatcagggacgcgcccacatggtggacgtgtccgcaaagcagcggaccgagcgcatcgcccgggccgcgggaaaggtcctcatggcgccgggcacgatcgagctcgtgcgccagggccgcatgggcaagggcgacgtcctcgccgtggcgcaggtcgcgggcatcatggcggccaagcgctgctgggagctggtgcccatgtgccaccccgtgcagctcacaggcgtggacgtgagctttgccttcgagcccgacggcatcgcgttcgaggcgaccacgcgctgctgcggccagaccggggtcgagatggaggcgctcacggcagcctccgtcacggggctcacgatctacgacatgtgcaaggcgcagcagcgcgacatggtggtgacggacgtgcgcctgctggagaaggacggcggcaagtccggccacttcgtgcggcccgagggggacgaccccacggcgcagggagcggtcgcgggcacggacggcacgtccttctcgcccgcgtttgccgtagcgcagcgcggtagggtcgtggccacgtgcacgagcgagcgcaagggcgaggtcaaggtgcccgtcgacggcatcgagctcgtggccgggctgggcatccgcggcgacgcgcacgcgggcaggtggcaccgccaggtgagcctgctcgcggacgagtccgtggacaccatgcgcgacctggggctcgagcttacgcccggggcctttgcggagaacgtcctgacccgcggcgtggacgtgaagggcctgcccgtgggcgccctcgtgcgcctggggccggcgctcgtgtgcgtgacgcagatcggcaagcagtgccacaacgactgcgccatccgccgtcgcacgggcaagtgcgtgatgcccaccgacggcgtgttcgccgtggtggtgcgcggcgggaccgtgcgcgcgggcgacccgatcgaggtcctgcgcgacggaacggcgccggatgacccgggtgccgaggacggaatggctgacggggcggccagcgccccgagggagggtgacgcgcgatgagactagtgaggaccgaggacgccgtggggcacgtgctctgccacgacatgacgcagatcattcccaaggagaaggacggccatccgcgcttcaagggcccccgcttcaggaagggccacgtggtgaccgaggaggatgtgccggtgctgctctccatgggcaaggagcacctgtacgtgtgggaggtcacgccgggcatgctgcacgagaacgacgcggccgagcggctcgcggcgctgtgcctgggctgcaacaccgtggcgtccggcgccccgagcgagggcaagatcggcatcaatgccgcgtgcgacggagtgtacctggtggacgtggagcgcctgaacgcggtcaacgccacggacgaggtcatggtcgccacgcgcaagggcaactttggcgtgcacgagggcgacgccctcgcgggcacgcgcgtgatcccgctcgtggtgcgcgaggaggtcgtgcaggcggccgagcgtgcgtcgcgcgtggatgccgagggcccgctcatgcgcgtggagccgtaccgcctcaggacggcgggcatcgtgaccacgggctccgaggtaaagggcggcctgattgaggacgccttcaccccggccgtggagcgcaagctcgagggctacggcgtcaaggcgacgttccacgcgatgcccggcgacgacccggacgccattgccagggccatccaccaggcgctcgacgcgggcgtggacatggtggtgtgcacgggtggcatgtccgtcgacccggacgacaacacgcccggcgctatcaagcgcgcgggcgcacgcatcgtcacgtacggcgcccccgtgctgccgggcgcgatgctgctcgttggctactttgacggccggcagggcggctgcggcgagacccccgcgggcggcgtgccggtgctgggccttcccggctgcgtgatgtacaacgccgcgacggtgttcgacctggtgctgccgcgcgtggtggcgggcgtgccactggtcaagcgcgactttgtggagctgggcgagggcggcctctgcctgcgctgcaatccctgcacctacccgctctgcccctttgggaagtgaggtcacgatgggagaagaacacgccgcaccggccgcggccggcgcgcaccacgtgcacggccatgggcatgacgacgggcggaaggtttcctacacggcctgggtggtgacggtgagcgaccgcggcgcgcggggcgagcgcgaggacgcgagcggccccgcgctggtggggctcctgcgcgggcacggctacgacgtggtgggcacgagcctcgtgcccgacgaggaggaccggatccgcgacgcgatcctgcaggcagccgcgcgcgacgtggcactggtgctcaccaccgggggcacgggcttctcgccccgcgacgtgacgcccgagacgacggccgccgtgtgcgagcgcatggcccccgggatccccgaggccatgcgtgcggcgtccatgcgcatcacgcccatggcgtgcctctcgcgcgaggtcgcgggcatcgtgggccgtaccctggtggtgaacctcccgggaagccccaaggcggcggttgagaacgtgtccgccgtgatcgggcccatcgcgcacggcctgcgcatcctgcgtggcgggcccgcggactgcgcgcgcgagctggggcgctgatgccagacgtcacgcggagagtatgcagatgtgccagtctgtgatataagaaaattggtggcgggtttccgctacctccaagtgccgggggcttatcccccggcttcttctgtctctaggggctgactttccaaagctacgacaacggccaagccatcgtggagcgcgctctctatggggccattgcgggtgcgctttccagcaacgtgatggtacgacgcaagacaagagagctcgcgaaggcgacgccgccgtccttctcgcccgtgtccgtgcccacgctcgcacgggtggcgctcgcgcactaccagctcgaggcgccgcacccccttcgtcgacggcaacggccgcatcggccgcattctggcgcagcgcatgctggtgggcgcggggcggcttccggctgacgcgctgctgctctccgaaacgctcaagcgtcacaaacaggcctactaccagcgcatagaggacgtggagaagtacggcgactacgagtcgtgggtcgcgttcttctgcgactgcgttgcggaggccgcggactacacgctgggccggctgcgggcgtagggccgttgcttcctagtaaagcagccagtccagcaggttgactatccgcacgccgctgggcgtgacgccgcagcggtagcggtcgagcgtcaggacaacctttgggaacgagtcgccaatcatgtcaagtggcgcaagctcgcgctggtaggtggcctcgtccgcgagagactcggtcacctgaaggtaggtcttctcgcccgtgcgctttgatgcgacaaagtcgacctcgccagagcggagcgtgccaacgctcgtcgaatgccccctgcggacgagctcgttatacacgacgcactcaagctggaaaccgaggtcttggggagagaagccgctcatgaggttgcgcagtcccgtgtccgctggatagagcttgtactgcggcctcaggacctgcttccccgagatgcccgcctgctcgcaccgggagacgatgaacgcgccctcgagggcgtgcagatagttgtccacggtgtttgcgctagtcttccttcccgcgctggtaaggtagtttgctatcgatcgcgtcgagaagaggtttcctgatgtcacgaaaacgtacctgacgagcttctcaagcaggtcgatgtcggagatgccgccgtgcgtcgcgacgtcgttcaggatgatcgtctcgtatatggccgtcagcatgctttcgacgtactcatcgctctcggtcggcgcgtcgaactggccgggcatcccgccgtatttgaggtatcgagcaaagagtgcctcgactggttgctcttgcgtgtgtctggccttggagaaggacaggtactccttgaacgacagggggctcaccttgagctcgatgtagcgacccccgatcagcgtggagaggtccgaggacagcacgaacgcgtttgagcccgtgatccagacatccgtccgctcacgggtccggagctgacgcacgaccttctcccaggcggggacctcctgcacctcgtccaggaagacgtgggccatgcggctgccgtctgccttgtcgagggccgcctggattcgctccttcagccattccgcagtcggctcgagcggcatgtcgaagccgtcgagcctgatgaggattgcgttgtccttgccgtcgcgggttgccgcggcagaggcgagtgcctggaggagcgtggacttaccgctgcgtcgaacgccaatcagcaccttgatgtcctcggtgtcgaggtaggggagcaggcgctcctcgtagtcggggcgggcgattctgatggtcattgcgaggtccaatcttgttatgcgaagcgcatttaacattataacttgaaaaaggtacgaatgttaaattgatttgacgttttgagatttaccgacaggattgtcaagtttgattaacaaaacttgcagtctcaaacttcaagatttgcgaaaacttgacgtcctagaccgcaagggacgtggtcttggggtcacgggccatgtccttctcgccctgagctgccatggcctcaagcttgctcaaagcttcgtttcgggtgtgtgagctgtcgcgtccgcgtgggtgcgcagggcactgcggtgcgctacagtgggaccaatcgaatagctccaccaaaccattgaggcggaaggtagacgccagcgcacgcacagagagcccggagtgctgagatccgggtcggaatgcggaacgttgattgggccgccgagggcgcaccgaaagggacgttgggtcccaagtggcgggacttcgccgtcgtcgcgaggagtagcaagtaactgaaaaccggacgcattggcggggcgcaatttgaagctgcgccccgttttttcgtgtcggaaagccattctggttatggtgagcttgccactacccacgtggcctttgcaatttgtatattgtggtatacactcagagcatgctggggagaagaagaacagtatgagctgcgagtcagttatggtccaggctgcctgctctatttttataggacgtgacgaagagattgtctggctgctccttggcggagacaagtcctcacggcaacgtgatgtcaagcgtgctcagcagctgaacagggaatacgaatgaggtgagaaggacgacagggaagaagaaggttgctgcaccatacgatgcggcggagttcttggagacggaagaagacgttgccgcctacctcaacgccgcacttgaagacggcaatccacaacttctcacagcggcccttggagatgtcgcacgtgccaaggggatgacccagcttgcgcaggagacaggcatcacgcgcgacggcctctacaaggcactctcgccctcgggaaatccgtcctttgccacggtgcagaaagtggtgaatgccttgggattcaggtttgacgtaactccgaataatcaagtcccggcatagggtgcttgcaatgggcgacaagaagattgatatacgtaagcgcgagctgcgccatcactttattgacgtccg

SEQ ID NO: 213 - DNA, 18822 bp, Unknown
  Metagenome-assembled genome
ccggagcccttgtacttctcgagcttgtcccacacgccgtccgtggcgagcatgacgtgggtcatgcggaggttggccgccttcgcgagcggcgcgacgcacgccgaggcgcccgacgccgcaaacaggtcggaaaggcgcatgtcggacttgccgtcgttcaccttggtgtcgagcggaatcgtgacgaggtagcccttgcgcttggtggagttgagcgtgaggatctgcgcgttcttgagcttgggggtctgcgcgttgacgtcgtccacggtgagcacgagcacgttctcgaacgagtcatcggaaatggtgtaaccgtcggggctggtcacggcggcctgcgtctcgagcgaggcgctcagcgtcttgttgcctacgctgatgggctgctgggccttgctccacaggacgcccaccaggaccaccaggcaaatgcccacggccacgagcaccgcgatggcgatgtagttgcgataggggttgtagcgcggaacgtccgtgcgctcaaaccgctcgcgcttcctgtgctgcatgttccctcccctggcgaggccgcgccggcgcgccccgcaggtagcttacagaaacccttagaagatgatacctaatccgctcacggcaagcccgcagaccacgcccaccacgtaaatgaaggcggtaatcgccacgttctggcgcatgtcgcggttggtgcggaagagaacgagaagacccatgcccccggagaccagaagcccggccatcatggggccggcaccaagcgatccggcgaggtagagctccgtgatcgcgacggaggcgccgcagttggggatgagcccgatgagcgccgcgagcagcgtcgcgcggaacgggtgcacgcccagggcgtggccgatggcgtccgtgcccgcgagctcgatcaccaagccaaacgcaagcgtgacgaggaagatgaagaacgtgacctcggccgtgtggatgagcgcgctgcgaactatgtgccagattcggctgccgtggccgtgcgcgtgggagtgggcgtggctgtgcgcgtccgcgggcgcagccgcggcggagccgtcggccaagacgtcaagttcttctccctcgatctcatcgcagtcgcagtgggcggcctcgcagagttccgcgatgtgagcgtggccgtcgccggcgcggtgcagggcgcgcagcaccacgtccacaaggaggcccaccaccatgccgatggcgaccttggtgcccatgatggccagaaggcggccgacaggctgctcgtgcgccacgaacacgggaatcatctcgtccgaggtggagaggatcacggccacgagcgtgccggcgctcaccacgcgcgcggcgtacagcgtgccagccatggcggaaaagccgcactgcggcagcgcgcccaggagcgcgcccaccacggggcctgacttgtccgcgcgcgcgatgatgcgctcggtcttgccgcccgcagtgtgctcgagggcttccatcgcaaggtaggtgacaaacaggaagggaacgagttccaacgtgtcatgaacggcgtcgagaaggacgtccacaaagagctgaggcgtcaagctgggtactcctatagtttctatttacatgttcatgctgctgcactcagaccgctgcggcggttgtgcgcacagtatatgagcagatgaacatatgcgtttacctgcgctttaggcgcagcgggcagagggattatacccatttgacagcagcatgccaacattaggccatgccacacaatgccaccacgagacagctcggccgcacgacacgggccgccgccagctactcccagggctcaagcgcgccggccaggtacgtcacgtcctcaaacgtgaggccctcggcgggcgccgtgggacctgccgcctgccgcgaccgggcctcgagcgcatgcttaagccacgcggcgtcgcgatgcccgcggcccacctccacgagcgagcccacgatgatccgcaccatgttgtgcaggaaggcgttgccgcgcacgtcgacggcaacaaggtcctcccccgcctcgcgcacgcgcgtcacgtccacggcggtcaggcacctgcacgtcgagcggccgtcagactcgagcagctgcgcggaggatgccttgcagaagctcctaaagtcgtgctcccccagcagacagcgggaagcctcggccatcgcgtccacgtccaggttcgcggcggtgcgcagccaccacgagtggccccacgccatgacgggccgcgccggcccacaggcgattcggtagcgataggctcgctccgtagcgtcaaacctggccgagaaggacgggccgccgcggtagatgccgcgtatggacaggtcgtccggcgtgagcgccacgagcgaggcggtcgttcttctccccgaccgctcgagctcccccgccgtgacgggaacactcacgtactgcgacagcgcgttcacgcccgcgtcggtgcggcccgcgcaggtcatgtctacttcgcggcgcagcatcgtctcgagcgcacgcctgagctcgccggccacggtgcgctggcccggctgctcggcgtacccgctgaagccggcgccccggtagccaaccctcaacaccaacgtcccagccaccagatctgcaggcagcacgccctcagcttctggctcccccgcatccgcaggacctgccacaaccccggaggcatgaccatcaacaacgttctttagctcgtccaacagatcctccgtggtttcttgcacttgtctgcacagcacaccggcgccgcatgcccttcagagcgattctaagctcattttcggccacaaaaccaaccagcaccagtacttgcccgctagcgcatcccaagactaaattcgggcggcattcaggccacctctgtccaagccgggcgcaacaaaaaaggaggcccgcaatcgcgagcctcccaaacaagctatatgcgagttgccgctatggctactcggccttctcctcggtggcctcctcggatgcggtctcctcgaccttctcctcggccttgtcctcggcaggctccaccttggtgacggtggtcttggcctcggccttcttgaccggctcgttcaccatctcgataatgacgacctcggccgcgtcgcccttgcggggaccgagcttcatgatgcgggtgtagccgccattgcggtcagcccacatgccctgagcggccttctcgaagacctcgcgcacgacctccttgtcgccaacctttgcgatggcgagacggcgggagtgcaggtcgcccttcttggcccaggtgatgaccttgtcgacctcggggcggatggccttggcgcgggcgtcaagggtcttgatgcgatcgttggcaagcagggaagcgacgaggctcctcttcattgccttggtgtggctgacatcggtgccaagcttcatgccacgcttcttgttgtgtctcatggtctagctactcctaagtaaaacttgcgacgtgtcctaggccttgaggctaagacccatagattcgagcttgtccttgacttcctcgatggacttgacgccaaagttgcggatgttgagcaggtcgttctcggagaactccaccagctggcgcacggagtggatgccggcgcgcttgaggcagttgtaggagcggacggaaaggtccaggtcctcgatctgcttgtcaagctcggtgttgtcctcctcgacaccactggcgaagatggaggtgtcctcgacgggctcctcctcgtcggccagcgtcatgaaggcgttcatgtgctgatcgacgatgtttgcggcctcgaccaccgcgtcacgcggggaaacggagccgtccgtctcgacctcgaggatcagacggtcatagttggtgtgctggccgacgcggcacggctccaccgtcttggcgcagcggcgcacgggcgagaagagcgagtccacgtggatgatgccgatggggtcgccgtcgcgctcgttgtcatcaccggagacgtagccgcgaccggtgccgatgcgcatctgcatggtgaggtgagcgccctcgccgagcgtgcagatgacgtggtccttgttcacgagctcgaactgggacgggacctggaagtcaccgccggtgacggtgcaggggccgtcgatggagacggtcgccacggcctcgtcgccggtgcccatgctcttgaacacaaggcccttcacgttcaggacgatgtcggtgacgtcctcgtaggcgccgtcgacggtcgtgaactcgtgctgaacgccatcgatctggatggcctcaactgcggccccctcgagggaggacagcagcacgcggcgaagagagttgccgagcgtctcgccatagccacgctccagcggctccgcggtaacgcgggcgagattatcggaaatctcctcgaccgacacctgcggtcggatgaattcggacatgaaaacctcctaccagtccagacttacttggagtagagctcgacgatgagctgggcgtcgatgtccaggtcgatctggtcgcggacggggagctgcaggacggtgccctggagcttctcgatgtcgacctcgagccaagcgggaacggcaacgtgctcggaggagatcagggcctccttgatggggagaagatccttgtacttcggcgcgaccgcgacgacgtcgccggccttcacctggtaggaggggatgtcaacgcggtggccgttcacggtgatgtggccgtggcggacggtctggcgggcctccttgcgggtgcgggcaaagccgaggcggtagaccacgttgtcaaggcgggactcgaggatggtcatcaggttgtcaccggtgatgccctcgatcttcttggccttgtcgtaatagccacggaactgcttctcgagcacgccgtagatgaacttggccttctgcttctcgcggagctgctggccgtactcgctctcctggcgacgacgacgctggtgctcgccgcggttgctcttcttgttgtagcccatgtcgacgggctcgatgccaagctggcggcacctcttgaggacaggggtcctatcaactgccattgctactgtccttccttactacacgcgacgacgcttgcacggacggcaaccgttgtgcggaatgggggtcttgtcctggatgcccgaaacctcgaggccggcggcctgaagggaacggattgcggtctcgcggccggagccgggacccttcacgaacacggcgaccctgtgaaggccgtgctccatggcagccttggcgcaagcctcggcagcgacctgggcggcaaacggcgtggacttgcgggagcccttgaagccgacggtgccaccggactgccaggcgatgacgttgccctggggatccgtgatggagatgatcgtgttgttgaacgtgctcttgatgtgggcctggcccacggcgatgttcttgcggtcggcgcgacggacgcgctgggcaccgcgctggttcttcttctgtgccatttatctactccctacccgcgcttctttgcaccgatctgacgcttcttgcccttgcgggtgcgagcgttagtgtgggtgcgctggccacggacgggaaggcccttgcggtgacggaggccgcggtagcagccgatctccatcaggcgggcgacgttctgacgaacctcgcggcggaggtcaccctcagtggtgaagtgcgcgtcgatgtaatcgcggatcttcgtcacgtcgtcctcggtgaggtccttgacgcgggtgtcgggattcacgccagtctcagcgcaaatcttcgtagcgctggtctgaccgatgccatagagatacgtaagaccaacctcaacgcgcttctcgcggggaaggtcgacgccgttgatacgtgccaacttcgagctcctctcttagccctgacgctgcttgtggcgagggttctcgcagatcacgtaaaccttgccatggcgacgaatgatcttgcacttgtcgcacatcttcttgaccgaaggacgtaccttcatttgcgtttcctttcggtagtactggtagttctcatacgaactggtcttgcctggcgcctcaggtggagctaagacgccgctatgtaatcgcccagccgcaggcgtgaatatcctaggctgatgacacccgcgcgaggcgccagccagggttacttgtagcgataggtgatgcgacccctcgtgaggtcgtacggcgagatctcgacgacgaccttgtcacccgggaggatgcggatgtagttcatcctgatcttgcccgaaatggtgcagaggatagtcttaccgttctcaagctcaacgttaaacattgcgttgggaaggggctctatgaccttgccttccagctcgattccgccttgctttgccaccttgcctactttctccctgtgaatcacagcgactgaatatcatacataaatcaacacagcacgtccacggtacggaaaagactacatttgagctgcacatatccgaaccgtggcattcgcaggcgagaagaacgtcacgccttggcctcgccaccgccttgcatggagcaccacgcgcccttctcgtcctgcgtcaggacgaccgggccgtccttggtgatgccgatggtgttctcgaagtgtgccgcgggcaggccgtcgtcggtgacgaccgtccagccgttctcgcggacgtgggtctggctggtgccgagcgtgagcatgggctcgatcgcgatcatcatgcccacctgcaaaaggacgccgcgccccttcttgccgtagttggggacgttggggtcctcgtgcatgacgtggcccacgccgtgtcccgtgtagtcgcgcaccacgccgtagccgttgttctcggccagggactgcacggcatagcccacgtcgcccaggcggttgccggggacggccgcctcgatggcggccttgaggcagtcgcgcgtgcactcgcagaggcccttgacctcgggcgcgacctcgccgacgtagaacgtccatgcgttgtcgccggcccagccggccttgttggcgcccacgtccacggagaggatgtcgccgctcttgaggatgacgccgggcgacgggatgccgtgcacgacctcgtcgttcacggacgcgcagatgctcgcggggaatccgccgtagcccttgaagccgggcttcgcggcgttctggcggatgaacgcctcgacggccaggtctatcgacttggtcgagacgccgggctttgcgagcgaccccgccaggcggagggcgcgcttggaaagctcgcccgccgtggcgcggtactcatgcatctcgagttgcgtcttgatgtgcatcataggccgaggagcaccttcacgtcagcgtagacctcgtcgaccggacggtcgccgtcaaccttcttgagcaggcccttcttgccgtagtagtccacgagtggctcggtctgctcgcggtaggtgtcgaggcgcttcttgatggtctcgggcttgtcgtcgtcgcgctggtacatctcgccaccgcagcgcgggcagacgtccacgccggcaccggcggtgtagccgcaggagcggcaggtgcgacgcgagctcaggcggttgatgatcacgtccgcagccacgtctaccagtagagcggcgtcgaggctgatgcccatggcgtcgagctcgcggtccagcacctcggcctgtgcggtgttgcgcgggaagccgtcgaggatgaagccgcgcttggcgtcgtcctggcccaggcgctccttcacgaggtccaccaccagacggtcgggaacgagcttgccggcgtccatgtagcccttggcctcgacgccgagcttggactgcgccttgaccgcggcgcgaagcaggtctcccgtcgagatgtgggcgacgccgtaatcctcaacgagcttctgggcctgggtacccttgccggcgcccggtgctccaagaaggacgatcttcatgagttgccgcctttcgcgttcaaatggccttgcggccatatctccacatagatagtcacagtgtagccgctgcgggtgcagtcggtggagaggggcgagaaaagcggtcgattttctcccctggcccgcatacaaaaggaggggtcccgaaggacccctccgctacggttgcgctttttccgcgatatgggctacttgaagaacccgtcgtagttgtgcatcttcagctggctctcgagctgcgagatcgtgtccattgccacgccgaccatgatgaggaccgaggtaccgccaaacgactgcatgagcacgttgccggtaatggagaacaggatggacggaacgacggcgagcaccgccatgaacagtgcgccgggaagcgtgatgtggtcgaggacacccttgatgtactcggccgtcgcgttgccggggcgcacgcccgggatgaagccgcccgacttgcgaagctggtcggcggtctcgtccgggttgaacaccatggaggtatagaagtacgcgaagaacacgatcaggacgacggagagaatccagttgatccagccggacgcgagcgcgttggcgaaggcctggatccaaccgacgttggggaagaacacggcgagctgggcgggcaggtaaagcagggcggaggcgaagatgatgggcacgacgccggccgtgtttaccttgatgggcaggtaggtggactggccacccatgatcctgcgaccaacgaccctcttggcatactgcaccgggatgcggcgctggccgcgctcgatgtagacgatcaccgggatgatggcgatcatgacgaggaccgtgacgagcgtgatgattgcgcccgtgctggaggtcttgaccgaggagatgagagcagagggaaggccggccatgatgttcgcgaagatgatgagcgacatgccgttgccgattccgcgctgcgtgatgatctcacccagccacatgatgatgaccgcacccgtcaggaggacgccaatgatgatgatgtcctcgatgaactcggggaacccgagatgggagaagtcaatgccgtagctcttgaagaggaagaggtaaccgatggcgttgacgagcgcgagcacgatcgtgaggtaacgagtgtactgcgtgatcttgcgctggccagcctccccctcctttgcgagctcgcccagcgagggaatcactgcctggaacatctgcaggatgatctgcgcggtgatgtagggcatgattcccaggctgaagacggacacacgggaaagtgcgccgccggagaacaggttgagcaccgcgatggcaccgctaccggcagcagccgtctggaacacctcgagcatgcgcgtgaacggcacgcccggggcgggcagataggcaccaaagcgatacaggcagagaatcccgatggtgatcaggatcttcttcctgagctccggaacgcggaacgcatttgcgattccctttagcacgcctgctcgacctttccaccggccgcctcgatcttggactgggcggatgcggataccttgtcgaccttaacggtgagcttcttggtcagctcgccgtcgccaaggaccttgacggggatgtagtcgtgcttgatgacgcccttctccttgagggactcggcgtcgacggtgtcgccatcggcgaagagggcctcgaggcgagcgacgttgacgggagcgtactcgacgcgagagtggttggtgaagccagggagcttcgggaggcgcatagcgagctgcgtctggccgccctcgaagccagcgcccttgccgccaccggagcgggagagctggccgttggtgccgcggcccgaagtggtgccgtagcccgaggagtttccgcggccaatgcgcttacgggacttcctggagccctccacgggacgaagatcattgagctgcatttgggtgactcctagttctcttcaacctcaacaaggtgcttgaccttgaagatcattccacgaacgctcgggttgtcgggcagcacggagacgtcgccaatcttgcggagacccatggcacggcaggtcctggtctggtcctccttgacggacgcgacagcgctgtggacgagcttgacggtgagcttcttctcgtctgccatcggttagtcctccttcttaccgttgaacatctcgctgacggtaagaccacggcgctcagcagcctcctcggggctggagagggacttgaggccctcggcggcagccttgatgatgttgagagcgttgtcggtaccgagcgacttggaaagcacgttggtgatgccggcgagctcgaagagcggacgcacggggccaccagcgatgacgccggtaccctcgatagccggcttgatcagaacgtggccggctccgaagtagccgtcgacggggtgagggatggagccaccagcggtgacggggaccttgaacatgttcttcttggcgtcctcgacacccttctggatggccaggggcacctcggcggacttgccctggccgaggccgatgttgcccttgccgtcgccaacgacgacgagagcgacgagggacatgcggtgtccgcccttgacggtcttggacacacggtggatgtagactacgcgctcctgaagatcggagtcattctggcgcttacgatcacgtggcattcaaattcctcctagaacttcaggcccgcggcacgggcaccgtctgcgagagcctggacacgaccgtggtagaggaagccgccgcggtcaaaggtgacctcggtgacgcccttggccactgcacgcgcgccaacgagcttgcccacgaactcggcggcctccttgttggagccgaccttgccgagggccttgaactcggggctgagggtagacgcagagcagatggtcttgctgtcctggtcgtcgatgacctgagcgtagatgttcgcgttggtgcggtgaacgctcagacgaggacgctcggcggtgccgaaaaccttggcgcggacgcgacgcttacggcgctgaaggcccgcacgcttagcctggttcttgttcattccttctccttcaaacgccatcacctgacggggtgatggtcttctctatggcctagcgagactacttaccagccttgccgagcttcctacgaatgtgctcgccctcgtagtgaatgcccttgcccttgtaaggctcgggcggacgcttggcgcgcacctcggccgcaacctggccgacctgctccttggagatgcccttgacggtgatgtgggtgttgtcgggcacctcgaaggagattccctcgggagcctccatgacgacctggtgcgagtagccgagcgagaggtcgaggctcttgcccttgagcgcggcacggtagccgacgccggtgagctcgagcttcttctcgaagccctcggagacgccgaggaccatgttgtggatcagggtgcgggtgagaccctgctgggcgttggagtccgtcgtgtcgtcgttgcgggcgacgaggacctcagagccctcctgggagatggtcacgaggtcggagaaggtgcgagtgagctcgcccttgccgcccttgaccgtgacggtggaaccgtcgatagtcacagtaacgccagcgggaaccgtgacaggcttcttaccaatacgagacattgtctcctcctatctagattcgaccgttggttaccagatgtagcagatgacctcgccgccgatgccgagcttgcgggcatcgcggtcgcacatcatgcccttggaggtggagatgacggcggtgccgagtccaccctggacacgcggcatgtcagctgcggtggtgtagatgcgcaggccaagcttggagacgcggcggatgccacggatgaccttgctgtggcgcgggccgtacttcagcgtgacgtgcagggtcttctggggcttggtatcctcgacctcgtacgacgcgatgtagccctcctcgcagatgacgcgagcgatctcgaccaggaccttgctcgagggcatggagacctcggccttgccggcagagtttgcgttgcggatgcgcgtcagcatatctgcgatgggatcagtaaccttcattgattccttctccttcgttagtgatgaaactgcgcgttcggttcatcgggacccttagcccagatgccttaacgccagagctctcgggttaccaggatgccttggtgacgccagggagctcgcccttgctcgccagctcgcggaagcagacacggcagaggccgaacttgcgatagacggagtggggacgcccacagcgctggcagcggttctgcttacgggtcgagaacttcggctcacggttcgccttgacgatcatcgatgtcttagccacaaatcctccttcaggaagagaccccgacgccctgtcggggtgtttgacgaaactttgactaggccttcttgaacgggaagttgaaggcggagatgagcgccctgccctcctcgtcagtcggggcggtggtcacgatggtgatgtccataccacggacgtggtcgatcttctcgaagtcgatctcggggaagatcagctgctcggtgacgcccatggagaagttgccgtggccgtcgaaggacttgctgctgatgccacggaagtcgcggatgcgaggaatggcgatgcagatcaggcggtcgaggaactcgtacatgcggtcgccacggagggtaaccttggcgccgatggcctggccctcacgcaggtggaaggtagcgatggacttgcgggcgtgcgtaatcatcggctgctggccggtgatggcgcgaaggtccgcgacggcgccctcgatggccttggaatcggtagcggcctcgccgacgcccatgttgacgacgatcttctcgatcttggggatctggttgacgttgccgtagttgaactgcttctgcattgcgtcacggatctcggagacgtacttctccttcagacgcggcacgtacttctcggccatctggcactcctaactcatggggttttaagtgcggggttggtcctcgcacctcccagtccctgtgactgggagccgtgcgccctcgggttcaaggcatacctatccccacatagagacgcagggttagatattacgtgtttctcgtcctctttaccagcgtctttttgccggagcggaatcttcgcagttttgacaaaagaagggcccgtccctttggacggaccctcggatactatcgctctgggcgagaaggactagaacttagcgccgcacttcttgcagacgcggaccttcttgccgtcctcctcggcgtggccgacgcgggtggccttgtcgcagctggggcacacgagcgcgacgttggagacgtcgatcgcggcctccttctcgacgatgccgccctgctggttggcctgggtcggacgctgagccttcttgacgactgcaacgccacgaacgacaaccttgccctcggcgggaagagccctgatgacctcgccgcgcttgcccttgtccttaccggacaggacctcgacctggtcgcccttcttcacgttcatctttgccattcgttctcactccccctacagcgtctcgggtgcgagcgagacgatcttcatgtacttgtgatcgcgcagctcgcgagcgacgggcccgaagatacgggtgcccttgggctcgccatccttgttgaccaggacgcaggcgttctggtcgaacttgatgtagctgccgtccttgcgacgggtctccttggtggtgcgaacgacgacgcaacgcacgacgtcgcccttcttaacagagccgcccggcgtgacctcctgcacggcgcacatgatgacgtcggcgaggccagcataacggcgcttggagccacccatgaccttgatgcacttcacgcgcttcgcgccgctgttgtcagcgacgttgagcatggtctccatctgaatcattgctgttcctccatacctgccccccagaggtgcgctcgcctaggcggcgcacttgagggaacggggtgaatacgatcgctactttgccttctccacgatctccacgacgcgccaacgcttggtcttggacatggggcgggtctccatgacgcgaacggtgtcgccgaggccgcactcgttcttctcgtcatggcagtggagcttcttggagatggtcatcatcttgccgtacttggggtggtgcttacggtaagtgatctgaacggtgacggtcttgtcgccagagagggagatgacctcaccggtgcggaccttacgagcgttcctgctttcggtttctgccatttctgtctcctgcaactagttctgggcagcggcgttgtccgctgcgatctgacgagcacgcatctcggtctggatgcgggcgatgtcacgcttcacctgagaaacacgcgcggtgttgtccagctggctggtagccatctggaagcgaaggttgaacagctcagcgcgaccatcctcgagcttctgtgcaagctcctcgtcggaaagctctcgaatatccttgtacttcatagtgactactcctccacgtccttctcggcgcgggtgatgatcttggtcttaatcggcagcttgtactgggccagacgcagggcggcctttgcggtctcctcgtcgacgccaccgatctcgaacatgacgcggccgggcttgacgacggccacccactccgcgggatcgcccttgcccttacccatacgggtctcgagcggcttcttggagatgggcttgtccgggaagatggtgatccagaccttgccgccacgcctcatcctacgggtgatggcgacacggacggcctcgatctgacggttggtgatccaatggcgctccagggcgaccaggccgtaatcgccaaagtgcagctcggtgttgcccttggcctggcccttcatggagccgcgctgtaccttgcggtgaaggactcgcttgggtgccagcattagcgacccctcctctcgttgcgacggcggggacggctggagccctcaagcgccgggttgggcgcaggctggccaggcatcttctcgccaagatagatccaaaccttcacgccgcaggcacccatggtggtgcgagcggttgcctcgccaaagccgatcttggcgcgcagggtgtgcagaggcacgcgaccctcgcgggaccactcgcgacggcccatctcggcgccgttcagacgaccggagcactggacgcggatgcccttggcgccggccttgcgggcggactggatggccttgcggacggcacgacggaaggcgatgcggccctcgagctgctcggcgatggactgggccacgagctgggcgtcaagctcgggacgcttgatctcgatgacgtccacagagatgttgcccttggagacgcccacgatcttctcgagctcggcgcggagcgcgtcgatctcggaacccttcttgccgatgacgatgcccggacgggcggtgtagatgatgaccttcaccttgtcgccggcgcgctcgatgtcgacgcgggaaagggcggcgcttgcaagcttcttctcgaggaacttgcggaccttcagatcgttgccaaggctcttggcgtagtccttcttatcggcgtaccaacgggaacgccactcctcggtgatgccgagacggaagccagtaggctgtactttctgacccatacttcccctacgcctcctttcgaggtgcaacgacgatggtgatgtggctggtgcgcttgttgatgcgcgacgcggagcccttggcgcgaggacgaatgcgcttcagcgtggggccctcgtcgacgtaggcggacacgatctggaggttctcgctgcgaaggccgttgttgttctcggcgttcgcgacggcggagcggaggactttggcgaccggctcggcggctgcacgggtgttgaactggagcagctcgagcgccttgtccacggacttgttgcgaatctggtcgacgaccagacgaaccttgcggggagccatgcgcacgtacttggcggtggccctgacctcgttgttgttagccatttattccataccccctgttaagcctgcttgtggccacggaaggtgcgggtgggcgcgaactcgcccagcttgtggccgaccatggactcggtaacgtaaacggggacatgcttgcggccatcgtggacggcgatcgtgtgaccgaccatctcggggaagatggtggaggaacgcgaccaggtcttgatgacctccttcttgccagcctcgttcatagcggcgacacgcgcaaggaggcgagtctccacaaacgggcccttcttgagacttctgctcattcttaggtactcctaatactcgtgttccggctacttcttgttgcgacgacggatgatgaggcggttcgaggccttcttcgggtcgcgggtcttgtagcccttcgtcggcttgccccaaggcgtgacggacggacgaccagaggtgtggttcttgccctcgccgccgccgtgcgggtggtcgacagggttcatgacggtaccacggacggtcgggcgaacgttcatgtgacggtgacggccggccttgccgatcacgatgttgctgtgctcggcgttgcccacgacgccgatggtggcgcggcaggtgagaagaacgcggcgaagctcgccggagggcatgcggagcgcggcgtagccgttgtccttacccatgagctggacggaggtgccggcggaacgagccatcgcggcgcccttgccaggctggaactcgacgttgtggagcagggtgccgacggggatctcggacagcacggtgcagttgcccggcttgatgtcgacgtccttggtgccggagacgacgacgtcgcccacgtgcaggccctcgggagcgaggatgtatgccttggcgccgtcggcgtagtgcagcagcgcgatgttcgcggtgcggttggggtcgtactcgatggtcgcgaccttggccggcacgtcgtccttgttgcgcttgaagtcgatcttgcgatagcgacgcttcacgccgccaccctggtgacgggtggtgatgcggccgttgttgttgcggccagccttcttgggcaggggctcgaggagggacttctcgggcttgtcggtagtgatctccgcgaagtcggagatggtctgccaacgcctgccggcgctcgttgccttcagatgtctaactgccattacaaattccctttcttgtccgttggccagaccgcccgggattggcgacctgacaccggattaccacggtaccgcgcgtatccatcatgcgcggcataagagcccggcctccgaagaggctcgggcgaagaaccacttactcctcggcagcagcgccctggttggagaagacctcgatctgctcaccatcggcgatggtgacgactgccttcttccaggtgcgggtcttgccggtgacatagcggacacgcttgttcttgggcttgacccacatggtgttgaccttgaggacgtgaacgttgaagagcttctcgaccgcgtcggcaatctcctccttgggggcctttgcggcgacctcgaaggtgtacttgccctgcgacatcaggtcgaacgaacgctcggagacaaccgggcgaatgatgacgttgtagacggagttcattacgcgagcacctcctcgagctgcctagcgactgcggtgggcatgacgagagcgccgttgtccagcaggttgcgggtgttggcctcggaaacgccgatgacgttgaccttcgggacgttcctgaaagcgaggtaggtgttgacgtcctcgtcgtcgaccacgacggtcacgcgcttctcggcaacgtcgagtgccttgagaagggcgacggcctgcttggtcttggcgtcggcgaagttcagctcgtcaacgagcacgagctcgccgtcggcgagcttgccggagaggacggaacgcattgcgagcttcttctccttgttgttggcgcgcttggagtgatcgcggacctggggcccgaagatcacgccgccgccgacccactggccagcgcggatggagccctggcgggcacgaccggtgcccttctggcgccaaggcttgacgccgccgccggagacgtcgtggcggttcttggtggagtgggtgccctgacggagggaggcctcgtaggccacgacgacctggtgcaccacggggatgttcggctcaatgccgaagacgtcggaggaaagctcgacctcgccggccgccttcccctccgcgttcttaacttcgatcttggacattagtcctccttgttagccttagggtgtgattgcgatgggcccttaggccatgcggatcgaaacgagcgcgttcttgccaccggggacagcacccttgatgagcatgaggttctgctcggcatcgacgcgaacgagcttcaggttcttgacggtcacgcgggcgttgccataatggccagccatgtgcaggcccttgcggacgcgcgcggggtaggcgcactggccaatggagccgggcttgcggtggttcttgtgggagcggtgccagtcagcgccagcgaagttccagcgcttcatggttccctggaagcccttgcccttggaggtgccgatgacgtcgacggtcttgacgtctgcaaagtcggcaacggtgaccttctcgcccgtcgcgtgctcctcgccctcggggacgcgaacctcgcgcaggaagcgcatgggctcgacgccggcagcggcgaagtggccggacatgggcttgttgacgtgcttggccttgatgtcgccgaagccaatctggacggcgtcgtagccgtcggttgccttcgtcttgacctgcgagacgacgcaggggccagcctggacgacggtgacgggcacgacgttgtcgtcctcgtcccacacctgggtcatcccaagcttgcggccgagaatagtgttgaccattcctggtcctttccttaggtggtcatgggacccatgagacgcatcctgcgcccctccccagcggaccacatccaacg

SEQ ID NO: 214 - DNA, 7615 bp, Unknown
  Metagenome-assembled genome
gcccgcgcctgcgcgccagctgacctatgcaagctacattcaacctgtgttcagccacgtgtgtcgattgcccccgtgcgtagggggctctccacgaaaggaagattcacatgcccgacaaccacccaggtacttccaactacaccgtccgtctgatcaagcacaagagcgcccagatgttcgccaggggcgccctcgcagtgacgctctcggccgcgatgggcacggcgatgatcccgacgcaggcgattgccgagggtctggatgccgcgacgactgccaccgagcagaaggctgctgcgactgatcaggctccgaccttcgaccccaagagcgtcgtctacaacgccggtgaggtgagcatgaccctcgacggcaagagcgagggcaccttcagtgtcttccaggttgccacgtcctgggtcgcaggtacgcccaagcagagtgctgatggcgcctggacctgcacgctcacgatcaccccgaaggacgagaacaagatcgcgggccacttcggcgactccggctacgagctcgactccgccaactcaaagctgacgttgacctacacctacaacaagtggagcggctggcacgcctttgacaaggctgaccatgccacggtcgcgtacaagaaggccgagcaggcgccgaccttcgacgcgagccaggcagccaacgactccaatgccgtgaagatgctgcttgacggcgtagagcagggcggcttcagcgtctcccaggtagccgactcctggaccgccggcactcccaagaaggacgctaacggtacctggacctgcatgctcaccttcgtcccgaaggccgagaacaagatcgcgggccacttcggcgactccggctacgagctcgacgagaccaactccaagctgacggtgacctacacctactccgacaacaagtggaacccgggctggaaggcgctcggcactgccgaccgcggcaccctcgcgttcaagaaggccgagcaggcgcccgcgttcgacgtcaccaagcaggacgtggaagtcatggtgtacgacgccggcgagttcgatcctgcctacgagaccaccaagcctctcagcgccgacgtcgcgaccgtcggcgaggtctacaagaaggacggcaagtgggccgttgacgtcaccctcaagcaagggaccgcaaaggactacggtgtcgcagaccacacgaccaagggcgtctacctcttcgatgacgccaactccgtgacccaggtcacctacgtcaccagcagccttaagaccgctgactggaagcccgagggcgacgcggccaaggtcgcgttcgcgcaggtcgaggccccgactgcggacgacatcgtgaacgcgcaggttacggtcaagaccacggacggctccaaggagaagaactactacctcggcgcaggcacctacgaggtcggccccgtgacgatgggctacgcgaaccccatgtgcgtcgtcacgctcaaggcggacaagcagcagtcctacgtggacgagttcaacgccgagaaggacgcggatggcacctacgagctcgctgcaaagccgaacgacatccagttctactttagctatgaccccgacacgcaggagtggaccaacaccacgaccgaccagtacatctacgtgaagaaggccgaccaggccccgaccttcgacgctgacgccgccgccaacgaggctggcgacgtgaagctgctcctcgacggcgaggaccagggcaacttcagcgtctcccaggtcgccaagtcctggaccgcgaccgagcccaagaaggatgccgatggcaactggaccgtggacctcacgttcgtccccaaggacgagagcaagatcgcgggccacttcggcgactccggctacgagctcgacgaggccaactccaagctcacggtgacctacgagtacaacaagaactccggctggcacgccttcgacaaggccgaccgtggcacccttgcgttcaagaaggcggcggtgaccccggacaagccctccaagcccacccagcccacgactccgaccaacccgaccaacccgaacaacaacggcggtaaggcaaccggcaacaatgcgaacaacaacgccggcaacaacgccaaggtaacccctaaggctggcgccaccaaggccaacgctgccaaggcagccgctaccaaggccgcagccagcaaggccagcgtccccaagaccggtgacaacaacagcctcgctggcatggcgacggcaggcgtgctcggtgcggtgagcctcctcatcgcggcggtggagaagctccacgacctcagggagcagctgcgctagccgcaacaaccctcctcgccctccgtcccgaccttgacgcctgaggccgcgacggtacggcggggttgacgagaaccctccctttcctcgcgggtcaccctctggggtggcccgcctgcgtctctcttgcgctttgcgtgtgctgcagctgggagggccgtccttctcgccccttcccgtaccatggggcggacggattccgatgcctgggcaacatgcgcgggcacgttgtggaggagtggcatggcagacctgggtgggttcgaccctcagaagctgatgatggccgtgatgatgggcaggggaggcgaggctctgtcgatgctcaagtcgctcgacgtggacaccatcgcgaggcttgtcgacgcggcaaagctttccgcaagccccgaggcgctgcatgaggcaatcgccggctccggctccatcgacgagctgctttcgaaggtcgagaaggactgcggcctcagcctgggcgaccttgccagcatggcgacggggttcatgggccgcaaggggtaacggcggtcgtgcggccagctcctgtgagggctctggtcctattgcggctgggagggcttgctgactcggttagacgagctctcgaatctctcctattgcccacaagggaatgttgacgagccagccctcgtccctgtacgtcgagagcgaggtgcggaccgcgcgcgaaagagcgaacttgtcgcatgcgaccttcagactcttcgagcgcaggttctcgccagccttcacctctatgggcacgaccttctcgtccatcgggatgacgaaatcggtctctgccgtgccggtgctcgaggaccagtagacgggcgcaaatcccttgcagacgagctcctcaagcacgtattgctcggtaagcgaccccttgaactcggtaaacagacgcgacccgtcaagtacggccgacggattgaggtctgacagcgcgcagagaagtccaacgtcaacgcagaacagcttgaagccggacaggtcctcgtatgcctcgagcggcattttgagtgacgacacccgcgggacctttgtcacggcaccgtagtcgaagagccactggaggctctcctcaaagtcgcgggcgcgtgcgccagggcgcactgcaccgtacacgaacttcttgttctcgcgtgcgagctggctgggaagcgacttccagacgagcctcatcctctcgacgatgcgaccaggcgcgtgctttgcaaagtcgctcgcgtagccttcaagtatttggttctgcacccttctgacttccgagaggtcccccgtggagcgaaacaggtcgactgcctccggcatgccaccgaccacaaggtactccttgaggcgctgcgtcagcatgtctcgtagcggcgcgagctttaccatgtctgcctgtgcaagggcgtctgcaacgggatctccgcttgtggcgcgaaggaactcgccaaagcacatgggatgaaggacgagttcgtccaccttgccgaccgggaaagactcgccctcgcgtcgcatcgatatccccatgtatgaccctgccgcgacgacgtggtactcgcgtgcctgctcgcagaagtacttgagggaggtgagccctcttggcgcctcctgaatctcgtcgaagatcaggagcgtctcctctgggtcgatgctccggccatatctcaactcgatctcggagattatcctcttgggatcaaggtcctgggagaagagcgtgcgtgcggactcgtccatcaggaagtcgatcgtgacggaatcccggaactcctggcgagcgaactcccgcatgagccatgactttcccgtttggcgtgcgccacggatcaccagcggcttcctgttggggcggctcttccattccacaagcgaagacatcaggtcgcgctgcaagtctggtcacctctcgtcctgccatggcctcgttaagggggatattgatactcccacattttaccctaggaaaaatgtgggagctaaccacgttttaccctaggaaaaatgtgggagctaaccacaaagttcctagggtaaaacgtgcaagaagaaagggccgtccgcaagctcgcgcttgcaaacggcccctatgctgcgattttgtgataccgtgcgtcacaatgccttgcctgtgcaagactccttcgatttagtcctccacctcgagcagcgtaatctcgaagttgagggccttgccagccatctcatggttgaggtcgaacgtaatcgtggtgtcgtccttctcaaccacctgggcggggaagggacggccgtccatgccggagagcatgaccttctggccgggctccagggtctctgcgccgggcagctgcgccagggggatggtctggaccaggtcgtcgcggtgctcgccgtaggcgtccttgggctcaagacggacgttgacggtctggccgggctccatgtcctttacggcgttgtcgaagccggcaatcatctggcccgccatgcaggtgaaagccagcggctcgttgcggtcgtaggacgagtcgaacttggtgccgtcgtccagcgtgccggtgtagtggaccttgaccttcttgccttcgttgctcacgagttgctcctgtcggttgcgcttgtctggatgggacaagggtacccaaaagccgcggctcgaacgcgggggagtcgagagcgggcgcctcgccatcgagcgcccacaattggcgtgggcgcccacgtggcatcttggctacaatcgatacaacgcgtttgcgctttgtaccagcacaaatgatggaccgtgactttctgcgggggtgagtgtcccagatgcgacgcgacgttgtggacgaagcccttggcgtggtgccgcaccgtcgtgcgcgcctctgccttgttgttgccttgcgccttgccgagtgcctgcttgcgatgggcgcggcctggccgctgtgcgattccgtcctcgtgatgggggagggtgccgccaagacatccgcaagcctgacgatcgtgctgttcggcatcccgatcgcatgggccgcggctcatgcggccgccgggtggttggccgcgagcctgaggcttgaactcgagctcgcgctgcaggatgcggtggcgggccatgtgagccagctcgcgcgggccgatgcggccgcgtgtccgggcaggcgcgaggcgctcctgacccagggcgcgatggaggacgtctgccgggaccagaccgagtttttgccctggctttgcgcggcggcaatctcgtttgcagtggccattgcgcttgcctcgcagctgtctgagcaggcggccacgtgcgtgctggcgacgggtgggctcgaggcgctgctcgtggtcctcgcgagtggcggccgccgctcctctgcggccggcgacggctcggacgagggccgcggccttgacgggtacctgaggcaggaccttacggagctggacggctatgcgtcgcttggcgccgcggacgggctgctcgccaagtcaggggagagaaacgcgctcatccggcgtgacaggcttgccgtggggcgcggcccgcgcgtggttcgggcgctcgcgctgctgcttgcgctggcgtgcctcgcgatcgtggtgggcatcgtggacgcggcgggtggtggtgtcaccacgctgcaggcccggcgcgcgctgggcgtggccgcgtgcgtgggcctggcgccgctcgtcctgctggcggcgggtgcggagtcgcacctctccgcgcagctggcgcgcgaggacgtcctgcaggtgcttgatgaggacgcggcggagccggacgagccctttggcctgcagatccatcccggcgaccacctggctctgcagcatgccggccttgcggaggccgaggctcggatggcggcggacgcctggggcgacccgctccccgtggtggacgacgtgagcctggacgtccccgccgtaggccttacggtgctcgcgggtccggcggacggcggcaggcgcgcggtggcggtgctcctcgcgggcgcggtgcgcccaggcacgggcgtggcgctcctgggcggtaagccgctcgaccagctggatcccgcggagcttggcggataccttacgctcgtgcggcccggcgactacctcttcgagggctccgtgcgtcagaacctgcgcatggccgaccccgccgccactgagggcatgatgtgggacgtgctgggcgccgtgggtctggacgaggccctgcgccgcctggacgggctcgacacgccggtgcgcgcggacggcgcgaaccttgcgcctggcggcaggaggcagctcgtgctcgcgcgtgcgctcctgcgcgactccgccgtgtacgtgctggacgacctcctggacggcgcggacgaggacgccgccgcgagcatgatgcgcgccgtgcgcgggatcgcacgctacaaggccgtcgtgctctcgagcgggcggctggcggacgccgcggacgcgggcgtggtctacgcaatcgacggcggccgcgtggtggcctcgggcacgagcgaggagcttgccttgcgcctgcctgcctggaacgacgagctgcgcaggcagcgcgggctcgagacgttcgcgctccgccgggcgcaggacctggaggaggcgcgcgatgcctagggagaagaacaacggcctcggccgtggcgcgcacgtggacgcgcgcggcgccaacgacctggtcgtgctctgggggctgctgcgcctcgtggcgcgctggatcccccttgcgcttgcggccgcccttgccgccgcggggtcgctcttctcgctcgcgacgctcgttgcgggcgtggtgacgggcgggccgatcctggggacgggtcacgcgctgcccctgcaggcgctggggttcgcgttcgtggcggctgtgcttgcgtttgcctggcgggagctctcgctcgcggcgtccacgggcatggggtgcgagctcaggcaccgcgtgctggcgcggctgggcgatctttcgcccgtcgcgatgggcgacgtggcgcccgagggtacgcgctccttcgtgcgtgaggtgccgcaccgggacgtggctgccgcggtggagggccttggcgggttctaccggcgcgtggtgccctgcctgctcgcgacgctcgtgatgggcgtcgccacctgcgtggcgctcgcgacggcaagcgcgcaggcggtggtgctggccgtggcgtcgtacctgctcatggggctggtcgcgccgctggcggccatccgcctcgcggcatccgctcgcgaggagctgccccgcgagcgtgcgggcctttccgccacggcgacggaccaggtcgccggcgcggccgagctgggccagctgggtgcgg

SEQ ID NO: 215 - DNA, 5423 bp, Unknown
  Metagenome-assembled genome
gcgcgaggcgctctgctccgaggccgagtcggtcgcgggcgagaaggactggcgccgcgggccgtctgactttcgcaggctggcggacgagtggcgctcgctgaggcgctggcacgacccgcgcgaggacgagctgcagaggcgctttgacgcggcacgcgaggcgttctacaccgcgcgcgacgccgcccgcgaggaggccggcaagaagaaggaggcgctcgccgcagaggcggagcgcctgagcaagtccgaccgctggaaggcgacgggcgaccgcttccgcgagctcatggacgagtggaaggccgccggcaccgcgggccacgaggtggacgaggagctctggcagcgcttcaacaaggccaggaggagtttctacgacgcccgcgaggagcacttcaagcagctcgacgccgcgcgcgccgaggccaaggccaagaaggaggcccttgtggagagggcccgcgaggccgccaagacgagcgaggactggaagggcgccgagtggcgtgcggcatccgcgcgcatgaaggagctcatggacgagtggaaggccgccggcgtggcggagcgcgcggacaacgaccgcctgtggaaggagttcacggacgcgcgccagccgttcttcgacgcgcagcacgcccactacaacaaggtggaggcggaccagaaggaggccgcgcaggccaagcaggccctcgtggacgaggcccgcgagctgtgcgagggctcggacttctcgcgcgaggcgacggagcgcgccaaggacctcgaccgcaggtggcgtaagataggatacgccggcaaggagctcaacgaccgcctgtgggaggacttcaacaaggccaaggagggcttctgggacaagaagcgcgcctacggcgaggagcgtcacgaggagtggcgccagcgcacggaggacgcgatcgagcgccgcgagaagcgcatcgccaacctcaagcagcagaccgagcacctgagggagcgcatcgccaacgcgtacgcgaccgaccacgtcgaggagatgcaggagcgcctcgatgacaagctcgacctcatcaagcagatcgaggacgaggtgaaggacatcaagtcgcgcctggacgactagcgcggcggaaaaggggacacatggcggagcaggcctcgggcacggagacaccctcgtacaagagcagggaggaggtgcccgagcgctaccgctgggacctgagcgacctcttcgagagcgacgaggcattcgcgaccgcgctcgacaaggccaggtccctggtggacgagtacgccggctggagggaccgagcccttggctccggcgaggggcttcttgcgtacctgcgctttgacgatgacgccacgctcagcctgcagcgcctggggaactacgccggccgccgcgcggacgaggacacgcgcaagagccgctaccaggacctgaacgcgcgcgtgacgaccctcatggcgcaggtgtccgccgcgggctcgtggtttgagccgggcgtccaggcgattgacggcgcgacgctcgagggctggtaccgcgacgtgccggggctcgacctctaccgcctggccatcgaccgcgtccgcgcgctcgccccgcacacgctggcgcccgagcaggaggcactcctggcccaggccggcgtgctcatggagcagccgggcctcgcgttcacgatgctgaacgacgccgacctcacgtttgccgacgcgaccgacgccgggggagaagggcatgccgtcacgcacggcagctttgtcccgctggagaccttgccggaccgcgtgctgcgcgagtccgcctaccacagcgtctacggcgcctaccggtcggtccgcaacacctgcgcgtccctgctggcctcccagatgaggcacctcgcgttcttctcgcacgcgaggcactacgcgagctcgctcgaggcgtcgctcacgcccacggaggtccccgtcgaggtctacggcaacctgatcgactccgtgcaccgcaacctggagccgctccaccgctacatggccctgcgcggccgcgtgctggggctcgaccagatgcgctactgggacgtgtacgtgcccatcgtgaaggtgccggagcgccacttcacgtttgaggaggcgtgcgacctcatgctgcgcgcgctcgccccgctgggcgagaagtacctgagcgtggtgcgtcgcgcgctttccgagcgctggatcgacgtgtacgagacgcccggcaagatgagcggcgcgtactccgcggacggccacggcatgcgcccgctcatcctgctcaacttccagggcacgctcgaggacgtgttcacgctcgtgcacgagatgggccactccatgcagacatggctctccaacgaggcgcagccgccccgttacgcggagtaccccatgttcgtggcggaggttgcctccaccaccaacgagtgcctgctcatccactacctgctcgaccacgcgcaggacgacgcggagcgcgcctacctggtgaaccgcttctgcgagatgttcaggaccacgctgtaccgccagaccatgttcgcggagttcgagcgcgacgccaacgccgcctgcgacgcgggcgagggcgtgagcgcggacgccctgtgcgagcgctaccgcgcgctgaacgacctgtactacggcgacgccatcgcctccgacgacgagatcgcgcacgagtgggcgcgcatcccgcacttctactatgactactacgtgtacgtgtacgcgacgagctttgccgcggccgccgcgctttccgaccgcatgctgcgcgagggcgagccggccgtccgcgactacctgggcttccttgcgggtggctgctcgaagacgcccatcgagctgctgcgcggcgccggcgttgacatggcggacggttcggccgtcgacgcggcgctggcgaccttctccaccttggtggacgagctcgaccggatgctgtaggggcggacatgcagagggactccctggtgcacgtggccgccacgggcggctacggcagcgtgttcgaggtgcagaacggcgtgtgcgaggtggggctgcttgaccccatggcggaggagtactccctcatggtgccgcagacggccctggaggagctcgacccggcgacggacgcggataggcgggagctggtggggcgcctggcgctcctgcacctgcgcgtgacccgcggcctgctcgcgcgcgacggtttcgagctgtatgttggcaggaacgaggacgatgcgtttgagctctggtttgcccagggccttgcacgcacgcaaagggtcgcgacactcgatgctgacgccgctgcgaacctgacggaggtgctccttcccctcgggctcgacgcctgggaggacggcggcgcgccgtgcctggacggctggggctggtcgctcgagctcgttggcgctggcatgggccaggcggcctacggcacggcgccggccgcgtgcgcggatgcggatgccggtgcctgcgagggcctgcgcgacctcgtgacggcgcttgccggcctgggcctgcccgtcgagtggtgtccggacggcccgcacgccacgggcggggacggggcatagcccgtatgggcgagaaggacgcgcgcccttgcacgactgacgctgccaacgtccggcagacgccagaggagcgaccgtactacgtctacatggcctcctgcgaggacggcagcatctacaccggcatcacgaccgacgtggctcgtcgtatggcggagcacctgggccgcaccggtcggggcgcccgctacacgcgcactcaccgcgtgacggggctcgtggggctctggtcctgccgcggccgctcggccgcgagcgtgcttgaggcgcgcatacaccgcctgccgcgagcgaggaaggacgtccttctcgcccagccggcccttgccgaggacctcgcgggggatggatacgctcccgttccggagggggagcgggagcgtctgtggcgagatgccctcgagcgggtagccgcgggctaggtttaggttgttggcgcggtttgcctactggttcgagctcgtgtcggtgccggtgtccgtgcccgtgtcagagcttgtggtcgagctggtgccggtgtccgtgctggcgctcgtgctcgagtccttcttgaacgagatctggtcgtagttggtgtcgtagtccgccagcgtgttgtagatgtcgccgccttcggccgtgctctgcgtgatggggtcgagcagcacctgcgggtagtagctggggtagttgtagcccaggtcgatgccccagtagcggtcgacctgctgggccacggtcacaaggtccttgtagcaggcgtccgtcgcgacccacgccttgtagaacgtcgcggtctcctggtaggcaagggcgctgttcgcgctctcgtccgcctgcatctgctggatgagctccttgagcgacgcgcgcttggcctcgcgctggtcgcgggtggccacgtacagcgtcttgtagtcggaaatcgcggtgtccacctgcgagcggtagctcttgagcttgtccgagtacgcggaaatcgcctgcttctgggccttctcctccgcggtgagggtctcggtggtcttcttcttggtggacttgctgctcttcttggacgaggacttggagctcttcgtgctcgacttggagctggacttcgtgcttgccttggagctcgagctcgacgaggagtcgtccgagcccgtcgtggactcgctcttgcgcgaggtcacgttcttggcctgcgggtcgctgaagttgtagccgtgtgtggtcacgagcgcggacacgagcgtgatgatgatggtcgcggccaggatgcccacgatcaccctgcggtcggaggtccagaagctgtcgctgcgctggaacctggactccgtggggttggtgcccacgggcgcctgcatcggtgcgtgcgaggagtcgatcacgtcaaaggtgggccgctcgtcatggcgcggcagccgggcctcctcctcggcaacgtcccgctcgtgctcctccctcaggcgctccgcgaccgtctccctgtgctcggcgggggctgcgtcggtcggctcaacgggctcgaagggtgcctcggcgtcggtcggctcaacgggctcgggttcggcgtcctcgttcagggggtcgtcggggtcgggttcctccaccgtctcctccacgtggccggtggccacgggactcttgctcacgagcgtcgggtcctcctcggagatctcctccgcaaggtcctcgggacggaactcggcatcgtcggattcctcccactcccgcaggttggtaccgcagaccatgcagaactcctggcctggcttgaggggggcaccgcatttgggacagaacttaggcaacatggcactcctggcgacgttccgggaagattatgaacgaaggctgaagacagtatgtcacctc

SEQ ID NO: 216 - DNA, 21862 bp, Unknown
  Metagenome-assembled genome
cggacgtcgtggcgggcctccgtcacgatgcgctcgatcacgctgtctgcctcctcgccggtggccgagaagaccgtgcgcacgcccgcgatggtgaggtttggcctgtcgggcgacacgttgcccgcgccgtcgaacacgacgacggcctcgtagcggccctgggcgtaggcggccacgtctgccacgagcagcttgcgggcgcggtcgaaggggtccgtgtcgcccaggcggcccgagacctcgtccaccagcgccatgtagcgcggcgacttgtggatcacgttgtagccatccaccacgaggagctcctgcgggcgcgccatcgctactccgcctccccggcagcacgcagggactcgcggcgcagccactcgtagcacatgaccgtggcggcctgcgccgcgccgagcgacgccctcccccgctggggcaggcggcactcgaagtcgcacctctggcgcaccaggcgcgatacgcccgtgccctccgggcccacgaccaggcagaggcggccctccagcggggccgaccacacgtcctgccgcgcgtcgtccgcggggcaggccacccagaagccggcctgcttgagctcgtcgatcgcggtcgcgaggttaggcacctgcgcgacgggcacgcgccgcaccgcgcccgcggacgccctgtgggcacgcacgcccacgccggccgcgcgcgccttggcgaccacgacgccggccgcgcccacggcctccgcaaagcggacgacggcgccgaggtcttcctcctcgatcacgtggtcgagaaggacgacgagcgcgtcgccctggcccgccctctggatgacgtcggcaagctccgcgtagtcaaacgggctggcctgagccacgacgccctggtggacgccgtggttgctgagcgagtcgagccgcgccttggggacgctctccacgggcacgcccgccgcctcgagcctgcgcacgagcgccgcgagcgtctggtcctgatcggaccccgcggccacgagggcgcgcctgagggggatgcccgcctcgagcgcctccgcgcaggcgcggcggcccaccacgaggtcgctcgcgggacgcgcgccctggtgcgccccacgggtgacgccgccgcgggggcttgcgcccctggggccgccggagcggggaccacggttcttctcgcccgcgccgccgcgggacttggggccacgctgaccctgtcccgcggacctgggacccctgccgcgtgaggagcttcgcgccatgtgcctacgccttcctggtcaggcgtgcaccggcggccgtgtcctcgaccacgaggccgagcttggcgatgccgtcgcggatggcgtctgccgtgccccagtccttgttggcacgggcctcctggcgcgccgccagcagcacgcgggcggcctcgtccgggtcgtcgccctcgaagccggcgtactgtgccgcaagtggcaccagctcggcggggaggctcttctcgcccaggccggaaaggtcgatgcccaggacgtcggaaagctccacgatcatgtcggccgcgcgcagcgccggggccgtggcggcgtcgttgccggcgtcggccaggtacttgttggcggccgtgaccaggccaaagatggccgcgaggccgccggaggtgttgaagtcgtcgtccatctggcgcacgaactcgtcgtgggccgcatcgatggccgcgcccagcgtgcggtcgttgtcgctcagctcgccgtcctgcggcgcgttgtcggccgcccagcgcaggttcttgacgcaggtgcgcaggcgctcgagcgtgcccacggcgccgtcaagctggtcggtctggaagtcgagggcggagcggtagtgggtctgcagcatgagcaggcgcacggcgtccgcggggtacttgtccaggatctccttgagcgtgaagaagttgccaagcgacttggacatcttctcgccgttgacgcggagcatccccgtgtgcatccacacgttggcgagcggacggtcccacgcgcacatggcctgggcggtctcgttctcgtggtgtgggaagaccaggtcctggccgccgccgtggatgtcgatgggcgtgcccaggtagcggtggatcatggcgcagcactccgtgtgccagccggggcgtccctcgccccaggggctgggccagctgggctcgccgggcttggcggccttccatagcgcaaagtcgaaggggtcgcgcttctggtcgttaacctccacgcgctcgccggcgcgcagctggtcgagctcgcggccggacaggatgccgtagtggttgtcagagcggacggagaagtacacgtcgccgttgtcggcaacgtatgcgtggcccttctctatcaggatcttgatcatgtcctgcatggcctggatctcgcgcgtggcgcgcgggcggatgtccgggtcgaggatgccaaagcggtgcatctgctcgatgaaggcgtcgctgtactcctgcgccacctcggccgcggtgcggccctcctcgttggcgcggttgatgatcttgtcgtccacgtccgtcaggttctgggcaaacgtgacctcgtagcccttgtactgcaggtagcggcggatcacgtcgaagctcaggaacgtgcgcgcgttgccgatgtgaatctggtcgtacacggtggggccgcacacgtacatgcggaccttgccctcgtctatcggcttgaactcttctttcctgtgcgtctgggtgttatagatgagcatgggtttctccttgctgtgcatgcacgtcggcctggggccgctcacgtatctggaatggcattctatacggtttgcgtcgcgggcgcatgccacgccgcgccggcatggccccttgcgtcccgcgctcctagcggccgctacatcgcccgtccccaggcgcgccatcgtccaggaggaccaccgcccatgcggcgatgccctccttcctacccacaaagccgagcccctccgtggtggttgccttcatgccaacgctccccacgggaagccccatggcgccggcgagccgctcgcgcatctgctcgcggtacggtgccagcttgggcgcctgcgcggcgatggtgcaatcgcagtcgagcacgcgcgcgccgcgcgagcgcaccacgtccatcacgcgcgagagcagcacgagcgagtccgccccctcgaaggccgggtcgtcgtccgggaagagctggccgatgtcgcccgcgcggagcgtccccagtatggcgtccatcagggcgtgcgtgaccacgtccgcgtccgagtgtcccaggagccccagctcgtagggcacctcgaccccgcccaggacgcacctgcgaccctcggcaaaccgatgcacgtcaaacccgtgtcctatgcgaagcacgacgcctcccaacgcggccgcggctacttgatgccgcagccctcctccatgatgcgacgctcgagcagcgtctgggcaatggccaggtcctcgggcagcgtcaccttgatgttctcgcgcgtggactccacgcacaccacgcgcccgccgtgacgctccaccagcgacgcgtcgtcggtccccacaaactcgtcccagatggcggcgcggtgcgcggacacgatggccttggtcctgaagacctgcggcgtctgggcgcaccagtagtagctgcggtccggcgtcgcgacgatgttcttctcctccaccagcttgagcgtgtccgtggatggcacggcgcagatcgcgccggcaacggagtcgtccgagcgcaggcgggcgcagcaacgctccaggtcctccgtcctcatgaggggccgcaccgcgtcgtgtatggccacgagcgagaagcccgcgccccctgggattgcgcagaggccggagtagacggactcctgccgggtcgcgcccgccttggcgagcgtgacgccgcagcgcaggtgcaggcggcccagcacgtcctcgcgcatgagctgctcgcgctccggcttgcacaccaccacgatgtgccccacggagggcgcgcggtcgatcgccaggatggaccagcaggctatgggcagcccgcagagctccacgtactgcttgcccaccgggttgccaaagcgcgcgcccacgccacccgcgaccacgacggcgcaggtgtccggcccggacgccgcctcgcccgggcgccgcgcgcacgcgcaggcgcatggcctcggcgcgctcatgcgcgcttgccccacatgcgatagaggctgtccgccaggatgctggggttctgcacgcccacggagtcgaggcgggaggggttcttctcgatgtcgtccagaaggttctggagggagccgtactcgtccacgatcttgtcggccatgcccttgcgcacgacggagatgctcgaaagcgtgcgcaggcccagcggcgtgaggatgctgtcctccgtcttgccctcgtagcccagcacggacgccacgaccttgggcgagcgcaggcgcgagttgtccgtctcgtggaagatcttgcggatgcgctgggcgttctccacggaggagtccacggcgtagtcgcggatgagcagcgtgtagttgtcgtccgcgtcgcccacgaactcgtcgcgctgcatggcgatggtcttgccctcgctacccagctccaggatgtggctgtccaggtgctcggccgcgttcatgagcacctcgaacaggtagatggtgtccatgatgtcgctcagcgtgacgtagttgtcaagctcgagcgtggtcaggcgcagcaggctgtggtcgagctgcgtgcgcgtgctctggagcgagaccagcagctggttgacggaggacatgatctccgtcacggggcgcagctggtggcccttgccgtccacgaagacggtcaccacctggcggcgctcggagacggagatgaccatggccttggtgagcaggctcatgcgcgcggccgtgcggtggcgcatgcccgtctcgctcgtggggagcgacgggtcggggttgaggtggtagttcgcgcgcaggatctgcgtgagccccttgtcgatcacgatggcgccgtccatcttggagagctcgaacaggcggttggccgtgaacgagatgtccaggcggaagccgtcgtcaccggcggcgagcacggcgtccgtgtcgccgatgcagatgagcgcgcccatgtggcccgcgatgatcatgtcgagcgcgtgcctgagcgaggtgcccggcgccgtctggcgtatggcggagcgcagtcgctcccggctgtccttgctcttctcggcctcgtcctgacccatcggcccacctccacatcgcagccagcccgccaaggcgggccggcgtcgggttgtccccatcaagtatattgcgaatccacccgcgttttaaggcgcggagcagaaggggcgcgacggccacgccgccacgccccccctgcgatcgaattccgctcgccttgcggccgccctgccgatgctactcggccgaggccacgccgcccggctcggacgcgctgggcgagaagtgcccctccgcaccggacgtccagtgctcgcgcgtctgcggaaggtccatgtggacgcgctccgtggcggcagggatctctcccttgcccttcgtgaacgtgagcccgtcctttccggcgtccacctggatgatgtcgccggcctgccactcgcccatgagcatctgctcggacagcgggtcctcgatgagcgtctggatggccctgcgcagcgggcgcgcgccgtagaccgggtccgtgccctccttggcgatgtagtcgcgcgcggcgtccgtcagctcgatggacatgccgtttgcgatgaggcggttgcgcaggtcgcgaaccatgagctccacgatcttgcgcagctgctcgcccgtgagcgacttgaagaccacgatctcgtccacgcggttgaggaactcggggcggaacaggtgcttgagctcgccctccacgcggctcttgatctccttgtcggacaggccgccgttgccctgggccgagaagcccatgggtgcggtctgcgcgatctcgcgcgcgccgatgttggaggtcatgatgatgaccgtgttgctgaagtcgaccgtgcggccctggccgtcggtcagcctgccctcgtccaggatctgcagcaggatgttgaagacgtcggggtgggccttctcgatctcgtcgaacaggaccacggagtacgggcgcctgcggacggccttggtgagctcgccgccctcgtcgtatcccacgtatcccggaggtgcgcccacgagcttggagacctcgtgcttctccatgaactcggacatgtcgaagctgatgagggcatcgtctgagccgaagaggaactcggcgagcgacttggcgagctcggtcttgcccacgcccgaggggcccaggaagatgaacgagccgccggggcgacgcgggtccttgagcggggagcggctgcggcggatggcgcgcgcgaccttgctcacggcctcgtcctggccgatgacgcgctggtgcagggcgtcctcgcagcgcaggagcttggaggcctccgcctcggtgaggttggagacgggcaccccggtgatgtccgagaccacgtcggcaatgtccttctcgtccacgatgacgacgttcttgctctgcttctcgtgccaggccttctccagctcgtcgcgcttggtcgagagctcgcgctccttgtcgcgcaggcgggcggcctcctcgaactcctgggcgctcgcggccttggacttttggtccttgacgctggcgagctcctcgtccaccttggcgagctcgggcggcagcgtggtcttgtggacgcgcgtgcgggcgccggcctcgtcgatgatgtcgatggccttgtcgggcaggaagcggtcctgcacgtagcggttggacagcgtgaccgccgcctcgatcgcggcgtcggtgtacttgacgtggtggtgcttctcgtagcggtcctgcaggccgtggaggatcttgacggtgtcctcgggcgtgggctcgccgatgttgacgggctggaagcggcgctcgagcgcggagtccttctcgatgtgcttgcggtactcgtccaccgtggtggcgccgatgacctggatctcgccgcgcgacaggggcggcttgaggatcgacgcggcgtcgatggagccctcggccgagccggcgccgatgatggtgtggatctcgtcgatgaagaggatgacgttcttgtcgtcctcgacctcgcggatgaccttcttcatgcggtcctcgaactcgccacggtacttggagccggcgacgagcgacgcgacgtcgagcgtccagatctgcttgccgcgcaggatgtcgggcacgttgccggccgagatgagctgcgccagcccctcgacgatggccgtcttgccgacgcccgggtcgcccaggatgagcgggttgttcttctggcggcgcgccaggacctgcatcacgcgctcgacctcgcggccgcgcccgatgacggggtcgagcttgccgtcggccgcgagcttggtgaggttgcggccgaactgctcgagcatggagccatcatccgagccggagcccgcgctctgcgggcccgcacccatgaactgggggccgaagccgacctcggccgcctgcgacgagggctcgtccttctcgccctccttgtccatcagctcgctgacggcgttgcggatggcgtcgccggagacgcccatgcgggacagcgcggtcatggcgcggccgttgccctccgcgacgatgccgagcagcaggtgctccgtcgcgatgtaggtctggccgcgggtgaccgtctcgcggtacgccgcctcgagcacgcgcttggcacgcggcgtgaagggaatgtgcccgccagggacgggctccttctcctcggacgagatctccttgatggtcgccacggtctcgtcgtacgtgacgtccagcttcgcaagtgcctgggcggcgatgccgtcgccctcccggatgagcgcaagcaggaggtgctccgtacccacatacatcttgccgaggttgcgggcctcttcctgcgcgaggctcatgaccttgcgtgccttgtcggtaaacttctcgaacatgggcggtccgatgcctccgttcctgtgtccggcgcgggcctggggccgcgcccattggttaacttgtagctctttaccccacctcgcgacgcagtaacgcgcaatcccaaattcacgaacgcgcgacacggggcggtaacgcggcggcgggggcgtggcgaaggcgtcgcctcgtcctggctgcgcgtaagattgattcgatttgcgtctggtacgggaggatgagcacacggtgattctgtctttggcgcccatggagggcatcacggggtacgtcttccgtcgcgtgcacgcccagtgctttgggacgctcgagaagtactacacgccctttttgccgacgccacgtgtgggcagccggtttggcggccgggcgtccaaggaggtcgccccggcacacaaccgggggctgaacgttgtcccgcagctcctgaccaagaacgccgacgagtttgtctggtcggcacagatgctggccgagatgggctacagggaggtcaacctcaacctgggatgcccctcgggaacggtggtggccaagggcaagggttccggcttcctgcgccatccggaggagctcgaggcgttccttcgggacgtctgcgcacgctccccgctgccggtctcggtaaagacgcgccttggcctgagcgacgacagcgagtacgaggcgatcctggacgtgtactgccgcatgccgcttgccgagctcatcgtacacccgcgcgtgcaacgggacggataccgcggcgagccccggtgggagccgtacgggcggacgttggagcgggctccctttcccgtcgcctacaacggaaacatctttggcgtcgccgattttgaggcgctggtggatgcctacccgacgacccgccacgtcatgctgggccgcggcatcgtcgcgaacccggccctggcgaggatgattggtgggggcccggcgctcggcatcgatgagctcaggcggttccacgacaggctgttccgggcgtacgaggaagagatcggcggcaatgccgtgttccgcatgaaggagtggtggtcctacgcaaaggacgactttgcggacccgcacaaggtgatcaaggcggtcaggaaggccaggggcgtcgccgattacgaggcggccgtcgagcgcgtcttcaacaccgcggagcttgcatagaggaagagaagaacggggcctgccggcggaaggctccaccgacaggcccctggccttgctatgtgcgtggccgcgacgcggccgttacccctagtagagcttggagcccgcggggatggacgggtcgaccatcagcaggttcaggcgctcctggccgtcctcctcgtggatggcggaaagcagcatgccgcacgactcgatacccatcatcttgcgcggcgggatgttgactatcgcgaccacgttcttgccgatgaggtcctcgggctcgtagtaggcgtggatgccggagaggatcgtgcggtccgtgccggtgccgtcgtcgagcgtgaactgcagcagcttcttgctcttggggacggcgacgcagtccttgatgtggacgacgcgcatgtcggactggctgaagacgtcaaacgtgacgccctcggcgatcggctccacggtcacgccctgcttggcctccgcgggggcctcggcaggggcctcggaaccctcgtccttctcgtccttctcgtcctcagcacccttggcgtagatgtcgcccacgggggcgatggccttcatggcctcgagcacctcgttgagggcgtcgttgacctcgaggccgttgtactccgcgcccaggcgcatgacgtcgcggtcgcagccggcggcgaagcgcttgtccttgaacttcttcttgagcgacttgagcggcatgtccatgacggagccggacgggcgcatgtgcgcggccgcctggatgaggccggagacctcgtcgcactcgaagaggaccttctccatcttgagctcgggcttgggcaggtcgtggttcatgtcggagttgtgcgtcatgatggcgtgcgccaggtaggggttggcgcctgcctcggccaggagctcggcggtcttctgggtgtgcagctggtcgtcctgccacatctcccagtcgaggtcgtgcaggaggccgacctggccccagaagtccacgttctgcgggtcatacttctgcgcgaagtggcgcatgaggccctcgagggtctccgcgtggctcacgtggaacgggtccttgttgtacttggtcacgagtgcgaaggcctcgtcgcgggtgagcccgctgtcaagcttgtccccctcggcggccttggcgtcgatcgcggccttgacggcgtcgctcatggcaccctcctcctgggcaggggcctcgtccttctcccccgccgcgtcgtttgcgtcggcctcggccggcgcatccttctggtcctgggcctcggcctcggcggtcgcgcccttctccgcattggagaagagcgagtccacgttggcggcggcgttgtccgtgcgtgcgccgctgacctggcgcgcgatgtcctccttggtcacgacctccggcttcatctgcgggaagagcagcacgtcgcggatggagggctggtcgcagaacagcatcatcatgcggtcgatgccgtagccgatgccgcccgccgggggcatcccgtactcgagggcgcgcacgtagtcgtagtcgtagcccatggcctcgtcgtcgccaaagcccttggccgcgacctgctccgcaaagcggccggcctggtcgacggggtcgttgagctcgctgaacgcattggcgtactcgtggccggcgatcacgagctcgaagcggtccgtgatgcgcgggtcgtcgtccttgcgcttggccagcgggctgacctcctccgggtagtcgcacacgaaggtggggttcaccagggtctgctcgcccagctcgtcgtagagctcgaacagcagcttgccggcgccccagttctcctgccactcgataccgtgcttcgcgttgagctcgcgcaggtgctcgatcggcgtgtcaatggagagctcctcgccgcagacctcggacgcaatctccgccacggtcgcggagcgccaggtgccggacaggtcgatctgctggccctggtacgtgatgacctcgtggccctcctcgcagccgcagacctcgcgcgcgatggtcttgaacaggccctcggtcagctgcttcatgccgtcgaggtcgctgtaggcgcagtaggcctccatggacgtgaactcggggttgtgcgtgaggtccatgccctcgttgcggaactgacggccgatctcgaacacgcgctccatgccgcccacgatgaggcgcttgagcgggagctcggtggcgatgcgcaggtagaagtcacggtcgagcgcgttgaagtgcgtgacgaacggcttggcgttggcgccgcccaggatggcgtgcatcatgggggtctcgacctcgatgtagccgtcggactccatgtagcggcggatcaggctcacgatggcgctgcggcggcggaacacgtcgcgcacctcggggttcatgatgaggtcgaggtagcgctggcggtagcggatctcgcggtccgtgaggccgtggaacttctcgggcagcgggcggaccgacttgctgagaaggacgaggctcttgggcgcaaggctgagctcgccgcgacgcgtgcggacgacgttgccctccgcctggatgatgtcgcccatgtcgagcttgcgcagcagctcccagctggcctcgtccatgtcgttgacgcggcagaacagctggatcctgcccgtcacgtcctcgagcacaacgaacatgagcttgccctggccgcggatcgcgcggatcctgcccgcgagggagtacgtgtcctcggtgtcggcaccagcctcgaggtcggcgtacttctcctccaggtccttggcgtgcgcggtgaccttgctcttgatgggatacgggttgatgccggcatccatgagcgcctgccgcttggctcggcgcaccgccagcacgtcgttgatgtcaacctcgggcgcgttgctcgtctggtccattctcttctcctacgctcctttgcgtctctgttgcgcttgcgtcctcaacgcggtcgcccgccgccgctcgcgtaccaaaagcgccccaaccacacagggcttgcctgcgcagtggggcgcgatgcggttccgtggcggcgggtacgtgctatcgcgtgatgttcacgatcttgtactcgcgggtcttgcccgtgggggtgttgaaggaaacctggtcaccaaccacgtggccgatgagcgccgcgccggccggggactcgttcgagatcttgtggttgagcgagtcggtctcggtggtgcccacgatggtcaggctcaggtcgtggccgttcttgtcctcgagctccacggtcgtgccgatggagacggacaggtgcgcgtcctcgccggccgcctgcaccttggccgtcgccaggatgtggcggatctcgttgacgcgggactcgttctgggactgctcctccttggcggcgtcgtactccgcgttctcggagaggtcaccaaagccgcgggcctccttgatgcgctcgacgatctcgtcgtgcttctcgccctcgcggtactcgagctcctcgaccagcttctggcggccttcgggggtaaggatgatttccttgtttgccatggtctgctttcttcctcggtgggcaccagcgggcgcccgtgctgcgtgttgctacttggagaggggcttgccgcacttggagcagaactccgcgccggcctcgttcttgtggccgcagtgcgtgcagtacacggcaccctcgtcggcagcgtccgcgtcggactcggcaggctcctccacgacgtcctcggcggtggcgtcagcggcgggcttggcgtcctcgaccttcttgtcggagtcgtcgccctcctccatgccctcgcggacgttcttgacggtcttgccgagcgacttgccaagcttcgggaggttcttgggcccaaagatgaccaggacgacgaccaggatcaaaagtagctccggaactcccattcccaaaatcattgcaaatcctcccaatgggttctgccaacaggcgcgttctgtcttattggtgcttcttcgtcggataatgacgcaatggttagtataaccaaagcacctgcgtactcacaatctctatcgcccatttccccaccctgcgcgggagcgacacaggaggcagcaaccacatgcaaggcatccccgcgccgctgcgcatcgccatcatcgtctgcatcgtcatcgacgtcgtgttcgtggtcttcatggtcgtgctcaggaagcgcggcgtctacgtcaagccccacaccatgtttggacccgcgctcgtgttcgactcgcaggacgacgacggcgtccccatccgcctgctcaacgtcaacggcaagtaccagtccgtcagctacgtgcaggacagcctcaagtaccgccttgtctgcgtgtaccaccgctactttgcgcagatagtcgacatcgcgggcctccaaggcgggcgagaaggacgtgccctcgtcatagggggcggcggctactcgtttcccaagtggctcgtgagcgagtgccccaacctacgcacgacggtggtggagatcgaccccaagatcacccagatcgcgcgcgaccacttcttcctgaacgacctcatccgcgactacaagacggagtccacggggcgcctggacctcgtgacggacgacggctggggctacctccagcactccgaccagcgcttcgacctcatcgtgaacgacgcctttggcggcaggaagccgctcggcccgctcaagacagacgagggcgcccgcgccgtgcgggaccacctgacggagaagggcgtctacctggcaaacgtgatcgcgccgctgcaggggcgcgggcgcgaggtgctggacgagtcgctggcggcctgcagggacgccttcgagcacgtctacctcataccggaggcgcccgagagccccgagctcacgggcgacaacgtcctggtggcgagccggtacgcgctcaagatccagaggcagtacgtggtcaagtaggcggcgggccgggacagcgggctggcatcgccgtgcagtgcatggctatgcggcggccacggccgcgcgggcttctcccccagcgctaaccgatggtacgcatgagcttggacgcgacctccgcgtggcgcttctccggcacggggacgcgcgtgtcgtccgtcatgacgacctcgcggcgctcgatgagcgagacatagctggggttcacgatgaagctgcggtgcacgcgcacgaagccggagccgagcgagcgctccacctcggacaggccgatgctcgcctcgtagtcgccggacaccgtgtggatgatcgtgtgcttgcggcgcgcgcccacccagaggatctcgttgagcgagacaaagcggatggggccgttgacgtccgggaagaccaggcggcgcttgtcgctctgcgcggcgatgcgcgcctccacgtagcggcgcgtcgccttgttgagggcgtcggcctgctccgggctgtcggggttcacgcgcttgcgtggccagctcacgaacatggagacgatcctgagctcgcccatgcggcgctcccaggtaaactggcagcgctcctgcacctggtggaagaggcccttctcgccatcgaccgtcacgacgtagcggcccacgacggagcatgcgtcaccgcagttctgcaccaccgtgaactgggcctgcgatatgtgcgccggctcgatctcgcgcgcggcacgcgtgaagtccgccgatacggaatcgataccgcgcatataacggccctcgtccggggccacccacatcacgtcatcactgcaggagcccagcacgatgctgctgtcgccctgccagaagctgaccagcgccgcctgggttaattcgacacagcgccgctctatttcctttttcatgtcgcaccgccagtgtcaaaaaccaaccgtgcaaccaatttatgcccacatgtaacgtggtggttatctcgctggtaccaaaaacccgcgaatgggaaccagtgtgcgatttcatataaacaatatggcaaacggcatcgattccgccccagacgttcttctcgctcgattattcccaccgcttacataggattttgttacgagacggttttcctacttgattgctagggattcaagtgccaccatcttgcccaagcgagttaccacgcacaaggcgctgtttacctcgccaccagtccttacaggaggaaatagaaccatgaagtacgcagctaagaccgaggggctcatcggctccaccccgcttgtcgacctatccgccctggcggacggcaaggccacgatcctgggcaagtacgaggccaccaaccccggcggctccgtaaaggaccgcatcgccaaggccatgctcgacgcggccgagaaggacggctccctcaagcccggcggcaccgtgatcgagcccacgagcggcaacaccggcgttggccttgccatgctctccgccgcgcgcggctacaagatgatcctcgtgatgcccgagaccatgtccgtggagcgccgcaagctcgccgcgtcctacggcgcgcagatcgtgctcacccccggatccgagggcatgaagggcgccgtcgccaaggccgacgagctgcacgcccagacgccgggctccatcgtcgcgggccagttcgtgaaccccgcgaacccgcgcgcccactaccagaccaccggccccgagatctggcgtgacaccgagggcgccgtcgactttgtggtcgcgggcgtcggcaccggcggcaccatctccggcacggccaagttcctgaaggagcagaagccctccgtccagggcatcgccgtcgagccggccgagtcccaggtcctggcgggcaagccggcaggcagccacaagatccagggcattggcgcgggcttcgttcccaagacctacgacgcgtccgtggtggacgaggtcgtgcccgtgacctccgacgacgccatcgcgaccaagaagcagctcgcgaccgactttggcgtgctcgtgggcatcagctccggcgcagccgtcgctgccgcggtcgagctggccaagcgcccccagaacgccggcaagaccatcgtggcgatcctgcccgacaccggcgagcgctacctctccatggacctctaatggacgcgaccattgcggcagcctcccccaaggcagccgcaagcctcggctcccacgcatccaagggcgagaagaacctctcccttctcgcgcagatgcgcgaggacgccgaggccgcgttccagcgtgatcccgcggcggactccgtgcgggacatcgtgctcttctccaccggcacgcacacatgatttgagcccctcattcgggacctcggaccacgtccggggtcccgttttgcatgcgcccgcaaccaaggcggcgcgtacttctcccccgccgcggccgcacggctggtaaggtatccgcaaggcagcaggcaaacgcaagggagaagaacgtgagcgcactgatcgactatcttcttgagccgcagacggccgtggtgtttgacatcgacggtgtgctggcggtgtacgagtttggcgagctggggcacagcgctgtgcccgacggcgactgggaggcctacgtccgcacgcacgacccgtacgcgagcagccgccccgtggcggagatccaggagtttgtgcggcgcaaggggcctgagcgcgtgtttgcctgctcggtggcgcaggacttcgaggcgcccggcaagcgcgccttcgtgtgcgccaactacggcatccctgccgaccacgtgcggctggtgccggacaagccgctcaagacggccttcctgcacaaggtggcccgcgagctgagcatccccacgcggcgcgtcgcgctggtggaggacacggtcaagacgctcgacgccgcctgcgcggagggcttcacgacggtgcacgtcacgtcgttcttcgacttcgggcgcgacgggcgctaacagccgctgcgggcaggccgtcctgccgaggcatgacaaagcccgcgtcgccgaaaggggaagcgacgcgggcaagggagggaaacacgtaagaagtcgtgggcccgaggcccgtggtgcggccggccggcgggtccctccggccgtcctggggtcacgcgggcgagaagttcgccagtccccggttgaagccgaagctagaactcgaggttcttctcgtccttcttgctgaagaggtggatgacgtcgccgtcgaacgtgaaggagaccttctcgcccagctcgaagccgccgcgcttctcctccttgaggtcctgggtctggacgatcacgatgacgtccttgccgagggtgttgaggtgcaggtggatggaggagcccatcatctcggagacgtcgaccgtgcccgtgacgagctgcggcgcgtcgtccgtgagggtgacgtgctcgggacggatgccgagggtgacgtcctgcggctcgacgttctgggccgtgaggcgcttctgcttggcctcgttgggaacgaaggtcgcgtcgcccacgatggccttgtagacgccgttctccttgacgagcttggcgtcgaagaagttcatctgcgggacgccgatgaagcctgcgacgaagaggttcgcggggtggtcgaagacctcctgcggggtgccgacctgctgcacgacgccgtccctcatgatcacgatgcggtcgccgagggtcatggcctcggtctggtcgtgcgtgacgtagatgaacgtggtgtcgatgcgctggcggagcttgatgatctctgcacgcatctggttgcggagcttggcgtcgaggttggagagcggctcgtccatgaggaggaccttgggctcacgcacgatggcgcggccgatggcgacacgctgacgctggccgccggagagcgccttgggcttgcggtcgaggtactgcgtgatgccgaggatctcggcagcctcgtcgaccttcttgtcgatctggtcctggggcatcttgcgaagcttgagggggaaggccatgttctcgcgcacggtcatgtgcgggtacagggcgtagctctggaagaccatggcgatgtcgcggtccttgggggccacgtcgttaacgagcttgccgtcgatgcgcagctcgccggaggtgatctcctcgaggcctgcgatcatacggagcgtcgtggacttgccgcagccggaggggccgaccaggaccacgaactcgcggtccgcgatctcgaggttgaagtcctcgaccgcgaggacgccgccctcgacctgcttgaggttgctcttcttcttttcctcttgcttcttcttgccgaagtggtgcttcttctcaccctcgatgttgggatagatcttctcgatgtgcttcaggctaaccgttgccattagcgtctcacgtcccttccatagatatgggtcattgcggcgatgcgcttagtgagcccgggcgtgatctgccccggcaaaagcctccactgccagttcccacccagggttccgggaaggttcgtcctcgcctcgggacccaactccagatagtcttgcatttgcgccacgaacagctccgcgacgctggacatgccacccctgatgacgccccaggagaagccctccgtctcgttgaggccaaggtacgtggtggcaagctgcacgtccgcctcgtcagcctcgcgacgccagccctcgagggtctggttgtcgtgcgtgccggtgtagcagacgcagtgcggcgaatacgcgtgcggcaggtagtcgctcacgtcgcgggagtcgaagccgagctcgagcaccttcatgcccgggaagcccgaatccgccaggagctgcctgacctcgggcgtggtgtagcccaggtcctccgcgatgaagctcacgttcttgaagcggcgcttgagcgtcccgacgagcttcatgccaggacccttgacccaccggccgttgcgtgcggtcttgtcgccgtacggcacggcccagtagctctcgattccgcggaagtggtcgatccggatgctgtcgtagaggttggccgcacccgcgatgcggcgcacccaccacgcaaagccgtccctctccatcgcgtcgtagtcgtagagcgggttgccccagagctgcccgtcctcgctgaagtagtcgggcgggacgcctgccacctcgatgggcacgttcttctcgtccagctggaacatgtcggggttggcccacacgtccgccgaatcgagcgccacgtagatggggaggtctcccaggatctgcacgcccttgctgtgcgcgtagcgcctgagctgctcccactgcgtgtagaagaggaactgctcgtactcgtagaagtcgatgtcgtctgcgagctccctggtgtagcgggcgacggcctcgggcttgcggagcctgatgtcaacgtccggccactcgatccaggagaccatgccaaagttacgcttgactgccatgaacagcgcgtagtccgcgagccaggactcgttctcctgcttgaactcggagaagagccgcttctggcggtcgcgcccgcgcttgtaggcgagcctcagcaggggctctcggttctggtagagaagggcgtagtccaccttggcggggtcactgccccagtcgggggcctccacctcctcggaggtgaggagaccgtcctcgaccaggtagtccaggtcgatgaagtaggggtttcccgcgtaggtcgaggggctctggtacggggagtcaccgtagctcgtcggcccgacgggaagtatctgccaccaggactggcccgcctcggacaggaagtccacgaactcccgggactccctgccgagcgtgccgatcccatgcggcgtggggagcgcgtagatgggaaggatgatgccgcacgtacgatccatgattgcttagcccttaacggcgcctgccgcgacgcccttgatgatgtacttctgcagcgcgaggtagaagacgatgacggggatgatgctcaggaggatgagcgccatggtcgcgccgaggtcgaccgtaccgtagctgcccttgaggtactggatgtggatggggatggtgcggtacttgttgatgtcaagcaccagatacggaagcaggtagtcgttccagacccacatgacttccaggatgccgaccgagatcagcgtgggcttcagcatggggagcacgacgcggaagaaggtacgaatcgggccgcagccgtcgatggaggcagcctcctcgatctcgatggggatggacttgacgaagccgacgaacatgaagatcgcgaggccggcgccaaagcccaggtagacgatggggatggtgaacggcgtgttgagctggagcgtgtcagccgtcttggagagcgtgaacatgaccatctggaaggggacgaccatggagaagatgcagaggtagtacaggatcttgcagaacttcgagttcacgcgcgcgatgtaccaggcggccatcgagcagaagaacaggatcaggaaggtcgagagcaccgtgatgatcacggagttggccacggccgccatgaacgggtagttgccgaaggtcatgccctttatgaagttcgaccagccggccgcactctgcgcgttgggcagcgcgaaggtctcggtcttgacgaaggtgttcttcttgaacgagttgatgacaaccgagacgatgggcagcacccagatgatgcagatgatggtgagaataacagaggcaatggtcttgttgcgcttctcggacgtaagagtctcctgcttggaagccattactgctgcacctccctcttacgggtgtacgaaagctgcgcgaggccgagcaccgcgaccaggatgaagaagatgacggcctttgcctgcgcggtgccacgtgcgacggaggcggttccgtagaacgtgttgtagatgttcagcgcgagcatctcggtctggtggatcgtgtcgccgctcgcaagctgcttgaacggctggccgccggtgagcgcgaggttctggtcgaagagcttgaagccgttggtcagcgtaaggaacatgcagatcgtaatggaaggcatcacgttcggaatggtcaccttaaagagtgtctgcgacttggaggcgccgtcgatcttcgcggcctcgagcatgtcctcgggcactgcctggagacccgcgatgtagatgatcatcatgtagccgatctgctgccagcagacgaggatgacgaggccccagaagccgagcgtcgagttcatgacgatcgaggtgccgtacctggagaggatgccatcgaagatcatggaccagatgtagcccaggacgatgccgccgatcaggttcggcgcgaagaacaccgtacggaagatgttgctgcccttgatgttctgcgtcaggacgtacgcgacggcgaacgcaaggatgttaatcaaaatgacggtcacgatggcgaacgccgccgtgaaccagaaggaatacctgaagctcgggtccgcaaatgccgccgcatagttcccaagcccgatgaacttggcgtcagacgtgaggcggaactggcagaaggacagatagatgccttggatgaacggccagacgaagccgatcacgaaggctgcggtcaccgggcccaggaagaggagtccccagtgcctgatggacctgatcctggagttcgatgccgtaatcttttttacttttgcactactcatataacgctccccaatcatgaccacccgcatagcgggtggtttgctcttagggtataaccctagagttccggccagggactcaagtccctggccttcacttcgttcaggccctatggccgcttgactcgtggcgtgcccg

SEQ ID NO: 217 - DNA, 17933 bp, Unknown
  Metagenome-assembled genome
tgttcttctcccccggctgttacaggagcctgagcgagacctccttgagctgcttgcccgagacctcggacggcgcggagctcatgaggtcggagccgctcgccgtcttggggaacgccatgacctcgcggatgttgtccgcgccagcgagcagcatgcacacgcggtcgaggccgagcgcgaagccgcccatgggaggcgcgccgtactcgagcgcgttcatgaggaagccaaactgcgcctgcgcgcgctccggcgtgaagcccagcttctccaggatcttctcctgcagcttggcgtcgtggatacgcatgccgccaccgccggcctcgtagccgtccatgacaaagtcgtacgtgtgcgagcccatggccagcgggtcgctgtccagaaggtcgagctggtcctcgttgggctgcgtgaagggctggtgctcggagtccaggcacttgcggtcctcgtcccagtggaacagcgggaagttgacgacccacaggaagtcgtgaccctcgcgcggcacgtcgagcgcatcggccatgtggcagcgcatgccgcccagaatctcgtccgcgtgcaggcggtcggccaccgcgaacatcacgaggtcgccgggctcgacgtccatctcggcacgcagggccgccatctcgtcgtccgagaagaacttgacgatggggctcgtgacgctgccgtcctcgcggaaggcgatgtaggccaggcccttggcgccaaactcggcggccacgttggccagcttgtcgatctgagcgcggggccacttgccggcgcccttggcgttgatggccttgacgtactggccctcggtcgccgcggcggacgagaagagcttgaacttggagttcgcgaagatcggcgtcacgtcgtgcagcgtcatgccgtagcgcgtgtccggcttgtcgattccgtaggtgtccatcgcgtcccagtactcgatgcggcgtaggggaagctgcagctcaacgcccatcttgccaaaggccttggcgagcacctgctcgagcgcgcccatgacgtcgtcctgggtaacgaagctcatctcgacgtcgacctgggtgaactcgggctgacggtccttgcgcaggtcctcgtcgcggaagcacttggccacctggtagtagcgctcgacgccgcccaccatgaggagctccttcaggagctgcggggactgcggcagcgcgtagaagtggcccggctgcatgcggctggggaccaggaagtcacgcgcgccctcgggcgtggacttgaagagcgacggggtctcgacctccatgaagtcgctgccgtggaacgcctcgcgcagcgcgaaggtgaagtcggagcgcagcttgaggttggctgccatcttggggcggcgcaggtcgaggtagcggtagcgcaggcgcacgtcctccgcggtgtccacgtggtcctcgatctggaacggcggggtctttgaggtattcagcaccacgatcttggtcacgtacacctcgatggcgcccgtggccagcttgtcgttgtcctgaccctcgggacgctcgcgcacggtgccgctcaccatgatcggccactcggagcggatggtctcggcctcgtggaacgtcgcctcgtcgcacacctcggggtcgaactcgagctgcgtgacgccgtcgcggtcgcgcaggtccacaaagatgagtccgccgtggtcgcgacggtgccacacccaacccgtgagcgtgacctcctcgccgatgttggcctcgcggagctctccgcaggtgtgcgtgtgcatgctaaacgccatgttgttcctctcgtctcctccgccccgtgccgtgacgggcggaccagcagatgacggcacgccaacgtagacggcggcggcgtgcgcggtgccccattctagcagcgttgcgccgccgccacggcgcgccgcaaaaagctcccacgctttgaaacatttccacgcgcggaggggcgccaaccgaggggccgcgtccttctcccccgcacgcgccgcgttgtcagataaccaataaacacgggacgagaaggacgcggcaagccttgtgccagccacacgtcagctgcaggtcaggtacctgtttccaaaagatttcaaccgtatgcggattccttcttgcaagtatgcttattttggcgtatgggccaaatgccaaagtttcgacatacttttctggtaacgtttccgagaccgccggaaacccatgcagacaatctcaagtaaccccggcacccaaacgcgcagaggcaagcgctggagagggcatccgacccctcggaaagaggcaatcatgacttacaaggcagctatcttcgacctggatggcacgctcctcaacaccatcgaggaccttcacacgtcgatcaactacgcgctccacaccaacggcttccccgagcagaccctggagcagaccacgtccaacgtgggcaacggcgtgcgccagctcgtgcaccgctcgctgcccatgggcacccccaccgaccaggaggagcaggtcttctcgaccttctccgcgcactacggcaggaactactgcgagaagaccgtgccctacccgcgcgtgatggagatgctgcacgcgatctccgccgcgggcatgctgcgcgccgtcgtgtccaacaagccggacgccgcggtccagaagctcgtcgcgatctacttcccggggctcttcaacgcggtcgtcggcgagcgcgaggacatccgtcgcaagcccgcgccggacacggtcgacgccgtgatggaggcactgggcgtcactccggacgagtgcgtgtacgttggcgactccgaggtggacgtggacaccgcgcgcaacgccaagacggactgcatctgcgtgtcgtggggctaccgcggcaaggccgccctcaaggacgccggcgccaaggtcatcgtggacgacgcggaccagctggcggacgtcctgctgggcgagtaaccaccggcggcgggcggctcgcgcggccaccgcacgacagcacgactaaaagcaaggcggcgctcccggggattcccgagggcgccgcaatttgtgcccttataccccaccttcgcaccgagtttcaccaaaagcgaagcccttacgtccacgtacggaagcgcaacgctgacctaaccaaacccgcggccggcgttcgccgcgcgcgccctgcggtaagatgcacacatccgatggtcagatccttcgagaaaggatgcgatatgggaaagaaagcagctgaggcactcgacataaattacgaagaccttgccgactacctgcacaagaaccattccgtctacatgaaggtcggcaacgacgtctactacctcacggacgtcaactacgaggcctggcgcgcacaggacaccagcgtccgcaactccaagaaccactttgtcgactgcagcgaccttgttgacacgctcgacgagttcctggcacttcccttcgtgaacggccacaccatcaaggacgtcttcgactccgcaacgttctacgcctccacgccgggcgtcaagcagccgtagcgttgccagcacgccacgcgtgcgccacatacaagagccaggggccgagaagatcgctcttctcggcccccttccttaccttggctgcatgcgacggacgcccgcggccccgccggcagcatgcctggcgttggccgcgggcgccggcgctggctactcgctcttctcggccgaatcggctgccggggccgcggtgcccttggtggcctccatggactccgagacctcgttgtcctcgtcctccttggtgaagcccttctcgagcacggggacgagcatgcggtacgagttctccgtcgcgttgacgtgcggagagcgctttgcgtagcgcttgaccgcggcggcggagcggttgatcgccacgagcgtgcccgcgccggccacgcagccgcccgggcaggccatgccctcgatcaggtagccggggtacttgcccttgacggcgtccttcatcatcttgcgacagtctgccaggccctccgcgttgaccacgttgacctcgcggtccgggtagcggcggtggatcgcgttcacgacggcggtcgcgacgcctccggccacggcaaagttgcggccgtcggttgaggccacgtcgaagtcgctcttgttgtcgtccgcgagcgacaggtagtcgatgcccttggcgtccatcatgccggccatctcctcaaacgtgaggacgaagtcgacctcgctgcggacgctcttgcgcatggcctcgagcttctttgcggagcacggccccacaaagacgatcttggccttggggtgacgcatgcggatcatgcgcgccgtcagcgtcatgggcgtgagggccatgctgatgcagttggcgtggtccgggaactcgcgctttgccatgaccgaccaggccgggcagcacgaggttcccatgaacggcagcttgtccggcacctcctccaggaagtcgtccgcctcctggatggtgcagaggtcggcgcccagcgcgacctcctccacgccggagaagcccagcagcttgaaggcctcgcgcagcttgcccacgttgcccttgccgccaaactggcccacaaaggccggcgccacggccgcgatgacctcctcgccacgcgcgatggcccagatgacctgcgcgatctggctcttgtccgcgatggcgccaaacgggcagttgatgaggcactggccgcagctcacgcacttgtcgtagtcgatgtccgcgcggccgtgctcgtcagagccgatggccttcatgccgcaggcgtccgcgcacgggcgcacgtgatggtggatcgcgtggtacgggcacgtcttgtagcacatgccgcacttgatgcacttctcctggtcgatgtaggccttcttgtccttgaaggtgatggccttcttggggcagatctcgcggcaggggtgcgcgaggcagccctggcaggtgttggtgacctcgtacacgttgtccttgcaggcgttgcacgcgaacttgatcacgttgatgagcggaggctggtagtagacctcgtcgctgttggcggccttctcgaacccctcgctcacgcgctccggcttgtccatgctggaaagcggcaggcccatggccaggcggatgcgctcgctgatgatcgcgcgctccaggaagacgctctcgcggtacgtggcgacgtcgcccgggagaatcttgtacggcagctcgtcaaactccttgtcgagctcctccgcggtctctccgcccgcgtcgagcttgtagcagatcttggcgacctcgcgaaacacgctgcgcctgatgtccgtcaggttggtgtacacgcctcgcatggtatcggccatgtcgacccctctcctaggtgacccaggtgagcgcccgcggcgcgaccccccagccgcggcgcgcgacgcacgcattcccctacattttagcctcgcgacgcgctgccaaggtcctcctcgccaaagtacgcgtcaaagcgctgcggccatccggcgcaaatgctgatcttctcccccgtgacggggtgcgtgaactcctcctggtacgcgtgaagcatgagccccgggcgagaaggaccggcgcccccgccccgcgcacgcccatagagcgcatcccccacgatggggtggcccaggtgcgcgaggtgaacgcggatctggtggcggcgaccagtgcccagctccagctccacgagcgagcggccgccgcgctggcacagcgtgcgcaccatcgtaagcgccggcttgccagacgcggatacgcgcatgcggcgggcgtcgtggcggtcgcggccgatgggcgcctcgatcctgctcaggtcccgcggcagcgcgccctcgacaacggcgaggtagcgcttgtgcatggcatggcccgcgaccagggcgtcaagctgcggctggaactccgtcgcgagcgagaagagcgtgacgcccgcggtctgcacatcgagccgctggacggcctgcggcgtggccggcacccccgcggccgcgagccaggccgcgacccagctcgtgagcgtggcagcacccccaccgtccgagtgcaccaggatgccggccggcttgtccaccgccatgaggaacgcgtcccggtagagcacgcgcggctccgccacgcctgccggcaggtgcgccgccgccggcgcgtcgccaccgccgcgcgcgagccgcagcgtcaccacgtcgcccgtggccaacgcgtccgtacgcgcgaggggctcgtccccacgcagcagcgcgcgcccggcaaacgcgcgcgccagcacgggcttggagcagtccatcgagcgcagcagcccctgggcgtcacacggggcggccacctccaggcggagctcccgcgggccgccggccgaaccgtcgctcgcgcccaggtagcgggccacgcgcacgggggcgcgtccttctcccccggcggcgcccgcggacgcggggcccctgcctgcggcgctcatgcccgcacgcccctcgcgacgttgtccgcgtcgagcctcagcatcgcgctttcgcccagggcgagctcgtccgccagcagctcgtagaacgccagaatcacgctccacacgtggtcggagtcgcgccaggcggcggatatggtgatcgcggcgtcgtcccccaggcccacggccgtgaggcccgcctcggggtggcggcccatggcgcccaaggccagcgcccgcggcacaaagcaggcgcccacgccgcgcgcggccaggtccatgagcgtctccgagttcttggagaagacccggttccacggcttgacgccggagcgctccaggatgcggcgcgcgatggcgcccggctcgtccgccttgccgagcatcatgaacgggcagcgcgcgagcggcgccaggttgccgcgcgcggcctcgcgacgggcctcgtcaacgtcgtcgcaggactcccgcagcaggtcctcggtcaggatgagcacgatcttctcgcggcagaggcgacgcaccaccaggccgggctcgtcgtcgggcaccgtggccacggcgaggtcgacccgcccctccttaacgaggctgatgagctcctggttttccgactcgtgcagcagcacgctaatgccggggtgctcgcgctggaaccgcgcgagcgttgcgggcatgagcatgtgcccgcgcgtgctggcgatgcccacgcccaaaaggccgcgctcgtccttggcgatgtccaggaactcctgccccatcgtgcggcgcagcgcctggaagcgccgcgcgtagcccaaaaagacgtcgcccgcgtacgtgagcgtgagcggcaccttgcggttgaccagccgcacgcccagctcgcgctccacgccggcgatgtgcgcggacagcgtctgctgcgtcacggagagccgctcggccgccttggtgaagctcttctcctccgccagcgccacgaagtagtccatggtcgagaagttcatgcgctgcctcccgggacggacccatatcaccaaaatttcttgtgtctgataccgataataacagttggactccttatgaccaagcacctaccctatcgagctggaaagaaagggtctgcctgtcttgggacgggcacgaggttctgggagcaaagatggtcgaggccggggttcttctgacgttcgccgcggtgctggtggcaggcatcgtcctgagcgcgccgctgctgccgcttctggtgtttggcatgctgctgtttgccggctatggcatctggcgcggctttggcgtgcgcgacgtcgcgcgcatggccggcgtcggcctcaagagcgtgggcaccgtcctcacgctgttcgtgctcatcggcgcgctcacggcaagctggcgcgcagccggcaccatccctgccatcacctgctggtccgccaacctggtgagcccgcgcaacctcgtgatcgtgagcttcctgctcacggctggcatgtccatgctcgtgggcagctcctacgccgcggccgccacggtgggcgtcatctgcatgaccatcgccacggccatgagggccaacgcggccatggtgggcggcgcgatcctcgcgggcgccttcgtgggagaccgctgctcccccatctcgtcctccgccgcgctcgtggcgagcatcaccaagacgcagctgttcgacaacgtgcgccgcatggtgcgcaccggcgccgtgccctttgcgctatgctgtctggcctacctgctggcgggcggcgtcgcgggcggctccggcatggccccctcgttcgcaggctccttcgcgtactcgttcgacctcagctgggtcgtggcaatccccaccgtcgtgatcctcgttctgtcgctcctcaaggtgagcgtcaagaagaccatggtcgcgagcctggtgaccgcacttctcgtctgcgtcttcgtgcagcacgtgcccgtggccgagctccccgcaatcctcgtaatgggctaccactgcaagaacctggcaatcgcacgcatggtcaacggcggcggcatcgtgtcgatgctcgacatcgccctcatcgtggcgaccgcatccacgtactccggcatcttcgagggcacggggctgctcctgggcctgcgcgactacgtcaacaagctggcacgccactccacacccttcgtgagcgtcctcttcacgagcatcgccacctgcaccatcgcgtgcgaccaggtcgtcgccctcatgctgaccgcgcagctctgccaggacactgagcacgacggatccgcgctcgccctcgacctcgagaacagcgccgccatcatcccgtcgctcatcccctggtccacctcgtgcgtgggcatcatcgccttcgtgggcatgcccatgacgagcatcctctggaactgcctgacctacctcatccccctgttgacgctggtcatctccatgtaccagcatgcgcatcagggcttcacggataccggctacgcacacctgctcggcctcgaccgcagggacgacgtcaggcgcttcccgagcgatggccagcgccgcggacttgccgcctaacacagcgcctttgcctggaacacatcgcaatggtccagacagcttcctcctaaggcagcgcgcccgccacgggaaaccgtgcgcgggcgcgctgtttgatacttgatgatgttcctgcgcttgggcgagaagagcggccctcctactggagcctctggccgcactcgccgcagaagttgtcgttagggccgacgggcgaaccgcagttggggcaaaagctcgcatgctgttcctgcggggcaggctccacctcaggctcggcaggcctctccagcaccgtggtgggagcgacctcctcggcatcggcctcatcggaagccgcaggctcgggctccgtttccgcgtcgacctcaggctcaggttcggactcagactcgacgacaggctcctcctgctgcgagggagcaacaggtgccgactctggagcggactccacgggtgcaggctccaccaggactgtcggcgccacagatgcgtcggacgcaaccgatgccgcaggcggaacgggggtagcgggaggctcggacgggctggtgaagtccgcgcccctctcgcccttgaggccgcgcaggtctcgcttgatgtcagaggtgttgcgcgcgatcacgatgttgaggatcaagaactcgttcacgatgcggcacagcagctcgagcaggatgcagacgatcgccatgacgacgagggtcccgaggaacgcgcccacgccgaagctgatggagctcagcaccacggccaggcagccgaacgcgatcatgagcgtgttgaagaggtacagcgccttgaggatcttgtcaatgagcaggacgtcaaagcgcaggaacgggccccacgaacgcttgtcggaaaggctcaggtgcatgtcgctcttgtccgagatgtagcgcttgtagcccatgacggtgagcacgatcgccgcgatgaacgcgatgagcatgagcacgcccagggcgccaccgaagttcgcccaagaagtcagagggttgccgtaggagttgtatccgtatccgtacatcatgagggtcccctttcagaccttcgctggtagcagtggccgggctatgccaggcgtgccttcacctcgtcggcaaggctcgcgagcggcacctgcacctgctcgtgcgtgcccatgtcgcgaagcgtcgccacgcctgccgcgacctcgtcggagccgagcaccacgcacaggcgcgcgttgtgcttgtcggcctgcttgaactggctcttgagcgagcgaccctggtagtcggcctcggtgcgcacgcccgcctgacggagggcaagcgtcgcgcggaacgcggcgtcgcgctcgtcggcaccggtgcacgcgacgtagacgcagcccggctcctcgccatccatgttcacgccgagcgacttgagggcaaggtacatgcgctcgaagcccacggcgaagccgatgcccggggtgggcttgccgccctcgagctccatcaggccgtcatagcggccgccaccgccgatggcgccaacaccagcgccctcgcactcgacctcgaagaccgtgcgcgtgtagtagtcgaggccgcggaccagcgtcgggtcctcgacgtagctcacgcccgcctcgcccaggtactgcttgaccttggcgtagtgctcggcgcaggcgtcgcacaggttgtccttggcaaggggcgcccccgccatgacctcacggcagtggtcgttcttgcagtcgaagctgcgaagcgggttgatctcggcgcgctccaggcagtcctcgcacatctcgtccttgtgggcgaggatgaagtcgcggaccttctcgcgataggcggggcggcactcggcgtcacccatcgagttgatgcgcagggtgagctgcttggggtcgaagcccatgcgcttgtagaactccatcagcatgatgatgcactcggcgtccgccgcggggtcgggggcaccaagccactcgacgcccacctggtggaactgcctcagacgacccttctgcggacgctcgccacggaacatggcctcgccgtaccacagcttgacgggagcgccgccctgtgggacgaagttgttctccaccgcggcgcgcacgacgccggccgtaccctcggggcgcatggccatgcgctgcttggccttgaggccgctctccgtgccggcgtccagcaggcgctccatgagcgcaccggagaacacgcggaacatctccttgcggacgacgtccgtcgactcgccgatgccgtggacgaaggtgtccacctgctcgatcgcgggcgtctctatcatgtcgaacccgtaggcgccaaacagctcgcgcgcaacgtcctgcatgtgctgccacgcgcgcatatatccgccgtacaggtcttccgtaccctgaatcctctgtgccacagtgggcctccttccgcgccttcagcgcgaccagggccgtggccacaaacaccgtgcggcgcacggtgccttccacggccgacgggtatgaagtatacgccgacgccggcgctccaccccgctacagtgcgacggcagacgcatcgcacacccaaaccattacacgctacgacaccccgcggacatctcgcaggtactggctgcacgtcatgctcctcacccgggagcccgcaaacgccttggcgtcgcgcgtgaggatgaagtccatgccctcgatttccgccaccgccctcacgatgccgtcctcgaagtcgggctcgttcgagcgcagtgccgcgtccagggtctccgcgctcacgggcgcgaggatgacgaagcccatgagctcccccaccaggcgccgcgcgtccttctcgccatgaaagcgattaagcacgtagtagacgtccttgagcgacatggcgcacgcgaagccgcggtctcccccgccgttgcagagctcgagtacgcgcctggcctcaacggactccggacggcgcctgtccagcacgtcgagcaggatgttggtgtcgagcaggaggtcactcatagcggctcgtcactatatcgcgcgcaccctcgcgcgtgagggagtcgaggccctctgccttgggcaggtcatcgcagtcccgaaagaagtccgccaggctcgggcgcgcgtgcgccgcggcctccctctggggaatcttccccgtgtccgcaatgttctggaacaccgtgcgaatcacgtcgccgggaaggacgtgcgcctgcgcaaggaccacgtccgcgcgacgcttgacgtccgcgtccaacctgccggaaacgaccacgcttgccatggggcctcccctcgccgtttacgtgtagacagcatagcgcgtgggcgagagggagacaagtactttttcgaacatacgtacgtaaattttgcgcgacggcagcttgtaggccagcgcgggctcgagcccatgcgggcgtggcccggtgcctgatgcctagcgcagggcctcgcgctcgtagtcgctcatcgggacgagccagccgtgctcgcgcagggcctgctctatagcgtccagcgtctcctcgctgtcggcgcgcacgtggtggaagtggtagccgctcgtgatgccgctcaggagcgaggacctgctgctccgcaggtcatccaggaagcgctccacgtcgcggcggctcgacacgcccaggtgggcgctcatctggccgtacgtgcggtggttgaccatcgtgtcctcgatggtgccgcccatgtcgactatgaggtacatctcgtcggccacctcgtcgtcgcggtggtgctccttgagcaggcggcagggccgggcgtcgcgcgcgagggagtagccgcggctcgtggagaccacggccgtgccgtccgcgcgcagcagcgccacgtcctgcacgatgacctggcggctcacgcccagctcgcgggcgagcgccgtgccggacacgggggcctgcgccccctccagcagctcaactatgcgcgcacggcgctccttgcccgtcatgctagcgtccctcctccaccgtgaggtgcttgagcgagaggtccagaatcggcgccgagtgcgtgagcgcaccggagctcacgtagtccacacccaggtcgaccagggtcgcggccttggcggcgtccacgttgccggacacctcgacctcggccctgccagctatgatacccattgcctggcgcatgctctcgtgatccatgttgtcgagcatgatgatgtccgcacccgcgtccacggcctcgcgcacctggtcgagcgtctcgacctcgacctcgatcttgcgcacgaagggcgcgtgctcgcgcgcggccgcgatggcctggcgcacgccgccggacgcatcgatgtggttgtccttcaggagcacgccgtcggaaaggttgtagcggtggttgccacccccgcccacgcgcacggcctccttctcgaacacccgcatgttggggcaggtctttctcgtgtccacgagctttgtgcgggtccccgcaaacagcgcggccatccgccgggtcagcgtcgcggtgccgctcatgcgctgcaggtagttgagcgcgaccctctcgcccgaaagcagtgcccgcacgtgggcgtgcacgcatcccaggtcctggccggcagccacgtcgtcaccctcggccacggtaagctccaccttggccgtggggtccagcagctggaacgtgcgctcgaacacgtcgagcccgcagatcacgccgtcctgcttggcgatcaggcgcacgctgcccgtggcctcgggccctatgaccgacgcggtggtgacgtcctcgctcgtgacgtcctcgcgaagcgccatgaggatgagcggctccgcctggagccttaggctgactgggtccatccgtgcctcctcctaacgatgtcgcgtgcggccaggcggctgaagaccaggctctcgagcagggagttgctggccagtcggttcctgccgtgcacgccgttgcagctagtctcgcccgcggcgtagaggtgcgccatccccgtcatggagttctggtccacatggatgccgcccatgaggtagtgctgcgcgggcaccaccgggatgggctcccgggtgatatcgtagccctcctcgaggcagcgctcatatatatgtttgaagtggttggtgcacacgtcgttgggcacgttggcaaacgacaaccacacgtgcttggtgccgtccttctccatctggcgcctgatggccgcggaaaccacgtcgcgaggctggagctcgtccgtgaagcggttgccgttcttgtcgagaaggacggccccctcgcccctgcacgactcggagatgaggaacgagcggccgggcttggtggtgtagagcgtcgtggggtgaatctgcacgtagtccatgtgctccagggccacgccgtgctcctcgcacacgcggcagccgtcgcccgtgaggcaggggtagttggtggagtgttcgtacaggccgcccacgccacccgtggcgaggaccgtgtcgcgggagcgcagctcgatcgggttgccgtcgcggtcgtgcgcgtgcacgcccacgcaggcgccgtcctctaccagcaggtcgtccatcgtggtgtactcgcggatctgcacgttgcgcagctcgcgcacgcgcgccagcagcttggtggtgatctccttgccggtcacgtccgcgtggtgcacgatgcggttgcggctgtgcgcgccctcgcgcgtgtagtccaggtcgccctcgggcgtacggtcaaactccacgcccaggcggatgaggtcgttaatgatctcgcggctggaccagatcatggtgtccacgctctggggccggcactcgttgtggccggcgcgcatcgtgtcgtcaaaccagtagtcgtagtcgtcgtggtcgcgcatgacgcagatgccgccctgcgcgagcatggagtcgcagctggccacgtcctccttggagagcatgacgatacgcaggtggcgcggcaggttgagcgccgcgtacaggccggccacgccgcagccgacgatgacgacgtcgcagttgaggctctgcgcctgccgggaggccgcgttcttctcgcccgcggtgggctgggcggccgtcgtgggggccgctgccgtctgcgcgctcatcgggctgccagctcgagcatgcgctcgagcggggccatggccctctccgcgtcgtcgggaagcgagacctcgccgaggttgccctccagcgcggccagcaccttttccggcccgaccatcgccatgttggggcagatgggcggcgtcgccgggaagtagatgcgcttgtcctggccggccgtgaccttggcgatctgtgcggccacgcccaccaccgtgagcacgatgaactcgcgcgcgctcgacgcggcgatgtgctcgattatctgcttggtggagccgatgtagtcggcctcgcgcaggacctcctgcgagcactccgggtgcgcgcagacctcggcgttggggtgctcgagctcgaggcgctcgacctcctgcgggatgatgcgctggtgcgtggggcagtagccgcggttgaggatgacgttcttctgcggcagccgctcggccacgtagcggccgaggttcatgtccgggatgaagaggatgttgtgctggggcagctcggatatgaccttcacggcgttggacgaggtcacgcacacgtccgaccaggtcttaatctgcgcggtcgagttgatgtagcacgccacggcaaggtcgtcgccatactgcgcgcggaccttgtccacgtcggccttgcgcaccatgtacgccatggggcagtgcgcgcgcggctcagggttgagcacggtgcgcgcggggttgagcagcttgacgctttccgccatgaacgacacgcccgccagcacgatcgtcttgcagtcgagcgtgcgcgcaagccgcgcgaggtagaacgagtcgcccacgtaatccgcgagctcctgcgtctccgcaggcacgtagtagtgcgcgagcacgacggcgtccttctcgccctttagctcctgcacccgccgagcgatgcggtccagctcctcgcgcgagaggtccgagccccgtccgctcctgaagcgacgcgtcgcctcgcgcaggctcgcctcctcctcgggagtcctgacgtagtcctccataacatcccttcccacaatgcgcccctctggcgctcactgggtcggcagtatgacacctgacaagacatgtgacaagtcagctgtcttgtcagtaacgcagatgagaagaacgcgggcggatgtgcaggaatccgtgtgcaagtgggcggtggcgaggtgctgggaaggcggagtggcgcgtggcggcggtcggtgggctactgccgacgccctacgatttgctcgcagaatgtaatggttagaaacttgcacgcaggatgtcacgtttaaggcctgttgaaggggcctaaacgttacatcaagcgagcaaatagtttaaacgttaccatctgcgagcatgtttgtttgtgcactggcaggcggtgcggacccccgcggcccgatcctgccctaccccaccagaaacccaaagccaaatccctcgctccacgaacggggcactttggtgcatttaacaaacttcggggcacttcggtacggttaagccccctcgtagagggcctaaacataccaaaatgcacagaaggattttaaccataccaaaacgccccgaagttcacggctgccgggctcggctgcgcccaccgccccactgccaccgcggcaggttgtcccacgtcgccacggggagtacagtcggacgagaagaacggcggcaccgggaggaagcatggcggaagcgagcaatccgaacgcagcaggtgcggcgggagcagcagacgcgggcagcgcggccggcgacggcaggggcaccttgggcgacgtgctgcagagggcggcggcgcgcaggatggcatcgctcgtcaaggccgcgttcgaggagcccgagcgcaggacgccggacgagtcgcgcgcgtacggcaagggcctgcgcgcggacttcccgccggagtcccaggccgtctggccgcccgcgggcgccagccgtccggacccgctcgagctgctgcagagccaggcccccagccgcgtggccgaacttctccccatccgctacgcgcggatggccgcaagccccttcgcgttctaccgcggctgcgcgctgcccatggcgagcgacctttcgctcacgccgacaacgcccatccgcgtgcaggcctccggcgacgcgcacatcgcgaactttggcatcttcgccacgccggagcggcagctcgtgttcgacctcaacgactttgacgagaccacgcgcggcccgtgggagtgggatctcaagcgcctggccgcgtccgtggaggtctgcgcccgcgacctggggctttccggctccaaggccaccaaggccgtgcgcgcctgtgtgggcacgtaccggcagtcaatggcgcagtttgcgcagatgggaaacctggaggtctggtacgcgcaggccgacgcccgccacatcgaggcgctggtcagccaggtgggaagcaagtccgaccgcaaggcgttcaagaagaccatcagcaaggcggagcgcaagaacaacgcccgcgcggtcgagaagttcacggaggtcgtagacggaaggctccgcatcgtgagcgacccgcccatcatcgtgcctgtgcgggacatcgccgcgaaggcgacggcgcaggacgacgccgcgagccgcatcggccagaggctcgcgcacgacgcgggcgtcacgccggaggacgcggcggcgcggctcatccggctcgtgctgcgcggctaccgtgactcgctcccgcccagccgtcgcgcgctgctggacgcgtacactggagtcgacgtggcgcgcaaggtcgtgggcgtgggctccgtgggcctgcgcgcgtggatctgcgtgttcgagggcgcaagcgagcacgacccgctggtgctgcaggtaaaggaggccgtgccctccgtgctcgagcgctacgtgggcaagagcggctacgccgagcagggccg

SEQ ID NO: 218 - DNA, 1019 bp, Unknown
  Metagenome-assembled genome
ccgacaaagctggcatgtatgacgcatcccgaagttcgctcgtcctgcagattgaccttgcaggcacagccgcgcagataggaaattgcggcaccctgacacccacgaggcagtcgcagcgcggcatcgtcctcttcgccaaaccacagatagcgaggcgttgtcccgggataaatcctttgatgcatcctctgcttcatgaagaactccgggttggccattgccgccagggcagacaaatccgcgaccataggttgcgacagctggtccttcctcagctgcaccatgccgtccagagtgacatccacccgcgatggcgcatgatcgacggccaccgcgccatcctgggccgccatgcggcccgccgtcaccatatcgctccggacggccaaactctttttactatcccgccgagaccgtcctctccccattccaggggcgacatagctctcggccagctcgtgcaccagggaagctggaaccttttccacggacgaaagaaacgcccactggtcgtcataggccacaaagtcgtcatccacaaagacgctgttgcccttccgaaccgcagcaccctgtaggggaagagctacgagattgcccaggccatcagaagtaatggtgtcttgcgtcgggaacagccgatcgtacgaatcgaacccgatcttcgagcagtgcctccgcgcatcatccagcagaagcgtgccgagcgtccgtgcctctgccgcaggcacctcctcctgaaagaacatccaaacgtgtgcgccgtgcccagaacgcgacctctccaccgcacagaagagctctcgtcgtcggcacgcgtcgcgatgcaccccggcggcttccttccacccgtcgtcatcaaagtccgcaaccagcagccagcaggtggtgatgtggctggccaatcctagacacgcttgagccggagctaccgaaagcccgacaatgtgccgagaggcacgaagggagctttcggaccatgagcaggacgacgaggagaaggtacgacccgcagt

SEQ ID NO: 219 - DNA, 3587 bp, Unknown
  Metagenome-assembled genome
agcaagggcggcaacgggatcgtcaagacgggagacctgatcaaccttgcgccggtcgctctgctggcgctcgcgggagccggattggcggtgatgggcctaagggtgcgcaagaggggcgagaagaacgcgcgctagggcccaggcccctgcgtgggttcggcaacgcccatcgctcacggttttggtaatcatgcggatgcgtccgctgaacggaagggatatgaaatgaagaagcacaacatcgcaagggcagcagtctccgctggactcgcaatcgccatgacctttggcggcatcgcgccggcgaccatggcgtttgctgctgacacgccggccgctgcgtcgaccatcaccatcagcaacgtcaagggcaacgagacgaacttcaagggctaccagatctttaaggctacggtcacggataccgacaatggcaagtccgtctccaacatcacgtgggctaacgaggacgtgaaggctgccgtcgagggcgtcatcaatgcccaggatggctcctacgccggcacgaccgcccaggacgcagctgactggatcactgctcatgtgactggtacgaacaacacgacccccgtcacagcggactcggttgctgaggccctcgcaaaggccgttatgggcaagacggcttcgaccactgtcaatactgctacggccgacaagaagggcaagacgagcgacgtcctcgattctggctactggctgttcgtgaccgatcctgactctgtcgacaacaatggcggcaagaagaataccgagacctacacctccccgatctttgctgtcatcggcggcaaggcctataccgtgaccgagaaggcaagcatcccgacggtcgagaagaaaatcgtctccgatgcggatggcaaggaatacgacgctgccgattctcatatcggccaggatgtcacctacaacatctacggtaccgttgcccaggacatcgcaacgtatgatagctatacctacaagttcacggatacggtctccaagggccttacggtcaatgcagatgcagctggtgctcctcaggtccacgtctttatgtactcgagcaagagcgctgctcaggctgatttgacgcacgccaagggtacagatgtgaccgactacttcacatctacccttaccaatggtacggacggtgcacatgtcctcacggtgaccgcgaagaccacagatggcgcaaagggcttgaagtctatctctggcgttgataaggactcctgcttcgtcgttacctatacggctaagatcaacaaggatgcagtcatcgccagcacgggcaacccgaatgacgtcgatcttgagtactctaacaacccgaacgctgagggcacgggtaagactgtccccgacaaggtccgcgacttcacctacggcctcaacctcgtgaaggtcgaccagggcaccgagaaggcactccagggagctgtgttcacgatcaaggtcaagactgctgacgacacggcatccgcgggcaagtttgtctcgtctgacggcacgctcagcgatagcgaagtcgagctgaccactgatgcgaacggcaagattgacgtgactggtctcgatgctggcacttatgaggtgcacgagaagtccgctccttccggatactctacggtttcggacttcacgttcacgatttctccgaccatcactcaggaggatcagactctcagcctgaatggttcggtcgccggagcagagggtcatgtgattgctggcctctctgatggctccgcaggtgataacgagctgactcctgccagcaattccaccgttaccgacggtaagttgaacatcacggtcggcgataccaagtccgtgggcctgcccctcactggtcaggctggcgtgacgctgaccttcgtcgctggcgcactcgtgctcgccttcggcgtgagccgcgttgtccgcaaccgcaaggagcaggacgcggagtaagctaggactcagttcatagccgaatgggcaagttcttctcgcccgtaagatgggaccctgccttggcggggtcccatttgcggatgggggacggcctgtttggcggcgcgtttggtttgggggtacctgtggccgcgcactttgccaaggggaagaaggatgcgtccggggcgtcgggcgccggcgtggcgtccggcgagggcggatccggcaagaggggcggcaagcgcaagggctgtcgcaagcgtctgcccaagtgggcggaccgcctgattaccgtgctgatcatcctggttggcgcggggatgctggcgtggccgtgggtgatggaccggctcgaggcgtcgggcgtctttaaccagatcacgaccgtgagcagcaacatcgacgcgatgagcaagcagcagcgcgcgtactaccgccagcaggcccaggcgtacaacgcggttctggcggggcagactcccgcgatagacgcgaacacgatcctgccgtacaagaagcagctgacgtttgaccgcgaccccatgatgagctggatcgagattccctccatcaacgtgagcatgcctatctaccacgggacgagcgactccgcgctgatggcgggcgtggggcacctggaggggacgagccttcccgtgggcggggcctccacacactgcgttctgacggcgcacagcggcatgaagaacctgagcatgttcgacgacatccgcgacctgaagccgggcgacctggtgcttttgcacacgttggggaagaccctggcgtacaagatggtgagctccgaggtggtgtggccggacaacatgaagagcctggggattgagcagggggccgacaaggtgaccctggtgacgtgcacgccgtacggcatcaacgaccaccgcctgctggtgcactgcgtgcggaccaagtacgaccccaagaaggccgcggcgcagcggagcctttccggccggcactggggcaggcgcgagctggccgtgcttctggtggccgtgacgctggcgctggtggcgctggacgtggtggtgcaccgcgtgcggaagaagcggaaggcggcaaaggcggcggctgcggttggcgcggctgcgggcgccgtggaggcgagcgcgggtaagaacgtcaggagcaagggctcaagttgacatgtcttctgctgcagaagacgtttgacgcaaaatctctcttacaggaagagaaggttgacgtaaaagttctcctgcagcagaagaagtattggtgcggagttcttctgctgcaggagacgatgcgttgtatggggcgtgagctgtggttgcgctacgccttgaggcggcggatgccgaggacggctgcgccgatggcgccgcagagctgcgagtcctcgtgcgtggcgacgggggagtccagcacctcggacagggccttgacgacgccctggttctgggcgacgccgccggtcatgaggtagggaggctcgccgccgacgcggtgggcgagggcggccgtcttgcgcgcgacgctcacgtccaggccgtggatgatgtccggcgtgggggtgtcgtccgcgatgagggagacgacctccgactccgcgaagaccgtgcacatgctggagatggtgaccgcgt

SEQ ID NO: 220 - DNA, 12296 bp, Unknown
  Metagenome-assembled genome
gcacgtcgtccgcatggagcggcgcgttctccgcaatggtctggaccgcgatggagcttgcgacctcgccggctgcgtggccgcccatgccgtcgcacacggcgaacacgggtgcctgcacgaggaatgagtcctcgttgtggctcctcacaagcccgatgtccgtgcgcgagccccaggcgagcctgccgtccgagcctttcttcgagtccgtgccctcgcggttctcgaccggaatcgtgtcatggcccgggctgttgacgggcttcttgtccccatgactcacgacctttgcgtagaggctctccctatgcaaaggcaacggcttgagtttgagcttcctcatcgacggctcacatgcatgatcgcatcgcccacctggacctcgtcaccgtcgcgcagcgtgacgggctggccgccgatggggcggccgttgacgagggtgccgttcttggagttgaggtcctcgagcacgagcgccgggccctggagggtgaagcgcgcgtgtgtcgcggagacgaagggctcgttgatgacgatgtccgatgagggactgcggcccacgacgacggggcccaggatatctacgtggaggcccctgagcgccttggagcccttctccacgtcaacggaccagatggccgcgtcacgacgctggccgcgcacgaggccgatgccggtcttcatgaccgcaaagaggaaggcgtagagaaggacgaccagcaggatcctgcctacgaacagaatgaggtcgatcatgcgtggttctccctgaactctaggttgacgagacccagggtgatgaggtcgccgtcagcaagcgtgcaagaggacacctcggcgtcgttcaccatggtgccgttggtcgagttgaggtcggtgatgtgccactgcctgccgtcgtacgagagctcggcgtggtggcgcgacacgttggggtcgtgcaggacgatgccgtgcggcgtgcgctcgcgaccgatcatcgtggtgggggcgatgcccgtgtaggtgcggccagtctggtggttgatgagcaggcaggtggcggcgtcgggctcctgggcctgcgccacggtggcgttgcgctgcgggttcaccagggggacgttgcggcgctgcgtgacggggacctcctccgccgccggctcgggcgccggccgcgcggggacgtcctcggggtgcacgaagtccgtggggatgacgttgaggccggcggacgcgtccgcgatgggctcgacggagggagcgaactcctcgtgcatgagtccgtcgatgctgtcgcgcgttatgggctcggggtcctgcggcacggcaggctgcacgggcgcgggagcgggcgcgggcatgggtgccggctggacgccacgacgcgcgttgcgctcgcggcgcgcggcacgtccgcgggcggggcgcttgggctccggcgcaggctcgggcgtggggctcagctggttggccgcgccgcccaggccgatggagctggagagaaacgcgtcctcctcggcccgcaggcgtgcgagggtgttggcgtccacgttctccgcaaacacggcaaagcggccgctcttgagggaggggtcgatcatgaagcgcgcgagcggcttgcccacgaagacgtagcccttcgtctgggcctgggcctccacaaaggccacgatctcggccgtgagctgggcgtacaggggacgcatggcggcgtcatcggccgcggagaccaggatggtgtacagcgccggcgcggtgttgatgccgtcgatctcaaacgtctcgttctccatctcgcgcgtggcgcgcttggcaagcttcttgaacgagaacggttgcgtatatccctgcggagcggcgccaaaggcatccccgacgcggctctcgaacgtcttaagcaagttcatctatatcctcaacctccccgtccgcgtcgagcggacccaccaggttggtggctatgcacatgagcaaacataagattatcgcactgagggcgtattcccacgtggggggcatccatataccgccattctccactctgagggcgatgacctgcgcggcaataagaatgacggtaccaaggatctgtcccgcgataccagacgccaccgtgcccctccagcggtacagcttggaggcagccccggcggcaacgcagcatcccagcagcaggagccagaacgagggcaaagccagctgggggagaagtacggcaaccgtggcggaggcgtcaaaccgcgcctgcaccgccgtcaggaatagcgcccgccacgcgtaggcgacgcccgccgtcgcggcggcctgtgcgggcggcaggcagaagccggcaagcgcgctggcgcaggcggcctgccccgtcgcgcagggcaggagcacggccgacgtggagaggtgctccctcgtgcccacggggatccaccagcacaggaagcccacggtgcaggcaagtggcagcaacaccgcagcggcggagcccgcgcccgcggtgccgagcagcgccgcggcaagcgcgagcatcacgagcgccgcgccaagcgggggccacgcggccgccgccgcggcgcaggcgaccgtgccgccccacgtcatcgtggggtccgccgcgattgccggtgccacctggtagacggtcaccgccgtgagcgccgcggcaagaccccgctcgcaggcacccgaaagccaggggtacctatagaggagcggcagctcctccggcttgaactcgtccgagcggcgcgcctcgtccttctcgtcctggttcatgagctcgcggatcgactgggcgcccacgtcggggtctcccaggccaaacaccacctcgttggcgaacgcctccacggagggaatgcgctgcgtgatgcgcgggtccagcgcctgcatgatggcctcctcggccatgcccgcaaaggcagggtcaagcttgccgagcggcaccttgggcccgcgctcgatcttgcggagcgactcctgcgccgtctttgccgcaaaggggtcctcgccggtgagcgcctgccaaaccacgaccgcgagcgagaagatgtccgtgcgctcgtccaccatgccgccctcgatctgctccggcggcatgtagcccacggtgccgccgcgcgcgccgccgtatcccgcggcggaggccagcatggccatgccaaagtcgcaaagctttatggcacccgagtgctcgatcatgatgttcgacggcttgatgtccaggtgcagcacgccgttctcgtgcgcgaaggaaagcgccttggcaacctcctgcaccaggtaggcgcactcgtcgccggtgagggtgccgccctccacgcgcgcgaggaactcctgcagcgtgagcccgtccacgtactccatcaccaggtaggcaaaggaccggtccacctcgaagtcgaacatcgtgacgatgttggggtgcgcgagcatgctggaggtgcgggcctcaccaagcgcctcctcgatggtcgaggtgccggccactgtgccgccctgcgtcatgagcgggatacgcttgatggccacgcgccgctggagccgcgtgtcccagcaggtcaggaccgtgccaaagccgcccgtggcgtcctgcgccatgatgcggtagcgcccgagcaaaagcgtcgggcgcgtctgctcgcggccctgcgccgctacgcgctgactctgttggaggttgctgtcacccacgacgccatccttgtccggctctgtcgcatttattggcgtgatgaatgcccgtgtgcagacattgtactgtcgccacgtgcgggcgagaaagacgtgccgccccgctcgggcacatttcaccatatgcgcgtcatgcggctttgaaactcacaaaaatattcccttgccaaacggatgagagttggtctagaatctggtcctacgcgggcgtggcggaattggcagacgcgtacggttcaggtccgtatgagagcaatctcatgaaggttcaagtcctttcgcccgcaccattgagcttgaagccccctgtcggcacgtccgacagggggcttttccttacgcgcggggcgcacgtcgccgcagctagctgcaacaaaagccccgccgcgggcactttggtgcacctgcggcggggctgcgtctgcggtgggcgttcttctcgcccgtgggccggttgggctagtggttgtcctcgtcgaactcgctccagccactctcgtcatcgctgtcgtcaaacaggtcccagtcgtccggagacttctcgtggttgtggtaaagcttgcgcgtcttgcgctccagcacgatggagatgacgaggaagagcaggatgccgcccacgatcagcacgagcactcccgtgcggtcgttgaacagccaatcgaagaagttgccaatctggctcatggcatggcctttctatagcgagttcgttagtcgggttacaaaatgcatgattttgaacaacaagtatatacttgagcagctgtactgaggcccgcgtccgcgagccgtcgcatacctatacaaaggggaaacgagatgctcgacatcaagtttgtacgcgaaaaccctgacgtggtcgacaagtcctgcgcctcccgccagaacgcccactgggacagggagaagttcttcgagctcgacgaggagcgtcgcaaggtcatcgctgaggtggagagcctgcaggccgaccgcaacgccgcatccaagcagatcggtcagctcatgcgcgagggcaagaaggacgaggccgaggcagccaaggcaaaggtcgccgcaaacaagcagcgcatcgcggatctgagcgagaagcgcaacgacgtcgacaagcagctcttcgacctcgtggcggccatccccaacatcccgcacgagtccgtcccctacggcgtggacgattccgacaaccccgaggtccgcaagtggggcgagcccaccaagttcgacttcgagcccaaggcgcactgggaccttggccccagcaccggcatgatcgacttcgagcgcggcatcaagctcgccggcaccaggttctacctgctgggcggcgccggcgccctgatggagcgcgcgctcatcaacttctttatcgacacgcacgtcaaggccggcttcacggagtggtggccccccgtcatcaccaactatgacagcctctttggcacgggccagctccccaagttcgacgaggacctctaccacgtctccggcggcatgtacctgatccccacggccgaggtcatgctcaccaacatccaccgcggcgaggtgctcgacggctccaagctgccgctctggtacaccgcgttcacgccctgcttccgcgaggaggccggttccgccggtcgcgacacccgcggcatcatccgcgtgcacgagttcgacaaggtagagatggtcaagttcgccaagcccgaggactccatgaaccagctcgagtccatggtggccgaggccgagcgcgtgctgcagctgctcaagctcccgtaccacgtggtgaccctctgcaccggcgacctgggcttctctgccaccaagtgctacgacctcgaggtctggctccccagctacaacaactacaaggagatctcctcctgctccaactgctgggacttccaggcgcgccgcgcgaacatcaagtacaaggatcccgcggagttcaagggcacacgcttcgtgcacacgctcaacggctctggcctcgcggtcggccgcaccatggcagccatcatggagaactaccagaacgccgacggctccatcacggtccccgaggtgctgcgcccctacatgcgcgacatggaggtcatcaagcccctcgcgtagcgttccagacggcgctacgggcggcgcccccgcccacgcgcgcgagaagaaccacgccacatagctggacccagaccgggacggcgcccatcgcgggcccgccccggtcttcttatgcgccgccatggcgtgccgaaaaaatatagaacacacgttctatttttggtccaaagagggtatcatgtccttaacgcaaaccaaggtcagaaggaggccgccatgaaagacatcctgcttggcatgagaggcacaaacgtgctgcacaccctcacgatgggtgagtcgcgaacggttgacctgtttgagggtgaccaagggctcgaggtgtgggaggagacccgtggccccgtgacgttggatctgttcggcactcccacgcacgtcaatagggttgcgttgggcggggagtctctcgcgcgtgtctgtacgctcttggggcatgcatctggcgatgccgtggcagccttgtccgagttcttccagaaaggggagaagaccgccatggacctgatcgactggcttgaccgtgccggcatctcgtacgagtcgggagactcgcccgacgggttcctcatataaaagaagaggcccctttcggggcctcgaattaactggtgcggcgtataggattcgaacctatgacgttctgattcgtagtcagaccctctatccagctgaggtaacgccgcatgtgcaagagcccattgctgggctccagaataatctggtgcggcgtataggattcgaacctatgacgttctgattcgtagtcagaccctctatccagctgaggtaacgccgcattgcagtaattaaaatgccactcatccgaatccccgtcaagggtaaatctcatcttttttaggattcagcctggaatgtgtcatctacctgcaagaaaaagacccggccacgtaagtggtcgggtccgaatgctctggcggagagctggggattcgaaccccagataggatcgctcctatactcgcttagcaggcgagcaccttcggcctctcggtcagctctccaaatgtcgtgcttggcaataataccccacattgcgccaatctcacaacagttactcaagaaagaagttttcggtcacaaccacgtcacgtttatggtgcctcacggcatcccacgtgaacctgttcgcaaactcctccgccgagatggcctcgcccctctcggcaaggccgatgagattggccagccggccaacgatcgcttcggcgctgatgcctgcctccctgagcgaggagatgtcggtgtcgcggtcacgcttcgacagcctgcgaccatctggtgccacgaggaggggcacatgagcgcacgagggctctggaaggtgaagaaggcgcgccaggtaggtctgacgggcagacgagggaaggaggtccctgccacgaacgacctcgttcactcccatgaggccatcatccacaaccacaacgagctgataggcaaacaccccatcgcttcgtctgatgagaaagtccccacagtctgtcgcgaggtcctcgtggtagtcgccatagactcggtcgcgaatggtgacttgcccctcggcagagccagcgtcgggcaccttgagacgcgtggctggatggcgatgcttgctcttctcgcgcacctggtccgcggtcaggtggcggcacgtgccctggtagacgaacgtgccgtccgaggcgtggggtgccgtggcggaatgaagttccgaccttgtgcagaagcaggggtacgtgaggccccgggcggtaagggagtcgactgcctgctcgtagatgtctaggcgatcgctctggaagtagggtccctcatcccagtcgaggccgagccattcgtaatcgcgcatcaggtcgtccgccacgcggcgatcctgtgccctggggtcgatgtcctcgatgcggaggaccatcctgccgtgctgggagcggacggaggcccatgcgatgagggaagagaaagcattgcccagatgtatgtggccagacggcgttggggcgaagcgacccacgggaagggtatgcgccacgtgggtcccctgaatgcatccggttgtctgcctttgcgtcatcatgcaatacatactagcttcacgacttgcatggcatggagtctttggccttttgcaaggcataaaaggaaacaatttggcatgaacccgtcatgcgaaagaattaggtaaattgcacagtattggaatataaaatagatatatgcatttcagttctctcgaaaattagcgtttacctttgaaaacgatttttctaccgtttatagaatcaagaaattcctttacaaaaagtccgtcctgacggtatagtctggattctgttctagagggcggtgcgcaggcatcgccttaagtgtttagaagacgaaggagagaacatgtccaaggcatacggcaagccaaaccgtgttgtcattgccctcggcggcaacgccctcggcaacacccccgaggagcagatcgcgcgcgtccgcgccgccgcccccacgctcctgagggtcatcgagcagggcaacgagatcatcatcacccacggcaacggcccgcaggtcggcatgatccagaacgccttcgcctacgcccacaaggacgaccccgacaagatccccgccatggacctgcccgagtgcggcgccatgtcccagggctacatcggctaccacctgcagcaggcgctcggcgtggccatgcacaaggagtacaagcgctggcacgtcgccacggtcgtcacccagatcgaggtcgaccccgacgacccggcgttcacgcacccaaccaagcccatcggcgccttcatgaccaaggaggaggccgacgccgagcaggccaagcaccccgactggaccatggtcgaggactccggccgcggctaccgccgcgtcgtcgcctcgccgcagcccaagaagatcgtcgagtacgagtcgatcctgaacctcctcgacaacgagttcatcgtcatcgcctgcggaggcggcggcatccccgtcgtgcgcgactacaacgacaagggcgcctacaagggcgtcgcggccgtcatcgacaaggacatgggcggcgagctcctcgccgaggactgctccgccgacatgctggtcctgctgaccgccgtcgaccacgtggccatcaacttcggcaagcccgaccaggtcgacctcgaggacgtcaccgtcgaggaggccaagcgctacatcgccgagggccagttcggcaagggctccatggagccgaaggtcaaggcggccgtcaagttcgccgagtcccgcgcgggccgcacctgcatcatcggctcgctcgagaaggccgccgaggccatggccggcctctccggcacccgcatccacgcgtaagcgagggcggaaacattcggaccaaagggtccgaaccagctcgtaaatgatggggtcgcgacttcggtcgcggccccatttctgtgttgcgattgtatgtgggcgctggtcccgaaggactgactgcgagaacgacgtgtccttctcgcctgcataggcggagggcggataggttagctgcgccagaagtccttcttgagctcctcgcggttgggctgcccgcacttcttcatgatgttgtgtaggtgagtttttatggtgccctcggccaggaccagctgggtggcaatctctctgtttgacttgccttccacggccagtgcgaggatctccgtctcgcgctttgagaggttatgggcatttgcgtatgccgggagcctgttctcgatgtgctccacgaggttcctgttgtgcttctgggcggaggcctggacctcgggcggctcgttgaacctaagtgcaaggtccttgacggtccagtagagcgtcatgccggctacgaagatcatcatcacgttctcggagatgctgcggctcgaaaggaagacgccagtcagcacgtcgttggatgccggtatgggagacaggaggatgacgtaggtgtcctccgccaggatgcagcaggtgaagacgaagaggatggcgaaaatcttgcggcgcttgaccatgcgctgctggaagatctcgtccttgttggtcctgtacgtccagtacgcgtagccgaggcacgcgaagatcgagacctggcgcatggtgtagaagagccactgccttaccggaccgtaggggagcagcaggacgatgagcgcctggatgacgcagacgacgaggttcggcatgatggccttgcgcggctcgcgcacgtcaatcacatcgaagatgatgagccaaaggcagcagagaatcaagccgccaacgataattctgaaggccgggttgtcgatctcgtagtagttggagtagctgacgacaccgacgttctgcaggagccactcgccgccaaatatctgcgtcagctctacaaagtaagcggcaaagaagagcgcctgcggaatgtacttgaggcgtcgggatacggcaaacgcggccatcgagatcgatgcggaactcaggcagacgcaaagcacgatgatggtgtacacgaagatgaccgtactcaactgcccatacctccgcgctcgaagcggaaccaacataagtactatgtactatttggcgtgaataggatatgcagaccacaaatacgccatttgaggtatttggtcacgtgcatttatccgaaaagacgaaatgctcgcaaacttgaggttgcctttgccaagatgcgacaaaaacgcccgccgtcaccaacgacgagcctggcggaggggaacaagtacacttgagcaactaccgacgaaggaggtcacgtgcctgacgcaaacatggaaaatggggacttcgtattagggacgcccgcgctcgtctgcaggtggaggctgtcgaacaagacgcttcccctcgagaacaggcacttgcgtgcgcttgcggcgcgcaacatagatggcgaggccataaagacggagctcgtcgcgtgggccaaacagcacatagagtggacgctgcaggacggtgcggtctcgaaccccgatggggtgctcatgacgatcgtggacgagaacggctgcgcagcgatgtcggtcggaccgtacgaggagcttggcgacacgaggctctcggcacttctcgcccgtgcagacctcgctcgcaaggagtccgaggaggtgggggtcgcccccgagatgctttgggtcgcgaagggcggaaccctgatgagagaggcgcgccccaacagcgtgccctcgggtgcggtctcgctcgtcaccgacctggccaagacgctgggcattcgcatcaactatgtaagcgacctgctgcggaaggttcagggtaggcagattgacttcgacgaggcctttctggtgtccgacgagcacggcattgtgcccgcaagcgactgtgccgggccggaggggcgtcgctttgcgagcggttacgcgaagttgctaagcaaggccggaaagtgacgctgtcctgcggatttgtaagacgggtcaattcctagtagaaataaggaatttccagtcaccgttttcatggaatattgcatccaaattgcgccataatccaaatgagtgcgtgtcttgccaggcgcgctcaaaggttctgcgacaggagccggcggcaagggccgcgactccggctaaccaccaaatcaacgggcgcgcgacggcgcccggaggatgtaaggagaggatatggaacgtaagttcaagtcgatggacggcaacgaggccgctggctgggtctcgtacgccttcaccgaggtagcgggtatctacccgattacgccttccagccccatggccgaccacgtcgaccagtgggccgcgaagggtctcaagaacatcttcggcaacccggtcaagatcatcgagatggagtccgagggcggcgcctctggtaccgttcacggttcccttggtgctggtgcgctaaccaccacctacacggcatcccagggccttctcctcatgattccgaacatgtacaagatcgccgctgagggtctccccggcgtcttccacgtgtccgcgcgtaccgttgcgacccaggcgctcaacatctttggtgaccactccgacgtcatggcctgccgtcagaccggcttcgccatgctcgccgagggcaacgtgcaggaggtcatggacctcgcgcctgtcgcgcacctcgccgcaatcactggcaagaccccgttcctgaacttcttcgacggcttccgcacctctcacgagatccagaaggtcgctgtctgggacttcaaggaccttgccgacatgatggactggaagtccctgcaggagttccgcgatcacgcgctcaaccccgagcatcctcacgctcgcggcagccacgagaacggcgacatcttcttccagcaccgcgaggcctgcaacgccaggtacgacgcgcttcccgccgtcgtccagtcctacatggacaagatcaacgccaagctcggcaccagctatcacctgttcgactactacggtgccgatgacgccgaccgcgtcgtcgtctgcatgggctccttctgcgacactctcgaggaggtcatc

SEQ ID NO: 221 - DNA, 40859 bp, Unknown
  Metagenome-assembled genome
atgcttcaataggacactgcacaaagctgtaattttgcgctatagtaaagcaaactgaaatagctttaaggtaggaggtcccccatgagagcatttcagagggcgctccgtgaatgtgtgcttgttggtgtagccgctcttctcgccctggtaatcgtgccggggacggcgcttgcgcagggtggaacggtcagcgtgacgggtagtggccaggcgtacgcctcgctttcggacgcggccaaggccgttaaggcaaatggcaccacgggtgtcgttacgtacacggtgtccggctccgtcgactttgatggcgcgccaactgcgacgctggcgccgcagggcgtgacgggcgtctccatcgtgggcaacgctggcgcgcaggtcacgctcacgggcacgtatgcgggctcgctctacacaacgcccaacggccgcgcggacggcaagctgggcgtgccccttaggatgagcaacctcacgctgaacgacggtcgcaacgagcacgagggagagatggcctcgggcaaccccgggccgtgggagttcacatacctctccagcaacgcctcgaccgaggagttcgacggcgtcacgtttaccgagggctttatcgtggggcagatacatgcaacaagcgtgcagaagggcacgttccgcaactgcaccttcaaggtttccgaccccatgtccgcgctcgacgacgatatggccaacaagaagtcccactacgagctgtggctgagcggtatggctgacgtcaccgtggacggctgcaccttcacgcccaacgcgtacggcgcaatcaagggcacgtactccaatacatatgcaagctactaccccaagccctacgttgctctgtcggtatataacagcacgttcaacggcatcggccaccaccacgtggtgcacctggacggcgcggacgccctctcgttcaggaacaacacgctcaccaactgctacaactcggacaagcacgacaggcagttcgtggacgtcgcgctggacaagacgggcggaaaggcagctgtcataagcgccgactactttggggccaacgccaacgacaacaggatccagtactcgctcttcctcaccaaggacggcaaggccgtggcgggagcgccggcgtactaccagtacaaccagacgcttgcgacctacgagctggacggctatacctaccagctggccaagggctccacggtcgcggacacaaaggccatgctgcctgccggttcgcttgcgggcatgtacgaaagcacaaaggcagccggctggtccgtgttcaccacgggctcgcttgccggtgacgatgcgacgtccatcccgctttccagcgtcggtccgcgccgctacgagctggcaaagggaaccgccaacacctacacgattaagttcgagaagaacgcggacgacgcgaccggaaccatggatcccatgaccgccgtgtatggcaaggacgtgaccctgcctgcctgcgccttctcgcgcacgggctacgtctttgtgggatggaacacctcggcggacggcaagggccttgccgtcaagaacgccgcaacgatgcgcaacctttccgccaagaccggagcgaccatcacgctgtacgcgcagtggggtccagacaagcatccgaagccagggccaaagggctgcaacgctggctcgaccaccaaggcaggggagaagtccgcctgccccagccggaaggcaaatgccagcaaggcgtctggtgccaacgtgccgttgacgtcggacgattcggtctcgtgggctgttcttctcgccatcgtcgtctgcggcgttgcggctgcgggctttggcgtggcggagcttcgcaggcgctcgcaaggctagcgcaacgcagccgacgtcccaacgcaacgtatggaaacgggctgatggcgtaagccaccagcccgcatccatgcctcggccagctgctacttgtggtacgcgacctcctgcagggtgtagatggacttgtccatgttgaagaggtatgccaccgcgcacaccacaaagaaatgcggcaggtaggcaaagccaaacacctccgcgccgatgaacgtgggcgccagcagcgtgttggtggcggagccaaacaccgccgcgtagccaagcgcagccaccagcggcacgggcagtcccagcaggccgcccagcacaacgcccagactcgcgccgatggagaagagcggcgtgacctctccgccctggaagccagcggaaagcgtgagcaccgtcagcacgaacttgagcacccagtcccatggcatgatcgtggcggacgccttgggcgagaaactcgcggatatcaggttggtgccgagtccggagtagcgtccctgccacagcagtaggaagaggacggaaagcgccacgcccatgatcgcgatgcgcttgatggggttctccaggtgtgcggcggcgatcttcttgccccacttgaggcaccacgcaaagagcccgcccacaatgccaaagcagaggccaagcaggagcagcagccccagggtgcgtgcatcgatcgcggagggtacgctcagcgcgacctcgaacttggagaggccgagtgcgcccgaggtccagcttgccgcgatggaagccgtgagcgcggggaagagcgcttgcagctcaaggcgaccggcgaccaggacctcaagcgcaaagagcgtcgccgcgaggggagtgcggaacaggcccgcaaagcccgcggccatgcccaccagcaggaacgtgttgccaggatgcttgaacggcagcttcgagccgatccagtgcgaaagcgtcgcgccaatctgcacggccacgccctcgcggccggcactgccgccaaacagatgcgtgagccaggtgccacccatgatgaggggaatgagcctgaggggtatcacgttctcgcgtcccaggcccacgtcgaacacgaggctcatgccgcggccggtgttctttccaaagcgcaggtacgaccaggcgataagagcgcctgccgccgccaggaacgggatgaaccagaaggggtgcgcgtccctcaggtcgccgatcgctatcagcacgcgaccgaacaccgcgtcgatcccgcccacggccatgccgatgggaactcctacagcacccagcaggatcaacccgccatagctcacccagaccctgcgaagtctgtcactcatctgctactcgctttcatgtcacgttgtccggctggctgccgcgcaactcgtcgtcgcggcaaaagaaaagacctctgccgctctacagtggcagaggtcatcatcccgaaggcggtttggggcttggtgccccgcggagaacctcattccgcttggttcatggtagggatgggtgtcgttcccgtcaattcgtaaagaaaaatgtccatgcttggactcgtcatcggcggggctcgcctcatttgttaccaggacggagcatgctcttctcgcccgcgggaattgctaatcgctaaacaggcgctggtagatgcccgtgacctcggtcacggcgcgggtgtagccctcaatgtcgacggggtgcttcatggtgcggtggtacttggggtagtcgaatatcagcatggtgagcacccaggcctcggtctcgatgtcctgggacaccatgttcagcttggcgaggctgcccagcgcccgcgcgattatggcacgcacgtggtcctgcacggtctggccgtccagcgtcacgcgctccagaaggatgagcgttcccacgttgcggccgacctcctggttgtcgaccatgctgtccagctcggagtagctgcccgtccttgcaacgatttcgatgcagtttgttatgttcttctcgaactcgtcgagctcgcgacgggcgatgcactcggccacgtcgtacttgtcgcggtagtgccggtagaacgtgcccttgttcacgagggcggccgagcagatctgcttgacggtgacctcgtccagcggcgtcttgaccatcaggctgacgagcgcggactctatcgcgcgccttgtgcggacgacgcgcaggtcggtactggtgtcgcgggccatgggactccttgttcgggacggtgcgtgggtttgcgaggttggcccacgtgccgtgagatatcaatacaaatgcaagctaagtgtatggataacgatacgcattgtccagtattgcccattgtgacaaacgtgcagtcatttgataatgcttaggatggcaatagtcgccccgtaacagggcagagggagtgtggacatgcaatccaaggttgtgcacgcggccgagcgcaaggccttctcggtcgtgattgacaagatcatcaaggcgggttccggcgaggaccgcgagaagaacatccagcacctggtggacatggcatccaaactgctcaaggattccgtgcccggcgcgtccaggggcatgaacaaggcgctgtaccccggctccaagtgggagcagtggattttccgcgtgatcgacgagaccgaccccaacgtcctcaagatggccgtgctcaacggcgcgtacgaggctgcgttccgcggctaccgcgacaccatcgccaacgctgagaagctgcagtgcaacgtgccctggatcgtgatcttcgacccgacctccgcctgcaacaagcattgcgtcggctgctgggcggcagactactccaagaggctcaacctcacgtttgacgagatggaccgcttggtcacgcaggccaaggcactgggtacccacctcttcatgctcacgggcggcgagccgctggtccgcaaggcagacgtcctcaagctggccgagaagcacaacgactgcctcttcaacatcttcaccaacgcctcgctcatcgaccagccgttctgcgacgaggtcaagcgcctgggcaacctgatcttctccgtgtcgctggagggtacggagcagtccaacgacggccgccgcggcgagggctcctaccaggaggtcatggacgccttcgacctcatgcataagaacggcctgctgtacggcacgtccaccgcgtacacgcgcctcaacaccgagatggtcacgtccgacgagtactttgacaagatcatcgagaagggcgcccgctgggcctggtacttccactacatgccggtgggagagggcgccaacgcggacctcatgcccactatcgagcagcgcgagtacatgatcgatcgcatccgttccgtccgcggctacgagggcggcaagcagatatttgccatggacttccagaacgacggcgagttcgtgggcggctgcatcgccggcggccgcacgttctgccacatcaacgcccgcggcgacgttgagccctgcgtcttcatccactactccaacatcaacatcaaggaccacgactgggtggactgcctgcaccagcccatcttccaggcgtaccgcgagaactacccctggaacaagaacatgctgcgcccctgccccatgctggagaacccggccgtgctgccgcgcatcgtgcacgaggcggacgccaagtccacggagtacgtcaccccggagagcgccgacgagctgtgcgcccgcacgctgccctacgccaaggcctgggcgccggagggcaacaggatctggctcgagcagcaccccacgggcgtcaaggagtacggcaacgacgtcagcggcaagtccgcaaaggagcgcgcggagcgcatcgacgcggatgacgagaagaacgaggcggttctggactaaggtcctgccaagttcaactagttaacgattgggcggcggagcaaattgctctgccgcccttttcacgcttagggaatcgttgggtagccagtgaggtgactttagacccgccatagcagactctgcgtatggattcctacttgaagttggtaagaacgtgacgaatcgcgtcctgggaggttggaatgcccaacgtatcaactggcattgccacggatgcaaatgtgctgaacctaaaagcaatcgagctctccgatgtccgtgatgaagttggagctttgctagtgggcggggaggagattgagctcgcgttccaaaccgttcgagaccaggtaatcttcacgaacaagcgcatctttgttgtcaacgtaaagggtgtaactggaaagaaaactgcctacttctcctatccatattccaaggtccagtactacggaatcgaaactgcggggatgatggacgtcgacagcgaacttatacttgcattcaacaacggccgtatgctccagttcgatttcaagaagaaggtggacatccggaagattagcgagttgatctccgagcacatactgtagttgggctagttacaaggcatcaataacatgtgggtttgatagcttagttcagcactccgaaggctccgcctcgtttggtggcctgagggatgatgagtgatattttgtggagctcaagaacaccttgtggctccctttggtttctgtattctcgcagtgcaaggaaggtctctcatgtcaaacagtgggtcgatacctggcctcaaacctggtcgccaagatctcgacaatgcagaggcaatcttgctcaaagagcttgattacggtaagagaagctttgttgagcatggtggcatgtcaaccgaagagatgcgagttctgctggcaagcaagttcgagaagcgcgcgaaatgaggtttgctagggcgtccgcggttgcacatggtcctgatggggcaaacaggcatagacgggattaactcaatatagagaagaccgaggaacgcttacacgaacctcggccacagaatggagggacacgaacggctatggcacgtgtccgcctcatactccagcacttcacctaagaaagatatttatcaagtagccagcctctgtcacctagtgctttggatgaaggaaggcagctcgttcttctccgtcgcggcggatatggtctcgagggcctgggcgatatgatcttggttggcgggccgacaacacctgtccgtgcttatggagcttgagctagcgctcgacaagacggagtttgactcagctcatgcaacgggggagggttgctacaattctcgcatggagctggagaaacatctcaacgataggagagcgcatggcgacgatgacgctcctagagagaacgccagacgcgctcgtctataggtacttcccggagtcagacgagagccacggcggtatcgttccggttggcaactcaacaaagagatgaccggactctaatcccccgaaggaataaaagcccggtcacaactcatatatcacattgggatgccgaagttccagatggctatgtccaactaagaaatggtctggctctaactccgaagaaggagtaaaagccaggccagaatctttataccacaagtaaatgattcgaccagccaacctggcatcatcctattgctgcatgaaggaaggcagcgcgttcttctccgccgcgtcggctatgtcctcgagggcctgggcgacggcgtcttggttggcgggaccgatgtgccagcgggccgcggccgcgacctgcggcgttgcgttggcgacggcgacggagttgggaacgccctcgatgatggccatgtcgttttccgagtcgccaaagacgcagacctcgtccaggccgatgcccatgcggtccatcaggcactgcaggccggtcatcttggtgacgccggcgggcgtgatgtcgatggtcgaggacgtggggttggggaagacgaagctgagctccgggaagcggcgcgtgaggtcgtcgcggaggcgctcgacgtgcgggcgcgggcggtcgcagtggatgttggtcttgacgaagaggccgtccggcacgtgctcgcttgcgaggtggaacgcgtggaacgccttggggtggcgcgccatctgctccgtggtggtgccgacgcagatctcgcggccctcgacctcgtcgtcgtagagcgtgagcgcgacgccctcgccctcgacttcctttaggtagtctgctagggcgtccaacgtattgcggctgggcgcctcgcgacggatgacctctccgcgcaggcgcacgacctggccgttgacgaagatgccggtggagaagcagtcggctgcgtcggcctcgaacatccaggacatcatgccgattgtccggcctgagatggggcccgccaccaggccggggatggcgttgacgcggcggatcgccgcgatggagcgattggacgcgcggccctggccgtaggggatgagcgtgtcgtccaagtcggaaagcgcgagcctgatcatggagcctccgggtggcagtggtcattcttctcacctggctattttcgcacgtgtgggggctgatgctacggcagcttgcgtaatcccgcctttgtgccagacattgtgcgtgacattcccgggaagtgttctacaatgggccgcgacatggggagctgggatacggcccggctgagaggtggtgtccattcgccacgacccaagaacctgatgtgggtaatgccaacgaagggagcgtcatgacgcagatggattctgcgcgcgcgggaaccgtaaccgacgcgatgcatgcagtggcacaggccgagcacagatcagacgagtacattagggacgccgtcgcgcggggcaccatcgccatcccgtgcaacacggcgcacacggcgctgcggccgtgcggcgtgggcgagggcctgcgcacgaaggtgaacgtgaacctgggcatatcgggcgacatccagaacgcgcccgaggagtgggagaaggtctccatcgcggagcgctttggcggggacgcgatcatggacctgtcgaactccggcaagacgcgcccgttccgccgcaagctcatccagaagactccgctcatggtgggcaccgtgcccatatacgacgccattggctacaacgacaagccgctggtggagctgacggcgcaggacttcctggacgtggtggaggcgcacgctgaggacggcgtcgacttcatgacgatccacgcggggttcaaccgctcggtgctgaagaccttgatggagaccaagcgcctgaccaacgtggtgtcccgcggaggttcgctcctgtttggctggatgatgaccacgggacaggagaacccgttttacgagcactttgacgaggtgctcgagatcctgcacgaccacgacgtgaccatcagcctgggcgacgccctgcgcgcgggatcgacctacgacgcgacggacgcgagcgaggtggccgagctcgtggagctgggcaagctcacgacccgcgcatgggagaagggcgtgcaggtggtggtcgagggacccggccacatggcgctcgacgagatccaggccaacatgaagctgcagaagcgcctgtgccatggcgcgccgttctacgtgctggggccgctcgtgacggacatcgcgcccggctacgaccacataaccgcggccatcggcggcgcggtggcggcaagctccggcgcggactggctctgctacgtgacgccggccgagcacctgaagctgcccaacgcgcaggaggtacgcgagggcctggtggttacgcgcatcgcggcgcacgcggcagacatcgcaaagggaatccccggcgcgcgcgacatcgacaacaagatgagcgaggcgcgccgccgcgtgaactgggatgacatgttcgcctgcgccatcgaccccgaccgcgccaaggagatcctggcggaggcgcccccggaggaggacggcacctgcacgatgtgcggcaagatgtgcgccgcccgcaccgtcaacaggatcatggcggggctcacggtcgacctggactaggtccggctgccggcagccatccgcaacataggcgccgcaaccatcgcggcacaccacaaatcagaagagaagaacgacggcctcgccgggcaccgcgcccgcgacggctgccgaaaggagcatgtaaccatgaagtccaccgagcttgcgacctgcctcgacgcggtgcgcgccacgtcgcccctcgtgcactgcatcaccaactacgtgaccgtgaacgactgcgccaacgcgctgctcgccataggcgcgagccccatcatgagcgacgagccggacgacgtggaggacatcacgtccatctgccaggggctcgacctcaacatcggcacgctcaaccgtcgcagcatcgagggcatgggccgcgcgggcgccaaggcggcgcagctgggccacgccatcgtgctcgaccccgtgggcgccggggcctcccacctgcgcacggacacggcgcgccagctgctcgagtcctaccaccccacgctcgtgcgcggcaacatgagcgaggtccgcgcgctgggcggcgcgtcctccagcacgcgcggcgtggacgcatccgcggccgacgtcgccacgcgcgacaacctgcacgagtctgccggctttgtggcgcgcctcgcccaggcgtggggctgcaccgtggccgtgacgggcgcgatcgacatcgtgagcgacggcacgcgcacctgcgccatcaccaacggcgtgcccatgatgagccgcatcacgggcaccggctgcatgctatctgcgctgctcccggcgttcctcgcggccggcacggacgcgtttctcgccaccgtcgccggcgtggcgaccatgggcgtctgcgggcagaaggcgcgctcgcgcatgacgggggccgacggcacgggcagcttccgcacgtacctgattgacgcgctctcgaccgtgaccggcgcggagcttgcggacgccgcgcgcgtggaggacctctgatgcccgccgcgaaggggaccagcctgggccaggagggcctggcgccgtgccggcgcggccgctggtccgccgaggccatacgccgcggcatgctgctgtacgccgtgacggatcgcgcctggctgcgcggccgcacgctcgccgcctgcgtggcgcagaccgtcgcgggcggggcgaccttcgtgcagctacgcgagaaggacgcccccgcggaggagaagcgcaccctcgcgctcgagctcaaggccgtgtgcgaggagctgggcgtgccctttgtgatcgacgacgacgtggagcttgcgcgcgaggtggcggccgacggcgtgcacgtggggcaggaggacacgtcctgcgctcgggcgcgcgcgatgctggggccggacgccatagttggcgtgtctgcccagaccgtggacgaggccgtggcggcgtggcgcgccggggccgactacctgggcgttggcgctctgcaccccacgccgaccaagcccgacgccgtggacgtgacctacgacgagctgcgccgcatctgcgcggccgtgcccattcccgtggtgggcatcggcggggtggacgcctccacggcgcacgagctttccggtacgggcgtcgcgggcggcgcagtggtgtccgcgatctttgcggcagacgactgcgaggcggtggcccgcgagctccgcgcgagcctggaggccgcgctgccggacgcagtgggcaccagctccggacaggcccgcgcatgagggccgtcctcgcgatagcggggctcgacagctccggcggcgcgggcctcgcgcgcgacgtggcgaccatcacgggcatggggctccatgccaaggtggccgccacggccgtgacggcccagtcgctcgcggcggtgcggcgcgtggtcccgcttgcgccggagctggtggcagcccagattgcggctgcctttgaggacctggcgccctctgccgtcaaggtgggcatgctcggcacgcccgaggtcgcggccgcggtggccgcggcgctcgcgcaggcacacgcaagcaacgtggtggttgaccccgtgctcgcctccacgagcggcacgtcgcttctggcgggcgcgccgggggagaaggacgcggagtccggggcttccgcagcctccgcgctcgcgtccctcttccggcaggccgcgctcgtcatgcccaacgtgccggaggccgaggcgctgctggggcggcagataaccgatagggatggcatggcagccgcggcggacgatcttctcgcccgctacggctgcgcggtgctcctcaagggcgggcaccttggtcttgcggatgactgccttgccagctcggagggcacggcctgggtgggcgtgcccgcggtcgcgggtggctcggcgcatggcacggggtgcatgctgtcgagcgccatcgcggcggggcttgccacggggctggggctggtgcaggcggtgcgcggggcaaagctgctgctcgcgcgggggcttgcgggtcgcgtcacgctgcccgagggcgcctacctccaccttcccggctgctggccagaggcctagcccgtggcatcggccgcggcaccggtggccgctggtttgcggctgcctgtcgcgtccctacgccaggaccttcttgttgtccgggcccggggtggtcacgatcacctgggacggcgtgatcacgagcgcgcccttggcggtcgcggcgcccttgaagaccttctccacgatctgcttgaactcgtccacgatggcgccctcggccacgtagcttgcggtccccttgacctggtagccctcgagcgccttggggtcatacacggagatggcgatcttgccgccgttggcctcgatgttcttgagcgtggtgcccaggaacacgtcgcccaccaggagcctgccgtcctcggtcaccttcttgaaggcgacgggcaccacgttgggcacgccgttggcgtcgcaggtcgcaaggtcccacatgctggcgtccagaagcttggtcacgttctcgttcatgtcgattcctctctcctcttgggttgctctgccgtttggcgatactcaagatatggaatcgactcggcaacctaaagacatcaaggggaacttgagcgactatggttgccacaagcatcggcctgacctgcggctatgcgccaacacgccttcccgtgggctccacgtccacgtagccgcaggtctggcactggcgcggcgcgtcgctcgtgacctcgcggtgcacctgccccgcccacgcgcagatggagcgcaggatgggcacggcggaaaggccgcgcggcgtgagcgagtactccacgcgcggcgggatctcgtcaaagctctggcgcagcaccatgccgctcgcgatgagctccttgagcgatgcggaaagcaccgcgtccgacacgtttgtcatctcgtctcgcagttggctgtagcgcagccgccccttggttgagagcacgcagatgatgcggctcttccacttcccgccaaacacgtccagcccgtactccagcgggcagcggatgtccttctcgagcttcctcctgtgctgcataaagttcacgacccttggttgccgttcttctcgtccgcacaaagtcttgcaggcaacctgccaacccgcaagtaactaaggggaacaatagcggcgcaaccagcggccaagccgccggcagccaaggccaagccaggggagaagttcgcgctgggggagaaggacgcgcccccgtgcctggcgcctacctccagatgccgcggcggtggcggatcgtgtagtagaggtcgttctccatggccaggacctgcgggatgggcaccggcttgagcggcgccatgtgcatcttgcgacggatccagaagagcgagagcacgcccagcaccgccagcgtcacgagggagaccagccacaccaggcgcgcctcggccgggtcggaggaaatgttggcgatcatgaacacggtgccgacgatgcccacgatggggacaaccgggccgcccggcaccttgaacgcgcgcggcgccttggggaagcggcgcctgagcaccagcacgtccaggtccgccaggatgtaggacacgagccacagcaccgtgaccaccaggatcatgaacgagatggagtcagacgttccgccagagaggaacgcgatcacgcagatggagatcgtgacgaagaggatcgccaccgcgggtgccccgtgcctgttcttcctcgcaaagacgtgcggcatcatgttgaccttggtcatgccgtcggttatctgggacaggccgttgaccgtggagttctgcgagcccgtaaaggcgagcgcggacacgacgcacatccagaccttgccaaagccgcccaggagcctctcgccgtagagcaggtgcggcgtggcggagctggagaggtccgcccacggcacgtagttgccaaagcccagcaccacgatggagtccatcacgaagatgagcaccaggctgatgatcatgccgagcgggatgttgcgcttggcgttgcgcacgtcctttgatatggggatgcagtactccgcacccacgaagagccaggacgccgtgcccacggccgccacgacggacgccgggtccgtggcgacggcggtctgctgccgcacgacctcgcccgtgccgagcctgagcgcgccgatgagcccgatggcgatcatggagaagagcagcaggtaggacacgaagtcctgcagcttggcaaaggcgtccacgcccaggagcgcgcacacggcgatcacgatggatacgagcgtgggccacacggccgcggggatgggcagatgcagcgtctgggtcatgaccgtgccaaagatggcggcctccactccgccgcagaggatgttgcacaccaggtagccgccgaccatggccacgagcgtgggcagcgggccgagcccggcgagcgtgtactgcaccaggccgcccgtggcgttgggcatgaggctgttgagctccgccatgcacgccgcggagcacaggttgagcacgagcgcgatggccatggccggtatgaacatggtgccggcctccccggcgccctgcccgagcgagacgaggcagctcatcgacacgatgagtcccatcgatacggatacgacgttcctgagtccgagcggcttgtcctcgtcccgtgccatggcgttccccctcagtcggctgcgtggctagatcgcgtccgtgtcctcgtctccggtgcgcacgcgcacgacctgcgtgaggtcgctcacaaagatcttgccgtccccgatgtggcccgtatagagctccttctcgatcaggtccacgagctcgtacacgcgagacgtctccaccaccacggacaccatggtcttgggcaggagctccatctcgtagttctcgtccacctcgtactccttggtgcccttctccacgccgcagcccagcacctgcatcacggtcatgccgcgcacgtgcgcgcggctgagcgtgcggcgaaggccgtcgaacttctccatgccggtgatgatgtcgatcctcgataccgcagacattgcagcctccctcgggcgcgggcgccctacgcgggcacggtgtgccctggtctggattgtggtgatgcgggtgatgcatgtggtaaagcgggcgagaagtacgcctgggcgagaagtacgcctgggcgagaaggacgccccgccgcgctggcggcccgcccctaggccgtggctcccacgagcgagcggaactgccccggcgtcatgcccgcgaagtcgtcgaactcgtgcacgaggtgcgactggtcgttgtagccgcaggcaagtgcgatgtccgtcgcgctctgcgtgccgtgcgcgcgagagacgaggctcagggcgtgctggaagcgcacgaagcgggcgtagagcttgggcgagaagccgtgcacctcggcaaaggccctgcgcaggtagcggggagagacgccaacggcctgcgccacggcggacaccgtggccctgccgccggtgcgctggatctcgcgccgggcggcgcgctcgagcgagcgcgtgcgctccgagcccggcatgcgcacgggcgccggcgcggccccgccaagctgccaggagcgcagctcgtcctcgagcaggctcatgcgctcctcctggtcctccgcctcgaagagctgcgtcgcgagcaggccttcggtaacatcacggtcgagcgcgacgtccgcgtccacgaggtcctccggcgcgagcccgcagggaaggagcgcctcgccggagcggaagcggcagcccacccaggagcgtccctccgagaaggaccatacgcgggccgatgacacggtgccgccgatggtcacgaccacatccgacggaccgatgccaaaggagaggtcgacgcagccgtcgggcacggcccaggggctgacggcgtccaccccggtcgagaatgagtagacgagcgaggcgcagccgcccttgggaacgtgctcctcgtagttggtgacgccaaggggcaggtagggctggtcggcccgctctggggcctcggcctcgtgggcggtccttctcgcccgtgcgacccttgcctcgagcgcgcgtggcctgcgaaccagcgaagacgtctcgttcatgggagcctcccgtcgccgtgtggggccgacgcgccgccggcgcgccatcccctgcgtcatcctgtcccaccaactacgctagcagcgaaggttttcaggacgttgcggcaacggttacggggatgttgcgccgcgcgggtcggccgggccgtcagaacatggcgggggcgtcccagagcttgagctcctggccgatgccgagctccttcgcgcggtggtacacgtcgccgccccaggcgatgtcctcgacgggcatgccgccgacggagtagacgatggtctggtcgtcgctcacgcggcccgggaccttgccggtgatgacgtccgtgatgctgacgatggaggagcgctcgatcttgccctcgtgcgcgaggtccgtgaacgcgcagccgatgatgcccatcttggggaaggtggggtaggggtactcctcctcccacgcctcgtagaggcccatgttgtcgaccacgaggcggctcttgagcaggaagtcctcgtcgaacagggccgcggacggcatggagacgagcgcgcccggcttgatccaggagcccttgaccttggggaagctcgcgaggtcgtccgagaccgtggtggtgaacgagacgatgtccgcgtcgcgcacggcgtcctcgatcgtgtcctttacctcgattttcttgatgctggggagctccttcttcacgaacgccacgaacgagtcgagcgagcgcttgccgcggcccttgatgcggatggtgtcgagcgtggggcaggccgccacgaaggccgcggcggacgtcttgcccatgacgccggggccgacgatggccgcgaccttggcgtccttgggcgcgaggtagcgcgcgccgacgccggggatgccgcccgtgcggtacgcggagaggaggttggcggacatgagcgcgagcggggcgccggtgtccttgtcgttgagcatcatggtgaggatggagcgggggagccccttggccttgttctccatgttggagccgtaccacttgacgccggccatctgccagcgaccgcccaggtaggcgggcatggccatgaagcggcggtcctcaccgttggcgggcatggtggggaacttggggtggtccgggaacatgatcatcgtgccgtgggagttgtggttctcgccacccatgacgtagtcgcccttggcgagcgtgacgaggagctcctccatgcagtcgatgcaggcgggcatgtccttgacgcccgcggcgatcatgtcgggttcgctgaggtagaggaagtcgatgctggagtccattggtggtcccttcaatcgggtgtggttaaggattggagaagagcgtgccgcctaggccctggcgtggaagcggtcgtagcggaatgccgagaggtcgagcgtggtcttctcgccccgtgcgacctccgcgaggagcgtgccgacgatgggcgagatgccaaagccgtggcccgtgaacgcgcagcccacgacgaggccggggacctcgtccacggggccgagcacgggcacgccgtcgatgcagacgtcctcgtagccgccccaggtgcgcacgatcttggcgttggcgagcttggggatgtagcgaaggatgccgcggcagatggccggtgccgtgatggaggagttggcatcgtgcccgttgtccttgttgacgtcctcgaggccggagtcgccgccgaagacgaaggagccgtgcttggtctggtggccgtagaagtccgcgtcggcggtgccgagcatctgcgggaacatctggggctccatctcggtcacgagcgcctcgatcaggacgttggacatggggacgtcgatcccgacgctggcgaggatcttgcgggaggcgtagccggcgcagacgatcacgctgtcggcctcgaacgtggcctcggggcagacgaccttgcggaccctgccgtggaccttgcggagctccgtcacgggcatgccggtgtagaagcgcacgcccaggcgacgcgcggccatgtagtaggcgtacgtggccttgagcgggttggcgtggccgtccgtggggcaccaggacgcgccgatgacctcgtccgagaggtacgggttgatctggcggacctcgtctccggtgatcatgcgcatgtcgagcccctgggccacggccttgtcgcgcaggccctcgaggatcttgatgtggcgctcggtcttgccgaggcggaggttgccgccctggcagtactcgacgtccgcgccgagctcatccgagaggtgcggccacatgttcttgacggcgtacatcgcgagcgggagctcgcgcgggtcgcggccggactggcggacgccgccgccgttcctggtggagccgccgttgccgatgacgtcgcatgcgtcgagcacgatgacggacgtgcccttcttggcgaggtagtaggccgtcgcgcacccgatgatgccggcgccgacgacgatcgcgtctgcggtgcggctggggacgtctgccgtggttcccttggtcacgttactctccatcccttccaccttccttcgcgaacacgctcatctcgatgggacgcatgggggcgcgcgagcttgcgggctcgagctcgtccggggacacgcccagctcccgtgccatgatgcccttcacgaggcgggcgcaggtctggccctggcagaggcccatgccgcagcgcaggtagcgcctgacctccgcgacggtgaacagcccgtcgtgcacggcctgcctgatctggccctgcgtgacctcctcgcagcggcagacgaccatgtcgtcgccgggcttgggctcgaaggggccgaggtccctcgtgcggtcgttgatatccttcatctggattgccccctcagtcggtttctgtggcgggcgccgccttgaagaagcgggccctcatcgacatgtcctcgggcaccttgaccgtgacgatcgccgtgtggtcgaaggccttggtgcgcttgacgcccacgacctccgcctcgcacacgggcttgccgtcgcggccgagcgcctgcccgcggtcgcccttctggggcagcgggaggaactcgtaggggagcgtgacctcggcaaagccgggctcgctcttctcgtccacgaggaagatcgcctggcccgggcacgacgccacgcagagcccgcagccgatgcagttggcgtccggctcgagctgcggcagcgccgtgatgtgcgagccgaccttgatgcagtgcttggggcagacgtcctggcaggggttgcacgggatgttctgggtgcactcgatgacgggatggatgcccacgcggtgcgtgacgccggggaagcgctcgatctcgctatcggctacgtagccgcgctcgagcagcgtctgggagacgggaatgccctcctcggtcttctcgaccttcttgccgcggttcttgggcgcgaacatgccctggcgcaggccgtcgagcgcgcgctcgttggcgtccacgccggcgcgctcctcgtcgtccgtggcaaagcccaggtaggaggccgcggcgaggccggcgatcctgccctcgatcatcgcggaggatgcctcctcgatgccggagacgtcgcccgccgcgaagatgccggggatgctcgtctggccgaggtcgtccaccacggggacctggccgcccttcctgcggtcgtccacgaccttgcagccgtccatcttgaagagctgcgacatgggggagaggcccacggcgacgcagatcgtgtccacgtcgaagtgcttttccgtaccagggacaaactggaagtggctgtccacctgcgcgatcgtgacgcccgtgacgtggtccgttccctcggccctcttgatggtgtggctgaggtagaacgggacgccggtgcgcgcgacctttgcggcgtgcacgccgtagccgcccacgtgcggcgccgcgtccaccagggccaccacgtcgcacccggcctgcttgagctggtagctcacgacgaggccaacgtttccggtgccaagcatgagcacacggttgccggggcgcacgccgtgcaggttcatcatggtctgggccgcgcccgcgccgatgacgccgggaagcgtccagccctcgaaggtgaccatgttctccgcggcgcccgtcgccacgacgatggcgtcgcccttgtagtggttgacctgctcgccctgcttgacgacgacctccttgtcctggtagaggccgatgacggtggagtcgagctcgaccgtgacgccgagcttggcggcctcgtccagcagctcctggccgatcacgaagccgcggatcttggcgcggtgctcctttgagccaaagaacttgtggatctgcttgaagagctggccgccggggcgcgcgttctcgtcgaacacgacgacgtgcacgccgtgcttggccgcctcgatggcggcggacatgccggccgggccggccccgaccacgatcaggtcatagcgcttcatgcggcaccaccgtccttcgcggatgcctcgtccttctcgcccgcgtcaaacggcacggccgtggcgccgtactgggtgcggacctccataccctccgcgagcggcgtcatgcacgtgcgaacgttggggacgccgtccaccaccatcacgcagtccgtgcagcggccgatggcgcaaaagatgccgcgcggctcgtggcgcttggcggtgtagcggtgcaccatcacgcccgcggccttgagcgccatcgcgaccggctcgccctcgtatccctggagcgtctttccgtcgtaggtgaagctgaccagccttcccttctggggcacgcccagaatcggatgctctgcaatgcgcgttcccatgtcccctcctctgccgagcgccggtgccgaccggcgcgttgtgtgcggctagggccctgcgggaggggctgcgtccgatgcctcccgcagtgcctgagtttgtaataggccagctcagagggcgggtattgtaagaaacggccctcacgaccagtcgaaacgcctggttttcaggctcgaaacttttgaaacgggcgagaaacgcgcgcggccagggttgggactcgtgcgggggtgcgtgagggacggaaggcaattgagagcgatacagaaaaatagttgcatcctgaaatgttgtgcaacatttctggatgcgtgctgaacgaccatggagcacgagagggcgactgctccgccggctttgtagctgcgggggatggcgtcgccgccgttggcatggggatgccgctggctgcgcagatcttctcgccctcgtagacatgggttggaaggagtgcggcagttatgaagaagaatgggcaggaatccgtttcccccaagcacatgaagtccgcgaagggcatcgccgcggccgcggcgtttgcgacgacgggcgcgctgattgtgggtgcgacgccggcgctggctgacgaggcttccgcaacgacgaccacgggcgacaccgcgaaggcgaccaccacgcagaccgctccgacgaactccgaggttgcgaaggacgcgctggacaaggcaacggcggcgcacaaccaggccgcgagcgacgcagccaacgcaaagcagacgctttccgacgcccaggcgcagaaggccaaggacgaggcgaccgttcgcgacggtgtgaaggacgtccagcagaagtccgcggacgaagctgcgaaggcgcaggatgccgcgaacaaggctgctgacgcagcggaggaggcaagcgacaaggcaacgtcgaccaagactcagctggacgaagcacagaagcaggccgccgacgcccagaaggctgccgacgctgctaaggacgtggaccaggcaacactggatgccgacaaggctgcggttaacaagtctgctgccgcgcagaaggacgcgcaggataaggccaacgccgcacagaaggcttcggacgacgcgaacaaggccgtgaaggacgcccagaaggctgcaaccgatgccactgcagcaaaggacactgcaaagcagaaccttgatgacgccaagaagaacgccgactccgccgagcaggcgcagaagaatgcccagaaggccctgagcgacgccacctccggcagcgccgaccaggccaagaaggacgccgacgccgctcaggctcaggccaatgccgaccaacagcaggccgactcagacgccgacaaagccacccagaagtccgcagacctcgatagtgccaagaaggtctactctgatgcccaggctaaggcctctgacgctaactcgacgctggaaaaggcccaggacgccctatccgacgcccagtcgaagctggaaaaagccaaagcaaacaagaacacgactgctgctgagcttaaggatgcccagaaggcttatgacgatgccaaggcagcttatgacgcgctgccggaaccgattcctccaaagacggcaaaggacacgcttgacgcactgacgtcaaaggacattgccggcgtttccgggaatgaaaacatgtatgccaatgattatgccgatatcaacaagggcaattatggcacagatgtgaaggtcgatggctcgaacgcgaactatgactcgctcatgaaggcttgcgacgtcatggacgagattaacaaggtccgcgagagctatgggctgcaggacttgaaggtcgatccgtatacgttcatcgagcagacgcttgagtgcgacatcaatgacagcggaacctatgccaatcactccccatattcgtatgggacgcgaaatctcgcttggggatatacggacccggttgccgcttggatgagcgagaagtccgagtatgacgccttcatcaaggcccacccagatgccgtcgtccagggagtcgagcacgcgaagagcggcctcagcgtctatgagttttatctgaagtatcctgacgagtatcacaaggtcggtcacttcctgaatatcctcgataacaataacattcaaggcgctggatttaactcgtccaacaatacggcagcgtggggcgctgattgtgtcaacctagacgctggctcatacaagtactacaccgtcgaggagttccgcaacctcatcaagtcgatgatgaacggcagcggctctgcggagaagcaggcggcaaaggagaagatggacgccgcaaaagcgagcgttggtaaagcacaggctgctttcaaagatgctgagtctgcagtagcgagtgcccaggctgcagtcgaccaggcgcagaaggccgtcaacaccgccgccgctcagaagtccgcagccgacgccatcgcccagcaggcaaaggccgcccgcgacaaggctcagtccgcatacgaccaggcgaaggccgctgctgacgcctccagccagaaggctgctaagtctgcccaggccgccaaggacgcgcaggcccactacgagaccgtgagcaagggcgcccaggccgccaaggacgcgctggacaaggcaaacgacgagctggcaaaggcccagcagaagctcgccggcgcccagaaggcctataatgatgcgactcaggcgagcgacaaggctgacgcggcgcttgccaaggcaaagcaggatgccgcgcagaagagcgcggccctgacggatgcacagcagaagctggctgacgccaaggttcaggccgactctgatgaaaaggaactcgctgccgatactgctgccagccagaaaaaggctgacctgcagaagactgcccaggacgccaaggacaaggtggagcaactgaaggaggagctggcggacgcccaggcggatgcgaaggccaaggccgacgcggtcgatcccgcaaatgccgaggccgctcgcctcgccgcagtggcaaagaagcttgcggagcttgatgcggacaagattctggcagatccggccgttatggatccctacatcgcggataccgagctttctgactggaaggctgaactgcagaggatccaggatgcggcagtcgcctacaacaccaaggattccgatgcgatagatcaggctcagcaggcgtacgatgccgctgctgcaaacgagcagaagaccgctgccgacctgaagaaggcaaaggcggactacgaccgcacgaaggctctggaggatgccatcaagaaggcggttgccgaggcgcaggccaagactggcaaggctgctgctaccgttcatactggcgtgtacgttccgaagcacatggcgagtacgaacggcaaggggcttattgccgcgacgactaaggcatctgcaaccgaggccgtgcccaagactggcgacaccaacgccgctggtgctgccgtcgcgtttgccggcctgggtgccgctgccatcctcgaggggctgcgtcgtcgccgtcacgaggaggactgctagtcaacggttggctgttgagtggcaggcggtaggttgcatagcctcgatggcaatcgtctgacaagttgatgcatgggccccgtcgcacgagtttgcgacggggcccattgtcatgccaagttatgaagtgagggggagaaagacacggccctgaggattggcgctcagtcttgggattgagagtagtctggcccagtgagcagggtcaggtactgcggcggaacgctgtccgcgagccagacatcgttgttgcccaggtagaagcggacgccgtcgcttgcggctgcctttgcgtccacgagcaggatcgctgggtgctcgtccctgcgcgcgcctacctcgcgggccatcgccacgttggtggagaggtgaacgtactgccgctccatggggaggagcccctgccggcggatggatgcgagcgcgcggcgcgtggtgccatggtagagcacgtccggcggcgtcgcgggcgcgtgatcgatgcgcgttgcgaaggagtggccgtagagcgcgcggatgcggtcgccggatatctggtggcgctgctttggcgaggtcgcgatgatctgctccaggtccgcgcgcgtgacggggcgcctgccggggtggcgcgcgttgagcgcggccagcagcgcgtccacgggcacgaagccctgctcgtccggagcgaggccgaactcctcgggatggtggcgcagggcgtaggagatttccttacttatgtggacgagccgctggtccatggttgctgttcttctcccctagaactccttggggtgcaggcgcacgcgcacgtactgcaccaccatgagcgccagcagcaccaccatgaccaggaagtacgcccacacggccccgttgaacccgatggtgggcaccagcgcgccagagagcaccagcaccacggcgagcgcgatgccgtaggcaccggtggccttctgctgctggcgcagcaccgtgatgatctggtacaaaaagtcgatggccgcggtcatgccgcccgccaccagcatcaggtactgcgccgtgcggtacggctcgaagtttaggccgtacaggaagctcgtgatggggatgccgatccacgccgcgatgaacacgtacacggccgtgagcaccgcgcacagcgccagcaccgccacgatgatgaggtcaaagcgcttgcgtcggctcgggtcggaccagatgttggccaggcgcacgagctgcggcttgtacaccaggccgatcaccatgaggatgctctgcgcggggaagtagatcgcgttgaagaccagctgcgccttgtagggcagcacaccctccatcacgaacttggggaccgactcgatcagcgtaaagacaaactgggcgagaaacgcggggaagcactccttgaagatctcccggatctcctgcagctcccacttgcgggacttgggcgtctcgaacagcgccagcggaatcgtgacgatcacgagcgaggcggccgccacgatcgcgagcgcgatggacgccacgggtatggagcgcgtcacaaacagcaccacgctgaagaccaccacgccggacacgcagcgcagcgcctgcgagatacccgcaaggtatagcttgtccatctgctgcagccggccttcgtacacgtcggcaaaggcgtcaatcaccctaaaggcaaacgtgccccagcagatggtgagcatttctcccgcgtagcccctgaccttgcagaagagccacccggccagcatcatgagcacgcacgaaagcacgcgctggatctggtacgcggcaaacgactccgtctcgtcgatgtcagacacctggtaggttcgcacgccgtagttgccgatgaagatgagcaggttcgcgatcacgaacgccatcgagaacatgcccgcctgctcggcacccgcaagctgcgacgccacgatggtgaggatggggaagagcgcgccccacacgcccatgccgacggagtttgcgatgtagtcgcgtgtctggttgtgcgcggcgtagcgcgcggtctggttggaaagcgagccggaatacacggcgccaatcaggcggtcccaccaatggtcgaccacgcggcggagaaacccgggctccgtgctcgcgtcctgcgacggggccgcggccctctcccgcgcggcgcgcagcctggtggacacgccgtcctgctggtcgtccgcctgctgtctggcgggtgccttccgtagcttgtggatgggattgttcatatggatcgacgccttcgtgtcgcggtgattcgccatcgcggcggccggcacggcatccatcacggacgcgcccgccgctcgcatgccatcaagcatagcccttgcgccgtggggcccgccagacgtgggggcaacccttacctttcgcaacaaatcacagttcgattaagctcacgttttcatgtcttaaacactgcttaactatcattcagacatgaatctcttgctgcggggtcgtgggaagctgcgctccggcggggcctctgcatgtatgaggacgctgccaacggttgttgggacaaactcctagcgagaagggccgcggctccgccagaaaatcggccaaaggcgcggattcatccacaggcgtcacgattttctcgcctgaaaggtgaatatctagtttcgcggcggtgcggacccaatggggagggcgccgccgcggtattgtgtacatgcaataatcctgcgagcgaatgcgcccgctccggtcgcggcccggcgccgcgcgggggagggccatcatgcagaggaggaacaccgtgtcagaagtcacgggatccaagggcgagaaggacgcgctagacgcagccgcggccgccaggggcgtgccgcacgaggacgtcgagcgctttgcccagagcaaccccaagaccatcgaggagctgctgcacttcaagcgcgaggaccgtcccaccatctatcccacggcggaggaggcggcggagcttgcccaggcggccaccatgctgaccggcgtggacgttccggactccatccgcgcgaacatgacgctgttcctgcgtctggttcgcaaggtgctgcgcgagtacgacccgcgcctgcgcgacgagttcgaccacatcctgcacgactccctcgttgccacgaggagcgagtgcagcggccgggacgacgagcagggcgaggccgcctttgacgactgcgtcaacacgtttgaccagatgtccatcgaggacgagaccctcatcgtgcgcgcgctgacggcctacttccacatggcgaacatctgcgaggagaactaccgcgtccacgcgctgcgcgcccgcgaggccaacgtggaccccgagtcgcgcgaggaccccgtgaacgagatcacggtcgcgtacgacaagctggtcgacgagtgcggccgcgccaaggcgcacgcgctcctgaaccgcctggagttccaccccgtctttaccgcacaccccaccgaggcacgccgcaaggcgaccgagggcaagatccaccgcatcgcggacctgctggagcagcgcccctacctgggtccgaccgagcgcgcggagaacgagcgccgcatgctgcaggagatcgaggccctgctgcgcacgagccccatcgccatcaagaagccgacgccggtccaggaggccgacacggtcatctcgatcttcgactacacgctgttcgacaccgtgcccgaggtctaccgtcgctttgacgactgggagctgggcgacaaggccggcaccgtgccgcccgtctgtcccgcgttcttccaccccggcagctggatcggctccgaccgcgacggcaaccccaacgtcacggccaaggtgagccgcgaggtgagcgagaagtaccgcgtccacatcctggaggcgctgcgtgaccgcaccgcctgggtgggccgcaacctcacgatcgacgcgcgcacgaccaagccctccaaggagctcatgaacctgtggagccaccaggtggagatgagcgaggcgctgtccgcctccgcgctgcgcgtgtccgcctctgagctgcaccgcgccgccatgatcgtcatctccaaccgcctggaggccacgatccagcgcacggccgacatcatgtaccagacggccgaggactacatcagcgacctcaaggtcgtgcagtcgtccctcgcacaggccggcgccgtccgcaccgcctacggtcccgtccagaagatcatctggcaggccgagacctttggcttccacctcgtggagatggagttccgtcagcactcgctcgtgcacacccgcgcgctcgaggacatccgcgagcacggccgctggggcgagcgtggcgagctgcagcccatgactaaggaggtgctcgacaccttccgcgccatcggctccattcagcgccgcaacggcgtcaaggccgcgcgccgctacatcatcagcttcaccaagagcgcccagaacgtggccgacgtctacgagctcgcgcgcctcgcgttcgcgcatgccgaggacgtgcccgtgctcgacgtcatccccctgttcgagcaggtggaggacctggagaacgcggtcgacaccctcaaccagatgctcgagctgcccgacgtgcagcgccgcctggccgagaccggccgcaagatggaggtcatgctcggctactccgactcctccaaggacgagggccccacgacggccacgttcgtgctgcacaaggcccaggctgccatcgcggagtgggcggaggagaatgacatcgacctcacgctgatgcacggccgtggcggcgcggtcggccgtggcggcggccccgccaaccgcgcagtcctggcccagcccaagggctccgtcaactgccgcttcaagctcacggagcagggcgaggtcatcttcgcgcgctacggcaaccgcacgctggcccgtcgccacatcgaggaggtcgccggcgccacgctgctgcagagcgcgccctcgaccgagctcgtcaacaccgagtccacggagaagtacgaggacgtgtccgaggccctcaccaatgcgagccgcgaccgctacctcgacctcctgaacacggacggcttcgcggagtggttcagcaccgtcacgccgctcaccgaggtcggcctcatgcccatcggctcccgtcccgccaagcgcggcctgggcgccaagtccctggacgacctccgcacgatcccctggatcttctcgtggtcgcaggcacgcatcaacctcgccgcatggtacggcctgggcacggcgtgcgagaagtttggcgacctggagcgactgcagagcgcctacaaggagtggccgctcttctcgaccttcatcgacaacatcgagatgtcgctctccaagacggacgagcgcatcggcaagctctacctttcgcttgccaaccgcgaggacctgagcaagaaggtcctggacgagatgcgcctcacccgcaagtgggtgctcgccatcgtgggcgacgagtggccgctgcagcaccgccgcgtgctcggtcccgtcatccgcatgcgcctgccgtacgtcaacgcgctgtcgatcgcgcaggtcatgtcgcttgcgcgcatgaggctgcgcggccaggtgctcaccgcggacgagaaggagcgcctgatctacctgatcctctgcaccgtctccggagtctccgccggcctgcagaacacggggtgatgctcgcacgatgtccccgcgccacgcgcgcgaatcgcgcgtaccttgcgcctagctgcgtttgacacgaagcccgccagcggatgcaaacccgctggcgggcttttctcgcccgcgacgcccgcgtccgcgtggtggtgggttacgatacctcccgtgggaggtgccagatggaaggcgacgtagacgagaagatcgagtccgcggtgttcaagctcatggagacgacggacatcccggacatccgtgtggcggacgtgctcaggctcgccggcgtgtcgcgctccacgttctaccggcactttgactccgtggacgacgtggtcaagcgcttcgagagcgggctgctcgacaacatgcgccgcatcaacaacgtggcgctcaaggcccgctttggcatatcagaacttgaccccacgagcaccatggtgagcaggatggagctgctgcagcgcaaccgcgacaagatcgtggcgctcaacgggccgaacggcgacccctcctttgtgcacaaggcgaccatcttcatgcacgactactttcgcgcgcggctggagaccctcgagggcgaccccgtgacgcgcgacctctacctgtcgtttgtgatcgcgggtcataacaacctggtccaatactggctcgaggtccatcctgagattgagccgcaaaagattgcggcggtcctcaacaggctgtactacgcgccgttcttcctttccgaggagagcgtgcgccagacgcccaaggcgccagagggctgggagtagcaaaggcgaacgcgtgcaccatgcgtgaggccttcggcttccctctagaaggagaacttctgcgccatcagatggatcgtgtcagaagcagttcacccgcggcatacttttgacatggcaaccgacatgacaaccgtagatgatgagtgtcatgcggtagctagaaatcctccaggtcgacattccccgcattccttggaaggaagttcccgtgtggggtgtcgccataaagctcctcaattctgtcgaaccatgaagaggggttgggggaatgcgacttaaagaacttgtcgcccttgcccgacatcacgtagtccacgaattcctgtggaagcttgacgtgatactttgtcgtgtacttccagcagtccctgtcccaccagaagtgcccgtctgtgtagcaataaggaccaagcagtcgtctgccaggcctgaatgggtgctcgtatataccgggtgacatgaagaagggctcggtggtcatcaagtatgcaaggaccttctcaggaaccgtgtagccgtcctcgacccagtcgtaaatgctttcgtcgccatgcttgagctctcggaacggagtcaggcagaccatctgatcaaactgcttgatgcgcctccgtgcctctatggcatctggcgtcttgacctcgcagccttcaaggtcggagacctccatgccgaaggggcacggtcccatgcattccctcacgtttgtatattttccgccaacaagcgctcggagtgcgaggacctctcgctcgacggatgaaccgtccataagctcaatggatgccgtctcattgacggcaaggcgctcgccatccccgagctttccatagatcacgtaagtgtctttgcccgaacgcccggcgaccaaactgatctccacccgatcttccaacccttcgcgcaatccatttatgttgcattcaatcataagggtttgagccactgacggcaccatagctaccgctcgtcgtcagcctcgcgagctaggtaccgcgcgaatgccccaaaaactcgtctcatctaccagcataaagaaacagaatttgcaaaagtgtcccacgcggtgaaacgcgcgccgctccgttgttcttacctctgtccgccctcgtccgtagcatgcgtgtcatcagataggcaagcaagtgagaaggacgtgagcacatggtcaagctgggcaagcaggcacgcagcgtctccatcgtcggtgtgggctgcacgccgttcaagaacttcgaggatcatcccgagaccaagggcatgagcgagggcgacgccttcggctatgccgcgctcgaggcgatcgaggacgcgggcctcgcaccgcgcgacatccagtacttctaccacggggccgcgaaccccttcatgattggcgactccctcacgccaaacatgcaggtggcggactggttcggcgtacgcgggctcggctccgtgcaccactccgaggcgtgctgcacgggctacgtcgccctgcaggaggccgtgcaggccgtcgcgagcggcacgtacgatattgtgctttctggcgccgtcgacctcgcggcgtcgcttcccgtcgtgaacgcccccggctgcttccgccgcgacttcccgctcgaggagatgctcccctcgattcccatggtgtacgaccgcgcgtacggccgtccgctcgactccgcctttggcatcagcttcgacaactggatcaacaagtaccgctgggagtacgacctctccgcggaggacatcgacgccgcgctcaacggcatgtcaaagagcctgcgccgcgacgccgtgctcaacccgcttgcgttctacgagtccgactttgacgatgctgccaaggccaacggcctcgaggacgcggacgcgttcctctcgtccatgttcaaccccaaggtcacgcagtacctgcgcgtcaccggcttcgagaccaagtgcgacggcgcggcggcgcttgtcgtgatgccgacggagatggcggtcgcccgcggctacgaccaccagcccattgacgtgctcggcaccggcgcggctgccttcgagggcgcgacgcccgacaacgagtacatgggcaccaaggagggcgcgcgccaggtgtacgagctcaccggcgtcagcccggacgagatcgaccttctctttgtgaacgacttcttcctcgcgggcgacatcgtcgcggctgaggaggtcggctacatcccgcgcggcgaggcctggcagtacgcgcgcgacggtcgttgcggatttgatggcgacaagcccatcaacacgcacggcggacgctgcaactttggccatgcgcacggcgcttccggcgtggcggacatcgtggaggccgtgcgccagatgcgcggcacggccggcgccgcccagatgcccaacgtccccaggaccacgttcctgcgcggctttggcggtggccagaacatccgctgccagatcctgcgcacgcacgagtagcccaaccagcatacacaccagaaggaggaagccatgcttcttacggacatggagcccatcgtcaagaggttctacgacggcgtcgcaaagggcgagtactggggccgcaagtgcgtcgagtgcggcgcgatcgagttcccgccccacctgggctgcaacgcctgcggctgcggccacacggagtgggtccagctctccggccacggaacgctcgagtcgttcgtcgtccccggcatccagaacgacaagccctacctcaaggccgtggagccctacggctacggcaaggtcaagctggacgagggcccggagtacaccttcgtgatcttctgcggcaagaagaaggtcgtcaagcgcctgcaggagcgcctgtacaaggaccacgaggtcatcggcgtgcacgccaagcccatcgagcgcgtgaccccgctcaagcccggctccgatcagaccgtcacctggagcgagctctgcttcgagctcgacgaggtcgcggaggcctagcgccaaccccgcagcaagtcgccaaagcgggcgagaagtacgacgcccgcaacatcaagcatcacatcaagataaatcaaacgcgaaaggaagcacaccatgaccaagcaggagctgcaggacaagctggcgggctacgccaagaccgcgtaccagtacaagggcgacatcacggccgacacccccttcgacgagctgggcaaggagtccatgaagatgatcgccctcacctcgctcatcgaggacgagctcgacgtcgaggtcacgatccacgaggtcatgaagatgaagacctttggcgagctcgtcgaccgcgtcgaggaggagtacgaggagtagccgggcgagaaggacgtgccgtctttgtcgggagcctcccgcaaggcggacgtccgccatggcagcgggccctgcccgctccaacttacgcacaacggaaccaagtgattcgacccagggacggagcgacccgcgtggccgccccttctcttaccgattggagggacccagcatgggcctgatggaagacgttcgcgcgaaggctgccgcaaatccgcagcgcgtcgcgttctacgaaggcgagaaccccaagatcctcaaggcggcggccgagctcacggcagacggcctcgccacctgcaccatcgtgggcgacgcggcggcggtcagggccgcggcggagcaagagggcgtgagcctcgcgggcatcacgctcgtggacgtgacggacgcggagcagaacgagtccttctcccagcgcttcgaggtcatttccgactgcccgtacaagcccaagggcgtccgtcgccacgcggcgcgcgccatggaccgcgccttcatgatgcagcgcgcgggcgacgtggacgtgagctttggtggcatcgactgctccacgggcgacgtcatcctcgcgggcgagaagatcatcggcctcgcggacggcgtcaccaccgtgagctccgcgggcatcttcgacatcccgggctgggaggggagcgagggcaacctgctcggcttcgctgactccgccgtctgcgtcaaccccaacgcgcagcagctcgcgcagattgccgtcacgtccgcgggcaccgtggccgcgctcaccggttgggagccgcgcgtcgccatgctcagctactccacggacggctccagcgagggtgacctggtgcagaaggtgcgcgacgccgtcgcggccgcgcacgagctcgcgcccaacctcaaggtcgacggcgagttccagctcgacgcggccatccgtcccgacgtggccgccaagaaggtgcaccgcccgtcggatgtggccggtcgcgccaacgtgatcgtctggccggacatcaacgtgggcaacatcggcgtcaagctcgtgcagaactttgcgcacgccaacgcctacggccccttcctgcagggcttcaagaaggtcgtgtgcgactgctcgcgctccgctcccgtgagcgagatcgtcggcaacgtcgtgatgagctgcgtccgcgcccacgcgctgaaggaggcatagccatgggggagaagaacgattttcgcgtgctggtcatcaatcccggctccacctcaaccaaggtgggcgtgttcgagggcgagcaggcgctgctgcagaagaccgtcaaccacgacgccgcgaccctcgccacgttcgcgggcgtgtccgaccagatgccctaccgcatggagacgatcaactccgccctggcggaggccggcatcgaccccgccaccatggacgcgttcgtgggccgcggcggcggcctcatgccggtggagggcggcacctacgaggtgaacgacgtccttctggaccacgcccgccgcggcgcaaacggcgtgcagcaccccgcccagcttggcccgcagatcgcccacgagctggccgcccgctacggcaagccggccttcgtggtgaacccgcccgacacggacgagctctgcgacctggcacgcgtgaccggcgtcaagggcgtctaccgccacgtgcacctgcacgcgctcaacctcaaggagacggccatccgccacgcggcgtcgctcggccgcccctacgaggagcttgacctcgtggtctgccacatcggcggcggcatctccgtttccgcccaccacaacgggcgcatggttgacggctacgacatcgttggcggcgagggcatgatggcccccacgcgctgcggcgcgcttcccgtggtggaggtgctcgacctgatcgactccggccgcagcaccgccgacatccgccgcatgtgcatgaagacgggcgggttcgtggacctgctcggcacctcggacgcccgcgaggtccagaaccgcgccgccgcgggggacgcggccgccaagcgcgcatgggacgcccttctctaccagctcaccaaggcgatctgcgccatggcgggcgtgctcgcggggcacgtggacggaatcctcctgggcggcggcatggcgcactcgcaggagctcgtagaccacgtgagggacacctgcggctgggtcgcgccggtcaccgcataccccggcgagttcgagctcgaggccatggccgccggcgcgcggcgcgtgctgagcgggcaggagcagcccaagtcctacacgggcgtccccgtcttccagggatttcacgactaacagagaggaatggtgttaccagtgaacaagactcaggtcaaatacatcgtcggcatctattccgccgcaatgtgcatcatgggcatgctcgtgccggtgccgattctgtcttccatcgccaagaccttccccgacgccaacatcgccgcggtgcagatgtgcgtcggcatcatcccgctgtgcatggccctctcggcgctgttcgtgtcgtcagtgctggcaacgcgcgtgcagaagcgttacacggtgcttgcctgccacatcctgatcatggttgccggcctgatggtcgtggcgtttcatgacgcgctctggcaggtgctcgcggcatccgtcttcatcgggattggcatcggcggcatccagaacggaaccgacgcgctcattgccgactacttcgaggggcagcagcgtggcaccatcatgggtgtgtactccacgttcgtcgcgctgggcggcatcctctggacggtcctttccggcatcctggggtctagcgagtggtacatgtcctatgccgcctacgccgccgaactccccttcatcatcgtcgagttcatctgcctccccatgggtcacctcgagcccaagcgcaagggcaacgtcctcaagaacatgccgcgcgaggtcgcgctcatcacgctcatcagcttcatcttcgtgctgtgcttccagctcttctcgaccaacgtctcgctgattgtgtccgcccgcggctttggcggcacggcgcagagtgccatggcatcgacgatcatgaccgtggccggaatctttgcgggacttcttgtgggcccgctcttcaagcggttcaagaaccgcgcgatgcccatggcatggtgcgtcaccatccttggcctcgtgctgacgctcgtggcgccctcgctcggcgtcctgtgctgcgccggcttcatcacgtccctaggcaaggagacctacgtgcccctgcagggcaacttcgcggcaggcaacagcacaaacgagggccgcgccttcaaccttgccatcggcatggccggcaccaactttggcatggcgctctcgccgctcttcttcgaggcggccactgcacccttcggcgcgcagatcagccagaagttcgtcctcggcatcattatcatcgcggtcctggtcgtctttggcatgatccactacgcaaagctgacccccgcgcaggaggcggaggagcgggcgcaggcagccgctcgcgaggctgccacccactagggacaaacgggttccagccgatgatatatttaatcaatcggcaggtacgcgcgtaggagggtaggccaatggacgagaagagcgtggcatcgggggctggcatgtccccggagggatgcggcgagcacgggcgtgagcgcatacttgccgcgctcttctcggaccgtggcctgcagtacatcgtggacgtggcggcgcgcgtgctgggaaaccccatcctcgtgatcgacgccaactttcgctacgtggcgcggcactttgacatcgcgccggacgacgactccacccttgccacggttatgcgcgaggagcttgcgaccggctttgtgagcgagaagggtatcgcctacatccacgagcgccggctggacgagagcctggccggcagtgtgtgcccctgcgtgcacaggaacgaccgcctgggcgtgaacacgctggtcggcgccgccatggtgcacggcatctgcatcgcgcacgtgatgatggtggagcgcgaccgcaccatcggtccggacgaggagcgctgcttcaacacgctggtgggcgtggtcgcgcaggagctgcagaagaatcccgtgtacctgagcacgcgcgggcagatgggctcgtacttcctggcgtcgctgcttgaaaacgagcgtcccgaccccacctcgctcgagcgccgcgccgcggccatcaacttcgagccgctcccgtggatgcgcatcgtggtggccgttcccaagaacccgctcgcaaacgtgggcaacctgcagaacgtggccggccagctgcagccgctgctggcgcacggcctctacaccaagcacaagaatcagctggtcatgctcgtctgccggcaggactcgggcgacctgacgccctacgagctggaccgcctggcagacgtggcggagctgaacgacctcctgtttggcatatcgaacgcctttgggtcgctggcggaggtgcacctgtactacgtgcaggcgcacgacgccatccgctacgggcagcgcgcgagcgactccctggaggtgggccgcgtgctgcgctacgaccgcttctcgtacatgaagcttctggagtgcacggaccgcacggacgacctgctggccatctgcccgcccgcacttctccacctgctcgaccatgacgaggagcacgacggcgacctcatgaacacgctctttggctacctgcagaacggccagtccaccgcgcgagccgcggcgcagctttcgctccacaagaacacgctgctgtaccgcctgggcacgatccgcaagatcctgggggtcgacctctcgagcggcgaggacgtgttccagatccaggtgggcttccgcgtcctcatgtacctggggctcttcaccccgcgcgtgcgtcacacccgcgagcagctcgagcagcccccgcgcgaggggtagcggcaccatcggcacatgcgcccccgccggcacatgcgtggcggggacgcgcttgtgcgggcgccacagcggcgtcgatgcaccctgtttgctcgcacaaagctgcaggcaaaggccgcaaaagccttgtgcgcgcacgcatggcgcggtcgcgggccaaggcgcatgctcttctcgacagatggcgcaaggggcgccagggcgagaggagcttacgatggcagaagagaccacagccaagcacaaggtgatgggcatctgcgctggcatgcatgacggcaacggcgaggtcgcgctcaaggcggcgctcgcgcgcctgcaggaaaagggcgcggaggtagagctcgtcaacctatttgactacaacatcctgccgtgcacgggctgcgagggctgcaccatgcagatgggcgccatcgcgcaggaccccaccaaggagtacaagggctgcgtcctcaaggagaaggacgacgtggacaggctcgtgaccgagctgcacacctgcaacggcgtgctgatcgccgtccccacgtacgacctgcagcccagctcgctctacacgcgctttgcgcagcgcttcctggcgtacgagctgagctttttgctctcaatcggcgtggtgaaggagaacccgcacaccgtggccggcctcatcgcggtgggcggctccatgcacgactggcagacgctttcgctcgagagcctgcaggccaccatgttcaccatgtcgatgcaggtcgtggaccgctacatgatccagcgctccgcgcgcccgggctccgtcctcaccttcccggagcagatggagcgcgtgcgcacgatggcggacaacatctggcaggctatggagacgcccgttgagcagcgcacctggctgggtgacccggacgacggcgtgtgccccaactgccactccagcctggtgtaccccggcgacccgcactgggacggcatcgagttcccgtgggagtgcgcggtgtgcggcgccggcggcgacctggtgaccgacgagaacggcaagccccgcctgcagattgccgacaacggcctcattcgcgaccgcaacgacgacaaggcgcgcgccgagcacctgaacgagatcatcaagacccgcatcgagttcatgcagaagcgcgacacgatcaaggacgagtacgcggagctgcgcgcgctcaagttccccacggtctagcagctagcttgcggccggcggccgggctgcccgcggctaggctgcctgcggctcgccgccggcctcgtttggcatgaggcggggagaaggacgcgtcgttcttctcgccccgcttgtgatgatgcgcgcgtgacggctcgcccacgcgcgcagcctgggctgttgcccgggtacgggtcgccgcttcggcgccgaggcgggaggtgcaccatttggaaaggaaaccatcatgcccatgaagacgtcgacgcggttcgtgaaggccgcgctcctgaacctcgtgaccgcgctcgtgctctgcaccctgtgcgagtggctggcgctctacgtgttccacacggcccaggcaccagccggccagggctggatctggcccatgttcttcatcaacttcgcgttcgcctggtgcgtcgcgac

SEQ ID NO: 222 - DNA, 2141 bp, Unknown
  Metagenome-assembled genome
tgacggggtcctgcgggcgctcggcgcgggcgtcggtcgactcccacagcgcgcggtagcccgcaatctcaaactgcccgcgcgagaagttccacagcggcaggctgtccgtcttgaacgtgacgaccccgcccggcttcagcaggcggcggtagctcacgagcacgtccgcgtgcgtgaggcgctcccacgcctccttcttgcgcgggaacggcgtggggaagttgaggatgatctggtcaagctccccgggcgcaaagtaccgcccgagcttgcttgcgacgccgggcgcaaagaccacgttgtcgagcccggactccacggcgtgctgagcggcgtacgcgatgcagatgggctcgcagtcgatgcccacgtacagcgtgtcgcggtcgcgtgacgccgcctccgccgtggaggctcccttgccgcagcccatgtccagcactatgcgctggtagcgggcgtgcgggtgtgcggggtcaatcggatggcaggcctccgcccacgtgcccgcgtagtccgcggggctcgcctcgatcgcgtcggcgtagcgctcgaggcgctcctcgaggacgaagttcttgggcagtctggcgtgaagcgcgtgcatggggacctttccttacggggggagaagtgcgtgggcggcgcgcgtggcacccgccctggtgacggatgcacattgtatgcgctcgcggccgcgcggacggagttgcgcgagcctccattgaaaaaatccgccgaactgggtggtttgtggttcagatatttattgaaatggagtcttgttgcctttggggtaccgttaaaacacccacatcacggccgaggctcgaaagagaccaggcttctgggtgttttgtgactggtcggggctaccgactcaagtcagaaacacccagaagctcgactttattaaatgggcgtccgatcaagtgctggacatgcgccctctggcgcgccctcaactgaagcaactctgcctgggtggtatggagtgggcttgggctggtctcgggtccataaaaggaggacccgaggcgccgcgcggcgtcccgggtcccaggtcaaacttgttgcaggcgaggcttagtcgtccagcgtgacggtgaagccctcctcgtcctgcttctcgagcatcttgcccttctcgtcgacgggcatcatcgagatgtcgtcgtcgtagaccttctttccggtcgggtgctcctcacgccagaccttctcggccacgggcgcccagctcttggcatacggagcggtgcgtgcgcacaggtggtcgacgctctccggcgtgacgtactccgtggacttggcgtccgcggcgtggaccatcttgggaaggacctcggggttctcgagcatggggcaggggcgcagcatgttgtcgttccacggccagttggcgcggtactgctggaagagcggctgcttgaggcactcgagcaggctctgctccttgatgttggcgttggagtagtggatgaagacgcagggctcaacgtcgccgcgggcggtgatgtggcagaacacgcggccaccagcgatgcagccaccgacgaactcgccatcgttctggaagtccatgaccatgatgggcttgccacccttgtagtcgcggacctcgcggatgcgcttgatcatgtactggcgctgctcgagcgtgggcatgaggtcggcgtttgcaccctcgcccacgggcatgtagtggaagtaccaggcccagagggcgcccttatcgattagcatgtcgtagtactcgtcggaggtgacggcctcgacgttggcacgggtgtaggccgtggagacgccaaacgggatgccgttggccttcatgaggtcgaaggctgccatgaccttgtcgtagtcaccctcgccgcggcggccgtcgttggcctccttggagccctcgagcgagacggagaagagcacgttgccgaggcgcttgcagtcgtcgacgaccttctggttgatgagggtgccgttggtgaagaggctgaacagggagtcgttatgcttctcggccagcttgacgatgtccttccagcgcaccatgggctcgccgccggtcatgaagaaccagtggcagccgaggtcgttggcctgctgcacgagggagtccatctcgtcgaacgtgaggt

SEQ ID NO: 223 - DNA, 1197 bp, Unknown
  Metagenome-assembled genome
cccgaattgtcaaatcaagtgcaacacttttgacctcaggtttagtagtggtctaggtgtctaatcatataaagtatcataggaactaaagatcttggcgggcgtggcgtagtccaagatgcgtcttggccggtggttcagggcaacttgaacttggtgaagttgttcagctgagtagcggtgtagtgattggcctttgggcacgaactcccggattaagccgttatggttctcattagtgcccctttcccaaggggcatacgggtgggcgaagtaaatctgcgtcccacggatttgattcaacttggcgaattcagagccattgtcaaaggtgatactgttaaaagccgtggcaccatagtgattaatcgttctctgtaaggcgcgtcgacaggtattggcctgataatcgggcagcttgaccatgatttcatagcgagaatagcgctcagttagcgttaaaatggcgggttcactggccacccgcttgcctttgaccaggtcaccttcccaatcaccaaagacttgacgtttctggaccgcagccggccgttgttcaatcgaagtgcccaatcgtttctgattcaggcgaacgtgatggtggccgggctttttaatgtggcggcgcagtttttctggcaaatcggtattcttaagttcgagttgaccgcaatcgatatagcggtaaacggttggcgttgaggggacgcgcaggcctggatgatcttggcgaaaggcatggacaaagctgtcgacactgtgaatccgtggtcgctgttttaaggctttaaccagcatcgcaaagaacagccagcaccgagacaataaacttttggcgtgacagttagcgcggtgtttttggtagttgatttgaccactatcggcaaagtaacgggtgtaatactggtagttggcgtcacgttgtctaacagtgccccgcttgagttcccgactaattgtactgggtgatcgatggagacaccgagcgatttcatgttcagatttcttctgttcatagagcgcttgaatttcaccacgttcgtcagcttgaagttgtcggtaatggatttgggtagtatgcttggtttgggtcatggagaagtcctttcttaattagtttggtcactattaagcataggtctccatggcctacttgtatacttggctcagtgttgcagttcaattttaaatccggcg

SEQ ID NO: 224 - DNA, 15524 bp, Unknown
  Metagenome-assembled genome
gcgaggaagggcgccaggtagatggggtcgtcgtgctccgcctccaccgcggcgagcttgtccttgtccaggtgaccctcgccgatggccgcgctcagcgtgcgcaccgtgcgcgtgaactccgccacgtggccgggcgaggtcgcgcgcgggcagtacgcgttgaccgtgacgccgtcgcgcgcgagctcctgcgccgccgccttggtgagccccaccaggccggcgttgcccgcgctatacgcgcagaggttggcgatgcccacccacgcgttggacgcgctgttgaggatggtgccgccgtcctgctccaccatgtgcggcgccgtgtggtgcatggtgttgtaggcgcccttcatcttggcgtgcgtctggtagtcccagctcttctcgtccgtgttgagaatcgtgccctgacccaggccggcggcgttgttgaccaggatgtcgatgcggccgtacgcgtccagcgccgtttggatcagccggccggccgtttcgtagtcgctcacgtcgccaaagaacggcgtggcctccccgccggctgcgcggatctcgtccgcaacggactgggcgtcgccgcgcatggatatcacgcgctcacgctcctcctcgggcaggtccgcgtactgtgagcgcagcgccgcgcggtcgagcggcttcctgttgttggtcacgaccttggcgccctcgcttgccatgaacagggctatgcccctgccaatcccctggccagaccccgtgattacggccaccttgccatcaaggtatcccatggatgcccccttctgtcgttatcttttttatgtgagaagaacgcgccgccgcaaccgcggccgcccactggctgcacgtcccgcgtgcctcgcgggccctacccgccgtcgcgcgagaacatctggttgagccgctggatgagcgccgtctggttgttgacgcccagcttgtggtgcatgtgctccatgtgcttgtagaccgtggcgcggctcacgcccagcacctgcgcggcctgcttgggcgagtggccctgcaccagctcgtagcccacggccttctcgcgcggggtcaggcgcgcggcgtcgtccgcgggcgtgccgccctcgcgccgcatgccggtgtcggccgccgtgcccgcacccgtgaccaggtccgccagcgcggagcgcggctcgctgggcggctcaacgtagaagttctggtacagcgcgttgatgtggtggttacagaccgtgagcgcctcgagctccgtgtgcgtgggggcgtggccgcgctcgccgcggtcgaactcgatcaccacgcgcacgcggccctgcaggtcgtacaggcaggccgcggcggaccacctcaggcgcaggcgcaacacgtactcgcgccagaattgggtgtcgtgcggctcgcgctcccagtccagcacgacgggccggtacgggtccccgtgctggcgcgcctcgcggagcgcctggtcgcgcgcggcgcgctcgatggagtaggcgccgtcatccgcgttcatgtagtgccccacgtactcgcgggcgagcgcgcggctcacccccagcaggcgcacgttggcaagccggccgtcctcccccaggaagaagacggtcgcggcgtcgtaggggtacacctgccgcaggacgacggccgccgtcacgcagaagtcggtcggcacgtgcacgccctcgcactttgtcagcacgtggtcgacgcacgaccacgcctccgcatccagcgacatgacaccgcccttctcgcccgtggcacccgtggccctacgaccagcgtgcctgcgttcgttccctcagaacgtcgttcagtctcgcggccacgctgtttcagacatatacgaaaagttgcgtaattgggccgcgcgggcttgcgcagcccactttttgcacaccagccacacgactcgttcatgtttcaagcgtttatgtcccctttacctaagtttggtagcatctgcctcgtcatgccggcgcgaggtctgggaggcagccgccatgagcgggagcttggaaggcgagggcgagaaggacgcggccaacggggcggacggcgcctcgggaggcgcgccgcagccgcgcatggccccgttcgtccggccgcagtggaaggtcctcgcggtcgtctgcgtcacgggcgtcgcctacaacgtgggcatggtcgcggggccctggctcgagggcctgctcgcccagcgccttgcggacatcctcgcgggcagggccgttgccgcctccatggtgccgctggcctgcgcgtacgttgcggccatcgccgcggtgcagctcatgcgctacctcaagcggctctacgtgcgcaagttcgcaaacaacgtcaaccgcgccatgaagcgcacgctctaccacaacctgctcctcgcggatgagcggaccctggagcgcgaggacgtgggcagcctcatgaccaaggcgctttccgacgtggacgactgcgtggagggcgtccgcaagttcacgacggagatcttcgacaccggcgtggtcatggtcgcctacatggcgatgctcctcgcgtacgactggcgcaccacgctgctggccctggtgttcccgccgctctcctacgtgctcgccgcccgcatgaagcagccggtcacgcgggccacggccgccgccaagcaaagcgtgtcaggcatggcgacggcggcgctcgaccgcgtggagggcgccacgtcctaccgcgcgctcggactcgagggcgtccgcgaccggctgttcgagcgcgaccttgcggactacgagcgcaaggagacgcgcgccaacgtgctctcgacggcgctcatgcccgtctaccaggccatatcgctcctcggcgccggcgcggtcatcgtgtgcggcgcgcgcgacgtgctgggcgtgggctgggccgcgtggaacgtcgcggcgttcaccacgttcttctccgtcttcaccaagctcgccgtcaagtcctcgcacgcgggcaagctcttcaacgccgtgcagcgcgcgcaggtgtcgtggcggaggatccagccctacatgggccaggccgccgcggacgactttgcccccgccgccgaggcgccgcgctttggccagcgcctggacgtgcgcgaccttggctttgccttccccggcgaggccccgctcttccggcacgtgacgtttgcggtcgcacccgggcaggtcgtgggcgtcacgggcgatgtgggctgcggcaagtccacgctgggccggctgctctgtggggagctttcgcccaccgcggggagcgtccgcctgggcgagagggacgtggccacgctgcggcggcggggccttggcttcgcgagccgcctcggccacgacccgcagctcctggacgcctccgtggcagacaacgtgctgctgggagacgacgcggacccgcggcccgacctgcggagggcctgcctgctcgcggaggcggagcgcatgccgcagggcctgcgcacgcccgtgggcgagggcggcgccgcactttccggcgggcagcgggcgcggctcgccctcgcgcggacgtaccactttgcgcgtccgctcgtggtgctggacgacccgtttgcgagcgtcgacctggacacggagcgccgcgcctggcagggcctgcacgagctcgcgcgcgagcggggcatggccgtggtggtcacatcccaccggctgctgcacttcccggagctggacggcgtcgtctgcctgcacgacggcaccgcgagctttggcccgcacgagcggctgatggcggaatgccccagctacgccaggctgttcgacctgcaggcaaacggaggggaggtggacctcgatgtcgagcgctagcgcacggcagacaacccaagggcaggcggccgcacgcgcggagggccgcgtgcccgcgtccgtccggggcgtgttcgcgggtgtggtccgcgcgcacgtggggctgaccgtccttctcgccctgtcggtcgtcgcgacggtggtgacgtcgctcctgccgccgctcgtgctcgcgcgggtggtcgacgccattgcgggcgcgcgccgcggctccacggcgtggcttgccggcccgctcgcgggactcgcggccgcctacctggcgctcgtggtgctgcagggggccgccggggccgcgcaggagggcgccatcgccgtgttcggccagaaggtcacgcacgcgctgcgctccggcatggcggccaagctcgaccgcctgcccgccgactactttgtgcgcaacgccgcgggcgccactacgtcgcgcctggtaaacgacgtggacgccgtggaggcgctcttcgcgtccggcgtcgtgggcatggtgggcgacctctgccaggtcgtgggcatcgtgggcatcgtctggtggcacagcgtggggctgggcgtcgtgctcgcggtgtcgctcccgctcatgttcgcctacacgcgccatgtgcagcgcgcgacgctggccgcgcagacggacgaccgcgtcgccgtggcgcaggccaacgagcagataccggagaccctgcggacgctccgcaccatccgccagctgggccggcaggccttcatggcgcgccggtacgccggcgccgtcgaccgcgccttcgaggcgcaggagcgctcaaacttctacgactccgtgtactcacccatcgtgatcaccacgagctccgtcgtaatcggcgtgtcgctctcgctcgcggcgcagggggccggcctcggcaggctctttggcgtgacggtgggcggcgccgtggccgtgatctcgtacgtgcagcaggtcttcaccccgctttcggacatcggcatggagatccagtccatccagcaggcggccgccggcgtccgccgcatcgacgagcttctggcggagccggaggaacccctggcgcccgtggcgcccacggcggagaaggacgcggccccaggcgcgacgcccgacgcccagggcgtccctgccgtggccgtgaaccacgtgacgtttgcctacccgggccagccgcccgtgctgcgggacttctccctcgcggtggcccccggcgagcatgtgaccctggtgggccgcacgggcgcgggcaagagcacagtgctcaagctgctgctggggctgtaccacccgcagaggggcgaggtccgcgtgctgggacgcccggccgggtccatccccgccgcggagcgccgccgcagctacggctatgtggagcaggacttccgcgaggtgccgggcaccgtgtacgaccaggtggccctgggcgacccctccgtcacggacgcgcaggtggacgccgcgctcaaaacggtgggcctgggcgacgtggtggccgccctcccccagggcgcccgcacgccctttggcgaggcgtccttctcgcaggggcagcgccagctgctcaacgtcgcgcgcgccatcgtctgcgacccgggcctgctccttctggacgaggtcacggccaacctggactccgccacggagcggcaggtcatgggcgccctcatggccgcaagcgacggcaggaccgtcgcgtccgtctcccaccggctcttcgagcggcagggcggccgcctcgtgcgcgtgggagcagcgctatagttgccccaggcaggcacttcggcctgtcgcaagacgtaaggagcggcacatgggcaacgcgggcgcgcccgcagagggcgagaagaacgacggctttggactggaaggcatccgcaagataacggtggcgggcgccggcacgatggggcactcgatggcgcagcgctttgcgcagtacgggtacgaggtgacgctctggaaccaccgccagcccacgctcgaccgcgcgcgcgaggccatcgcgcgcgacacgcagaacctcgtggaccagggcgacctctcggcggcggagcgcgacgcccttctcgcccgtatcgcctacaccacggaggactccgcgtttgagggctgcgacctgctggtcgagaacatcgtggagaacctggacgccaagctcgcgttctaccgcgaggcgtcgccgctcgtgccggcgggcgccatcatcgccaccaacacatcgggcctctccatcaacaagctggccacggccgtcacgggcccggagcgcttcctgggcatgcactggttcaacccgcccgcgctcatcccgctgatcgagatcatccgcaacgacgccacccgcgacgacgtggcgcaggccgtcttcgacctcagcctcgccatcggcaagaagccggccctggtgcagagggacgtgcccggctttgccgccaaccgcatccagctcgccgtgctgcgcgaggcctgcgacctcgtgagccgcggcgtcatatccgtggacgggatcgacgcggtcatgaagtacggcctgggcttccgctgggcggtgctcggcccgctcgagaccgccgacttcggcggcctggacaccttcgaccacatcgcggagtacctggtcccggacctctgcgacagccacgacgtccccgcccttctccaccggcactacgaggccggcgagctgggcgtcaagaccgggcgcggcttccacgactactccggcgacaaggccgcgctcgccacgtccgagcgcgaccgcaagctcctggccgtgtatcatgcactgtatggcgagaaggacaggacgagcgagtagcgcccccgtcccgaccgcaggcggcgtcccaaaggaggagccatggcggcatcccaccccacccccggcagcaacggcgacgtgtacgttccctacgccgaccgcacgggaaacgagtccatcgtctacttcacgcgcgacctttccgccgcgggcctgcagcgggcctacgagatggtgggcggccgcgtccacggcaaggtgggcctcaagctccacaccggcgagcagcacgggcccaacatcatcccgcgcccgtgggtgaaggagctgcgcgaggccgagcccgagcttgcggacagcaacatcgtcgagaccaacacctactacgcgggcgaccgctacaccaccgagcagcaccgcaagacgctcgaggtcaacggctggacgttctgccccgtggacataatggacgaggccggcaccgccgacctgcccgtgcgcggcggcaagtggttcaaccacatgagcgtgggcaacggcatgctcgactacgactcgctcgtggtcctcacgcacttcaagggccacacgcagggcggctttggcggctccaacaagaacatcggcatcggctgcgccgacggccgcattggcaagaagatgatccacacctggcccggcgccggccagtggagcattgccaaggaggagttcatggagcgcatcagcgagtcctccaaggccacggtcgacttcttcagcagcgacggccgcgccatcacctacgtcaacgtgatgcgcaacatgagcgtgagctgcgactgcgagggcgtccacgcccagcccgtcgtgacgcccaacgtgggcatcctctcctcgctcgacatcctggccatcgaccaggcctgcgtcgacatcgtgtacgccatgcgcgaggaccagcaccacgacctggtggagcgcatggagagccgccacggccagcgccagctctcctacatgaaggagctgggcatgggcaacgaccgctacgtgctgatcgacctggacgacccggccatgccgcgcatccaccccgaggactgcgtgcaggacctcaagccgttcgagggctagggccagggccatagccagcggtcgccacgggacggccgcgacaacaggcaacgccacgggccgccgacgcaaccacgccggcggcccgactcttttgcggatgtgtgaattcccacccacgcgctgggtttattggtaccatgtcacgcaaggcgcgcggcgcgggcaagcgcgatggcgccgcagcagagaagatcgaccgtccgttgggaggcctgggcatgacgtgtaacggcgcaacctgtcgcaaccgccgctgtcatagcggcgccgcacgccacgcgtgcgaaacccaggcctagcgagccggcgggtagccccgccgcacccaacggaaggatccaagcccatgtgcgagctcttctccatcaactccaacgtccccgtgagggccaacgcctaccttcgggagttcttctcacacagcgtgaacaacccccacggctggggcatatcctggcgcagcggcgacccgtgcgacgagtcgtccgtcacgctcgtccgcgagggcaagcgcgccatcgactcggacctcaactggaaggtcctgggcgcacccatcgagcagacgcacgtcctggcgcacattcgctacgccaccggcacggacacggccgagcgcaactgccacccgttcctcacctgcgacctcagcgggcgctactggaccatgatccataacgggatcctcttcaacgagggcatgaccttcccgtacgaggcgcgcacggagggcgagacggacagcgagcgcatggccgcgttcctgacggacgtggtggacgaggcttacatgcgcggcgcggcgcccacgtttgacacgcgcttcgacgcgctggccggcgccatcgcgcagctggccaaccgcaaccgcgtcaacaccatcatcgacgacggcgagtacacctacgtgcacaccaacacgtccacgcccacgctcttctggcgcgagcttatgggcgagaaggacgcgcgcgccatcgtcgtgagcaccacgctgctcggcggcgaccgcgaggccgcggcctggaagcctgtgcccggcaaccgcctgatagctctgcgcgacggcaggctcgtgcgcacctccgcgccgcacggctaccagttctgcgaggccatcctggagctgcagcgcaagatgggcgtgcgccccgaggactacgtggcgtagctacctaaaggacgcggactccgcgccgtccacctgcacgtccgtgccatagaacgcctccagcgcggcaatgccgtaggccgtgtcgcgcgcgcccgcggtctcgtagctggagtgcatggccagctgcggcaggcccacgtccacggcgtgcacgctcacctgcgtgttggaaaggttgcccagcgtggagccgcccgccatgtcgctccggttggcaaacgtctgcacgggcacgcccgcacgacgacagagctccgccatgaccgcgcggctgaaggcgtccgtcgtgtacttctggtttgcggcctccttgatcacgatgccgtggttgaggagcgcgcggttggcgtcgtcgctcttctccgcgtggttgggatgcaccgcgtgcgcgttgtcgcagctcaccaggaaggacttggccaccgcgcgggccaggtcctcgtcgcccttgcccagcgcgccgttgacgcggcgcagcgtatcgcgcaggaaggtggaaagcgcgccctgcttggtgttggagccgacctcctcgttgtcaaaacacgcgagcacgctcacgtcatgcgggttgtccgccgcgaggaacgccttgagcgagacgaagtcgcactgcaggtcgtccagcttgggcgaactcacgaactcgttggcaaaaccccacacgcggccctcctggcggttcaccagaaagaggtcgcgcgccaccacgtcggccgggtccacgcccagcgcctccgcgaccatgcggtcaaagtcgccgcgcttgagctcgcccgcgctgaagagcgggcacaggtccacctggcggttgaacgcgtagcccttgttgacgtcgcggttcatgtggacggccaagctcgggatgagcagcacgtcgcggtcgaggctcagcaggcggctccgcacgccgtcgccctcgcgcacgagcacgcggcccgccacgctaagcgggcggtccagccaggtgtagtcaatcatgccgccgtagccctcaacgtccaggcgcaggtactccgccggaccctcgagctccgccacggacttcaccttgtacgtgggcgagtccgtgtgcgaggcgcacatctgaaagtgatagctgtccagctgctcgcccacgcgccacgcgatgaggctcgagccgttgcgcaccgtgtagtacagcccgccgcgctccacgcgccacggctcgccctcggtaaggtacgtcgcgcccgccgcgtccaggtacgagcgcagcgtgtccacggtgtggaacatgctggggctcctgcgaatgaactcgaccagctccttggaggtctctacgtcgtccatgtgtctcctcgatcccgccgccgcgcgcccgcgccgcggcccctgtgttgtgccccgtgagcatagcacgccgcacgccggcaggccgaacgccgcgcgtcccaaatgcctacactggacgcagcgggacgtgccgcacggcatcacacacggtgccacgtcccagcatcggcccagctcacgtcacgcaaaggagaagaacgtgcgcatcgtcctcgcatcagactccctcaagggaacgctctccacggacgacaccgcggagcttctccgcgctgccgccacgcgccacctgccggacgccacctgcgtagccgtccccatggccgacggtggcgagggcacggccgaggtcctcgcgcgcgcctgcgggggcaccatgcgcacggcggacgcccacgacgcgctgggccgtcccatcacggcacgctacgcgctcctgccccacggcgaggccgtgatcgagatggcggccgcggcgggcctcccccagctcgcgccggacgagcgcgacccggagcgtgcctccacctatggcgtgggcgagctggtgctcgacgcgctggaccacggcgccacgagcctgaccctggccctgggcggcagcgccaccaacgacggcggcgcgggctgcatgcgcgcgctcggctttggcctgctggatgcaaccggccgcgcgttcgagggccgcgggtgcgacctggcgcgcctcgcgcgaatcgactgcgcgcacgcggatgcgcgcctcgcgcacctgtccgtcaccgtcatgtgcgacgtggacgcgccgctcttgggcccaggcggggccaccatggtctacggcccgcaaaagggtgcggacgcggcggcgctagcgcggctggaggtgggcatggccaactacgcgcgcgtgctcaaggccacgtttggccaggacttcgacgtccccggcgccggcgcggccggcggcatgggcgccgggtgcctggcgtttttgggtgcgcggcagcagagcggcatcgtgcgcgtgctcgagctcgtgcactttgacgagcttctggcccacgcggacctcgtcgtcaccggggagggccggctcgacgcccagacggcccacggcaaggtggtcgccggcgtggccgcggcctgcgcgcgggcgcacgtgccctgcgtggccgtcgtgggctctatcgcgcccggcgccacgccgcccgcgggcctcgcggccaccttccccacggcgagcggccccatcacgctcgactacgccctcgcccacgcgcgcgagctctatgccgcaacggcggagcggctcttctcgaccatcgccctcgggcgctcgctcggcggcatccgcgccgcgccaaggtgctaacctagtgccttacaagactcacgttaggacacgcaatgaacctcgctcaggcaatagagcacgcaaacgcactggcattccccggcttcctcacggacgaccaggcgctcacggacgagcgccgcaagaacgaggaggccgtggggctgctgctcgacgcgtggaagtccgcgccggcgggacaggagcccttctccttcggcctcatccagtcgctcgcggaccagaaccgcatcatctgcgacaagtacggcgccgcgcgcctgcgcaacgactccaacgacttcagcctcgcacgcaagctttccgacgaggacctcgtccgtgccgtcgccaccatgcagcatagggacgagaaggacgtggccgcctcggccggacccatgctccaggacctgggcgtcgcgtacacggaggcccccgtgtccggcacgatcatgggaatcgacctcgagaccacggaccgctacccagaccgcggctacatcatcaacctgggcatggagttcatggagctttcgcccaaggccaagccgcacgacgggcacacggcctactttggcatcccctcgctgtacgcggaggcgggcgtgccgctgagtgacatccaccacatcacctgggacgacctcaagggcaagacgcccttccgcgaggcgcggcgcgagcaggaggcgctcctcacggcgttcaagacgttcccgatcatggcgcacaacgcggccttcgaggactcgtggctcacgctgcacctggacggctacgccgaggcgcgcaaggccggccagatcgtggtgatcgactcgcgcgacatctgccgccgcgtggacccggactacaagaccctcccccacgactcgcgccctgccgcgctggaaagctgggcaaagcgccgcggcgtgctcaccggcgcggagtcggaggtgcaccttggactcgacgacgtggacctcatgttcaagacggtccaggccgagttcaaggagcgcaacatgttcgcgtagcgccgcctgccgccgctggcactactccaccaggatcgcgtcgcggccaaacacgtagatgcgcgtctcgtacgggcgcagcgtcagctggttggcgtcgtccgtcccggcgtcctgcacgtagtagttggaaagcgccagcgtgccgcccgtcaggttgccgtacgagtctggcacgccaaacgtgacggggtccttggaaaacgagcacatcaccagcagccgcgaccactgcgattcgcgcgcgtacacgtacaccttcgtgctcgcgcgcttgaactcgtggtagcggccgttgcgcaccacgggcagcagccggcgcagcctgatggcgtgacgatagaagttcagcggggacatgaggttcttctcctcgtcctccacgttcaccacgtcgtggttggggttcacgggcatccacggctccacgtcgcccagctcgggcgagaaggacgcgttctgccgcgcggaccactgcatgggcgtgcgcgcgttgtctcgggtcgcgcgcgagaccacggccatggcctcgtcaggcgtcttgccgcccttgaccagcgcgtcgtagtgcgcgatggcctgcgggtccttgagctcgtccgcgctcgtgaggtgggcgttggtcatgcccagctcctggccctggtacacgaagggcgtcccctgctgaaagaggtagctcgcggccagcgccgtggcggactccacgcgcaggtcctcgctgccgtagcggctcaccacgcgcgggtggtcgtggttctccaggtagagcgtgggccacgccttgccgtcaaaggtctcctgccagtccgcaaacgcgcgtttgagcttgcggagagagaacggcctgggcaggtactcggagtacatgcagtccgcggccatgtggtcaaagccaaacaccaggtcgagcggacggtcgcccgaggactggcgcctcaccagacgaagtgccttgcgtgcgggcatcatgggtgtctcgcccaccaccatgcagtcgtagccgtcaagcacgtcgcggcggaactgcaccaggtactgcagcaggtgcgggccaaagttgtagagcctgagcccgcggctgcccggcagcgccaggaagtcatccggaagcttcttgggcttgctgatgaagccgatcacgtcctcgcggaagccgtccacgccccggtccagccagaagcgcatgatcttctcgacctcctggcgcacggcggggttgtccatgttcaggtccggctggcgcttgtcaaacaggtggaggtagtactcgtccagggactccacgtactcccacgcgctgccgcccaccaggctgtcccagttgtttggcggcatcagctggccgtcgcgccccttgcggcccttccggaagaagtagtagtcgtgatagggcgagtccgcgtccgccagagcctgcttgaaccactcgtgctcgctcgaggtgtggttgatcaccaggtccataatcacgcgcagcccgcggtcgtgcgcgccctgcaacaccttgtcaaagatgtccagatcgcccagatccgggtcgatggacgtgtagtcgctcacgtcgtagccaaagtccgcgttgggcgagggcgtcagcgggctaaaccagatgcccgtcacccccagggacttgatgtagtcgagcttctggtacacgccccacaggtcgccgatgccgtcgccgttgccgtcgcaaaagctccgcggccatatctggtagaacaccatgtccttgtaccattcgcttcgagccatgaggcccctccttatgaacagcccaccgggaccgggcacggctgccgccgcgggcgccaggcgatgggcgcccgatccggtccctctatgggcgattaagtcttgctctccattttggttccgtcgcccaaaattgcaatataggtttcgtgtacaaaaaaggggcgagaagaacaatccttctcgcccctaacctcttatgtagcggagccaatccgcgtgactattagtgtggtatctctccttaatcggccaccccctaccggggtgtggcaccacctacgggaaacagcgggcgccttgcccgcgcacatcaaaactttggtctcaccctctagctggtcccaaaccgcgggacatcccatattcccaagagcttgcgaccgccctcgcggtaaacgcacaggctcgaaaagaatccctactgggtcaaggcgggaacgcgccaaccatcgccatcttccgggtaagctcgaagcctggcgagcgtccctcccgtacgtctgccttccggatcccagctgtgcgcccacaatctgggtcacgaccgcggtgcccaaacgctaccgcccatcaggagagcctagtgatccttgggcagacgtactgaatggcagtcatctaagcccattggaatcacctccaaaatcctggtcgccaccctggcggcctttccaactgtcctcattctacccgcggcggcccgttatatgcaaacggacggatacttttttgtttcgagcaaatgtacaggtcagcagcccgataagcacccgacactagcgcggctttctgtgcgtcagatgccatccgccgcagatttcgcacttgtatgcatagagctgcggcgcgtccttgcggctcgcaccgtgcgacgcggccttctttgcctccgccttggactcgtagcgccgcttgcgcgcgcaggcgtggtactcatggtcgtgcaccttgcccgcgtccacggcctggccgtgtatgacgcgccccgcggtggagtgtccctggctctggccggcaccgtgacgatggctcatgcctcgtcaccggaggccgcgtccttctcgcccttcttgcgcttcttgcccttcttgcccgacttgtgccccttggacttcttgcccttcttgcccttgccgggcttgctagactttttgtccctgcctttggcgtcgcccgcgggaagcggcacgtccgggttccacgcgcggtgcagcgtgcggctcatga

SEQ ID NO: 225 - DNA, 17107 bp, Unknown
  Metagenome-assembled genome
gatgtactcgtcgccccactcctcgatggcgtcgagcaccctcttgaacctgcggccgatgggcgtgagctcgtactccacgcgcagcgtgccctccgtgctcacgtggcggctgatcatgccctccttctcgaggtatttgagctggttggagagcgtgccctgcgcgatctcgatcctgcgcatgagctcgttgaagcgaagcggcccgcccgagagctggtagaggatgatgatggcccacttgccctgcagcacggtctgcgtcgtgacgtaggggcagatgccaaagagctccttgccctgctttctgacggtttcccgcgcctgcccgatgtccatgttcttctctcccccttcaagcctgccagcgtggcggacgtgcgccaccccgacggacgagtcatgtaaaagtgacctggtaaccagaaaaatcctagttgacgctccgtttgcgttccgtattctgatgttagttcaagtttctgacttagtccagaacttgaaatgacatcgggacattgccacacgacgggaggaaccgccatgagcatctatgagaggaccaggggcaagagggtcgacgtcgactacgagaccggctaccactttgtgatcgagtacctgagcgagggcgagctcgcctggacggcactctccaagaccgccgagggcgcgcccaatcacgagaccgagccgtactccagcctggagctgggcgacgatcgctacatggtcaactggatcgaggagtcggggctcgtcgtgtcgcaggtggcggactttgccaacggcaaggtcttcgcgttcatgacctggccggacgacagcgcccgcggcaggcgcgcggagctattgcacaagggcacgcttaccgtgctggactgacaccagcaaccaccagccaaaccgcagttatgtgagaaggacggccaccgtggccgcacttctcgcccaaaaaagaaggagatcgaaatgaccgaagcaaggaagatcgcagtcgtcgcgtccaacggccgtacgggccagctcatcgtgaaggaggccgtggaccgcggcttcgacgtgaccggctttgcccgcagcgccaacaagtccgccgcgcagcactttgtccagaaggacatcatggacatcaccgccgaggacctggccggcttcgaggcggttgtggacgcctttggcgcctggacgcccgagaccctgccgctgcacaccacgacctcgcagcacctggcggacgtgctcagcggcaccgacacgcgcctgctgatcgtgggcggcgccggctcgctctacgttgatcccgagcacaccacgcagctctaccagaccccggacttccccgaggcctacgtccccacggcgtccgcccaggccgacgagcttgccgagctgcgaaagcgtgacgacgtgaagtggaccttcgtctcccccgccggcgacttccaggccgacggcgagcgcaccggcacgtacatcctggctggcgaggagctcaccctgaacgatcgtggcgagtccgtcatcagctacgccgactacgcgctggccatggtcgacgaggtggagaagggcgaccacatccggcagcgcatctccgtggtccgcaagtagcgactaccggcaggacgccgccacgccaccattggcttagaatcgtctcgtcgttcgggcacacgtcgcgcgcgggcggcgaggctttttcacgcaaggaggactccatggcagacaccgacggcacgatggacgagctcgcggtcacacaggcgggaaaccccggcaacccgcacggcgagtttggcgagcagatgctcgagcgcatgaaccggagccacgccgaggtcaccaactgggcgcttgaccagctggaattcaaggccggtgaccgcgcgctcgacatcggctgcggagggggcgccaccatgggacgcctcgcgagctgcatcgaggccgcgggcggcatgggacacgtgagcggcgtcgacatatccacggtgtcctgcgagacctcacgccgcaacaacgaggaggcgattcgcgccggcaggatggacgtgacccaggcctccgtggagtcgctcccgtttgccgacgggagcttcgacatagtcaccacggtcgagagcttctacttctggcccgaccccgagcgctgcctcgcggaggtcgcacgcgtggtgaggccgggcgggcgcttccttctggtggcggacgtctaccgccgccccgacctcgcggaggacgtgctccagaacatcgagcgctacgacctgacggtgctcacgccggaagagtacgagcagctgctgagggaggcgggtttctcagccgcgaaggcgcacctcaaggacggcactacgtggatcgccgtggagggcgtgcggtagatgggaatgccgaccgtcgcgttcgtctgcacgcacaacgcgtgccgcagccagatggcacaggcgctggccgagcgggtcatgcccggggaggccgcgttcttctccgccggaaccaatcctgcctgcggcgttgacgcgggcgccctggaggagctcgggcgccgcagcgtgccacggaaaatcctcgtggagctgcgcccgaagcgcctctccgagctgcccgggcacgtcgactggctggtgaccatgggttgcggcgtcagctgcccctcgcttccctgcgcgcaccgcgaggactgggggcttgcggaccccatgggcggaccgcgcgaaggctacgttgcctgcgcggacgagatcctgcgccgccttgccggactgcgcaacaggatgcgagcggactccgaggattgcggcgactagcaaggaagcgtccccgcccggacgtcgagacgctgatgccggagttcgaacgctttgtcgatcgcatacgcgggtgggcggtcttccgcccaggttgtggtttgtggagcttgccgcggcactctgccaggaggcgcggggactccccttaagggtaaaggcgagatcgcaccgttgacatcggacttcccattccttatattgtgacagtcattgatacatgaaagggacgacaatgcacgacacaaggctctcctccgcaatccacatgctcatcctcgtatccgaggcggaagcaccaatgtcctcggcacagatcgcgaccagcatcggaacgagcgcggcggcggtgaggcggctcgcctcgtccctgcacaagggcggcatcatctccggcaggaggggcgtcaccggattcacgctcgaggtggaccccaggcagctcacgctgctcgacgtctaccgcgcggcctgcgacgcggacgaggtccacgtgttcgacgtgcactgcaacccctcggacgagtgcatcgtcggcagacacatccagcagacgctcggggaaacgtacacgataatcgattcggcaaccgaaggggccctccaatcgatcaccctcgcggactgcatcaaaacattaaggaaagaggccatcgcctcgggcgacatccagcccggaaagacagggctggcatgagggcggctcttctcccctccttatgctttcgccaggcttttgcccgacctctcggtcatgagggacatcacgaccacaaagacaagcaggtagatggggtaaatccgcaggctcaggacgtcggatagcatgccgaggaccttcggcccaagcgtgcttcccacgtacgcgcaggccatctcgatgcccgtgagggactgggagttctctgcgccgaagcgcgccggcgtggagtggatgatggacgggtatatcggggcgcagccaaggccgatggccacgaggccgaggaacgagagggcctcgatccgcgggaccaggcacaggatgccgagaagggctatgccctcccccaggcgaatcatgttctggtcgccaagcctctccgagacgaagcccgagatggcccttcccaccgtgatgccaaggtagaagagcgaggccagcgacgccgccgtctgggccgcaaccgagcgctccgcgaccatccagctggcggcccaaagccccgtggaggactccagcgcgcagtagcagaagaaggccacgaggatggaggcggcgccgggaagcctgacggcgtccttcagcggcacgacgttgcgcgtctcctgagcatgcgcgtccttctcgcccttccagagcggcagggacaggaagatcacggcgctcagcacgacctggatgacgccgatggcgcggtaccccgcatgccaggaggcgtgccgtatggcggcgcccatgatgacggggccggtgctggcgccgatgccccacatgcagtgcagccacgacatgtgccgcgccttgaagtgaaggctcacgtagttgttgagcgcggcgtccacggcccccgcacccagcccgtacgggatgcaccacaggaccaggtgccaatacgcgccgctgatggagaagccgaacagggcgaccgccgtcgtcaggacggagacggcggtcaccttcccggtgccgaacgcgcggatcagccggtcggacagcagtgacgagacgatggtgcagatgctgatgatcatggccagcgtgcccgcgtccgagaccgtggcatgcatgccctcgtacatcacgggccacgcgcttcccaggagggagtccggcaggcccagcgatatgaacgacacgtatatgactgcaagcaagagcgaaatcattggaccccttagtcctcgatcttgtggaacaccggctccatgtggtcgaaggtgcagaactcggtcagaccgatctcgtcgcgcacgatcctgcgggcgtcggcaaagtggtcgcccaagaacgccgtcttgtgggcgtcggagccaaaggtgaagaccttgccgcccaggtccttgtagagcgcgagtatcttcctcgacggctgcgtgtccgccagcccgtagtgccaggaggacgtgttgatctcgattcccttgccgtcgcggatggacagcttcaggatctcggcaacctggtccctcaccttgtcgaacggataggggcccgccgggtcgtagcgtgccagaaggtcgaggtgcgccagcacggagtagtccttgaactgctgctggacgcggtagatctcgtcgtagtaggcgtcgttgtactcctgctgcgtgcggcccttgaagtactcgccgttccagaactcctggttgtccacctggtgcatggagagcaggacgaagtccaaatcgtcgcgatacgtggagaagagcgtgcggtacttgccgagggtgccggtctggatgccaaactcgaggccggccttgacgctgaccctgcccgcatactcctcgcgcatgcgcttggcctttgcgaagtacttcgggtagtccacgttggccagcggctcccggtcgtccgcggaggagttcacgccgtcgccgccccggtacatgatgcccctggggtcgtcccagtcgcgcttgatgccgtagtccacgtggtcggtaaagcacagctcgtcgaggccgatctcgatggcgcgctcgacctggttctccatcggctccgtggagtcgtccgaaaactcgctgtgcaggtggtagtcagccttcattccgctttcccttcaatcaaggcggttgttcttctccacggattatatcgtcacaaaccgagtattattaggacgtaatcctcatgtcaatgggagaatatcgccatgttgcaacagtcgaccgaccagacggacgagcgcggcagggagcggctggaatacgggacccgcgagttcccggcggcattcttctacgacgacctggacgtggtcaccgtgccgtggcactggcacgaggagttcgagctcacctacatggtgcggggctcgctccgcgtgcgggccggcggcgccagctttgacgtgtctggcggggacgcctactttgtgaacgcctccgtcatgcactccgccgagccgctctgccgcggcgccatccagaaggcgtgcgtgttcaacgccaggctgatcgccggcgaggactccgccatctaccagcgctacgtgctgccactgatggccaggggcgacctccccggctgcgtcatccgtccgcggggcgagggcgagaaggacgccatccgtcgcatcgagcgcgcctgggacgcgggcgcctccaacgccaggcaccacgaggtcacggtccgcgacgactacacggacgtcctcctgtacctgctggagagcgcccccgcgacggtggcggcggacgcctccaagcggacgcatcgcgaggagctccgcctgaggcagatgctcgcctttgtggaggcgcactacatggaccccatcaggctggaggacatcgcggccagcgcgcacataagcaccagcgagtgcctgcgctgctttcgcacgctcacgggctcgacgcccatgcgctacgttggcgaggtgaggctgtcaaaggcctgcgagctcctgaccggcacggacctgacggtgacggaggtcgcggcccgctgcggctaccgggaccccggctactttgcgcggcagttccgcaagggcaggggtatgacgccggtgcagtttcgcaacggcggggcaaggctccgtagctcccgctgagggccggccccggggtcttgctccccaggctcgtacacgtgaaccgccgccacgcggacgacttcgaacgcctggtgacgggcgtcccgcacctgctgtagaaaacaaatggcttcttcgccatcggtatcaaacaccctaacgcggggtatcatgtacccaacggcgtgccttcgatgtgggctaggcggcgccgtttactctaacgccggtagttgccgctaccggcgccttttgtgtcgcctccttcgagctttggacctgggccttacgaccttgctgagcagtccgaccaccgcggtggccaggttgacgagcgcgatcacaagttccatagactgtgcctccttatgttgcagggaggcgccgccagcacgaaggtgccgttgggatgatggcctgatacccatatctacctgcgataatgccttgcagttaacttttccataccaacgctcccgggttcgggcgcattgcgggtccgtggcgcgcgatctgggcggatcggtggcgctggggccagactaggcacgcgacacagctcggttcccatgcaccacgcatggataccgtgagaacgcgacgcaaggattccgtttcccatgcgttcgggcgaacggttcccttgcgtggtgcatgggaaccggccccagaccggcccatttcgggccaaacgcaaggattccgcccttgcaaacgcatggcaaacggaatccttgcttgccaaaacgacggttcccatgcgcggcgcatgggaaccgtagatggccgatacgaggaaggcggtcgccccgcgttgccaagggcacaggcgcagataccgtcaaacggccaggcgcaggaatcgatttctgcgcttgcggccagcgcgcacatcagcaccagcgagtgcctgcgctgcttccgcacgctcgcgggctcgacgcccatgcgctacgttggcgaggtgaggctgtcaaaggcccgcgagctcctgacggtggcggaggtcgcggcccgctgcggctaccagaaccccggccactttgcgaggatgttcaagaggaactggagcgtgaccccgatggcgtttcacaagaggggcagggcgccgtagaaaacgaaggtccctccgtcgtcggtatcaagagccctaacgcggggtatcatgtacccaacggcgtgccttcggtgtggatcaggcggcgccgattacgttaacgccggtagttgccgctaccggcgccttctgtgtcgcctccttcgagctttggacgtgggcttggcgactttgctgactagcccgaccaccgcggtggccaggttgacgagcgcgatcacaagtcccataggctgtgcctccgtatgtagcagggagacgccgccagcacaaaggtgccgttgggatgatggcctgatacccacatctacctgctgaaataccttgcgattaacttttccacgccgacggggctgacacttgtatgccacatgccgcagccgagctttgcgttgagcggcagggcgagaccagcccgccgttcgacctgcttgtccgtgcgttgggttgttgcctaccggacggtatcccatacggcgccagaccagtcattgcggcgcacgagcggacgggtcggaggttgataccagacgaggccccggcgcggcgcggttcccatgcgcgacgcatgggaaccgaaggtggccgacgcggggaggacggctcccccgtcaccgccgtaagcgcaagcgcagattccgtcgaacggccaagcgcaggggtcggttcccgtgcgtcgcccgtcgcacgaccccgtgcgccccgcggttcccgtgcttgaacgcgcaggaaccgtcgcgaggtccagcgggcccggcactccaagcgcaggaaccgatttctgcgctcatgcgattttcggtttctgcgcttgcggccagcgcgcgcgtaagcgcgagcgagtgcctgcgctgctttcgaacgcttgcgggctcgacgcccatgcgctacgttggcgtggtgaggccgccaagggcctgcgagctcctgaccagcacggacctgatggcggcggaggtcgcggcacgctgcgggtaccgggaccccggccacttcgcgcggcaatctcgcaacggcggggcaagaaaggcggcaacatcgtgaacgtggattgggatgcggagaagtacgcgcgggacttctcgtacgtaagtgcctacggcgagggcgtgctcgggctggtggactttggccccgggcggacagctcgtgttcgagtttggcggcgcgggcaacaacgcgctcatccacggggcgctggccagcgcgtttgctgaggcggggctcgcgtaccgcatgccgttctacttccccaccatcggcgagtacgcgcccctggttgaggcggccgggctcaccgtcacgcacgcgacgctgttcgagcggccgacggagctcagcgggcccgacggcctgcgcgactggatcgacatgtttgtgaaggcaccgtttgcgggcgtggacgccgcgacggcggagggcatcaagcggcgcgcggtagaggcgctgcgcccgcggctgctgcgggacggcacgtggtacgcggactacgtgcgcatacgcatgcgggcagtcaagcggtagcggccgcgtgcaacccaggcccgcgttgttgcaactgggttgggcgccgcggtccggcgcgcctccctcgtgtacattcgtcttgacacgaggagaggaggccgaccgatgaaggtcagtttggaagagcgcgacgggcagcgcgggatcgaggtcgcggtcatcgcgccgccccgcgacccgcgcgtgccgcggctgcttgcggccatccgcctgtgcggcgggcgcatcagcgggtacgagagcgcttcgagcgcgcggcgccgggtggtcgcgcttgcagatgtctgcagcgtgcgcaccgccggcgaccacgcggagctcctgctcgcggacggcaccacgctgcagagcgcctcgcgcctgggcgagctggaggcggcgctcgcaggcggcgcacccgagggcgatgtcacggcaaacgagccggctaccagcgcgtttgtaagggtttctcgccaagagatcgtgaacctggacaacgcgctcaccatccgccccgagtttggcagccgcctgctgctggggctcgccggcgggcaccaggcgctggtctcgcgcacgtacgctcgcgcacgtacgcgccggcggtcaagcgcgccatcggcatcaagtcctaaaccatcagaaaggggaagaccatgggcaagaacatcgcgggcgagaagaacggcctcgtttacggcacgttcaatccggacgtgcaccccacggcgggcggcgccgtcagcatgggggtgtttgtgggcagctcctgggccgtggcgggaatcggctgctgggccgtggcgaccggcatcgcgcgcggcgggctggacgccaccacgggcatggtgctgagcatcgcgatcgccatgctggcgggcggcatcctgcagcagctgtggttcaactttgcgcctgcctttaggatgagctacccgcgccgcatcgcgggatttggcgtcacgtactacgcggtgctcctggcctgcgccacgctgggcgcgtggctgcccgcgggcaacccctacgctctggcggggttcacggtcagctatctggcagttctggccatcctcaccgtcgtgttcaccgtggcgctgcgccaccgggtctccgcgtaccagcagatgctggaccgcttccaccagggcagggcgcgcaagtaggggcggcaggcgctggcgggcacccgtcaccaccccctacccgcggcgacgcgcgtccgcgttgacccgatcgttccagccggtcggcacgcagcccaggtcacgggcagcacacgtggcctcggccacggcgtcgtaggcaagggccatgccgtcggagtcgctcacgtactgggccacgtggtcgcggccgatcccgagctggcccgcctcggccacggcgtcgatgttggcgcccaggaacacaaactcccagccctggcgccggtagccctcgaccatgcggcgcacgcggccgtagccgtagcggtggctggcgttttccagcccgtcggttatgaccacaaagaccacgtgctccgcgcgatagccgtccggctggcaggcctgcacctttgccgtgtggctgatggcgccgcccagcgcgtccagcagcgcggtgcagccgccgggctggtagtcgcgccgcccgagcgggcgcacgtcctcgatcggcctgcggtccacggcaacgtgcgggcggtcgttaaagaacacgacggagacgtttgcctccccgtccaacctgcggtttctctcgagcgttgcgttgaagccgcccacggtgtcgccggcgagctcgtacatggacccgctctcgtccaccacgaagaccagctccgtcagcccgcggcgggtgccgccgtgcagcctcaggacgtcgcggtcttctcccccgcgtccttctcccctgccgtaccttgcgcttctcttttgctcgtagcctgccatcgcgcgctcccttccgggcggtcgcaccgcccttgacctcgtgttgccacgagtctaggggccgcggcgggcctctgggtaaactgcgaggctacatcgcgggagccggacggcagcgcggacttgcgcctggctgcggcctcggcgcctacgacacgccgagcagctgctggtcgtgccggaagagcgcgaggttgatcgcgtccacgtcgtgcacgccgcggccgatgtagaactccacgatcacgtcgaacttgctgttgtgcgcgagcgagtagcccgcgcggccaagcagcagccgcgtctgcccaaggtcgagccccagcgccacggcgagcgccagcaccacgcgcttgctgggatggatcttgcccgaccgcagcttgctgaagtactgccgcgtcaggttggcgcggttgtagacctgcgcgtccgtgaggccgcgcgcgtcaatcatggagagcagcgtgtccggaaaggaggcgtcaaggttgcggagaagatcgtccagctccgcctcgggggcgtctcccagctgcatgggcgccgcggcagacagggcaaagtccgcgccaccggaggccggccctggcaccggggcggacccatattccgcggcaggctcaggcgccgcggaggcctcccctagccccagctcccgcgccaggtcgcgggcgccccgtgggtggcggcgctcgcactcgtccacgtaggcctggtcgatgtactcctccagctccgcgtcgagcccgcgggccgtcgcgcgggcggccgccgtggcgtcgcgatcgaacaccacaaggtagacgtccatgtcacgggggtcgtccttctcgcccgccacgcgcttcttgcccggcgcaacgtccggcccgccgcacagccagccgcggatcgccgtggtcgcgacgtccatggccacgtctttggggcagtcaaacgcaccggaggacacgagcgggaacgcgacggacgcggctcccaggccgcgagccacgtcgagcgagcgtgcgtagcagctggccagccgggcgcggcggcgcgcgtcttccgcgggggcgccgtcccagcgcgggccggccgtgtggatgacccagcgcgcaggcaggtcaaagccaggcgtggccacggcgtccccgcaacccacgtggccgatcgcccggcacgcagccttcatgcggcgctcgccggccgcgcgaaagatggcgccgcacacgccgccgcccatggacaggcactcgttggcggcgttgactatcgcgtccacccgcatgcgggttatgtcctgacggaccaaggtaagtggcatgtcgctccaattgcggccaaagtgatgcgcgggagagaagcccaaggcccctcacccgcatgatacatcccgcccccggcgcgtgcccggcgcgcgcctgccgcgtgcaagggccttgcatttgcgcaggcagacgcgtcgtttgcgcgcactcgcgccccgccgctaagcctgccggggcgcctactcctgcgccttgagcacaagcgagagcagcaccctgccgatgcggcgcatgtgcaggagcgccaccacgaggtaggtcgcaaagccaatcgcaaggtccgacacatagcacggacatgcggggtggcaggcacttgtctgccaccccgctctgcagcgctcgacgcgcatgattgttatggtcggggcggcgggactcgaacccgcatggtcttaaatccacgggcacctgaggcccgcgcgtctgccaatttcgccacgccccgtttggaagctggcttcccgtccgcgattcgaacacggatcgcctggaccagaaccaggagttctgccgttgaactaacgggaatcgtttgtgtgtggtctgcctaggccgcaatcagcatgggggcaggaacctgcccgccctgccgcaacagtcgtaactgtcgcaggccatgcccctggcgccgctgggcgcactgggaatattgggcgcacttctcgcccgtcgcgaggccatgccccgcccgagccgccgcgagctccgcgcgaagccgcgcgttctcgagctcgaggcgtgcaatctcggccgccgcgtcccgcgagcgcgtgccggccacgccggtcgccccctcgcgtgcggcgcacacgaggcgccgaaggtcgtcccggcggtaaagcgtgctgcgagacacggccgagcgctcggccacggagtagaaggacacgggctcgtgctgcacgagcagacctgccaccgccttgccgacgcggatggatatgctctcgctcatgtccgccggcgccgcgagcgccgcggacgagaagcgcaacgagtgctcgcccatgttccctcccccatttccgtaggccgtatgtgggccagtcagtagaccgagcgtctgccggagggcctctccctccgacgccttacattgtgcaccatgcgcgccggcctgccagcgcgattgcccagatgagacgaatgggacggtgggcgaaccgggcgcctcgccactccatccctcccgtcccacggaagcgctccgcaatgaactttttttggcaggcttgcacccgaagggggtttgagggtgttttatagttttaaagctgattgaatcagctgtcaggcgtccaatctggtacgtcgatgcgcacagaatcctacttcgtaactctcaggtggtctttcgtacgtctacacgagccctgcaaccttacgcacggagtcaaaaacaccctcaaatccctttgcgttgcacgcggcccgaaaaaacctgggatggcctaccggttggtgccagcggcaatcgaaaccaagcgccttggggcgatgcaccgtccacgtaccggcgcatcgtcccacgcagaacacgcaatgtcagctggccttcgtcgggctgaagccaggtcgagctgcgggctcgctacgccgtcgcgcccgcagtgcggcagctgaaattggccacgtatcccaggtcgtccttgtggccgttgaagaagcggaacatcctcgtgaacatctcgaagttctcctgcttcatcgcgttgaacatgatcttgagcgcgccgtcggtcccctcgtcgtgaaccataccctgcgggtcaagcagcgtcatgtccccggacttctgctcggtcacaaacccatgggactcgatcctgctcttccagccctcgcggtcaagcggctcgacgctcacgttgatggcgcggctgaggccccggcgcagctccctctgctggtccacgtcgtccgtcctgaagcacacgtcctgcgtcagcagcaggccgccgggcttgaggatgcgcgcgtactccgcaagcgcccgatccttgtttttgccgggaagcatggtgagcatggcctcgttgatcacgatgtcgaagctctggtcctcaaagggaagctcgaacgcactgccatggacaacggtcaggctatcctccaggcggttcttgccgatgttagcacgcgccttgtcgagggcccgctcatccaggtcgattcccgtcacgctgcacccgtagcgctgcgccagcatgaccatcgtggttcccatgttgcacgcgacctcgaggactttggtatccgggccgatgttcgcctggccaatcagccactccgtcgcgtcgatcccgccggggcgcagcttggtcttcccgagcctcgccaaaaaggtgtgtcctgcctcctgcatgattcgtgcctcctccgtgatgcagtaagttaaccgttgctaactctagggtagcatccggaggagtcgcggcaatatatgttactaatttacgtccattttgattcgactcggtcgtgtcgcacgtcaggccggatatcgtcacacgccgggtgtcgcgccagttccagcagcggcagatggttccctcgtcgtcccagtagagaacctcacctggcagcgacgggtcatcctcatccgaacccaagctcacgaacggcttgccgccccgccgccacacggcgaggccgcgtaatgctaacgtatcctcagctttgcctcagcaataccaaacctacggacaggagcgcatatgagcgagaagaacgatcgccacggccttggcaccacctgcgtgcagggaggctacacgcccaagaacggcgagccgcgccaggtgcccatcgtgcagagcacgaccttcaagtacgacacgtcggacgccatgggccgcctgttcgacctcgaggattccggctacttctacacgcgcctgcagaacccgaccaacgacgccgtcgcggccaagatcgcggcgctcgagggcggcaccgccggcatgctgaccagctccggccaggccgcgaacttcttcgcgtgcttcaacatcgcggaggccggcgaccacatcgtggcgagctcggccatctatggcggcacgttcaacctgctggcgcacaccatggccaagatgggggtccagaccaccttcgtctctcccctgtgctcggacgaagagctcgaggccgccttccgccccaacaccaaggcagtgttcggcgagacgatcgccaacccggcgctggccgtgttcgacatcgagcgcttcgccaaggcggcgcacgcgcacggcgtgccgctgatcgtggacaacaccttccccacgcccgtgaactgccgcccgatcgagtggggcgcggacatcgtgacgcattccaccaccaagtacatggacggtcacgcggtgcacgtgggcggcgccatcgtcgactccggcaactttgactggatggcccacgcggacaagttccccggcctcaccacgccggacgagtcctaccacggcatcgtgtacgcccagaagtttggccaggcaggcgccttcatcaccaaggccacgagccagctcatgcgcgacttcggctccatccagagcccgcagaacgcgttctacctcaacatgggcctcgagagcctgcacgtgcgcatgccgcgccactgcgccaacggccaggccgcggccgagttcctgagcaagcaccccaaggtggcctccgtgcgctaccccggcctccccggcgacccgtaccacgagctggcggagaagtacctccccaacggcagctgcggcgtcgtgagctttgacgttgccggcggtcgcgcggccgcggagaagttcatggccgcgctcaagatctgcaacatcgagacgcacgtggccgactcgcacacctgctgcctgcacccggcgagctccacgcaccgccagatgaccgacgacgagctggtggccgcgggcatcagtcccgcgatggtccgcctctcgtgcgggctcgaggacgcggacgacatcctggccgacctggaccaggcgctcgccacgctgtagtcgcgccacggcgcgaggcgggcactcctagcgcgggcggcccgcctcgcgctcccgctccatgcggtcgatctgttgctcttcctcgcggtcctccgcgggggtgacgggcgtgacgtacaggccctccgtccaaccggcgggctcgccgcggctgaggtggcggtagccgatgacggagaacgcgaccgcacccacgaagttgaccagcaggtccttcatggtgtcgatgaggccgatgtcgaggtatccgccacggatgtgcgtggtcttgccggacgcggtggtgatggccgtgtccttgatgttatcgatgtgaacgcgctggccggtgtccgtggggtcgagcgagaccgaggatatggacgtgaccacggtgtccttctgcatgtccaggccgagcgtggtgtcgaagccgaactccacgaactcccacagcacgccgaccgtcatggagaagcagaacgccacgagcgtcacgtacacgggcgacaggctgacctttttgctggagcggttgaggaggtcgacgagcgagaagcccacggccgcgcacaggaagccgttgatggtgtggagcaccgtgtcccagccggggacgagcacgtagtagtggtcgacctcgcccaggatctcggccgcgaagatgaaga

SEQ ID NO: 226 - DNA, 1973 bp, Unknown
  Metagenome-assembled genome
gacgagtaaggagaaggacatggctacgaacgaagtctctactcgcaagaagatcagccagttcttctggcgcagctgggccatccaggactcctggaactacgagcgccagatgaacatgggcttcatgtacggcatggctcccacgatcgaccgctgctatcccgatgcggacaaggacccggagcagatggagcgcaagaaggaagcgtaccgtcgccacatggcgttctacaactgcaccccgcagacgagcgccttcgtgctgggcctctccgcctcgatggaggaggagcttgcagaggaccccaaggccttcgaccccgacgccatcaacgccatgaagacctcgctcatgggacccctctccggaatcggcgactcgttcttccagggcacgatccgcgtgatcgcgttcggcctcggcgtgagcctggcaaagcagggctccttcctcgggcccgtcctcgcgatggtcatctcgatcatcccgtcggtgctcgtcacgtggttcggcgcgaagctcggctacgagggcggccgcgacttcctcgagaagatgcagcacggcgacctcatggaccgcgtgatgtacgtctgcggcatcgtgggcctcatggccatcggcggcatggtcgcgaccctcatcggcgcgacggcaccggcgaccttcgtgaacggaacggtgaagatccagaagatcctggacggcatcatgccacagatgatctcgctcgccctcgcggggctcatgtactggctcatcaagaagaacgtcaagtccggctggatcctcgcgatctgcatcttcggcggcatcctgctctccgtcctcggcatcctcgcgtagcgatcgcccgggacaggcggaaacgacagacaaagccggaaggcgaccagtgccttccgaacaaggaaaaggagatacgtcaatgttcgagatcgacctcagcaagcccaagcagatagtggcggacgtcctcaaggaccaccagatcgactcggtggcgttcgttggctgcggcgcgtcgatgagcgagctctaccccgcgaagtacttcctggcgaacaacacccgcacgctgaacgtgcagctcttcaccgccaacgagttcaactacgacaccccggcctgggttggccccaacacgttcgtcgtcacctgctcgcttggtggcaccacgcccgagaccgtcaaggccaacggcaccgcaaaggcgctcggcgctcccgtgacggccatcacgcacaacgcgacctccccgctgaccgagggcgtcgaccacgtgatcgtgcacggcttcgagaagaactacgccgccaaggtggagaagatgggctatgcccttgctctcgcggttgagctgcttcagcaggtggagggcaccgacctctacgaggacatggtcaacggcctcaacaaggtgtacgacctcgccgaggacgcggctgagcacgcgggcaagcttgcgagcgccttcgcggccgacttcaaggacgaccagctcatctacgtgttgggctccggcgcgagcgcgaaggtcgcctactccacgtccatgttcctgttctccgagatgcagtggctcgactccgccgcctacaactccggcgagtacttccacggtcccttcgagctgaccgagaaggacaagccctacctgctcttcatgagcgatggcgcgacccgcccgatggacgcgcgtgcgctcacgttcatgcagcgctttgacgccaaggtcgccgtcatcgacgccaaggactacggcctgtctggtgtcgtgggctccaaggtcgccacgtacttcaaccccttcgtgcacaccgccgtcatgcgcgtgtacgccgagaagatctccgaggcgaggcagcacccgctcaccatgcgtcgctacatgtggaagcttcagtattaggcgatgctgcatgtcgcaggccgtccttgcgcgggcggcctgcttttttgtaggcga

SEQ ID NO: 227 - DNA, 4273 bp, Unknown
  Metagenome-assembled genome
ctagctgctgcgtcgcaggttgattgcagctgcgggccggacccacgtggtccggcccgttttttgttgccgcggcccgcaaccaagccgcaccccgagttcctacaccgccagcttggggcgcgggcagctcaggatgatgggctcgccgtccgtggagagcctgccgtcggtcacggtgacgtcgcgtccgtcgatcaggttcgcgtacgtgccgtcgggcgcgtcgacctccacctcgcaggccacgcccttgagcgagaagaccccaagcgtccgggccgcgtccgcctcggcgccagagaggtggtcgcgatagacgacggccacgttcttctcgtcatccgccttggcgtggtagtagtcgtccgggcgcaggacgtcgcggttgatgccgtagagcgtgcgcatgagcgagctctggtccagggggccgtcccagcggccgtcccagtccacggggtcgcggtcaaacagactgggcgtgtggtcgcagccaacttcctggccggcgtacaggagcgtcgtgcccttgaggaagtacatgagggacagaaggttgcgcaggtcgcgggggttgctgtcccagctcgcgatgcgcgggaggtcgtggttctccaggtagcgcatcttgtcgtagttggcggggtagacgctgtcctggaagtcgaccaggtcaaggtagtggctgagcgtcgccttgccgcgcaggtagtcgtcaaacgtctcctggatgtcgtaggagtactcgatgtcaaacgcccggaaggcctccgtgtcgcgggcgcagttcatgcccagcgcacggcaggcctgggcaaacgagcggtgcacggtctccgcgagccagatggcgccgggacgcaccttggccacggccgcgcgagcctcctcccagaactccacgggcacaaaggacgccacgtcgcagcggaagccgtccacaaactgcgcccagtagcacagcgtctggatctggtagtcccacagcgggcggttccagtggccgggcgtgccgtagtccaggtcgatcacgtcggaccagtcgcccacgtggtttccgggctggccgtcgggcttgcgatagaagaactccgggtgctgctcaaacagcacggagtcggggctcgtgtggttgtacacgacgtcgatgatgcacttcatgccctgcgcgtggatcgcgtccgccagccgtttgaagtcatccagcgtgccgaactccgggttgaccgcacggtagtcgcggttggcgtacgggctgccgagcgtccccttgcgccccttcacgccggtggggtggatgggcatgagccacacgacgtcgacgcccaggttgtggatgcgctcgaggtcgggtatgagcgagaggaacgtgccctccttggtgtggttccttacgaagacggaatagattacctgctgtcgcagctgcggatcggtgtcctgtgccatgggcgctcttctccttagcgtcgtatcgtccgtgtcgttcggccactcatagtaagcctactggctcgttgcgggcctcgtctatcgcgggttcgctccatagcgcttctgggcgagtttggcaaatcagaaaacgtttccggacggaatgctacgctcacagaggaatttcccacgttcgccgccagtttccgggaattgaagctcttccgcttgactgaatctccaccaaagtggttcaatgcagtcacgcgctgaaaacgttaccagtaacgtttccgttgccgcgatgtgtcaccagcggcaacggcaggtaaacgaaggcgcggctaggtaagcgaacgagcatggattggggggcgaagatgaccataaaggacgtcgcaaagtactgcggtgtttcggtcagcaccgtctcccgtgcgctcaacggccatccggacgtgagcgaggacatgcgcgccaaggtgattgacgcggcgcgcctgctccactacgtgcccaaccgcagcgcccgcgaccttgccagcaaccagtctgacacgctgggccttgtggtccgtggctcgaccaacccgttcttcgacccggtcatgcacgccatcgagtccgagtgcaacgagctcggttacggcatcgtgcaccgctacatcgcctccgatggcgacgagatcgcggctgccgcggagttcgttcaggcaaagcgcctcaagggcgtcatcctcttgggcggtcgcttcgactactccgaggaggacgcaaagtccatcggcgcgccgttcgtctgctgctcgtactccaaccactttggcgacctgccgaaggaggagtactcgtccgtctcgatcaacgacatcgccgaggcctacaaggccaccaaggccctcatcgaccttggtcacaggcgcatcgcgattctgctcttctcgaccgacgacaagtcgatcagccagctgcgctttgacggctactgccaggcgctcaaggacgcgggaatcgagttcgaccgcaacctcgtcttcgagaccggcacgctctcgatgtcgtccgcatacgagaaggtcaggggcgcaatagactctggcatccagttcagcgcgatcttctccatcgccgacaccatggccgtcgcggccatgaaggcgattttcgacaccggcgccaaggttccggatgactactcggtcatcggaatcgacggcatcgagatgtctctctatacgattccaacgctcgccacgctctgccagcctcaggaatccatgggccgggaagctgcgcggatactggtggacgtcgtggaaggcaagaccaagaaccagcacgtaagactcaagaccacccaacgacccggagggtcgatgggtccggccaagaaggtaattctcgcatcttaaggggatgcgtgagggagacgtaggagggttccaaatgtttgagaagccaattacccgtaaggcgttcctgagtggcgcagccgccgtggcggcaggcctcggcctcgccggttgctctggctcgagcgacagcgactccggcagcgagaacggcaccgtctactggctgaacttcaagcccgagattgacaagaccatccagaagctcggcaagaagtacgccaagcagaagaacgtcaaggtcaagatcgtcaccgccgcctctggcgactacgagaagaccctgacctccgagatggacaagtccgaggccccgaccatcttcgtcatcggcaaccaggccggcgtcagggagtgggacgactacgccctcgacctcaagggcaccaagatcgccaaggcccagacgaccgacgactacaaccagtacgacgatgatggcaagctcgtctccgtcggctactgcttcgagtgctacggcatcgtcgccaacaccgacaacatcaagaaggccggccactccgtcgacgagatcaaggacttcaacagcttcaagaccgtcgttgaggacatccacaagaacgccagcgccaacggcttcgacgcctttgccgcgaccgatatggacgactccaactcctggcgtgtcactggccacctcgccaacgtcgagttcttctatgaggagcacaagggcgacggcaccagcaaggacgtctggaagaagacgccttccaccatcgagggcacgtacctcccgaacttcaagaacctctacgacctcatcatcaacaactccgtcaccgctcctgaccagctcgccacgggcggccacgatcctgcgcagcagttcaaggacggcaaggccacgttctatctgaccggctcctgggactacgcggacatcaccaagagcgtcaagaacaccacgatgctcccgtactactgcggcgtgtccggcgaggagaaggccggcctcaactgcggcaccgagaactgctgggccatcaacaagaacgcctccaagaaggatcagcaggcgtccatggacttcctgatgtggctcgtcaccgacgaggatgcctcgaaggagctcgtcgagcagctcggcatcatgcccttcaagaaggctgccgagtccacgaacagctggctgaagcatgctcaggagctctctgacagcggttgctacaacatggactgggctaccaactacgagcccaacgtcgacacctatcgtgctggcctcgtctctgcgctgaacacctacaacggcagccagaccgacgctaactgggacaagttcaagaccgccttcgtggacggctgggccacccagtacaagaaggccaacgcatagccaacggctcttgtaggcctgcgaggggccgggcgacattcgtccgcccggcccctcttctatt

SEQ ID NO: 228 - DNA, 2716 bp, Unknown
  Metagenome-assembled genome
cccgcgccccaagctggcggtgtaggaactcggggtgcggcttggttgcgggccgcggcaacaaaaaacgggccggaccacgtgggtccggcccgcagctgcaatcaacctgcgacgcagcagctagtcgatgacgaccttggtgacgttcgactgcttctggaccttcgggacgttcaccttgaggacgccgccctcaagcttcgcggaaaggccctcgcgcgcggcgtccttcaggtacacgccacgggttgcctgccactccgaggtctccttctgcaggtagttcttgttcttctcctcgtcggactccttcttgtcgacgctgatggagaggcggccctcgttaagctcaacgtcaatctggtccttcgtgacacccggcagctcggcggagaccacgtaggcgtcgccggtgtcctccacgtccatcttgaagccggcgtcggaggtcacgcgcgccagaggcgcgaagaagtcgtccgccgcgtcgaacggccagctgtgaagcatcctgtcgaagttgctgtaaggaatcatgcttgccatgatcatcactcccttgtgacgtgcgccgcgagggcggcgccttgctttcgcttaggtatgttccccgcgaggcggcatttattcacgtcggcacaggttttcttagcgtcacaatgtcagcaaatctaagtgcatgagggacatatttttgatttgtgttggcttgccgctatgggccatctgcgcggatttgcatcccccacgtgatttatgctagttggcgttgaatggtggcatgcaagggcaagggtgtgcgatggaccagagcgatctgaacagggcacgagcgacgcgccagacggagcacgatggctctgaccaggacattcccgacttcctggtcgaggcggcacaggcccccttgcatcatacgggcggcacggacgatgcacggtcgctgggcgagaaggacgcagccgctgccgtagccccctcggatggcggaatgagcgcctccgccacaggcacgaacgccgcacagggcggctctgcggagcccgcagacggcgccacggacgccacgtccgaggacgacctcctggggcttgacgactatgccgagtacggcgactatccctacgccgcgcccgggcagccgggcgcggacggccgcaagccgatggaccccgccgcgtacgaggagggcgagctcgactggcagactggcgccggcgcctcgggctcgaccatgggccgcagtccctacgtgaggcagcgcaccccgcacaagacgcagcccgcgattgacgacaacgcggaggacggcgcctacgcccccgagggctacgcgcacgactccaacatcgccatcggcggcgtgctgtccggcggtcacacgtaccgccgcgcgcgcaaggccagggcggccgtccagcgcgggcgctatggccagtacctggaggttcccaagggcaagcgctcgatcttcgcgacgcgcacccagatgcgcaggcgccgctcgctcctgaccaccatcgcgatcatcatcatgtttgtggtggtcgcgatcgtcatcgcgcagatggtctccaggctgggctaacggcacgccccctagtgacacgacggccggccgcggcatatgccgtggccgtctttttctgccttgcggctgtctgctaccgtctgccgtcagtcccaggggtcgcgctcgaacagcggctcggggctgggcctgcggtccgagtaggggtcgtacccgtcgtcgtcctcgttttccgcccgcaggaactccgcattctcgcgcggggcggcgtcgctcttgacgcgcgcggtgcgtggcgccttggcgcccgcctgcctggcacctgccttgggtgacgtggcctcgttcttctcgcccgcggacggcttggcaccctcgcttgcggctggcttgtgctggctcatttgatcaacccctattcgtacacgtccacgcaggcaatcatgtcgcagatgctgttgccaaacttggacaggtcgtagtcgtcgtacagggacgtgggcgcacaggtggcggaggcgcgcacggagtcgccctcgcttaccaccaggacggaccagctgtagtcgcccatcgtgccgtaaacgcacacgaaccttgcggatgtctttgtgagatcggacggcagcgtggcgttggcctccgtgagcgtctggctcgcgcccatgaagccgcagagatccgcaaggtgctgcgcgtcggcctccgttgggccggatgcgtccatcgcgatgtcagacacggcaaagtccaggcggatgccgcgcatgggcgcaccggacgcgagcacgtcgtccgtggagctccccgtcgcgaagctgtgcgagaagggcctgctccccaccgtgatgttgcccttgtccgcggaggcgtacaggacctctgccgcgccgtcgtccccggtcccggaggacgcgatggagaagccctgcgtcttgaggtactctgtcacgcgcttgacgcagtcaaagtagtcgcgaaggtgccggtagtctgacgggaacggcgacgagacctggagcgtgaccgtcgcgcccctctggattgtggtgccgggcgcggggtccgcagccacgacggtgcccgcgtcctcgctcgactccacgtacgcgacgctcgcggtcagccccgcctccgcgacggctgacttggcggcgtcctcgtccttccccaccacgtagg

SEQ ID NO: 229 - DNA, 12646 bp, Unknown
  Metagenome-assembled genome
cgctcggtgggcagggggataggaccagagacacgggcgccggtcttctgcgcggtgtcaacgatgagcttcgcggactggtcaacgacctcgtgatcgtagcccttgaggcggatcctgatcttctggcttgacacttctaatacctccatcaaatggcagcggctggctgccgttggctacttaacttaggcgttgacgccgctcttcgcgacgatctcgtccctgatgttcttcgggacgggctcgtagctcgagaactgcatggtgtaggacgcgcggccctgggtctcggagcggaggtcggtagcatagccgaacatctcgcccagaggaaccttggcgcggatgaccttggtgttggtgcggtcctccatgccctcgatcttgccacggcgaccggagaggttgcccatgacgtcgcccatgtactgctcgggcgtctcgacggtgacctcctcgacgggctcgagaaggacggggtcggactgctgcagggcgttcttgatcgccatggagccagcgatcttgaatgcggcctcggaggagtcgacctcgtggtaggagccgtcgaccagggtgaccttgatgtcctgcacggggtagcccgcgatgacgccggactccagagcctcctggatgcccttgtcgacagaggggatgtactccttggggacggagccgccgacggtgccgtcgacgaactcgtagccaaagcccggctccatcggctcgaggtcgatgatggcgtcgccgtactggccacggccgccggactggcggacgaacttgccctggacgtgctggacggcgtgaccggcggtctcgcggtaggcgacctgcggcttgccgacgttgcagtcaacgtggaactcgcggcgcagacggtcaacgatgatctcgaggtgcagctcgcccatgccggcgatgatggtctggccggtctcgtggtcggtgtggaccttgaacgtcgggtcctcctcggcgagcttggcaaggccaacggacatcttgtcctgctcggccttggacttgggctcgacggcgacgtcgatgacggggtcagcgaagtcgatggactcgaggatgatcgggtgcttctcgtcgcagagggtgtcaccggtggaggtgttcttcaggccgacgcaggcgacgatgtcgccggcggagcactcgtcacggtcggtacgatcgttggcgttcatctcgaggatgcggccgaggcgctcgcgggtgtccttgacggagttgtagacgtagctgcctgcctccgcctgaccggagtacacgcggatgtaggtaagcttgccgacgaaggggtcggtcatgatcttgaaggcaagggcggagaagggctccttgaagtccgcgtgacggacctcgggctcgccgtccgggttcttgccgtcgatctccttgacgtcaagcgggctggggaggtagtcgacgatggcgtcgagcagctcctggatgcccttgttcttgtaggcggaaccgacgaagacggggttgagctcgttggcgatgacgcccttgcggatggcggtcttcagctggtcgacgggaatctcctcctccatgaggatcttctccatcaggtcgtcgtcgaagttggaggctgcgtccaggagctcctcgcgcttctcggcggcaaggtccttgaactcgtcaggaatctcgtccatgggctcggggtagatcatgcccttggcgtcttccttgaagtcccaggcggtgttggtgacgaggtcgatgaggccccagaagttggactcggcgcccatggggatctgggccgcgacggcgttggcgccgaggcgatccttcatggtgtcgatggcgtggaagaagtcggcgcccacgcggtcgtacttgttgatgaaggcgatgcgggggacgttgtagttgacggcctgacgccagacggtctcggactgcggctggacgcctgcgacggcgtcgaacacggcgacggcaccgtcgaggacgcggagggaacgctcgacctcagcggtgaagtcgacgtggcccggggtgtcgatgatctggatgacgtggttcttccagaagcacgtggttgcggcggaggtgatggtcacgccacgctcctgctcctgaaccatccagtccatggtggcggcgccatcgtggacctcgccgatcttgtgggtcttgccggtgtagtaaaggatgcgctcggtggtcgtcgtcttaccggcgtcgatgtgggccatgatgccgatgttgcggaggtcctcgagctgatacttaacttttgccataagacactactcccctggactagaagcgatagtgcgagaaggcgcggttggcctctgccatcttgaagaggtcctcgcgacgcttcacggaagcgccaacgccgttggctgcgtccatgatctcgttggcgaggcgctcggccatggtcttctccttgcgggcacggctgaagttgacgatccagcggatcgcaagggtcgtggcgcgacgggagttgacctccataggcacctggtaggtggcgccgccgacacgcttcggcttgacctcgagggtcgggcggacgttgtccatggccttcttgaaggtggccaggggatcggaatcggtcttctccttgacgaggtcgaaggcaccgtagacgatgcgctccgcggtggccttcttgccatcgagaaggaccttgttgatgagctgggtcacgagacggttgttgtaaacggcgtccggctggacctcacgacggactgctgctgcacgacgcggcatgttgtatctcctaaaaactcgtagctaattcagatgcgaccttgcggctagttcttggggcgctttgcgccgtagcgggaacgagccttcttgcggtcctgaactgccgcgcagtcataggcgccgcggatgatcttgtaacgcacgccagggaggtcacgaacacggccgccacggatgaggacgatggagtgctcctgaaggttgtggccctcgccggggatgtaggcggtaacctcgatgccgttgacaaggcgcacacgagcgaccttacgaagtgcagagttaggcttcttgggggtcgtggtgaagacgcgggtgcagacgccacgcttctgcgggttgtgctggagtgcggcgttcttggacttggccttgtgggaaacgcggccctgacggacgagctggttgatagtaggcaaagcttctctccttaataggatcaaacggtatttggtgcgcgagcacctatgtatcagaggcagtgcagcaccgctacctcggattgttggggacagatacgtgcgcctttaccttggcttcccttcccggcagcggcccgggacagaatccttccgcaaattggcgcgacgaaaaactatattcgcccaaaccgcagatgtcaaaacgccacggtgccgggcgtatccctttttcacgccgcgtgcacaatcgcggcggcctcacgcgggcgagaagtgcggctcccccgcccgcggccgccaacggacggcatccgccacccggccgcagccccgcgggccgcgcgcctactccggcagcacgtcctccgcggcatgcgcgagtcccacgcggagcagctgcgccacgtgctcgtccgcgagcgtgtagatcatgcgctgcccgtcgcggcgggcgttcaccaggccgcggtctcgcagcagcctgagctggtgcgaaatggcggattgcgacacatggcagacttcctgcaggtcagacacgctcttctcgcccagcacgagcgctgccaggatctggaagcgcgtgaagtcggaaagcgcgtcaaatatctgcgtggcgctgtacaccacgtcgtcgtttgcaagcagctcctcgagcgcgctgtcgtttgcggccgcggtgcaccagtcctccatgtgagccccctttgtccgcacccagtttagcgcaagggacccgcccggggtctgccccaggcgggtccgcgcgtcgcgccgttgtggcgggccgccggcagccagctgtcagccagccgcaagccggagccggagccagagcctgcgccgtcgctagttgaagaagcgcctcaccaggtcgcgggagtactccgcggtctcctccatgtcgccaaacgacatgacctcgcccgcgtagtacgtgttctgccggccctggagcgcctccaccttgtcgtaccagccgtcggcgtagtcggcggagctgacgtgggggaagtagtaccagtcgtcgatccgctccgtcttcatgacgggcaggccggactttgccatgtcctccagggtggtgtcgcgcgcctgctcaaacgggacgtcgtccacgccctcgtggttgcgcagcgtaaaggtgaccagcggctgcgcgcccgcgtccggccagcggtgatagaacaccatcaggtggccgcgcgtctcgggcgtcatgttggcaaagtagtagtagctgatgtcggggctcttctcctcctccgtgcggacggccatggtgaagtactccttgtgccggatcttgccaaagagctccgcctcctcgggcgtggggtcgccgtagcccaggaagagctcgagcggcgtgcagatcacgagcttgtcaaactcctgctccgcgccgccattcacgcgcacgtacacgtgctccggcgtgcggcggatcgccgtgatctcgctgttgagctgcgcggggtggcgaagcgcgctgttgacgccagtccagatcgagttggtgccgttcttccacgtccacagcttgccggtagagaggaactgcttcaccgtgaaggcgtccaggtacttgaggacgtacgcggccgggatctcgtcaaagtatccgtagccaaagctcgtgaagggccccttccacacaagctcggcgtcctcgcagccgttcagcttcaggaactcgctaaacggcatgctcaggtccttgaggttggggttctcgccctcgatgtgggcaagcttcatctggggagaaggacacggcccctcgtagcggccctgtgccacgccgcggtggccgttcacgtcgtagcccttgtacttggtgtcgagcaggtggctgagcttgcgcatcttgagcaccttcttgaggagctcgaccttgctctcctttacgggcgtgccgtccgtgttcatgaagcgacgtcccatcttggggccgtctgcgtgcgtggtgtggccaaactcctcgcactcgtgcacggcaaagtaggtgtcgcagcccatgaccgcgcccatctcgatggtgcggtcctcccacttgcccctcttgttctttaccttcatgagcgggctgaaggccttgccacccacgcggccgctccgctcgaagatcgtgtagttgtcaaacccgttcttttgcaggtacattgccagcgacagcccggcggggcctccccctacgatgcagatcctggtgttcctatccactggcttctcctctccctgctgggcttgcagacgcggccgcacgcccccgcgcgcggcgttcgacaccgctacacaatgtcttcacaagtatacgcgcaacccaagcgccgggcgagaagaacggggacccggtccaagccaggtccccaacggtcgcccatcaaatgtaagcggaggctaaattctgcgggcgcgcgtcacgcagccgcacggcggcacgcccctggtgcggagcagtccttctcgctcccctactcgtacatcgcgagctcgttcctgcccagggcgtccgccgcgagcatggcgttggcgaccttctcgggcgtgacctcaaacggcatgttgtgcagcgtgtcgttgggcgcgcacgcgagctttgccacctcgagcacgcggtcgtagctcgcgtccttgacgccgagctgcgcaaacgtcatgggcagccccacctggccgcagaagtccagcacctcgggcagctcgtccgcatcctcgagcaccagctgcgtcagcgtgccaaacgcgaccttctcgccgtggtagtaggcgtgggtctcgggcatggcggtcatgccgttgtggatggcgtgggcgccggccaggcccgcggactcgaaaccgagtccggaaagcagggtgttggcctcgatgatcttctccacggactccgtgcacgcgcccgcctcgagcgcgatcttggccttgacgccgtcggacatgagggtgtcgtagcacaggcgggcaagcgccatggccgcgttggtcaccttggcgccggcgcaggtggtcgcgtcggagcgcttgcaggcacgcgcctcaaagtacgtggccagcgcgtcgcccatgccgctcacggtaaggcgcacggggctcttgctgatgaccgtggtgtccatcaggaccaggttcgggttcgccttgaagtactggtactccttgaactgcccctcgtccgtgtagatgacggaaagcgcggagcacggtgcgtcggtcgcggcgatggtcgggacgatgagcaccggcgcgtcgaccttgcttgcgactgcctttgcggtgtcgaagatcttgccgccgccgatgcccaccacgacgtcggagcccttggcctgggcgtccgccaccaggcggtcgatctcgtcctgcgagcactcgccgttgaactggtcaaactcaaacgcgacgcccgcgtccccaaagctcttggtcaccacgtcgccggagcgcctgatgccgccggcggatatgatcacgagcgccttcttgccgtaggctttggcatagctgccgaggttggcgagctcgcccggaccctggacgtacttgccgggactgatgaacacacgtgccatgactatcccttcgacgaggtctcacaatccatcccgcgcgaggcccgccccgcgcggccaccccgcattatggcaccaaaacctttgcgactccacgccccggacgggcggccccgcatccgtcgacacgcagcggggcgccaccgcaaccgcggcgacgccccatcaaaatccgtatcatacgcgggcgagaagaactagaactcccgcccgtcgcgcctgcggcagtgcagccagatgccggctgcgacgatgaccgcgcccgcggcgccgaggccgatccacagcggctgggtggagtcgccggtcttgacgacgctggagccgccctttgtggtcgtgcccgaggtggtcgcggactttgtggtctcgctcttctcgccctcggaggccttcgcgtacgtgttggtgaaggtcgggtccttgacggtcgagccctccccgtccgtatagctgacctgaatctggttcagcgtcgagcccgccacgccgccctgccagccaacgtagaccgtcacgtcgaactcggcggtgtcgtaggtccagccggaatccgtcccggccacctgcgtcacgtggtagtggtgctcgcccggctgcgacacgtctcccttgagctcgaacttgaccgtgcccggcttgctcgtgaccgtctctgcaacgggcaggagcgtctcgccctcgtccgttgcggttatcttgaacgtggactccgcgtcggcagaggcgccgtcgcccttgacggcgtaggtgagcggcacctcggcagtcacggcgtttgccgcgagcgacggcgtggccgcacccagtagcgccaggcacaagcccagggcagcggccaccaaaccaagccggcggttggctgcgccgcgcctcgtgctcttctccatctgcttgatcatgtccgcttgccccttcttccggcggcgcgaccgccgccctgctgcgttttgtctgcctggcggcgcgtgccgcccctgctacttgccgaccgtggagttgtcctccgcggtcctgctcacgacccggcacatcacgatggtgcgcgcgttggcgccgtcgtccgcgcaggtcgaaagcgcgatgatctggtcctgccccgtcgtgcccgatccgtccgtggcgggcgaccccttgccgagcgagccctcgcgcaggtactttgcgcttgtcttgagcttggcctcgacctcctggagcctggtcgagtccgcgggggtggagaagatcgtgccgtcgtaagcgtcggcctgtatgacagcaaccacctcgagctcgagcgtctgcttgggcaggtacagcgtcgcgctcttgtgcttcttgaagaagctcttgctcaggaacttgtccaggtccccaaacatcttgccctcgtccatgtggtggccgaagaccacctcgtacggctcgtcgaagttccggctgcaggccgagtccaaaaagatgcttccggatgcgctgaactcgcccagggcgtccttctccagatactcgaagttgtcacttccctgcacgatggggtagtcgatgttggtcccgtcgaccgtgatccacgcgcagacgtcggcgttcttcttcatgagctcgccaaagcccacgccgggcttgtattggctcgtgtcggtcccgtcgagcacctgttgctggtcccacagcgcatacgccgccgtggcacccatcagcacgaacacgacggccagcacgatggtgacgagccggtccacgcggcgggccgcccgctcgcacggggcgagcgacccgctgccaaaggcgccaaagctgtcgctagggaatcgcatcaggccccggggaccttagaagtcctggcccgagcggttgcggcgacggatcaccagcgtggcgccgccagcgaccgcgacgaccgcgatcgcgatgcccgggagcatgttcatcgtgacgccggtctgcggcgcaaaacccttgttgttggtgaaggtgacggtgtcgtcctcggtcgcgatggtgcccttgccggtcggggtgccctcgccgttggtcacggtcgcggcggtggtgctgtcctcgtccgcgacgtcggtggagtcgtagtccttggtgttggtctcggtcacggtgtacgtcgcgccctcgggcaggttctggacctcgatctgctcgccgtgcttgagcgtgaaggtgtacgccctgcccgcctcgagcgtggtggtctcgccatccttcacgacgttgtaggtgcccgtcgcgttgctgacggtgagcgagaaggtgaactcgtcgtcggtgttggcggcggtgccggcgaccttcttgctgatggtcagcttgtggttctccttggcggtgttgtcaaactcggcggagtccgtcttcgtgccggttaccttcttgaagacgacgctcttgacctcgggctgctcgatgctgccgtctgcccaggccacgttcacgtacacgtcgtaggtctccgtgtcggtcacgacgttcttgttgtcgctcgtccgctcggagagctggaagtggtagacgcccggggtgtcgaacttgaagccggagaagaggtctttctgcgagatcgtgccctcgtaggtgagcccgctcttcttggccaggttgctaacctcgacggtcttgaggatggtgcccgtcgcgggcgtcgcgccgttgtaagtcaggctctggctgccggagtagccgccgttctcggccccaacgtacgtgaggtcgaagctgaacgactggctggcgctgtactgggcctcggatgcgacggtccagtccttggtcacgccggcggaggtgtaggtcacggtagcagccggctgtgcctcagcagcaaacgcggttgcggggaccatagagagagccatggtgccggcgagcaccgctgccatcgcgccggacttgaggttgatcttcttcatgcgtcattcctttctgtctggcgagaagcgcttctaggcatccttcccgccgcctcccaacagagaagccttgcgtgtccgaaccttgcctatatctgacgaagccgaaggatcgcgactaccttcccctcgacctcggtggagcctatcggtcccagcgtcctggagtccgtcacggtggcgcgcccgtcgcccaggacgaagtactgccccttcttgagcttgagcgggtagctcaccccggagcccagggtcgtgctctgcccgaacttctcgggctgctcgctcccgttgatcaggagcttcccgtccgacgtcacctcgacggtgtcccccgcctgtgccacgatccgcccgagttgcagcttgccgtccgcctcgtacgccacgacgtcgtccgacttgggcgtcccgtcgaacctggcgaagagcgccaggtcgccgtcgcccgccgtcggcctcatgccgctgccggagacgcgcacgacgccgaaggcgaggtggaacaccgccgccagagccgcgaccacgatcgcgagcctcgcaatcgctccgcggaccgtggcgcgggcgttcgcgcgcgccttccgcctgcggatgaccgcggcctccggcgcagaggcgaggtcgggcagcgggtcgccgccccgcggagcgtcgtccttctcgcgcacgtcagctcctccggtcaccagttgccgcggagtccgtcggtagcctggagcgaccccggcaacgaaggctgcacggagccctgccgtcccgattccgtcgggctcccacccggcgcttcgcccctggcctgctggagcagggcttcgtaatgcacctgctgctcgcgatacagctgccggtacatctggtccagccgctccaccacgtgccacacctcccgctcgtccactcccaataggctgtgccgccaggtgagacggtcgagcttgtcggctatcagctgcagcgaaacctgctccgtcgatgcgtcccggccatcggacgtcgccttggactcggccttggccttcttgcgtcccagccggcctcgtgtgccttcccgtctgctactcctctcggccatggcgcttcctcacaccgaccgtcaccgcgatgccacccgcaacagccacgcccagcagtacgaccatggggccggggtcgatactgacgcccgtctgcggcacgagctccgcggtgttggtgaactcgacggtgttcgcgtcggtgggcgcgacgagcttcccgtccttgagcgtgtaggctcgggcgatcaccttgacggacacggggtcggtctcggtggcggtgctgccctcggacttgacggtcgtcgcgtcgccgccgtcgaccttcgcggtcgtggaggtcttcgcgttgccggaaaggccggtctccttcagggtcagcgtcatgcccacggggagccccgcgaccgacttgctctggccgtgcgaaagctggaacgtgtactggccgttggagtcaaacgtgactgcgtcgtcgccggtgccgtacgtcttgccggcgaggtcggagttgcccagcacgaagctgtacttctcgcccgtgttggcggcactgccggacaccttcttgctgacggtgaggccggttgcggtgggcaccgtgatcgacggacgcgcgaagtcctcctggccgctcttctccgtcgtgacgttgttgaccgtcgtctgctcgatgtaggtgacgtcgttgtccgaggcggtgttggtgtagaccttcacgacaccgtcctcgaccgccatgttggggtcggacgcgagcgtgccgttgagaagggcggccgccttgtccagcgtgtcctgcgtaaacagcacgtcgaagctgatcgcgtacgtccagccgttctcgagctggtacgactcgccgaggctccaggtgaccgtcttgccgctcaccgcgggaccgccgaaggtcttggtggcgccgtccttggcgtacgagtaggagccgtcggagttcttggtgagcttgacggcgtcgccgttctcgtccttcacgctcacggtgacggagctagcgacgaggttgccatcggccgtgtcactcacgacggcgtcggagacggtgtccctcatggtcacgttgcggtagtcgtgggcgttcacgatgtcctgcactatggtgctcaacgcgctctggagggccgaggagtcgctcgcgtcgaagtagttgtcggagctgatgccgcccaggttctgcatgctggtcgcgtcgccgaaggcgttgatgttgtagagcgtcacaccgttggcgacgaggctcttggcgacggcgtccgcggcaccgaagttcagcccgtaggggtccgagttacccgtgccgtagacgccgtacctccggttgtagtcccccgtgtagccgttggcgctgtcgcggaacgtggggttgccgtcagagacgaagatgacgtagttgctggtgttggagtcgctgctgacgaggtcctccgcctcggacaggccggcctcccagtttgtgccgccgctggcggagagccggtcgacgctgctgttgaacgagctgatgctcgaggtctggctcagcaccgtcgtggcatttgtgctgaacgtcacgagcgagaccttggtgttgtcctgctcgaggatcgtgctcgcagctgccttgatggcgctcttggcggcagtcagtcgcgtcccctgcatcgatccggagacgtcgaccacgaagatgacgttggcgcccgtggacgtcgagctgtacgacgacgagcccttgacgctcagggtgatggtgccgcccgtgtgctcgccgttctcagtaagcgtcttgctcgtctcggggccggtggcgctttccgccgcaaacgccggagccgcgccgcacagggccacggcgattgccgcgagcaccgagaggactgccatcccgcgcgacctgcggacggtgcgggcgcccttctccccctgtccaaaattcagctttcttgcat

SEQ ID NO: 230 - DNA, 1439 bp, Unknown
  Metagenome-assembled genome
ccaaggacgacaagaagcgccttgccctcatgggcgacatcctctacaaccaggcgctcctggtcgagggcctgcccgtggaggacccggccaagttcgcgcgcgagatcacggagctcatgtaggcagacgactgacctgggaggcccccgtcccgccctttggctcagcgctcccggcgcacggcgccggtcgctcgcggcttcgccgcgattcgccaagggcgggacgggggcctctctgtcatccgccttcagtgggggcggtacaatcgagtcggtggcaagcgagccgtggcggagggctgtgtgaggtaccccctcccattcgccactggtcgaaagttcgcccgccaccagccctcgctgccctagacttgactcttacgcaccatcgccgcgcgagctcgtcgcgccgcaccgtcaggagggggccatcatgtccaagcgactcaggatcaccataggtgagcaggtcttttacgcggacctgtgcgaggcggaggctccagcggccgtgtccgcgctggaggccgcaggcggcttcgacacccttctctttgcggcagacgtctgctacggcgagctcacgttccccacgccggcgcgcgactactgggagcagcagaacgtccagcaacagacgcagcccggcgacgtcacgttctacaacgactggagcgccgtctgcatcttcacgcagcgcatggagcagttcgcgcccggcgccaaggtcgcgcaggtcaggcccgacgacctcccacgcttccagcgcctgtacgccaaggtctggggcggccgcggcgtgcgcatgcactgcgaggtcgtctccgttgacgacgccacgggcgcggagcgccaccttggccccgagcggccgccccgccgctccgcggtgccggcggtcgcccgcttcgacgcgctgctgcgcgaggtctggctcgaccgccccgtcgagctggacgacatggtcgcacgcaacgccaccaccgcgcgcgagctcggcgtctgggcgtacgcgtggggcgagctcgtcaacctctccgacatgctgctcgtgctcatacgcatggcgcagcagaagaacggcagcgtgcgcaccctgcgtgcggttgcggcggagcagtgccggttcttctcgcccgcgtttggcagctccgcgcacatggtcgacacccggctcatcctgcaggaggccgcaagctacctcgagtgcgcggagacgtacgagcagttcgtggacctcgcgcgggccatccagctctgggtgctgcagatgagcttctggtgcaacctggagctcccgtgggacttcatgagccgcacgctgcaccgcgcgtggaacccggacgtgccgcttcccgcgggcgacgccaaaggcagggacaaaaagtctagcaagcccggcaagggcaagaagggcaagaagtccaaggggca

SEQ ID NO: 231 - DNA, 7175 bp, Unknown
  Metagenome-assembled genome
tggcggagttcacgcgcacggtgcgcacgctgagcgcggccatcggcgagggtcacctggacaaggacaagctcgccgcggtggaggcggagcacgacgaccccatctacctggcgcccttcctcgcgtacctgtgcggtgacgactgccgcgacatcacgggccaggtgtttggcctttccgcctccggcaagatcgagtggtactccgcgccgcagatcgtgagcgaggtgcatcgcgagcccggccactggaccatggccgagctcgagcaacagatgcccacgaccatcctgcgcgccgtgcgctcgcaggcgacggcggacacctgggacaagagggacggcgccgccgctgccgtgccacacacgctcttcgaccgcggcgaccgcgtgccggacgacctcttccacggcacggcctatatcaacatgatccagggcctcaaggaccccagcggcagctccgtgggcgtggtcaccttcgcgccgggcgtccacaacgactggcacacgcaccacggcaggcaggtcctcatggtgacggacggccagggcgtgtaccaggagcgcggcaagcaggcgcgcctgctcaaccccggcgacgtcgtggtggtggagcccggcgtggagcactggcacggcgccgctcccacgagctggttctcccacgtggggatgatcctgggcgaggccgtgcccaccacggccggccccgagctcacgcgcgaggactacctcgcggcctgcgagggcgcttctcccacaaaatagcgacgataccgacaccgtatatccccaggggagaaacgcgtgcgttacccgccggggatatcctcgtgcacgccgcgggcccggaacaggaccggcctgacgcggcacgaggattcgggagggcgttgcatgaggggttggaccgcgctgggagaggccatcggatcgcacatgtggctcgtctcgcccatatgcgtggccatcggcgtgctctttcccacgcaggtcgacgtgctcaaccgcatcgtggtggggctctttgcgttcatgacgttccagggctcgctcaccaaccacttttccaacctgggccagacggcgcgccacccgctgccgatgcttgcgattctggcgctgtccgccgtggtcctgcccgcgctcgcgtgcgcgctgggatggctcctttttgggtcggacgccaacctggtcacgggcatcgtgctcgagttctgcgtgcccgtggccgtggtctccaccatgtgggtgggcatgagctccggcgacatggcgcttggcctggggaccctgctggtgtccacggtcctctcgcccgtgaccataccgctcacgctcaaagtgctgcttggccaaaccgtgcaggtggacgtcgccaccatgatgttcgacatgctggtcgagatcgccctgcccgccctggccggcgtcgcgataaacgacctcacgcgcggctggggcaagcgggtgctctcgcccgcgctcatgccggcggctcgcatcaccatcatgctggtcatcatcgcaaactccaccggtatctcaagctacatgacgcacctcacgcccacgctcgtgacggttgcgctctttatatgcgcgttctcgagcgccggctacgtcgtgggctatcttgcggcgcgtctgctgcgcgagccgcgcgcggaggccgtcacgaccaccttccaggttggcatgcgcaacatatccgcgggcgcggtgctggcgcagcagttcttcccgcccgaggtgatgtttcccgtggtggcgggcacgctcttccagcagatcctcgcgtccctctgcaaggtcgcggttggccgcatcttgccgaaggacgcccccgcttgcgaaggctagccgctatcatcttccgtgccgctcggacgctgtggcggcgggttatatggaagggtgagccacatggaagaggacagcgagttcgtcgttcagccaagcagcgaggcccagcaagaggaggtgcaccgccgcctgcaggagtacaaccgtcccttctttaagggcgagaaggacttcagcttccacgtggagcgcgacggacagattgtggccggcatcgtggctggtagcacctaccagacgctcgaggtcgacttcctgtttgtggacgaggccttccgcgggcaggggctcggcagcctgctgctgcgcacggccgaggagcgggcacgggccgcgggcatctgccacgtgctgctcaacacatacagtttccaggcgcctggcttctaccgcaaggagggctacgcggagctcttccgcatcgacgactgcctgggaccgcacagtcagttcttcttctggaaggacctcgcctagggctgctacgcggcgccgcgcgtccttctcgcccggtcgatgagccagtagagaagcgcgcccaccacgtagctgacgacatccgcccagtcggtggtgctgggcttgaggagcggtgccacgaactcccagaagaggccgcagcagaacatgtaggccgccgtgacccaggaggagcggatgcgcgcggtggggcgcaccgcgtcgaacaggcagttggtgtacgccatgaacgtgaggccgcagaggacgtcgttgaggtgcccatgcacgaggcgggacgccggtgggggcagagtcaggcccttgagcagcaggttgttgagggtgtagagggcgagccccgcagccaggaccgtgaggtcgccgcgcagcggcgcccgcgcgacgttgaggcgtggcctagccaagctcggagaagagcaggagtcccgccgcgatgccgagcgctatcaccatgatccaccaacaaccgccatgctctccgcttgccatgtggcgccccccttcgacaagccacatgatagccgaacgcaagattgcggtctgttagcgctcgcgaagcacggagcccgcggcgtcggcaggcaccagctcccacacgcggttgcaggccgcctggaccatgcgcgcgtcgtgcgagaccaggagcaccgcgcccgggaagcccgcgagcagccgctccagcgcctggacggagtgcaggtcaaggtggttgcccggctcgtccatcacgaggagctgcggggagcggagcgacgccagcgccagcacgagcttgcggagctcgccagggctgggcatgtccgtggccagcagcgcctccggctccgagttcagctgcgccacgacggaaaggaccttgcccttctggtccggcgcgagctcgcgcagctgccgcatggcgtcccgcgcggcggcgggggagatctcctgcggcacgtacaccatgggcacatcgtttggcacgcggcgcacgacctcgcgcacaagcgtggacttgcccgtgccgttggggcccaccaggccgatgtggtccgcggagcccacaaagagctcgggcacgcgcacgcccgggacgccggccgcggcgccagcgcccgtaccagcatctgcgccggccaccacgtcgccacccgcaaacggcaccaggccctcgggcacgctcgccagcacgctgcggcgcgatcgctccccaaacgcgggcacgtcaccgtcgtagctcttctccaccgttgccgcagatgcctgcgccgcggcggagctgatgcgcgagtccagcgtcttggtcaggtgcgtcgcgcggccgtccttacctgacacgatggcgcggccgatgcgctcgcgcgcgtcgtggtcgccaggcgcaaggccgcggcgactccgcagacccttggagcgcgacgcctcctcgacccggcgctggcgctcctgggcaagacggcgctcctcgcggcgcgcgctctcgtgcagcgacgcggcggccgcggcctcgcgtcccgcctgggcggacgcctccgtgtagttgccggggcgtaggcgcacctcgccttcctcaaagcagacgcactgcgaaaccagcgcgtccagcagctcgcggtcgtgcgagaccaaaagccccacgccgccgaacccgcgcagcgccgcaagtatctgcctgcgcgttggggcgtccacgtggttggtgggctcgtccatcacgagcacgtccggacggcgccacagcgccaccgcaacctgcaggcgcttctgctgcccgcatgagagctccgcgtagcgccacggccagtcgtccccaatgcccagctggtcgcgcaggcggatggcgtcgcggtcccaggcgcaggcaaagtcctccagtccctcgggcgcaacggacgcgtcctgctcgcagtagccgcccaccaggccggacggccccacgctgcccgaggtgggcgtcatgagccccgccgcgatcctcgctagcgtggacttgccgcagccgttgtcgccaacgacgccggtccacccctggggaagggcaagggtcacgccgtgcagcacctcgcgggcgctgccggcataggtatggtgaatgttggtaaggttgagttgcatgagggacctctcggacgcagtccggcagccaaagccacgacgcgagccgccacgcagcgaatcgcatcgacagagcggtgccagacaatgggcagtttcgcgccaacgcgcgctatgccccaacggggcgcgtcctacttgcgcaaggtccctctcccatctctcggccggcttgccaaaggccgacccaactcacagacgcacactctaacacgccatctcccacgcgcgcaacaccacacaacaaaacaaagcgggggagaagaacagggcccgggagctgcactttgctcccgggccccgccgtctaccgcttgtgaccgtgcggcccgcgccgcctgtggctactcgtcaccgaagctgatgcccagcatcctggcctcgcgcacgaggtcgctcttggggtcgacgtacttgagcttgcctgcgatctgctccagggggatgtggcacatcttgcccgccaccttgccgaccatgtagccgtactcgcccttcaggaagccgcgtgcggcctctacgccacactgcgtggcgtagatcctgtcctgggcgtccggctggccaccgcgctgcgtgtggcccggcacagccacgcggacctccttgcccgtgcgagcggcgacctcctccgcgatgtcgtaggcgacggagggcttcacgcgcttcgcgaccttggccttgtagtccttcttgcgcatggcggcctcctccttggagatggccccctccgcacacacgatgatcgagaaccgcccgccgttcttctcgcgcttctcgatggcattcaccacgttgtccatctcgtaggggatctcggggatgaggatgacgtccgcgccgcccgcgacgccggcgtacagcgggatccagcccaccttgtggcccatgatctcgatcacgaagacgcgaccgtgcgagctcgcggtggtgtggatgtcgtcgatgcagcgcgtggcgacgtcgatggcgctcgtgaagccaaacgtgatatccgtgccataggtgtcgttgtcgatggtcttgggcaggcagatgatgttgaggccctcctcgcgcaggcggttggccgtcttgatggagccgttgccgcccagcacgaagaggcagtccagcttgagcgacttgtaggtcttcttcatggcggggaccttctggacgccgtccgcctcggggatgtcgatgcgcttgaacggcgtgcggctggtgcccaggatggtgccgccgagcgtgaggatgccgctgaagtccttccaggtcatcatgcggtagcgcttgtagatgaggccctggtagccgtcctcgaagccgtagatctcaacaccctccttggtgttgttgtacacggtcttgacgatggcgcgcatggtggcgttgagcgcctggcagtcgccgccgctggtgagcagtccgatcctgagcatggatcccccttacctgtcacgcccgtgccggcggccgcgaccatctgcatggcatccgcggcctggcatgccgcgggccctcttcaggtaaagattattgcgcattttgggacccatgccgcgctccgtatcactccattacaaatagtggccgcagcgcaggtgggaggtccagagtgaggcgcgtcggcaatccgcatcgcggacgtccagccgcgctgggtccagccacagcccgaaggccccggtccccagtccgaaggccctcacgaccgtctccagcgcgctcgccttaccacccaaagaggagctcatggtcgttctggtcatcttcctggcttgtcgtgactgtcttagacccatcctggttggcggacgatttgccaccgctcttcgagcttcccccacacgcgcccagcgtcagcgccagcaagccgcacatcgcaagtgagaggatcttccttccgcgccccatgggcccacctcgcaaatcaaaagcttaaattacctgcaggtggattatatgccagcgcaagtcgataggtccgcgagcaattcgttatggaagccttgcactgcctagcgcgtgcccacgttgggtaggttgtaactatcggtttcctttgtccgtcagcagggcgtttggcgtccacgccgcggactcttctccaggaggtggcccatggcggctagggacgtgcaggcggctcgtgaggcggggcagcgtgcccttgcgagcctgcgagaggcggaaaagtccctcgacagcgcccgcaactggggtttcgtggacatcctgggcggcgggctcatcacgagcctcgtcaagcactcgcgcatggacgatgcgtctgaggccatcgagcgcgcccagacggacctcgaaaccttcgccaaggccctcaagagcgtctccggcgtcacgggcgtgcgcctggagcgcgacggcgtgcttgaggcgttcgacgtccttctcgacaactcgatatcggacctctttgtccagtcgcacatagaggacgcccgcagccaggtgaagacctcgatatcgcgcgtgacggccatcctggcggagctggggcagcaggacgcaggctccggctctggtgccggctccgggtgcaatcggtaggcggtgcccatggcggagctcgaggcaatgccgcccacgcggcagcgggggagaaggacgcgcggcaggctgctcgcggccatcgcgtggctggtgctgggtgtcgcgttcgagatcctggcctccatcccgatacagctcctcaagctggactggaacctctccatcgag

SEQ ID NO: 232 - DNA, 15786 bp, Unknown
  Metagenome-assembled genome
gccaggcggacaggttgtacaggtactggaagtcgcgcacgtcaaaggcgccgtcgcgctccgggtacagcatgcagctgaagtggtccgtcgagcccagcagctcgacgcgcagctccgccgcggctcggacgttctcctcgatcgtggaataggcgtggcgcgagaagatcgtgtgcgtgtgcacgtcgcaggccatgtgcagcatcgtgttcccccttgctacgagtttccggccgcatcttgtgccaatcctagcaccgccctggtcgccgcgaggacaccgcccagtgcccccccctgcgttccgcgggcgtatcgaaggccgtcgcgccctcgtgcgagcacaacaatagaggtacacgtcgcgcacgttcccgtcatatagcaccgattaccagccattttgtaaaatctggagttgaactccagattttacacggtcgcataggcttgtaagaccgcctgcgcaagtcctccaagacgagcggcctgggagggatccagccgcctctggcagatggcctgcgagcagaaagcgtccgcagtgtacaaggaggcgggtccgcggggagttgattgcggcggttttcaaaaaacacgtcgatttgtgtgttttgggcaggcgtgaagaggctcccacgagggtctcggcctcatgcgttccttctggaaggtcgctcgtacccaaacagcaggccaatgaccttcagagcggtcagaacaggctccgcgaggccgttttggcggccccgaaacgcacaaatcgaacgatttttaaatgaggcggcaatcaactccgccggcgggcgctaccgactaggattcagcctcgccctggcgcctggcggcgcgagcccgggcctcagccagggccgcctcggcctcggctgcttgcgcgcgggcctctgccgccttggcgcgcgcctcgagcgcggcgagctcggggtcttcggaggtcgcggggccggccgtcacatggactgacgcagccgcaactgccgccgcgggctgcgcctcgggcgcgggcgctgccgcggggcgcgcgtccttttcgcccttgtgcgtgagctcgcgcgcggcacgacgcgtgggcgcggtcaggtctcgcacgaggctgagaccaggctgcaccatgcgcggctggaagttggggcaggcggggtcggtctcgcgcacgcgcctgccatgggcgctggactcgaggcactccatgtgcgtggtgaggaagcccgtacgctcggtcatgaagcggcagtccgcgcacgtcctcttgcgcggacgcctcgcgcgctggtcctttttgcccttgcccaggcccatgttcccatccttccgcaacggccgcgggcacctgcgccgcgcggccgtcgccttgcatcactacttgtactggttgcgcagcttctcccacgccggcatggagttctggatggtgtccaggctcacgcagtagcccaggcgcacccagcccgtgcagccaaagctgttggagggcacgggcaggatctcgagcgccttggccttgttgaagaaggcctccgcgtcgggctcgagcgacttgacccacaggtagaacgcaccgtcgggctcgatgtactcatagcccagcttgctgaggccatccgtgagcgccttgcggttggtcgcgtaggcctccacgttggtgggctcgtccacgcagtcgatcagcacgcgctggaagagcgccggcgcacacacaaagccgagcttgcgacccgcgcccgccacggcgtacacgagctcgtcgtgcctggggttggtgttgggcaccagcacccagccgatgcgctcgcccggcaggctgagcgacttggagtacgagtagcacacgatcgtgcggtcgtacaggctgggcacccagggcacctcggcgccgtaggtgatctcgcggtacggctcgtcggagatgaggtagatgtcgtgccccagctcctcgccgcgggtcgtgagcacctgggccagcgcctcgagcgtctgcctggtgtagacggcgcccacggggttgttgggcgagtcgatcatgacggccttggtcttgggcgtgatggccttggccacggcctccgtgtcggcctggaaggtcgtggcgtccgccatgacctccacgcaggtggcacccgcggtctcgatccagacgcggtactccgggaagtacggcgcgatcacgatgacctcgtcgccggggttcacgatcgcgttgagcgtgatggagatggccgccgccgcgccgcaggtaaggtaaaggtcgccggggtcgtagctggtgccaaagcggcggttgagcgagttggccacggcctcgcgcgctgcgggcatgcccgaggcaggcgtgtagccgtgcagctgcgcgggaggcagctccgcgttcttgaggatggacttgcgcaccgcgtcgggcgcgggcacggacgggttgccgagcgagaagtcgaacacgttctcggcaccgatctgggccttgcgcgcggcgccgtaggccgcgatctcgcggatggatgactttgccgcgccgtaggcgtagctcttctcgttgatgtccattactgctcctcgctcgtctcgcccttctcgaccgcctccacggcagcctcgtcctgggccgcgggcgtcgcgacgtcctcggcctcctcggggtgcttggccacgtactcgtcccacttgttgtccaggagcgcgttcacggcgtcgccctcgaccgtctcgcgggccagcagcacgcgcgccatggtgcgcatctggccgtcgcgggcggaaagcacgtcgtgggcgcgctggtgcgcctcgcgcatgatgcgctcaacctcgtcgtcgatgcgcttggaggtctcggcggacaggtcgtggtggttggtgtagtcgcggccgaggaagacctcgtgctgcggctcgctaaagacctgcgcgcccagctcgtcgctcatgccatagacggtcaccatggagcgcgcgatcttggtggcgcgctcgaggtcgttgctcgcgcccgtcgtgatgtcgtcgcagaagagctcctcggccgtgcggccgcccaggagcaccgcgatctggtcgagcatgccgtcgcgcgtctcgaggaagtggtcctcctccggcagctgcatggtgtagcccagcgcgcgcccgcggctgatgatgctgatcttgtgcacggggtcgctgttctcgaggatgtggcccaccagcgcgtggccgctctcgtggaacgcgatggtgttgcgctccttctcgctcatcacgcggcccttcttctcggggccggcgatgacgcgctccatggactcctccacctcggccatgccgatgagctccttgtgccggcgcgcggccagcagggcggactcgttcatgaggttggcgaggtccgcgcccgtgaagcccggcgtgagcttggcgatgcgggacaggtccatctccgtggcgagcggcttgttcttggagtgcacggtcaggatcttctggcggcccttgacgtccgggcggtccacggtgatctggcggtcaaagcggccggggcgcagcagcgccgggtccaggatgtccgggcggttggtcgcggcgatcaggatgacggcggagttgtcgtcaaatccgtccatctccacgagcagctggttgagcgtctgctcgcgctcgtcgtgcccgccgcccaggccggcgccgcgctggcggccaacggcgtcgatctcgtcgatgaagatgatggagggtgcggcctccttggcctgcttgaagaggtcgcgcacacggcttgcgccgacgcccacgaacatctccacgaagtcagatccggatatcgagaagaacgggacgcctgcctcgccggccacggccttggcaagcagcgtcttgccggtgcccggagggccaaccagcagcacgccgtgcgggatcttggcacccatgcgcttgtagcgctcgggctcgcgcaggaagtcgcgaacctccttcagctcctccacggcctcgtcgatgccggccacgtcgtcgaacttgaccttggggcgcgtctcctccgaggtgcgcgccttggtggccttgccaaagctcatggtgcggccgttggcgccgttcatctggttcatgaagtagatgaacgccacgaccaccaggatcgtggggatgaccgtgatgaggaacgactccaggaagtcgttggacgaggtgtcgatggtgaacgtggtcttggggctcttggccatgagctcctgcaggctgtccgagcccacgtacgtgctcttgaaccggggcgtcttgtccttctcgcccacctgcgacttcttgcgccagtaggtgcccgtgaggcttccgtcctcggtcttgaacgtgacgctcttgacgcggttctgcttgacggccgtgacgaactcgttggtgctcatcacgtccgcgggcgtgccgcggtaggagttgtagcccgcgtacatggcgtaggccaccacggccaccaggatgagcgatatcaggatcgacctgcgggagttggggccctggccgtcacccttgggattggaggggcccacgcccctgaggcttggcttgttgttgtctgccactcatggctccttgtgttgcttacttgctgtagacctcgggcttgaggatgcccacgtagggaaggttgcggtagcgctcggcgtagtcgaggccgtagcccacgatgaactcgtccggcacgtgcgcgcccacgtagtccggcgtgacggccggcttgtggttggggatgtccttcacggcgaacgcgcagatcttgatggacttggcgccgcggccgcggagcaggtccatcaggtagctgagcgtgaggccggagtcgaggatgtcctccgcgatgaggatgtcgcgaccgcggatctccgtgtcgaggtccttcaggatcttgaccacgccggagctcttgacgcccgcgccgtagctggagaccgccatgaagtccacggcgcacggcaccgtgatcttgcgcagcaggtccgccgtgaagacgaaggcgccgcgcagcacggccacgaccagcgggttcttgccctcgtagtcgcggctgacctccgcgcccaggcgcgcgacgatcttcttgatgtcgtcctcgctcaggatgacgctctggatgtccgggtgtagctgctctgccatggtgatccccatttcgtgtgtgcgcacgggcgccggacgcccgcccgggcgtcccgcgacggccccgcgctgccgtcagtccctactgagggacaattctagcagcagccttgttgcggggagcgttcgaactcgctcgtccggccgtattcccgccacccagaccacctgcccgcgcggggaggtgcgcaccaccggcacggcggcgcggtccgcggcggggaccttggcctcgttcagcaggtcggaaagcttcttgctctggccgtgcatgccgagcgggcacatgacgtcgccagcggaggcgctgtccacccagagcctgccgccctgcgcgtcgagcccggcggccgcggcgtcaagcagcacggagcggccctcccactccacggcgtgcgcacgggccacctccggggcagaggagccctgcggcaccgccacgacgcgggcgagaagaacgtggccatcgggcagggtcagcctgccggggacgtcgagccacagcgcgagggggccgtccttctcccccgccgcggcgcgcgcgcgaacgaagagcaggccgtactccacgcgggcgtcgcaacccatgggcgtgctggcagagccgctgcccgccgccacgagcgcgagcacgcggttgatgtgacgcgcctcgagccgggcgtccgggcagacggcgagcatggccttgcgcaccacgcggcgcgcgatggccacctcgcacgcggccaggcgcgcggcgtcgagcgccaccatggtgggcgagctgcgtcgcaccaggtcgcggtacgtgcgggaggccacctggttcatgtaggcgtcctcgtcggagaggatgtcgcacgtggcggacatgctggcctcgatcctggggttgcgctcgcgcagcagcggcatcacctggtgccgcacaaaggcgcgcaggtagcgcgtgtcagcattggtggcgtcctcgcgccacacgatgccgcgcatgcgcagcaggtcgcacagctcgtcgtgcgtgcggtcaagcagcggccgcacgatgcggttgcgccgccgcggtatggacgagaggcccgcgggcccgctgccgcggatggcgttcatcacgaaggtctccgcgcggtcgttggcggtgtgggccgtgaggatcctggcggcggagcgcggcacgcccacctccgcgcacaggcggttggcgagcttggaggcctcctggtagcgcacctcgcgaccgacgttctccacgttggagccggcggcctggcccagcgcgcccgcgtccgcgagcccggccacgtccacgcggcgcaccgtgcacgggatgccgtagcgggcggagaggtcgcgcacgaactcctcgtcctccgcggcgtccagcccgcgcaggccgtggttgacgtgcagcacgtgcaggcgctcgcgcgcgatgcgggccgtgccgcggccgtcgtctatgtcgagctccgccgtggcagccagcagcaagagggccgtggagtccgccccacccgaaaccatgagcacgaccggcgcccggagctcgtcgtcccgccgggacgacggccgctcgaactgctggcctgcgtttgcgtaccttctgctcacgcttggcaccgttgcctcctgaccctgcggccgcccgcgcggggcggcgtgcgtttgtgcacctgcaagcatacgacggccgcgccgcccgcggcggggaggaaacgcgaaggtcacgcccgccacaccgccgcggcgccacgtgtccgccgcatggcctacaatgccgtggttgtgccgcacggactatggaagggcgagaagagcatgacacccaggatgcacctgcacgtactggccagcgggtcaaagggcaacgccgccgtggtggagggccccgcgggaagcgtcctgatagactgcggcatttcccgccgcgagctgctgcgccgcgccgacgccgtgggctgcgacatggaccgcgtcacgcacgtgatcgtgacgcacgagcactcggaccacgtgcgcggccttcccgttttctgcaaccactttgggggcgaggtgatcgccacggcgggcaccgcgggcggctccaggtccctggcgcaggtgccgttcacgctcgtgacgcacgagcagaccatggagctcgcgggcatggtcgtgagcaccttccccacctcgcacgacgtggccgacccctttggtctgcgcttctccgtggtggatgaggacggcgagcttgaggacgccatcgcctggtgcacggacacgggctacctcacgcccgaggcgctgggccagctccgcggcgcgcgcatcctgggcctcgagtccaaccacgacgagcagatgctcgcgcatgggccgtatcccgctttcctgcgcgcacgcgtgggcggtgacaccggccacctctccaacgcgcaggcggccgacgcgctgccgctcctggtgacggaggacacggagaccgtggtcgccctgcatctatccgagaagaacaacacccccgggctgtgcgtccgcacgctggcggacgcgatgagcgccgccgtcacgacggacgacgacggccgcccggaggcgcgcacggcggacgggctgctcaccatatgcgcggcgagccaggaggaaccgctcacgatctggtaacggcgcgaagctggtgcggcgccgcgcgcacgggcccacgccgtcagcgggcggccgtgcttctcgcccgcgaatccgcctcgcgctggcgcagctcgcgctcaagctgcagcgccatggggatcgcgaccagcaccgtgatcacgtccgccacggactgcgcgcactccacgcccgcgagccccagcacgcggctgaggatcgccaccaccggcgcaagcgccagacccagccggcacagccccaaaaacgtggcacgccacatgcggcccgtggtctgcagggcaaagttggtgatcatggcgatgcccgtgagcggcagcgtcacgctctggaagcgcagcgtgacggtggcgatgcggataacctccgggtcgtcgcgaaagagcgagacgatctgccccgcgcaggcaaacgtcaggacgcacacgcacgcgaccacgccaaacgccgccttgcgcgcaaagcgcatggcctcgcgcacgcggtcgtagcggccggcgccgtagttgtagccgcacacgggctggaaaccctggccgatgccgatctggatgtagttgccaaagctcaccacgcgctgcacgatggcgatggccgcgatggcggcgtccccgtacgggcgggcggcgttgttgagcacggtgatggcaaagccgctcaccagctggcgcgcgagcgagggcaggccgccgttgttgatctctcgcgcgaggtcgcggcccacggcgagcgccccaagcgagagatgcgccacgtggctgcgctgcatgcccacgagcagcagcacaaagctgaggaactggcaggttatggtggcaaggcccgcgcccgcgatgcccatgcccaggacgaagatgaagagcggtgccagcccaaagttgagcaccgcgccggagacaaaggccaccatggcgtaggcgctttcgccctcaaatcgcagctgcatgttgagggtgagcgcggcgcacatccacggcgcgccgatcaggatgagcccgatgtaggtcttggcgtacggcaggatcgtgcgagtggagcccgccaggatgcagatgggctccagtagcaggtgccccaccaccgcgatggcaagccccgtgcagaacgcggccgtcacgccgatggaggccatggtatccgccatgcgctggtcgcgtctgcccaggtagcgcgacatggcgttgcccgtgccctgcccaaagtagaacccagccgcctggatgagcgtcatcaccacaaacgccacgccgatggcgccggaggcggaggtcgatatccgcccgatgaagaaggtatccgcaaggttgtagagcgtggtcaccaggttggacacgatggacggccacgcgagcgagagcaccagccggtgcacggggctctgcgtcatctggcgatacttgcgcttggctgcgtcctcctggccggaggcgccgtccgcctggcccgccgcgtccggcgacggcgccacgtccttctcgcccgctgcgtccttctcgcctgcgttgtcccgctggtcctgcaccacggttccctccacgattgccgccgcccgtcgcgcggcccgcacaacgtgatacacccgcgcggcacgccgcggcaaccgtcggggggagaagaacacccgcctcgccccacgccgcctcgggacgcgccccgcctcgcaccacacaaaaggagcccgccaccggtcggtgacgggctccatggttcacgcttttatgcggcttgcggcgcgcgggctggtttagaacgtgaccggctcgtcgtagtagcagcaggtgaggatcttctcgaagtcctcctgcttggtctcacgcgggttctcgggcgtgcaggcgtccagaacggcgttcgcggcgatcttgggcagcttctccttgaactctgcctcggagaccatgaccggctggtcgttgtcgtcggccttgatgccgcccacggcgtagttcttgatgccctgcgggatgttgagctcgtcgttcatgctgcggatcttgttcaccaggctgtcgaccagctggtcgtccgtggagccgggcaggtgcaggatctccttggcaacgtaggcgtaacgctccttggcgcgagagtccttggagttccactggatggccttgcccaggtacatggcgtttgcgcagccgtggatgatgtggccaccctcgaaggcggcaccggtcttgtgcgccatggagtggacgatgcccagcaggccagaagagaacgcgatgccggcgatgcactgagcctcgtgcatgtgggcgcgggcctcatggtcgccctggtaggacttgggcagccactccgtgatctcgcggatgccgtgcagggcgttggcatccgtgaacatggaggccgcggtcgagacgtaggcctcgaggcagtgcgtcagcgcgtccatgccggtgtgcgcgcacagcttggcgggcatgctgtaggtgagctcggggtcgacgatggcgacgtccggcgtgatgttgaaatctgccagcgggtacttgatgccctgctggtagttggtgatgaccgagaaggccgtgacctcggtgccggtgcccgacgttgagctgatggcgcagaagtgcgccttcttgcggagctcggggaagttgaacggcttgatgatctcgtcccaggactcgtccgggtactcgtagaacacccacatggcctttgcggcgtcaatcggcgagccgccaccaatggcgacgatccagtcgggctggaactcgcgcatggctgccgcgcccttctccaccgtctcgacggagggatcggactcgacgccctcgaacagctttacctcgaagccggcatcctcaaggtccttctggacgtcctgcaggaagccgccgcggcgcatgctgtggccgccggaaacgatgatggccttgtggcccttgaggttcttgacctcatgacgggcgccctctccaaagtacacgtcacgcgggttagtgaaacgacccatttcaatctcccaacatgttgaccatcgcccctcgcgatggactgttcgccttgaagcgcacccattacataccacgttttaaacgatacacgtgtaactattcggcaatattgcgcgattaaaaggcaaacgttgcgctattattagtgatgcttaaaattaagaaagttttcatgcgtaacttgtctattaatcactggacaagttgagatgaacccagaagcattaaaggtggatgagaagaccatggccacgttcctcaatccaagtcccgtcttcggccccgtgcgcagccgacgccttggcgtctcgctcggggtcaacctcatgccctgcaccggcaaaatctgctcgttcgactgcgtctactgcgaggtgggcttcaacgccaagcgccgcaccaaggacccgttcaccacgatggacgagctcacgtacacgctgcgcgacgcgctcgagctcatggccgcggacgacgacctgccggacgtcatcacgttcgcaggcaacggcgagcccacgctgagccccatctttccgcaggcggtcgacgccgtcatggcgctgcgcgacgagcttgcccccaacgcaaagatagccgtgctctccaacggcaccaacgccgaccagccggaggtccgcgaggcactcctcaaggtagaagacaacatcctcaagctcgacgcgcactcggacgacctcgtgcgcgccatcgaccggccgctggccgcctcgtactccgtcgagcaccaggtggagacctacgccagctacgacggccacgtcatagttcagaccatgttcctggagggcatgtttggcgaccgcaacgtttccaacacctcgtacgaccaggtgacggagtggctggaagacgtcaagcgcatcgcgccgcagtacgtcacaatctacaccatcgcgcgcgagacgccggcccccaacatccgcaaggcgcgcccggacacgctggacgccatcgcggatcgcgtccgcgctgccggcatccgctgccaggtctcttactagcgccagcggctgccacagcgccataaccggcaacgccagacgggcgggaaggacgtgccaaccaaggcaggacgtcctcgcgctcggccaggtgcgcaaacccgcgctcatgcgtgccctcttccggctgggcgccacgtactccggtcaggagctctcgtacaacaagatgctcggccaactgcaggacgcgggcaacaccaccaccctcgcccactacctcgatctcctgggcaaggcaggcgtgctctgcgcgcttcccaagtacgacgagaagcccgtcacgcgccgcaagagctccccgcgcctcatggtgttcgacacgtcgctcatgacggcaacggatgggcttggcagggcaacgtacgccgcggatagcgcgcggcgcggtcacctcgtcgagtcggccgttgacgcccgtcttcttgcgcgtgcgcccgaggagagcttcgacctcttctggtggcgcgagggcacgagtgaggtcgactttgtggccgtcagaaacgattcaatctccgcaatcgaggtcaagggcggtagcgagccccgtcagggcggcatggcgcagttcctctaccagcacccacaggcaaggcgcatcgtcgtgggcggtagctcctcgggggtctgcaccttggacgatttcctccgcgaccgcgtccccctcttctattaggccttctactaggagtgccccatgccgcacgatgaccaagacatcctccacatagcgcccgcaacggagctggaagaggagcgcatccacaccctcctccgcgcatacaacgcgcgacactggccaaagaacacgccgtcgctctcgctcaccgcgcaggttgagggcgagctcgcgggcggtatcgtggcataccttgtggcggataccgtggaggtcgagtacctgttcgtgcaggagcgcttccgcggtcgcggcatcgcacgcgccctcctcgcccgcgtcgaatcccaggcgcaagagcgcggcgccaggaaaattctcctcaacacgtatggcttccaggctccgggcctataccggcacctcggcttccaagaggtagctaccatcgacgacgtgctcggcaccagctggcacatcttcctcaagcgcatctagtcacagagtcgagtggaatctataccatcttacgcatgggtaataccccttcaagatgaagcgaaatcgtacgtatacgtactattgggaccgccgatgcatgactaggcgcaaggggcatcatcattctgggacgcattaaggatccaatacgcgtttggacgccgtcgctctgcgtggagctcccccttttgcaaacgacccatggcctttccccatcacgtaagtgagcagcaggatagtgcaagagcagtccgatttccgaaacacatgtagtgtctgccataagcagtggctcctcccgccatggcgggacaacgtcctcccatcaaaatcgttcgagggggagtccctcggaccgcaataaggaacgggcgcggatggtcatttccatccgcgcccgcttttgatttgttcggcaaggcttagttggcttctacactaccccgtacctacatcatccgcccaacaacccattagcgcgtccgcaaagcgaactgccagctctccgactatttcacccaactagaaacttgccagcttccttcgagcgagaagcacggccgtcgcgacgactatcgccatgccagtcgccagatatcgccttgttccagagccaccagtcttaggaagcacgtatccctccggcaacgtgttggtcaccacgatcgtccccgtctggatgccctcattgttcccataggcggtcgtatagccagatggtccagagatctcctcgacggtatagtagagtggatgaccctctgcgtccttcgttggcaggttgtcccagtcgcgagaccagttcggggacgcaagcgtaaccgcatccccataggcggtcgtgtctgtcaggatgtcattgggcttttccttttcgctaacggtgacgttgttattcctattgacggcagagccaggctccaacacgactatagagagctcagccccgtttgtcgccgtcgagggaactgatacctctgtgtagtcgacatttgtgttcgtatatgcgacaggagagtcgcccccaatcgcaaccgaaaatgcgatccacttggcgacttccaccttcatcttgaaagccgtcccgcgcttgaccctccccgttatgatcttgtctggtgcccaacccctatccgattccttgtcggcccggacggttatggtcaccgtgcaagtatcatccgggtcattcttctgcgtactctgatagagctgcacctttaccgaagcgtccttcggagcagtggcatccgtgccgtccgaattggcccatttcttgctcacggtcaagcgcgtgtaagtgttggggatgtacagagcaccaccgctgtagttgatgaaggtgacgtcaggcttctgaactgagggcacagatcccacctccttccatgcgtcatcggcggattcgttattcccgcgaacgacaaagtagtgcggggtcttgtccagcctataaccatccggtgcttccgtctcgaccacacggaaaagcgtgtctgtcgtgaccttcgcgttttcttcattcaggtcccaggagagcatgccgtaatcgcccttgctcgcgtctgtgcccgtcttctctgtgtcgctcaccatcttccagctgttggaggagctgtcccacttttctagcgtgaaagttgctccaggtaacagcgtccgatagttgtggctgtcaactttgtagagtgtgacgtgccgtcggtttgccgtaacagaggatgtgatgttcttcagcttggtcgtcttttccgaagaccactggccactgagattgaccgagttgctgacatcatacccctcaaccaccgcagatttgtcgatgcgctcctcatacccgaggacgcaggcgagtgcatcagggaccctgacggtcattacaccattcgacgcgtcatatgtaaccgagtaacgacttttatcgatttctgcgcccttatggtttcccgcatctggctggtaggcataaaggtggatggtgtccatcagcagctcgggagaataacggttcgcatcgccgaaggtgtctgtcagcaccagggtatcagagttcttatcaaggtcctttccggctgggttgatgtcaacgtagtagcgcatgatgttggtcggtgacccattagacatgacctgttcgcctgtcttcacgacgttctggacgtcacgggttaccgttgtcgtctgcgtgtccgtatgaccattccactccgctgtattggggtagggtttacgatcaaccgtaagattgttccacacactatccttggcaacagaggtcttgtagtgaatcgcgacgagcggataatcttcggtatatttgtagtcgtcaatctcgaaggtgacagtcgtcgtaccgtcagcgtttttcgtgggcgtatacttcggattcctcccctttacgaaggtcgtacctatatagttctcgctgtgctcgtcatattcgttcttgaagaaactaccccaaacctcgccgtcaacgatggacatgccagcgggcagcgtgtcagtcaccgtgatagtgctgccagtcgtgctatcggttttcaggatgatgcggtactcaagctggtcatttgaaacggagtcgagcttcttcgtgacggtaccgccagcaaagtgcccgtctccattgccgtccttgatgcggacttccttgtcgatcgtcttgggaatcgtaaagctcgtccttgcggtcgatttcgtatccccaaccgcaccggtattcgaggcgctccacacctggccctccgctacggttccgtcaatagtctttcgcactttcgtcagccagggtcccgtcccagtcgccggagctagctctgtctcttgagcacctccctctcgtcccatccgtccagcagttcggtgtcaaggtagcgcc

SEQ ID NO: 233 - DNA, 9618 bp, Unknown
  Metagenome-assembled genome
aagagatcgaggtcccaaggcgcaagcatcacgcgatcccccgccgtcaggaacaatgtcccatatccggttgcccgtaatacaggactaaagtcgccgggaggcgacgattaagaggataagaggatgacatggcacgctacatgacgtacacggaggccgcggaccttggtccctacgtgcggctcctgatgctggaggagcccacgcccatggaccgcgggctgcttggggcgaccacgttcgaggtgcgctcgcgcgcggccggatccgcggatgacgttgccgtgccggtgctgcgcgcgttcgcgtgcgacgccgcgggcgagccggtgggggagggcgccctgcagaccgcgccatacgtggcgctcgagctgccggaatgcgacgcgacccgcctcgtgggcgggaacctcatgggctcgttccgggtccgtcgcgagttccgcgtgaaacagtctggccccgcggacagcgtgacctttgacgtgcctgccggcgaccgctgtcccgcgctcgatggctgggacctggggctttcgggtacctttgacggctacggcctgcgctacgcgctcttctcgcccaaggcggccgcgcctggcggcacgcctctcttgctctggctgcacggcgcgggcgagccgcgcgacccgtacctttccgtcatggccaaccgcgtcacggcgctggggctgccgcgcatacagcgcgagctgggcggggccgcgtacgtgctggtgcccgcgtcgcccacgtactggatggactccggctcgggcatgatggaggacgacaaccaaagccgctacaccgcggcgctcaggcagctggttgatgccgtggtcgcggcgcacccggacgtggactggcgccgcatatatgtcggcgggctttccaacggcggcttcatgacctgtcgcctgatcgcggactatcccggctactttgcggctggcatcgcgctctgcgcgccatggaacgaggacctcgcgacggagtcggagttccgcgcgctcgcgggcacgccgctttggttcgttcactccaaggatgacccgatcgtggatcccaacaggaccgcggtccccaacttccgccgcctgcgcgcgatgggtgcgcccgacgtccacctcacgctgctggaccacgttgtggaccagactggcagatatctggacgagcagggccgcccgcgccgcttcaacggccacttcgtgtggatccccacctacaacgacctcatccgcgagacatgcgaggaccccgccacccaggtgggagacggggccctgacgctgtggaaatgggttggctcgcgtcggctttccgcgccgggcgagcgctagttagcggctagcttgcggttgtcgcgccggctactctacgacgaggtcgcggtactccggatgcttcttgaaccagtctttggcgtagctgcacgagagccgcgccttctttcccatcgacttgatgtgcgcagccgcgcgacccatcagcaggccggcggtgcccatgccgcgctcggacggcgcgacgtacgtcttcgtgatgtccaccacgccgtcctccgcgtcggcaaagtcgacctcgcccttcacgtcgtcgtcatcgcccaggaactcgacgttgttgtcgttcacttgaaagatcatgtgtgagcccccttcgtgtgtaaggaaggagtcgcgaggcatatctccccgcgaccccttggtaggtttgcatatggaatctgtatacccaactacgtaggccgctattctcgcccgccgtcggccgacgcgccgcgcctagcagttgcccgtcagcacgcagggcagcttctcgcgcgcgacgtcagccagccggtagacgacctcgcgcggcgtcgcgtcgcgatcggtcaggtgccagcgcgggaagaaccgcgtcacgtgcagcacgatggcggggtccacggagcgcagccagcgcgccagctcgcgcatctgcgtcgcggagtcgttcatgcccggcaccacgagcgtcgtgacctccaggtggcaggtgggcgtcgcggcgagcgtctctatcgtgtgccttacggcgtcgagcgtgcccgtgaccccggcgcacgcgtcgtagaacgcgggcgagaaggacttgaggtcgatgttggcggcgtccagcaggggcgcgagcgcgtcgaccacgcgcggcccggcgcacccgtttgagacgagcacgttggcgaggcccgcctcgtgtgcgagccgcccgcagtcgcgcacgtactcccagcccacgagcggctcgttgtacgtgtaggcgatgccggccatctgcctgccgcgggcctgctcccgctcacgctctcccacggcgagacttaccagctcggcgggggtgacctcgcgccacggcacgtccgactcgcccgcctgcgagatctgccagttctggcagaaggggcagcgcaggttgcagccgtagctccccactgacaccacggttgagcccggcttccagcgcgcgatgggcttcttctctatcgggtcgagcgcgatggacgtgagccggccgtagttggcggccaccacgcggccgtcccggcacgcgcgggcgcggcagaaccccgtcgcgccctcggcaagccgacagtgccgcgggcacacgtcgcacgtcgctaccttgcggctgcctgccgcggcgcccgtggccgcgtccttctcgcccgcgtctgctgccgtcatgtgtgcctcacgacctcgaagcgctcgagccgccagtcgtcgcggtcgaggtcgatcccgcccttgcgcgcggcgatgcgcacctgctgctcgatggtgtccacgccgtccaggtcgggcaggagcagcccgcgccggccgtcgcgcgtgctcacgatcacgccgtagcgcttggtgtccagctggccgggcccgcggatgggctccggcttggagagcacgtccacgtcgtacaccagctcgggcagctcgtcctcgctcacgggcgagaagcgcgggtcatgcgcgccggcggccacggcgttgctcagcacctcctgccggagcgtgggcttggtcggcgctatcgtgccgatgcagccgcgcagctcgccgtccttcttgagcgagacgaagcagccggccgcgcccttgggggccgcgtcctcgagctcggcccgcagcttggagggcacgtccttctcgcccaggcgctcgcccgtgcgcacgtaggtctcgagcgccaggcgcgccaggcgcaccagcgggtcctcggcggccttgcggtcggccatctgcttgcggtggaagtcctcgtacgcggtcaggaagtcgcggctggcgtccgcgcgctccgcgcccttgggatagaacgaggccacgccgtagcccacgccaaacggcccctcgtacgagagcagccgcggcgtgacgtccgtctggtcaagcgcgcccgccatgatctggaagctgcgcaggccgcactcggccgcgcgctcagcaaagccgcggtccatggtcagcaggtccagaaagtccgcggtctcgaagtcgtggcacacgcgccggtcaaactccggtccctccggcgcaaagccgtacggtccgtccggcttgagcttgtgcgagaggtcgcccgaggccacgtagaccacgcgccgccccagcacgtccgccacgcgctgcacgagcatgcccatgcggtagtgctccgcgggtgagaggccggatattcccatgcgcacgagcttgaagcttgctggtttctttgcgtcgcggtacgcctgctggataaagtggagcgcgatcgtggtggcgtggtcgagcgacgggtcgcgctctcccgcggtgccggcggcaaggccgtccgcgtcgcaggcagccgcaagggacgtggcaaacgcggcgtcgtagtcaacgtcataggcggcctcgggcgcgccaaactgcgcaaagctgccgtgcgcgtgcgtgccgggcgacacgtggatgtagtcgcggtacatgatggaatggggcgtggacagcacgatcgtctgggggtcaagctccactatctggcggctgacctcgcgatacgcctccacggtggacgcgatgcccttctccctcccgtgtccgacggccgggatgatgagtggcgggtgcggtaccgcaaacgctgcgacaatggccataggtccttctccccgcgccaaggcaaagcaaaggcgcgcgacacccagcgggcctcgcgcgccttgtgcatggcgctcaatcttggtgccagtcaccacattcttacccagcctgcggcggcgtatccgcgcgcgtcggctagagctgcccctccaggaactgctgcagctcgcgcaggcggctcacgctcatctggctggcggggaagtacgccacgcgcgacttgccaaacatggccaggcagccgtgctcgttgtggcgcacgtgcttgaggctcctgagcggccagcgcgagacctccgcgcccgggccctccacgatgacctcggtgggggtcaccacgttgtggcggttgaggtcctccttggagtcgcccaggttggtgcccatgagcgcccacatggtgacggacttccagttgcctgacgccgtggcgccggatatcgccatgatgagcgcgatgcagaacaccacgatgttgaagcccaccatgaagttgaccacgagcgcgaccatgcccacgaccagcgcaaccaggcagaggtcgcgcacgtggccctggccatagagctccgcggcgttgtccgcgctggcctcgtccagaaagtacgaggccgagaagagcacctccccgtacttgcgctcgtcttcctccgccgtggtgcggtgtgcctgctcgtgctccttcgcgctgatgcgcgccgcctgcttggcgcggttcttgctctttttggacatgcgatacctccgtagtgtgtgacttgccatggtagcgcaaacgagctgcggcccgccacagggcgggccgcacgggaaggctttcgtttgtctgcacgcgcgtcgggtgcacgcgcttcgggcaagaagtgcgcggcgggcgagaaggacgtggcgccttggttcgcgctactccaggacgagcggctccatcttgaacgtgacgcagttgacgtagccgcggttggtgaggcggaggaacggcacgcaggcaagcgacatgacgcccatggtcatgaacggcgaggggaggttgcagcccatggtcttccaggccttctccacctggtcgacctctgcggagacgacctcgacaggcttgtcgctcatgaggccgcagacgggcagctcaaccagggccaggaccttgccgtccatcacggcgacctctccgccgccgcagctggccagggtctgcgccgcgagtgccatgtcggcgtcgttgtcgcccatcacgagcaggttgtgggcgtcgtggctcacggtctgcgcgagggctccgtggatgccgaagcccgtcacgaagccgaaggcgtgcgtgccggcggcgccgtggtgacggtcgaagacgcaggccttgagcacgtcgtgggcggggtcggccgcaagcgagccgtcgcgcacggggaccgtggccgtgacgtcgcgcgtgagcgtgtcgcccgcggcgatgccgatggcgcgtaccttgcaggtgccttccggcttgtcgacggggatgcggaaggtatcgggcgtgacgtcgaggccgatgttcatggtgtgggtcatgaagtcaggccaggagaagggcgtgacctcgaacagggccttgccgtcctgcgcgacgaggtcgccgtcgatgatgacgtcacgggcgcggaagtccttgaggtcctcgaacaggacgatgtccgcgcacttgccgggcgtgatggagcccatgtcgagcccgacgccgaagtaggttgcggcgttgatcgtgcacatctggagggcggtcacggggtcgagcccgaggctcacggcctcgcgcaggacgcggtccatgtggccgtcggacacgatggtgtgggggtgcgagtcgtccgtgcagagcatgcagtggctggtgtccacgccgctcttgacgagctcgggcaggtagccgggcaggttgagccacgcggagccctggcggagctgcacgtacatgcccatgcggagcttggcgagcacgtcctggaacgtgctggactcgtggcagctggtgacgccggccgcgatgtaggcgttgaggccgcggtcgtcgtccggtgcgacgtagtggccggtgatgggcttgtcggccttgagcgtctcgctcacctctgcgagggcgttcttctcgcccgaaaggatgccggggaagttcatcatctcgcccaggccgcaggtctcgggccaggtcatggtctcggctacctgcgcggcgtcgatgctggcgcccgtgtcctccacgccctggaccgccggcacgcaggagggcgtggtcagcatgatcttgaggggcgtgcgggcggcgtcggtccacatggccttgacgccctcgaggccggtgacgttggcgacctcgtgcgggtcggcgtagatggcggtggtgccgtggggcacgacgccgcgggcgtactccgaggggccgaccatggaggactcgatgtggatgtgggtgtcgacgaggcccggcgccgcgtagaggccgtgggcgtcgatcaccttggtgtctggcccgatgcagtgctcggccgtgtggccgtcgaagccgatgtaggcgacgcggccgctcgcgatggcgatgtcggcgtcgtccaggatctcgcgcgtggtgacgctcacgagcttggcgtggcggatcacggtgtccgccggctcctggccctgtgccacgcgcacgagcctgtcgttacattcccagagggggaccttgcagaagtggttgatcatgtgcgcctcccgcgacggggccgcctctgcccgtgctggcggcggcccgattttgtttgcacctaggttagcgtatgcggacgagggtggcgtggatgccggctgctggcgcatgtacggggcacttgctcctgaccgagtcaactgcgaaccggatgaatgacattggttgattcgaggtttgccagataccgcagtggtctaaaatacaaaagcacgtaaagaacacgtattttgaagaaatttgaaatccgaaggctggtgattccatgggagatgaaattggacctcaagagaggattaggcaagcggagtccaaacttgaggaagtaaaggcagcctacgaggccaaggtcgagcaagcccgcaaagactcagaagaagcaaagcagaggtatgagagccgtatcgagcaatgcaagcaggcagtggccgacgccagcgccccgtacgacggtctagttatggaggttgggccagttaagctgtacggcgacagaattgaatacgagaacaatctccttaagctcgatgatagaattgagattacggtatctaccagcggaaatgtgtactctgatacgaagatatctggtggtggtcccagcattggcggcgcgcttgttggtggcgtaattgctggcgaagcgggggccatcgtaggcgggacgaaaaagatcacgtcttccaccgaaactcacgacgcaagaggcgtattcttgaccgccgtttcggatgcagggagtcttgttgctccgatcgatccccaacacgagctcgatgcgaggaatcttacggcgaaggcgaagtatctaatccgaacccttgaaaagagggagagtgaggtagaaggtcctgtctccgatgccaaggagaagctcgatgaggcgatgcgcgacactgcagaagccaatgagctgagccagcgttacgaacaaatcaaatcggatacgagcgaggtcgatgctgcaaaggcagaatacgaatcggtcgtaagcagtatcgatccttcggagatcagggctgaaaaacttgcgaaggtcaagcgtcatttttctagggccatgcaagtagtcaagattctactggcattgttcttcattgctctcgggctcgagtattggctcgactatccccaatctgctgtgggcggaattgtcagtctgcttcttgcagatgcgcttattgtctcgacggttcatcgagctagagccaggaaagttatgcagtgaaatttgccattgggaggagtcgataaatgagtgatgacaagaagccgtccagtggcggggaatcaactgattgcgcggagaccgaagagaccgaaacggtcgctgagactaaggagtcagaagcggtatcgagtgcccagcaagaggagaacggtaccgagacgccgaccgagaacaacgaaggtgacaatagccacgatacgcataaattatggaacagcctagaaggaaagatcggtgctgtagcggctgtcgtcatcattgtgattggcgtgttgttcggtacgcacgtattctgcgtccatcactgggccaaggcgacgtgtacctctccacgaacttgcataatctgtcaccggactcaaggcaagaagctcggtcattactggttgcctgcggactgcgagtacccgaagcgctgcggacgctgtggaatagaagtgggtaaaaagctgggacataaatgggaagcggctacttgtacggaaccgacgacgtgtaagcgctgtggtaagacaaagggctcgccgctggggcacgacgtcactgcttggaagacaaccaaagaggccacatgtacggagagcggtgaacaggaaggtacctgtaatcgctgcggacagacggtgacgcagacaattccaatgcaggagcacacgcctggagattgggaggttgcgaaagactacacgatagaccctgccggatacgtaacgcctgggctcaaagtgaggaaatgcaaggtgtgcggtaaggtgcttgaacaacaggagtacaccgttgagctcacaacgtcgcaaagtaacgcgctggcaaaagcggcggattacctctctttttcatctttctcgcatgagagcttgataaggcaacttgagttcgagggatattcaaccgatgatgcaacctttgctgcggaccactgcggtgccgattggatggtccaggcagagaagaaggcgcagtcgtacatggaggtctcctctttctcgagggccggtctgataaaccaacttgagtttgaaggctttacgcccgatcaggctgcgcatggagctgattcggtcggcttgtagcatttgaattggtggggccggctaggtaaagcgtgatcacgtgtatagatcagaggccgttggagggaatcctctccggcggcctttcgcatatccggatgtgcgatgcggtacgtttttaagagcacgcaggtagacgagttgcgacccaattcgcacatccggatatgcgaattttggagccgggtaacgtgggcggtagcccgcccgacgtgcactccgcatggagggcgtgtgcccgggccgtggctttttggtggtgtcgcggcaggcgcgcatgcgcggggcacgcgggcaggtagagtatcaagccgtgagtgtgctcggtgggttcgggcgacgtactgttccgaacctggtcaggaccggaaggtagcagccataaggagcctcgggcgggcgcccgttcccaccgagcacactgtgtacgacgcccca

SEQ ID NO: 234 - DNA, 5168 bp, Unknown
  Metagenome-assembled genome
tacttctcgggaatcaaccagagggcggcatagggaagggcaagaacagctaagctgggaacaccatcaggcaagggctttcggtagaaaacgctaattcgtgtcgaacagactcagccagttcacaaccttggtgacaagaccaaggaattcaagttcactgttaccttcactgcgcctgcaggcaagaactgggtgaacgatattaccgttaagggtggcgcctccgacctgaagtggaatggcaacgccgcaactttcacgctcagcgatggagataccgctcagtttgaaaatgttcctgctggcgtcacctatacggtggacgaggcggattactccgctgacaagtacaccaccgagggtgaggttactacgccgactgccatgacctccaagggtgcgaaggttgatgttacgaacaccaaggagggcaaggtcgacactggcgtgattcttaacaacgccccctacatcgccatcatcggcggtgctgcggtcgtcgcaatctgcgtcgtcaacaagcgtcgtcacagcgacatggactagtggcttagacagctgactagaagtcctttgtaagtgattgaggctgcgggcgggacgcccgcccgcagccatttcgataaggggaggtggaacacgtgagagcatcgaagccgctgagggcgtgcaacaaggtcttcaacattgtggttgctgtgctcttgatcggtgccaccttctttgcgggatattcgctttgggataatcagcaggtctatgcccaggcccaaaaggttggggaggacctgctcaacctcaggcccaaggagggcaagaaccaccgtaaggccttcgagaagctgaggaagatcaaccccgacgtggttgcgtggataaccatgaaggggactaagattgactatcccgtggtacagggcgaggatgacctcgagtatctgaacaaggatgtgtatggtgactttgctctgtcgggagcgatattcctcgactcgcaatgcaacccctcgtttacggactcgtactccctcatctacggacaccacatggataaccacctaatgtttggtgacctggatctctatcacgacaaggactttttcaacaagaacaagacaggcgtcctcatgacgccggatcaaacgtacggcttggaggtgtttgccgttatgacggtgaactcctcggacagcacgatcttctcgcccacctcgtggacgaaggactgctcgggcgttgtgtcctatgcggcccagaaggccgagcacgttcgtagcgacgtggtcgagaagatcggagccgatgtcgccaaggaaaggattgtggctcttgccacgtgttcttccacggggacggaggctcggacggtactactggcaagaatcgttccctatacgggcaacggcaagtagatggcgagttaggaagagaaatgaagattaaacacaggcttatggcggtcgcgctcgcgccagcgctcctcctcctggcggccctgttccccgcaaacgctatggctatcgagggggacgcgactaccgttaaggttcccgtttccgtgacgacgtctggtcagggcatccctggggagacgtacacggtgaacatcgaggccgagaccgagggcgctcctatgcccgctgcgtccaagattgccgtgaagggcgaggagctcaaggccggcacctataccggtgaccccgccgagttcgaccttgacttctccaaggcccgcattggcatctacaagtaccgcataacgcaagaggccccggagaactcgacgggacgcggcgagtatgacgacaccgtctactacatgaccgcgacctacgagcaccctgacggaaggatgaacgagaccagggtgactgccgccgtgcacaagggcacgaaggacgggaccaaggtcgccgtttgcagcttctccaacaactatgccaacctgcctgcaggcaagagcgatcctcccgtgagcaagcgtatcgccggggacaagccctccaccaagaccaggttcacgttcgtgttcgaggggctggacggcgcgccgatgcccgagggtgccaaggacgggaagatcaccgccagcgtcgacggcgagggcacgatcgagttcggcaactccgagtacaccaaggccggcgtctacacctacaagtgctacgaggtgaacgacggggcggagggctatacctacgataagacggtctacaccgttcgcgttgccgttactgagaccgtcgatggcttcaaggtcgagagggccatcatcgaccaagacaataaggagcatgactccctgacgttcacgaacacctacaaggagccggctaagcctgcggagaacaagccggcaactcccgcaacgaccaagaagggtggctccggcgtcgtcaagactggcgacaccaacaatgctgctgcggttgttgctctgggcgtgattggtgccgtaatcgttgctggtgcagttaccatgaggcaccccggcaagcaggagaagtagaagagcgttattggtaggttttctaactcgtgcatcattgttgacgcccctggctcacgccgggggcgctactgtgtttgggcgtgcaaatgaccaaatacctggaacgaactgagcggacagctgctatagcggctgggtaaaatacaagtgcaccagcggtgcccgtcctttctaaacggtactgcgggcaacgccaggtgtttcgaatcgaagagcccggtagcccccgggctcttcttatctctcacttccctcgcatgcagcggggattgggcgatgctcacgacgagctcgagggtttataggacttcaaggacaaagtgcatgtcaatgggcattaacctcctcttggtgagaaaagctgctcgcatccggacgccgctggtgtagtgaagattccgacgggttggcaaagccaaagccgttcgtggcatgatgtagcaaacaaggatcgttgtgcggacccaggaccgatggttttgggcccgcttgtgctgtgaagaggtttccatgctcataaaccgcgtcgccacaaagctgcttgcagcgccggaccttgcgcccgtgctgcaccagctggactccggccacgatgccacgctcggcgttgcgcagagcgcccgtccgctgctcgcggcgtcgctgtgggcgcgcgacccccggccgtgcctgatggtcgtggcgtgggaggaggccgcggaccgcacggcccgcgctctggccgcgtggctgggtcgcgacgtggtgagccgctatccggaccgcaaggacctgccgtggtcggaccgccccgcggacgatgccgtggtgggtgcccgctgccgcgccgtggcgcgccttgccgcgggcgagaagtgcctggtggttgccagtgcgcgggcactgctccggcgcgtgccgcccaagggctccggctactttgcctccagcacgtttgccgtgggcgacgtgctggactttgaggacgtgccgcggctgcttgtgggcatgggctactcggacgcgggcgacccctctgaggtgacggcgccgggcacgttctgcgtgcacggcgacgcggtggacgtgttccccgctcaggcgacctcgcccgtgcgcctggagttctttggggacgaggtggaccgcgtgcgccgcatggtgcccgcgaccggccagaccatcggcgagctgcagagcgtgaccgtgagcccctgccgcgaggtggcgctcacggataggaccgtggcccgcgcgcgcaaggcgctgtacaaccgcgcccagagcgactccaaggtggccgcggacctggagctgatagaggcccgcgccgccgcgcccacgctcgacaagtacctgcccgagctctatggcggcagcgccacgcccatcgagcacatgtccaaggacgcgctcgtgatcctggcggagccgcgcgccctgtttgacgactgcatgcacgcggcggacgacgtggaccaggccgcgcgcaacgcgcgcgtggacgcgagcggcctctttaccaacccgcgccagatggactttggcaagcagcagcgcctgtccttctcgtccatggcacgcgtgggcgggcaggcggacgcggagctcgacgtgcgccagccctccatagcgggaagcgacgccaagctgctgggccgcatgcgccagctggtgcacgaccgccagagcatcgtgtttgcggtgccggaccgcggcgcgcgcgaggctcttgagcttacctttacggacgagaagatccccattgcggagtcgctggccacggccgggcccaaccgcgtgccggtgtgcgaccccgcggccatgcagaacgttgagccactgccgcgcggcatcgtgacgtttgtggacgcgcccgttcccgcgggcgtggccgtgccctccgccgggctggccgtcttcagcgtgggggacctcacggcccgcatggcgcggcacaagcaccgcgtgcgcaaggtggaccccacgagcgtgaccttccccttcaagcccggggactacgtggtgcacgccacgcacggcatcgcgctgtttagccagatcgtgcgtcaggaggtcgcggggcgcgagagggactacttcctgctggagtacgcgggcggggacaagctgttcgttccgctggagcaggtggaccgcatcacgcgctacgtgggaccggacgggtcgagcccgcggctgacgcggctcaacacggcggactggtcgcgcgctacgggcaaggcgcggcgctccgccaagaagctcgcgtttgacctggtggacctctatacccgccgctccaccgtgcagggctacgcctttagcccggacacgccggcgcaggcggacatggagacgagcttcccgtacgagctcacgccggaccagcgctccgccatagaggacatcaaggctgacatggaatcccccaagccgatggaccgcctgctctgcggcgacgtgggctttggcaagacggaggtggcactgcgcgccgccttcaagtgctgccaggacggcaagcaggtcatggtgctgtgccccaccacgatccttgcgcagcagcactacgagacgttcttcaagaggttcacgcccttctcgctcgacgtgcgcgtgctgagccgctttgtgacgcctgcgcagcagcgcgaggcgctcaagggctttg

SEQ ID NO: 235 - DNA, 176905 bp, Unknown
  Metagenome-assembled genome
agggttcgaacctgcgacacgctgattaacagtcagctgcgctaccactgcgccaccggggaatttcttagtgcgttaggaactataacagacattgccgcccgcgcaagccagaatcgaatattttttgtcgccagagagcctccacatatcgcggcggcggtccgtaacgcgcgtgcagcaagtacgaattgatgcggaaatatacggtcaaagcgcgtatacgccgaccgatttgtaaaaagcggatatgtatccgcgggtgcgaaggcggtataacaggctcaagcggaaacgcgaaggtatccgccggcacccggccgacggaacgtcaagggaggttcgccatgggtcgcaggccaatcagggtcgtccagtacggttgcgggaagatggcaaagtacaccatccgctacctgcacgagcacggtgcgcagctcgtaggcgccatcgacaccaaccctaaggtcatcgggatggacgccggcgactttgcgggcctgcccgtcaagctcggcgtcaagatatctgacgacgcggacgccgtgctcgactcctgcgcgcccgacatcgccatcctcacgctcttcagtctggttgacgacatcgcgcccatggccgagaagtgcctgtcccgcggcatcaacgtcgtgacgacgtgcgaggaggccacgttcccgtggaccacgtcctccgcgaccacgaaccgcctggacgccatcgccaaggagaacggcgcgacgatgctcggcgccggcatggaggacgtcttctgggtgcgcatcgtcgggctcatcgcgggcgccgtcaaccgcatcgacaagatcgagggctccgtgtcctacaacgtggacgagtacggcatggcgctcgcgagggcgcacggcgtcggcctcacgcccgacgagttcgagaagaccctcgcccaccccgacgagatcgtcccctcctacgtctggaactccaacgaggcgctcgcgcaggagctcggcctcacgatcaaggagatcatccaggagaacgtgccgtacgtggccgagaaggacacctactccgacacgatgggcggcaccatcgaggccggcaaggtcctgggcatgaacacgcgcgtcaccacgaagacctaccagggcatcgacatagtgacctcgcagatcggcaaggtgtacgggcccgacgacggcgacctctgcgactggaagatctacggcgagcccgacaccacgttccacgtggacaagcccgcgaccgtcgagcacacctgcgcgaccatcgtccagcgcatcccgaccgtcatcgatgcgccgtccggctaccgcaccgtcgacgagctcgagccgctgcgctaccagaccgagcccatgatggtcgaggacatcgacttctagccgcgaaccaggcaacgcactaagggagaaggaccgcccccacaaaagggagcagtccttctcgtcattaccttgatgcttgtcgcggcgcgggtcttgggacgcaaggtccagggacgcgtcgccgacctgatgcgcggctagtcctcgatgtagtccttcaggcggccggagcgggacggatggcgcagcttggccaacgtcttgctctcgatctggcggatgcgctcgcgcgtgacgccgaactcgcggccgacctcctcgagcgtgcggggatggccgtcctcaaggccgaagcggaacttgatgaccttgcgctcgcggtcggccaggctgtcgagcacctgctcgagctgctcgcgcagcatggagtcgctcgcggcctcgggcggcgcgacggccgtggagtcctcgatgaagtcgcccagctgggagtcctcctcctcgccgattggcgtctcgagcgagacgggctcctggctgatcttctggatctcgcgcacgcggtccgcggagatgcccatctcggcgccgatctcctccggggtggggtcgcggccgaggtcctgcaggagctgcctctgcacgcggacgagcttgttgatggtctcgaccatgtgcacggggattcggatggtgcgggcctggtccgcaatggcgcgggtgatggcctgacggatccaccacgtggcgtaggtggagaacttgaagcccttggtgtagtcgaacttctcgaccgcgcggatgaggccgaggttgccctcctggatgaggtcgaggaacagcatgccgcggccgacgtagcgcttcgcaatggagaccgtgaggcggaggttggcgctgatgagcgactgcttggcctcgaggccgacctgctcgatgcgcatgaggcggcgctgctcggcgcgggtcagctcgatctcgccgttctcggcggcctcgagcttcttggtggcctcggtgccggcctcgatcttcatggcgaggttgacctcctcctgcgccgtgagcaggtcgaccttgccgatctccttgaggtacatgcggacggggtcgcccgtgagcatgacggtggagttgtcgaccctgcgcgcgcgggcgcgggagcctccaagcttcatgtcgtgccctcgtgctgtgttgtcgaccctgcgcgcgcgggcgcgggagctgcgcttgtgcgtggacttgcccttggacgcggagcggaggatctcgcttgccgcacgggcctccttgcgggccttggccagctcctcgtcctcctcctcgaggtcatcctcgccctcgagctcctcctcgtcctcctcctcgtcgtcgaggtcgtcggactcgatgtcggtcgcgggtgcctcctcgccgttggagatctccacgcccttggcgcggatcgcgtcgtacatgtccgacagctcgtcgtcatccacgtcgatctctgcgatcgcgacctggatgtcgtcctccgtgatggtgttgttggaggaggacgcctgagtgacgagcttgccgacgatgccctcgagctcgtcagagagctgggagtcggtaccgggagtagccttcttgtttgccacggatgtcctttctacgcacgtgcgttagggatactacccaaaatttggcttatgcaacggcagaaaccctatttgacagctcattaatacgtttctgcagctccgttgccgtcctgaagagcccccgcgcctggtcgtccgggacgctcgagctcgacatgcggagccttgcctttatctcgcgcacctcgcggcgcttggaccagagctcgaccacgtcaagcaggaagtccgcccgctgctccacgggcatgcgggacgtgacctcgagccggccgccggcgagaatgcgcggggcgtccgccacgacgtccgttgcggcgcctacgacctccgcgggcggcgtgcccgcgggcgtggcgagcatggcccacgccatggcctcgaagcgcgagtccgaccaggtgaacgtcgcgatgcggtcgccgtgctggcgcatcacgtccggatgggtcgcgatcatggaaaggagctcgcgctcggcgaccgactgcatcctctcgtccgtggagagggccgcggccggaagcgctcgtccttctcccccgccgccctgcgcggcctgctgcggtgccgcggcctgccggtcaccctgccattgggactgcgactggggctgtggctgctgcgcctccatgcgggagcgctcggcctccttgcggcgggccgccgcggccttgtcgcgaatgacctggcgcaccctgtccacgtcgaagcccagcatgtccgcgagctgcgtggcgtagccgtccatgagcatggagtccgcgagcggtgccaggacctgggccatgtcatccagcgcggcgacgcggcggccgggtacgctgaggtcgtagcccgcgaggcgcttgccgaacacgaagtccatgagcggctgggcggccgcgaggatgggcctgagggcgtccgccccgtggtcgcgcaggaactccatcgggtcctgattgttgggtaggaccacgcagagcatctcgacgccggtcttgtcgatgtagcggaccgcgcgctccgcggcgcgctggccggcctcgtcgccgtcgaacatgcagatgatgcgcttgcgtgcgaagcgctcgatcagcttgacgtggtccatcgtgagcgcggtgccgagggttgccacggcgttggtgaagcccgcctcgtgcatggcgatgacatccgtgtaaccctcgcacacgatgcaggtgcccgacgcgaccatggagtccttggcgcggtcgaacgcgaagaggtgctttcccttggagaagaccgcggtctccttggtgttgaggtactttggcttcgcgtcggtcatgaccctgccgccaaaggcgatggtgcggccctgctcgtcgtggatagggaacatcacgcggtcgtagaaccggtcgcgcaggcggccgccctggccctcgagcgcgaggtccgcggagacgagctcctgccgcgagaagccctgcgcgcgcaggtgctccgtgagcgcgccgtggccgggggcgaagcccaggccccagcgcctgcacacgtcagagccaaagccgcggccggaaaggtagcgccggcccgccgcgggtccgtccccacggccgcgcatcagctgggtgttgtagtacttctcagcctcctggaggcagtcgagcacgcgcgtcctgcgcggcccacgcctggggccggagcgctcctcggaaagctcgatcccggcgcgctcggccaggtagcggatggagtccggaaagtccaggctctcgcgcttcatgacgtaggcgaacacgtcgccgccggcgccgcagccaaagcacttccagaggcccgtggtggggttcacgtggaacgacgggctcttctcgtggtggaagggacagcatccccaccagtcggagccgcggcgcttgagctccacggtctcccccaccagctgcagcatgtccgtcgcctgtcggacgcgttccttgtcctcgtcggttatcaagagcgcacccccactccacggtcgcctaggttcttacgtacccaatcgatgttgccaagaaccacgcgctcgagctcggcggtcgaggagaacgggcgcgaggcgcgaagccaccgcacgaagaggacgctcacctcgcttccgtagaggtcgccgtcgaagcccaggaggttcgcctcgaggaaggcctcctccggcgcgctgaacgtcggcggggcgcccacgttggccgccgcgggccaagcgctggcgccgtcgcacacgacgcaggcgtacacgccgtctgcgggcatgcacgccacgcgcggcacgcgcacgttggcggtgggaaatccgaatgaagtccccttcccgcggccgtgctccaccacgccgcgcacccagtgcaggcggtccaggagcctggaggcctcccccacctttccctggtggagaagggcgcggatcctggtcgcggacacgggctggcccccggccgtcacgagctcgtgggcgtgcgcctcgaagccctgggcgcgaccgatggccgccagggccgcgacgtcgccctcgccccgcgcgccgaacctgaagttcgtgcccacgtggatggagaccggcctcacgacggagtcgagcgtgctcgcaacgaactcccggtagggagtccccgcgagcccgggcccaaagtcgagcacgaccacggcgtccacgcccagggtcgcaatcgcgcgcacgcgatccgcgacctcgagcagcctgctcgaggcgcgctcccccacgaggaggtcggccgggtccgggtcgaacgtcaccgcaacgcaggcgcagccgcgccgacgcgcgtcctcgagcgccgcggccacgagcgcgcggtgccccacgtgcacgccgtcgaacgcgcctatgcacaccacggcgtccacgtcgcttcccagccgcgtgccgtgcacgaggtacgcccggccgccgggaagcgcggcctcctcgagcggcgggcaggtatagaagagcgaccgcgccgtcacgcgcgcaaggtccgcgccggatgccggcacgtccgcgcgcgcctcacgctccgtcaaggccgcacccccatgactcccgcggggaagttgacctcgctcctcaggcgccggccctcacgcgtccagacgcccaccaggcgcccgccgtgcgtcaggcacacgcgcccgccctccgcgacggccgcgtcgccgcacgcgacgggcttgccgcaggcagcgtccgccgcctcctgcacggagagctcgcgcctgggcaacccgagcttcgcgacggggtcgagcgcggccgctgccaggacgtccggacccttggcctcgagctcgtccaggctgacgcagtcgcccaggccaacgctgccggatgccgtgcgcctaagcgccaccaggtgcgccgcgcttccgagcgacgtgcccaggtcgcgcgcgatgctgcgcacgtacgtccccttcgagaccacgaacgcgcagtcccagcacggctcgccggaggggtcgtcggccaccacgtcgaggaggaccgcctgcgcaatggtgacgtgacggctcttgagctcgaccttctcgccctttcgcgcacggtcgtacgcgcgcacgccgcccacggatatggccgagaaggacggtggcacctggtccagctcccccacgagcgaggatacgaccccggccgcgaacgtacggtcgagcacgcgctcgggcgccggcagcgtgagcacgggctcgccctcggcgtcgtccgtcgtggtctgcgtgccaaaggcgatgcgcgccacatacgacttggtgtccgcggtgagcagacccatgagcctcgtgccctggcccacgcccaccacgagcacgccggacgcgagcgggtcgagcgtaccggcatggccgacgcgcctctcgcccagcgcccgacgcacgtggttcaccacgtcgtggctgctcatgcccaccggcttgtcgacggccagcaggcagttgatcccgctctggccgcgcctcacgccctcacctggcccgtcgcgctcccgcccgagcgacgcgcgcggtccgcggcgatgagcctcgggtccagccgctcgccgatgatcgtgccgtcggggtcgacgtactcgaagagcgacctcaggggcggcagcaccgccgcgagcgcctggtcgatgtcgccctcgtacgtgaagccggccgctgccttgtggccgccgccaccgagcctgcgcgcgatgccggacacgtccttgtccgtcttggagcggaggttgccgcgcaccttgccgcccggcacctccttgaggaagagcgcgacctcggacccggacacgctcctgaccacgtccaccaggccgtcgcactcgtccaggctcgcgcccgtgcgctcgaggtcggccgtcgtggcgtagctgtaggttatctttcccgacgcgaaggtcgtgatgcgccccatgaccagcgcctcgaggtgcaggaacgagagcgagaagttctggtacacgttgagcgacagctcggacggcgaggcgccggcgtccaccaaaagcgacgcgaccgagaaggactcggggtccgcgttctggtactggaagcggcccgtgtccgtcgcgatggcgcagtacaggcagcgcgcgatgtcgggcgtgatatcgacgcccaggtgcagcgcgaactccgccacgaggacgcccgttgcggcggcctcgggcctgatcaggctctcgtccgcgtacgggtcgtcgcaggggtggtggtcgatgatggccgtccggcgggagcggagcatgacctgctccgcgtcgttcagccgcttcgccacggagaggtccacgctcacgaagaggtcgggcgcgccctcgtagtcgcgcgcgtgcacgagggcgccgctgccgggcaggtacgagtagatccgcggcacggcgtccgcgtcggcgaggaggcccacgacggtcttgtgcggccacctgctcaagatcaccttctgcagccccagggtcgagcccagggcgtcaccgtccgggctcgtgtgggcgcatatggctatggtcccactcccctcgatgagctctgctatgcgagagaagcgctcctcctgctcgggattctggcggacgtccatggctgtgctactcgaccccctcgtccttctcgtcggcgtcagactcggcggaatcgtccgccaccgggtagccgaactcgtccttctcgaccgagagcgtgggcggcacgttctcgagggcgagggcgatgcgctccgcctcgtccgccgtctcgtcgatctggaagatgagctcgggcgtcacgcgccagccgagcgcgtggcccagcaggctgcgaatgcggcccttggcgcgctccagcgcggcggagaccgcctcgtagcggtccctgtcgcagctgacgtacgccttcagcaccgacttgtcgaccgagacctccacgcccgtgagggtcacgagcgcgaggtccgggtcggacacctcgaacagaaggatgtttgcgagcttctcgcgcgcgaggttgttcgtgcggcgggaattctggttctgcttcatgttcctactccgtacgtgctacttcctcgatgcggtacgtctcgatgacgtcgcccacgtggatgtcctggaagttgtcgaggccgatgccgcactcgtagcccgccttgacggacttgacgtcgtccttgtagcggcgcagcgacgcaagcttgccctcgtacaccacgatgccgtcgcggacgagcctgcagaggtcgctgttcgtgacctcgccctcctggaccatgcagccggccgcgatgccgaccttcggcaccttgaaggtgttgcgaacctcgatggacgcggtctgcacctcctcctcggtgggcttgagcatgccgatgcgggcggcgttgatgtcctcgatcgccttgtagatgacgctgtaggtgcggatctcgacgccctcgcgctccgctgccgcacgggccttcgcatccgggcgcacgccgaagccgatgatgatggcgttcgaggcgtccgcgagcgtgacgtcggtctccgtgatggcgccgacggcggagtggatcgtgttgatgcggacctcggactggtccatcttgtcgagggagtcctgcagcgcctcgatcgagccctggacgtccgccttgatgatgaggttgagctccttcacctcggcgtcggccatggtgtcgaagaggttctcgagcgtgacgtgcttgaccttgttctgctcctcgatgcgggccttgagggcacgctcgtcggccaggctgcgcgcctcgcgctcgtcctggaagacgcggaactcgtcgccggccatcgggacgctctgcaggccgaggacctcgacgggcgtcgagggcgtggcctcctgcacgttgttgccgtgcgagtcgatcatggcgcggatcttgccgtaggccatgcccgcaacgattgcgtcgcccacgcgcagcgtgccgcggttcacgagcagcgtcgcgacggagccgcggccgcggtcgagcttggcctcgaggacgttgcccgacgcgaacgtgtcggggttcgccttgagctcgagcacgtcggcctcgagcagcacggcctcgagcaggtcgtcgatgccgatgtgcttcttggccgagatgtcgacgaacatgttctgtccgccccactcctcggggatgatgccgtactcggtcagctcctggcgaaccctctgggggtcggcgcccggcttgtcgatcttgttgacggcaacgatgatgggcacgtttgccgccttggcgtggttgatggactcgaccgtctgcggcatgacgccgtcgtcggcagccacgatcaggatgacgatgtcggtcaccttggcgccacgggcacgcatggccgtgaacgtctcgtggccgggcgtgtcgatgaacgtgatggtgcggccgttgatctgcacctgggaggcgccgatggcctgcgtgatgccgccggcctcgccctcggcgacgcccgtgtggcggatcgcgtcgagcagcgacgtcttgccgtggtcgacgtggcccatgacggtcacgacgggcggacgcggcttgaggtccttcgggtcgtcgtagaacgtgaaggagttctcctcctccttggtcatgatcttgatgtcacggccgaggtcgtccgcgacgagctcgatgaggtcgtcggacatggactcggtcaccgtgagcggcgtgccgagcaggaacagcctcttgatgatgtcgttggcgggtacgccgagaaggtcggcgagctcggagacggtggcaccctgcgggaccttcaccgtgtcgagctgcgagaggtcctggtcgtttgcgatggcctcctcgatgcgcttctcctcggccttctcggcctgctgcttcttcctgcgctccttgcgcttcttgcgcctgccggtggactcgcgggtcgcctcctcgacggcctcgcgcgcctcctcgagcacctggttgtactcctgcgcctcgcgcgccatgcggctgtagcggtcctcgttctggccgctccttcgctggttcttgcggcccttgccacggcccttgccgccgtgctcgccctcggaccccacctcgggctcgggtgcggagaccctggtgcgggaggtgcggtgcggcatcgaggactcgttcctgtcgcggcggtccctgcgctgcccgcggctctcctccttcttcttcgcctgctcctcggcctgctccttcaggacgacctcctgctgggcgatctggtcgagcaggctcgcgaacgaggggatggacttgggggcgttgtcgtggacgcggttgcgctcctcttcctccttgcggcgcttctcctcggccttgcgctgctcctcggccttcttgcgggcggcctcctcggcggcgcggcggcgctcctcctcggcgcgctcctccttgcggcgcttctccgcctcgaggcgctccttctcggccttctcgtgcttctcgcgctcgatggcggcctgtgcctcggcctcggccttcttctgggcctcgatctccgcggcgcgcgcctcgaggatcggtttcagcttcttgcggatgatggagacgtaggcatcctccagcgtggaggacggcgacttggcggggatcttcatctccgcgaggtggccgagcatctccttgctggtcattccatattccttggctagatcatgtacgcgggtctttgccataaaaccaaccttccatgatgggacgggatacgttcgtataacttcgactcacggctagatcagggagtcgggatcgtcggacacgtcggtgtcggcgtacttggcgagctgctcgtggatgccgcagtagcgcgagcccggacgggccatgttgcggcactggatgccggtcgggccggtgtactcgcagcggtgctcgccctcctcggcgggaagctcgacctccttcggcatctcgcgcatgacctcgcgggccagcgactcgttcttgatgtcgatgtgcatgcccgtgagcctcgcggcgagtcgggcgttctggccctccttgccgatggcgagcgacagctggtcgtccgggacgatgacggtggcgtagttgtcctcgtcgtccacgatcacgcggctgacgcgcgccggggacagcgcgttcgcgacgcacttggcggggtcgtcgctccacagcacgacgtcgacgcgctcgccgcgcagctcggacacgacggcgcgcacgcggctgcccttggggccgacgcaggcgcccacggggtcgagcctgtcgtccacggagctcaccgcgaccttggagcgcacgccggcctcgcgggcgatggagcggatctccacgacgccgtcgtagacctcgggaacctcgagctcgaagagcctgcggatgaggtccgggtgggtgcgggacaccacgatggacggacgctggcgctcgcccctcaccggctgctggttgctgttggggtcgcgcacgtcgatgatgatcgcgcggatctgctggtggtgcgagtagcgctcgccggcggggcgctcgttgagctcgtccgggtggcggcgctggtcaaagtacgggagctcggcctcgacgccctcgcggatcttgatgatcgcgaagtccggcgtggtctggaggacggtgcccgtgatgatgtcgccgatcctcttcgagaactcctcgtagatctgctggcgctcggagttgcgcacgatctcgttgatgaccgacttcgcgtgcgtgtatgccgtgcggctcgtgtccttgggcgtgacgtcgacctcgtcgaagtcggtgtagaggccggtctcgtcgtcccaggactcctccttcggcacgagctcgtacacgtacaccttgccggtctcgcggtcgatcgtgacgcgcgcgccgtccggcaggtgcatgacctccgcgtagctcttcgcgagcgactgctcgagctggtcgatcaggtacagctcgtcaatatgcttctcctggcacagggccatgagcgcttccatcatctcagatgccatgcttgtcctttccccatcctcttcttgattatcgcggtccgtcggaccctagtcgaacttcggctttatcttgcagctcttgatctggtcgagtgcgaaagagaactcctcgccgtcgcactcgacgaccacctttccgtccacgaggcccttgagcctgcccgtgtagtgcctgcggccctcgcggtcgaaggtgttgagcgacacgtcctcgcccgcgaagcgctcgaagtcgtgcgccttgcgcagcggcctcgacaggccggggctcgagatctcgagcgtgtacgagcccgcgaacgggtccctctcgtcgatgacctcgttcacccagccgctctgcgccgtcacctcgtcgagcgtgatggtcgggagcgtctcgtcggcgtggtcgatcctcacgcgcaccaccggcgccttggaggacccgaccacctcgacgtccacgacgtcgattccatgcgcgggtgcggccgcctcgagcgcctcgaggattcccctctcgatatccgtggatgccaaggcatctcccttcccgggcctagacccgacatacagaaaggaagcggggcgagaagatccaccccacttcctcgaacagtcacgattaagctgtgactaatctaccacaaccgcgcggtttgtgccatcgctcgcctggcgccacgaattaaccacaagcggttgtgccgcgtgcgcgctagatggccacgatgttgacgagcctcccgggcaccacgatgaccttcttgacgtccttgccctcgagctgctccgcgaccgcctcgcgcgccgcggcctcgagctcctccttggaggcgtcggccgcgacgtcgacgtgggcgcggaccttgcccttgatctggacggcgatctggatggtgtcgctcttggcctggtcggggtcgaactccggccacggctcgttgtagaccgagccctcgaggccgagcgcctcgtggaagagctcctccgcccagtgcgggcagatgggcgcgagcatggccacgatgtcgtgggcgacgtgccacgagagcgcggagtcgcgcttctcggccggaacgtcgttcacgtacttggacgcggcgttcgtgagctccatgacggccgagatcgcggtgttgaactggccgcggtcgaagtcgttggtgcacttgatgcccatctggtggagtgcgcggttgagctcggcggacttggcgtcgagtgacttggggtcgaccgtgcccttggcggcgttgtcgcagagctgccagaccacgcgccacgcgcgcttgatgaagcggttggcgcccgcgacggcctcctcgtcccagtcgaagtccttctcgggcggcgccacgaagaggatggccaggcgcatcgtgtcggcgccatagggctcgatgacgctcgagggcggcacgacgttgcccttggacttgctcatggtgtcgccgttggcgtccttgaccatgccctggcagagcaggttggtgaagggctcgtccacgtcgaccatgcccatgtcgcgcaggaccttggtccagaagcgcgagtagagcaggtgcaggatggcgtgctcgatgccgccgatgtagttgtcgaccggcatccagcggtcaacggcctccttgctgaagggggcctcgtcgttgtgggggtcgcagtagcgcaggtagtaccagctggagcacgtgaaggtgtccatggtgtccgtgatgcgctttgcgggacggccgcacttggggcaggtggtctcgtagaacggcgcgtactcggcgagggtgtcgccggcgccgaggtcgaggtcctcaggcaggcgcacgggcagctggtcctcgggcacggggacgtcgccgcagtggtcgcagtggatcatggggatggggttgccccagtagcgctggcggctgatgagccagtcgcgcaggcggtactgcacggtcggacggccgcagtcatgctccttcagccacgccgtgatggcatcgacggcctcggagtgcttgccgcccttgaggcccgtgaactcgccggactgcacgaggtagccctcggcgaccatggccttgtcccagtcgaccgagcgcacgcggatctcatgctcgtccttgagctcctcgtagagggggtcgtccttctcgcagatgatcgggatgatgtcgaggccgtacttcttggcgaagtcgaagtcgcgctggtcgccgcaggggacgcccatgacggcgccggtgccgtagtccatgaggacgtagtccgcgacccacacgggcgcggggcggccgttgatcgggttgatgacgtagcggcccgtgaacacgccgtgcttctcgcggtcggaaccctggcggtcgacggcgctgaccttctcggtcgcggcgcggagctcgcggtacgcgggctcgtactcggtgcccttgacgagctcctccgcgaggtcgctctcgggcgggagcaccatgaagctcacgccgaagagcgtgtcggcgcgcgtggtgaagacggtgaccttgcggtccgtcggggtcttgccgtccacgtccgccaggcggaagtcgatctcggcgccctcggagcggccgatccagttgcgctgctgcgccttgacgttctcgggccagccggtgagcttgtcgaggtcgtcaagcagctcctgcgcgtagtccgtgatcttgaggtaccactgcgagaggttgcgcttctcgggcacggagccgcagcgccagcagcggccgtccacgacctgctcgttggcgaggacggtcttgcacgtggggcaccagttgacggggctcgtggcacggtaggccaggcccctcttccacatctggatgaacatccactggccccacttgtagtactcggggtcgcaggtgttgaacatgcggtcgtagtcgtagctgaagcccatgcgcttcatggtcttgacggcctgtgcgatgttctggtacgtccacttggcggcctgggtgtggtgcttgatggccgcgttctccgcgggaaggccaaacgcgtcgaagcccatggggtgcagcacgtcgtagccgcgcatgcgcgcctggcgcgccatggcgtcgccgatggtgtagttgcgcgcgtggcccatgtgcaggtcgcccgaggggtacgggaacatctcgagcacgtacttcttgggcttggacgggtcggtgtccgtcttgtagaggtccgtgtcctcccagatcttctgccacttggtctctattgcctgcgcgtcgtacgcgggaatcccacgctcggcggcatcagtgttgtcagccatttggttcctctcctagccgtatgcctcaaacggcgatttagcacgccctagtatagcgaaacgtcccgatgcgcacgccggcacgttacgcgacggaaaggtgccgggcgtgcgccgggcgagaagtgcgtccttctcccccgcctatatcacgtagcaccagacgggctcgggctcgccggggcgacgcacgatcgtctcctggttgaggcggacgcgcgcgttctcgggcacggactcgcacacgaaggctgagccgctgatgaccgcgccgttgccgatgaccgtctcgccgccgaggatggacgcgttggagtacaccgtcacgtagtcgcccagcgtcgggtggcgcttcttgcccgatagcagctggcccttgcgggtcgacagcgcgccgagcgtgacgccctggtagatcttgacgtggtcgccgatctcggtcgtctcgccgatgacgacgcccgtgccgtggtcgatgaagaagtacttgccgatgtgcgcgcccgggttgatgtcgatcccggtcttgctgtgggcgtgctcggtcatgaggcgcgggatgagcggcaccttgagcccgtagagcacgtgcgcgatgcggtacacgtagatcgcgaagaagcctgggtacgcgacgagcacctcctcgaggctgcccgcggcggggtcgccgtcgtagagcgcctggatgtccgtcatgaggagctcgagcacgtgcggcaggctgtccaggaacgtctccgccacgttcgcggcacgctttccggcctcgtcgcgcgagaggtctccatcctcgaagagcagcgcctcgagcacctggccctgcagcacgcgctccacgtgcagcaggcgctcgcgcgtgaggtagtcgttgctctcgcccgcggcgctctcgttgtcgaagtagcccgggaacaggagctgtcgcacgtcgtttatcagctccacgcaggcgctcctgctcgggaagtgtctgcgcgtcccgccaaagaagtccttctccgcggcgtactctacgttcatggcggccagcctctctgccacaccgcaactcttcatgctcatcaccccaaagcccttcccgcacgggcgtcgacatacaaaaacccaccgccacactaggtgatggcggtgggtcaatgctacatcaagctcgctggcgcggctaggtgccgccttgcactacgacctgaagttggtgctcgtgtcggagtccttgaggatgacgtcgtgcgcgccgccctcgacgagcgacgtggacgagacgagcgtgatcctcgccttgtcgcgcagctcggcgagcgtgagcgcgccgcagttgcacatcgtcgagcggaccttggtgagcgactggtcgacgttgtccttcagcgggccggcgtacgggacgtaggagtcgacgccctcgacgaacgagagcttcttggagccgccgaggtcgtagcgggcccagttgcgggcacgtgcggagccctcgccccagtactccttcacgtagttgccgttgacgttgaggcgacgcgtgggggactcgtcgaagcgcgcgaagtagcggccgagcatcaggaagtcggcgcccatcgcgagcgcgagcgtcatgtggtagtcgtacacgatgccgccgtcggagcacacgggcacgtagacgcccgtctcctcgtagtactcgtcacgggcgcggcagacgtcgatcagcgcggatgcctggccgcggccgatgcccttctgctcgcgcgtgatgcagatggagccgccgccgatgccgaccttgacgaagtccgcgccggcctcggcgaggtagcggaagccgtcggcgtcgacgacgttgcccgcgccgaccttgaccgcgtcgccgtagtgctcgcggatccagtcgagcgtgagcttctgccactcggagtagccctcggaggagtcgatgcacagcacgtcagcgccggcctcgaccagcaggggcacgcgctccgcgtagtcgcgcgtgttgatgccggcgccgaccacgtagcgcttgtgctcgtcgagcagctcgtccggacgggacttgtgggagtcgtagtccttgcggaagacgagcgaggacaggttgccgtccttgtcgaccacgggcagggtgttgatcttgtggtcccagatgatgtcgttgcagaccttgagcgaggtgctcgtgtcagtggtgacgcactcggaagccggcgtcatgaactcggagaccttcttgccgcggtcgtcgcgcgagacgcggtagtcgcggctggtcacgatgccgcagaacttgccgtgcggggtgccgtcctcggtgacgggcatggtggtgtggcccgtgcggtcgcggatgtcgagcacatcctgtagggtcatgtcgggcgtcagggtcgagtcggacacgacgaagccggccttgtaggtcttgacctcgcgcaccatcgcggcctcgtcctcgggggtctgcgactggtagatgaaggagatgccaccctgctgggcaagcgcgatggccaggcgcgggccggagacggcctgcatgactgccgataccatggggatgtgcatcttgatggccggctcttctccgcgcttgaacttgacgagcggggtctcgagcgagacgtttgccggaatgttctcgtgggaggaataacccgggacgagaaggtactctgagaaggtgtgggactccccctcgaagaacgttgccatacacaatctcctttgcatcagatgccactgacggaacgaaacccaaatgcttaccgatggattttgacagattgtaacaccttgcggcacgagcggcctaactggcgccctcactcaccacctcatcaaagtccacggcgatgtcatgcttgacggggatccagtcgaccttcttgaagagcgcgatcacgttgatggggatgtaggtgagctcgaagatcgggaacgtgaagaggttgccgatcacgcgccagcggctcttggagtggatgtgcttccactccgtgatcgtggtgatgagccccatgatgaagaacatgaagtaggaggagacgagcgtcgtcacgatggagcgcacgcacgagcccagctctccctgcgtggcgatgtagcccctgctcgcggtgccgatgatgaggtacgcgatgttgacgaagacagagagcacagtgcagatcatggcgggagacatgcacatgagcatgtcgaacgacgcgaacgagcgccccttgaagatgccgcgcaggagatcccgccaataggagaagagcacctcgtacgcgccgcgcgaccacctcatgcgctgcgtccacgaagtcttgaagtccgtgggctgctcgtcgaagaactccgccggcgcgtagccgatgcggatgtcgtgcgcgctgcagaacgcggagaactgcaggtcctccgtgagcgtgtggaagagccagccgttcatgcccttgatgatggactccgagacgagccagccggagcccgagatggcgcaacttgtgccgaggagcatgcgtgcgttgttgaggtagcgagactcgcgaaggaaccagagcgagtagcccgcgctgatccagttggagtcgaagttcttggagttgcggtagctcgtgcacacgaggaagccctggtcgaacgtcttgttcatgatgctgacgtagtcgggcgggatcacgttgtccgcgtccatgatgaagaagccctcgtacctgccggggcactcgcgcatgagccgctcgaaggcgaagtcgagcacccagctcttgccgcgacgggcgaggtcgttcctctcccacacgatggcgcccgccctgcgtgcgacctcggccgtgtcgtccgtgcacgcgtccgccacgacgtagcaatcgatcaggccgtcgtagcgctgctccttgatcgactccacgaggttggcgatgaccgcctcctcgttgtgggcggcgatcacgaaggcgtaggagtggttcctcttggcgtcaggcagcttgacctcgccgcggaacagtgcccagatcgcgtagatgacctggtagaagtaggcaacggtgaagaagatgcccacgatgctgttgaagacctcgatgggcgacgtgccgagtcttgccagctccaagcgcacaccccttccggaaagatcgggacctcagtcacgtcccgggtccagcagttgggggcagatcttctcgcccgccgccgtgcgacccatggaacgctcagagagcgattctaatacatgcgctaggtcgggagggagcgtgtccgcaagctcgatggtctctccagttatgggatggtcgaacctgatgtgccacgagtgcaggaactggcggcgcagacccatgttggtgcggtcgtcgccgcggccgtagagctggtcgcccacgcaggggtggccgacgtggcgcatgtggacgcggatctggtgcgtgcggcccgtgtagaggtggcactcgagcagggagtagccgtcgtccacgcggccggcctcgaagcgctcgagcgtcgtgaacgtggtgatggcctcgcgcgccgacgggtcgtccgagaccgccatgcgcaggcggtccctgcgcgagcgcgcgatgcccgtggtgatggtgcccgagtcgggtgcgacgtagccgtggaccagcgtgacgtagcggcggtcgagcacgcgcaggcggatgaggtcctgcagggacttctggacgccgtcgtcctttgcgcacaccatgaggcccgaggtgtccatgtcgagccggtgcacgatgccggggcggtcgtcgccctggagcatgccgaggtgcccgtagccgcagtgcgccacgagcgcgttggcgagggtgtcgtccacgtggccggggctggggtggcagacgagccccgcctgcttggagagcacgatgaggtactggtcctcgaagcggatgtcgagcgggatgtttgggttgggggcgagctggccgtcctccggctcgggctcgggaagcctgacctgcacgcggtcgcccaggcagacggactcgctcttggacgtggcgggcgtcgtgttgatggtgacggcgccatcggccacgagcctcgcgcaggcgctgcgcgaggggcagccatcgaccgacgcgagaaacgcatcgagccgcatgccgtcggactcgggcccgaccagcgcgttcaggatccttgccacgaacaacccccaatgcaagggcgggccccgaggacccgcccagaatcagccttgcctacccgcgcgccttctggcgtcgcgagtcccatatgttatagcccacgagcgacgcgaccacgcccaccgtcacgaagatgtccgccacgttgaagaccgggaagtcgatgaacgtcgtggcgaggaagtcggtcacgtagccggcggcgagccggtcgatcatgttgccgacgccgccgcccgccacgcaggcgatggagacgacgagcggcatgggcaggtcctgcttccagacgagcaggaaagcgcccacgacgacgagcgccgcgatggccacgaagaccacgccggccccgcgcccgatgctgaacgcggcaccatcgtttcgcacgtagagaaggtcgagcacgcccgggatgaactcccgccgctcgcccacgctcagcacggaccgcacggcgagcttggtggtctggtcgaggaccagcaccaggcacgcgaccaccgagaaccagatggcgcggtacccgcgtgccgtcagcctgctcgtctctcccacggtctacctactcctcggtcggaaggctcgcgacgacctcgtggcacctcttgcagaggccgtcctcgcccagctcgcgccagttccagcagcgcgggcacttctcgccgttcgcggggagcgcctcgcaggagagctcgtcgccctcgtgcacgcagacctcggagcagacgaaggcctcggcgaggtcgcagccggcctccgtgagcgccttgtaggcgtcggccgggagcgtgagctcggcacgcgcggcctgcgtcgtcttctcggtgatggtgccggcagcggtcgcctcctcgtaggacttggtgaaggcgcccctggcctcggcgagcgcctggtacgcggggaggtacttctcgtacacgtcggacgcgacggggttctggtaccagtcgagcagcgccgcgtacttctggccctcgcgcatggactcgggcaggtacgccatgatctcgtccgtggtgtagaccagaatcggctgcaggtcgtggacgagcatcgagaggatgtgcgcccaggtggtctgcgcggagaggcgctcgtgcgtgcccttgccgccacagtacgtgcggtccttggtcgcgttgagatagccgttggagagctcggtcaccaggtcgtacaggttcctgtagacgacgttgaagcggtactcggagtacgccttcgtcacgacgtcgtgcacctcgcacacgtgagcgagcgtgaccttgtcgttcgcctcgaggtcgtcgaaggcgaggccatcggtcgcggggtcgaactggccctcgatctcgccgagcaggaagcgcagggtgttgcggatcttgcggtacgcgtcgccgacgtggccgaggatcgtctcgtcgcacgggacgtcgacggaggtgtcgacggacgcgagccacaggcgcaggacgtcggcgccgtccttggcgcagaccttgttggggtcgatcacgttgccgagcgacttggacatcttgcggccctggccgtcgagcgtgaagccctggctcacgatggacttgtacggcgcgacgccgtaggcgcccacggaggtcatgagcgagctcatgaaccagccgcggtgctggtcggagccctcgaggtacatgtcggcggggaactgcaggtagtcacggtgcttgcacacggccgtgtggctcacgccggagtcccaccagacgtcgaggatgtccttgttcgccttgaggtggtgcgagccgcacttggggcacacgcaggcgtcgccgaggtagctggcggggtcctccgtgaaccaggcgtcggagcccttctcgcggaagagcttgatgacggcgtcgagcgtgtcgtcgttcatgacggtctcgccgcagtcctcgcaggtgaaggccgggatgggcacgccccagttgcgctggcgagaaatgcaccagtcgggcctgttctccaccatggaggtgatgcggttgcgggagtgcgccgggtagaacttgaccttggcgagctcgtcgagggcctccttgcgcaggcccgtcttgtccatgctcacgaaccactggctcgtggcacggaagatgaccggctgcttgcagcgccagcagtgcgggtagctgtgcgtgatgtcctcgtgaaggatgagggttccgcgctcctgcagccactcgatgatcttggggttggcgtcgttcacgttcatgccggaccacgggccgcccgtgcccatgccgtcacccttgtagaagttgccgtcgtcgtcaacgggcatgaccacggggatgttgaagcgcatgccggcgttgtagtcgtccacgccgtgtccgggggcggtgtggacgatgccggtgccgtcgtcgagcgtgacgtagtccgcgtagatgaactcgccctcgacgccctggtcgccaaagatcggctgcttgtacttgttgtggaccagctcggtgccggtcatgctccacacggagccgtcagggcgcttggcgagctcccaggactcgtagccgaacttctcgcagtccttctccaccagtgcctgcgccatgagctcggcgcggccgtcaacgaggacggcgacgtagtcggcatcggggtgcaggatgaccgcgtcgtccgcgggaagggtccacggggtcgtggtccagatgtcgacccacaggttgtccttgtaggcctcgaggccctcggggaccgtggtcatctggaagcgcacgaagattgcgggagagacctcgtcgccgtactcgatctccgcctcggcgagtgccgtgtggcagtgcgtgcaccagtgcacgggcttgcggccgcggtagattgcgcccttgtcgaagatagccttgaagatctcgacgtcggtcgcgtcgtagtcatgggtgtaggtgaggtaggggttgtcccactcggcaagcacgcccaggcgcttgaagccctggcgctgcgtgtcgacctgctcgacggccatcttgttgcagagctcgcgaatcttgaccgtggggagctggttgaacttgtcggtccccagcatctcctcgaccttgtgctcgatgggctggccgtggcagtcccagccggggacgtacggcgtctggtagccgcgcatcgaccagtagcggttgatgatgtccttcgagatcttgttctgggcgtgacccaggtggatggggccgttggcatacggggggccgtcgtggagcacgaacttcttgtgaccctcgttcttcttgagcagctggccatagacgtcgttctgctcccagtccttgagccgctcgggctcgtgctgggcaaggccggccctcatggagaacttggtcttgggcaggttcatcgtcttcttgtactgatttgccacctcgtgtcctttcccttctgggcacccacgaaagaagcgcccgtccctcttgctgggacgaagcgctcctcgacacttcgcttgtgaccacccagcgagcggattctccgccaaactcggtaggcctgtctcggcggcctctccggcggcgcctacttgcaacgggcagacccgcgctttcggaccgcagctccggggtgatcttccgaaaggcacggccgcgggctcccaccgtccccgctctctgttggccgcagcgccagacgtactctccccatcaacgcagcatggccgatgatagcactatgcggccgttcacggaacgtttgccacgcgggccggatatttatttgacacgggcagcgttcgccattagccgcggcctggctcgccgggcgctacatgcgccccaggagcttggggtacacccagcgcaccatccacggctcggtcacgtggccaaggacctcgtccttctcgaaccaccgcaccgctttgttctcgtccggcttcgggcgcacgggctccgcggggtccgcctcgacgaggtacgtcacgttgaggtgcaggtgcgagctcacgtagacgccacgcttcacgtggccgttcacacacagcacctcgagcgacaccggctcgggcgacgcgagccgcgcgtgcgcgaggccgctctcctcccccacctcgcgcatcgccacacgcgcgaggtcgaagtcgccgtccgcgtggccgcccagccacgcccacgtgtcgtagatccggtggtaggccatgagcaccctcgagcggtcggggctcaccacccaggccgaggccgtcaggtgcgccacgtcgttccgtcgcgtgctgacgtcggggcagtccgccctcccgagccaggccaggatctgcgcgcggtcgtgctcctcctgctcgcagccgggcgcgaacgccttgaccgcccgcaccagccgctccctgtcgccaagccctcgcgcgagcctctcttccgcgtccatgcgtcacctccatgttcgccctcaaatccgcgtgccagtatagccaagcgcctctacgggcgagaagaacggaccctcggggccgtggggtcccgagggtccgatgtcgttccatgttccccgcgctacgcgggaagatgtctactgctgcgtgccagcctggccctgcgtgttgtacttgggggcgaagccgtcgtcgcggttgaggatgttcatgaactcctcgcccgtgatcgtctccttcttctgcaggtagtgggcgatctcgtgcagcttgaagcggttctccttcagggtctgcagcgcgatctggtgccccttctccacgagcctggtcacctcgtcgtcgatctcggtcgccgtcgcgtcggagcaggtgagctcggcgccgccacccaggtagcggttgcgcgtctcaccgagcgcgaccatgccgaacttgtcggacatgccgagctgcgtcaccatcgcgcgggcgatcttggtcgccttctcgatgtcgttcgcggcgccggacgtcatctgcccgaagatgagctcctcggcggcgcggccgccgcagagcacggcgatgcgctgctcgtactcctcgcgggtcgtgaggtagtgctcgttctcctcggtctgcatcgtgaagccgagtgcgcccgaggtgcgcggcacgatcgtgatcttgctgaccggcatcttgccgtcctgcaccgcggccacgatggcgtggcccgtctcgtggtaggccacgacctccctctcgtgctcggacaggacggtggacttcttcttctcgcctgcgatgaccacgtcgacggactcggtgatgtcctcctgggacacgcggttgcggcccatgcggacggcgcggagtgccgcctcgttgatgatgttggcgaggtcggcgccggaggcaccgggggtcgtgcgggcgacgaagccaaagtcgatgcccggctccatcttcacgtcgttcgcgtgcagcttgaggattgcctcgcggccggcgaggtcgggcagctccacggggatgcggcggtcgaagcggccggggcgcaggagcgccgggtcgagcacgtcgggctggttcgtcgcggcgagcacgacgatgcccttgtggttgtcgaagccgtccatctcggtcaggagctggttgagcgtctgctcgcgctcgtcgttggagttgatcgacatgccacgcttcttgccgatggtatcgatctcgtcgatgaacacgatgcagggggccttctccttggcctgcttgaagaggtcacgcaccttggcggcaccgcggcccacgaacatctcgacgaactcggagccggagatctggaagaacggcacgtccgcctcgccggcgacggccttggcgaggagcgtcttgcccgtgcccggagggccgacgagcagtgcgccgcgcgggcagcgggcgccgatggccgcgtacttctcggggtgcgagaggaagttgacgatctcctgcagggactccttggcctcgtcctggccggcgacgtccttgaacgtgacgccggtctccttgcccttgacctccttggcgttggagcggccaagtccgccacccatgccaaagccgctgccaaagttcatggagggttcgtcgtcgcccatctgcttacggagcctcctgttgaggagccagccgccgccgaagatgatggcgatgggcaggatgtagctcagtgcgaggtagagccacatgtcgctcgtctggtccggaatctcggccgagaaggtcacgcccgccttctgcaggcgcttcacgaggtcgctgtcgttggggaactcagtggtctcgtacgtgacgctactgtcgtccgtcgtgaacttgatggtgttgtcgcccgtgttgagcttgacggtctttacgtcgccgtcgtccaccatgtcgatgaacttgctgtacgtcacctgctctacctgcgactgcgtgatgctggggtacagcacgctccgcagcccgattgcgagggcaatcgcgatgatcaggtagacgatcatcgattgtctcttcttcttgtcgtccatagcgctgggacagctccttatgtcttgcgcgccgccctccgaacgggctgcgcgacgcttttgttttgatacccaaagatcggtcgaacttgcaacgccatggtgccagcggaagacgtcgcacttctccacaataccaaaggaacctttaaggctcacgcagcgcggctacgcgccctcccccgccgcgccgctggcgcgcgcgaacagctcccagaacgccaccgccgacgaggccgccacgttgagcgagtccacgccccgggacatgggaatgatggccgtccggtccaccgcgtcgagcacgggccgggacaggccggtgccctccgtgccaaagaagagcgcaagccggtccgcggcggcaagcgcggggtcgtccaccctgagggcgcgctcgtcgagcgccatggccaccgtggagaagccgccctcgcggagctgggcgagaagtgcgcctggccagggccgtggcgcgacggcccacggcaccacgaagacgttgcccatggacacgcggatggagcgcctgttgagcgggtccgcgcactcgggcgcgaggatgacggagtcggcaccgagcgccgcggcgttccggaagatggcgcccaggttgctcacgtccaccaggccctcgagcacggccacccgccgcgcgccggcgagcgcctccgcaaccgagagcgcccgcggcctgcgcacggccgccatgtagccgcgcgtcacgttgaagcccgtgatctggctcatgagctcgcggctcgcgacgtagatgggcacgtccttctcgcccagggcgggaacgtgggcaaggaggttgtcgaggtgccgctcgtccacgaggacgctcaccacgtcgaggccgcgctcgacggcaagctgtatcacgaggagcgactcgcagatgacgagcgcctgctcgggatggaggttggagcggagctggcgctccgagagcctgaggtaggggtcgagcccacgttcagctaggctcgtgatgcgtgtaattgtcatttaatccgtcaccattcgcatggtccgtgtcgttttggatagaattgtaacccgtgaatcaaggcgcccgcgaggatgcgggccagagaggcagatgcgaggcatccatgttgcctgatatgaggaaaccacagcgtcagcgcattgacgtcataaacgcacagggccagaggatcaccgtgaggaagcccgaggagggcacccgcggcgcctctgccaggagcgccgcgccgcaccaggccgcgccgcaccaggctacgggcgccaaccgcacggcacagcagggcgcaagcaccgctcgtacgacccgtcaggtcgcaggagccgcacgggcgacccgccaggaggccggcgccgcgcgcacgacccgtgcggaggcaggcgccacccgcagccgggcctcccacttcgcgaacccgaccgccgagggccagaggtcaagggcccaggccgctcccgacagggccacggcggctccgggcagggcccaggccgcgcccatgggcaaggccgtccccgcctacgacccccacatggacctcgagggcatgcgcgggcgcgaagccgccggcaaggccccgcgccgccgccacggcaagggcgcggccatcgccgtgggcgtcgtgtgcgccgtgtacctggcgggatgcgccctctggtccaacgtctacatgcccaacacgacggtcaacggcaaggccgtctcgctcaagacgcccgcggcggaggcctccgacctcaacgacgccctcggcagctaccagctcgccgtcagcggcgacaacgtgagcctgagcctcaagggctccgacatcgacctcaagtacgacacctcgtcctacgcgagcgacacgatgtcgaagatcaacgtctgggcctggcccgtcacgatcttcacgggcaacaacgtgacgaccaaggtcgacatggactacgacaaggacaagctcgcctcgctcgtgagcgctgcggtcaagaccgccaactccagcgcgacgcagcccaccaacgccaccgcgagctacagcgagtcctcgggcaagttcgtcgtcaccaaggagaaggtcggcaccgccgtggacgagtccgccgtcctcaaggcggtcaagtccgcgctctcgaccggcaccaccacgctcacgctcggcgacgaccagctccagcagcccaccgtgacctcgaccagcaagaagctcgagaccgccgttgagacggccaacaagtacctggccgccacgcagacgctcacggccaacagcaagaccgtggcgaccgtggacgccaagaccatcgccaagtgggtcaaggtcggggacgacctgtccgtcacgctcgacacggacgccatcaaggaatgggcgtccggcgacctggcaaagtccctcaacaccgtcggcaccacgaggacctacaccagggccgacggcaagcaggtctcggtctccggcggcacgtacggctggagcgtcaacaccgactccctcgcctccacgctcgcctccaacatcgaggcggcaaaggcagccacgttcgacgtcccctggtcgaccaaggccgagcagtggaacccgggcggcgcggactggggcacccgctacatcgacgtcgacctctccgagcagcacgcccgcttctacgacaacggctcgatcatctgggagagcgacttcgtgtccggcgacccgacggaggaccacgccactgacaccggcgtctacaccatcaactccaacaagggcacgaaccagacgctcaagggcctggatgagaaccacgacggcgagcccgactacacgagccacgtcacgtactggatgcccttcgtgggcaacctcgtcgcgttccacgacgcctcgtggaggtcgacgttcggcggcaccatctaccagggcaacggcagccacggctgcatcaacctccccacgagcgccgcgcagaagctctacgacctcacgaaggtgggcgacgtggtcgtggtccacagctaacccctcgggcgagaaggacggccgcctcggccgcagccacaagccacatggacgcaaaaggacgcccgcgagccatcggactcgcgggcgccctcgctttggggcgcgtatgtgacgggcaccagcctccggcctcgggcggggccgccgtccttctcgcccgctggaagccagaagccgtggcagccgcctgttagaacggcatcttgccgcccatgcccatgttgcgcatcatgttcgtcatctggcggcgcgccttcttggagttgccgccgccgtttgccatggagcgcatcttgcccatcatcttgtccatctcggaccactgcttgagcagctggttgacctcctggacgctcctgccggagccgcgcgcgatgcgcttgcgcctctgcccgttgatggtcttggggcgctggcgctcctccttggtcatggagtggatcatcgcctcgatgcgggtaatttggtcgtcggacacgctggcgcccgcctgcttgagcgcacgctcgccgcccgggagcgccgccaggatcttctgcaagccgcccatcttgcggatctgctgcatctgctgcagcatgtcgtccatcgtgaagccctcgcggagcatcctggccgcggactcgatgtccttctcgtccgtgacctgctgggcctgctcgatgatgctcacgacgtcgcccatgcccaggatgcgcttggccatcctgtccgggtggaagacctcgagggagtcgggcttctcgcccatcgacacgaacttgatgggcttgccggtgacctcgcgcacggacagcgcgccgccgccgcgggcgtcgccgtcgagcttggacatgatgacgccgtcgaagtcgacgcgctgggcaaactcggacgcaacgttcacgatgtcctggccggtcatcgcgtcgaccaccatgaggacctggtcgggcttgaccgcgttcttgatgtcgacggcctcctgcatcatctcctcgtcgatctgcaggcggccggccgtgtccacgatcacgatgtcgcgcaggccgtcgacggcagccttgatggactcgctggctaccttgacggcgtccttgccgtcgccgcggtagaccggcacgccgatctccttgcccagcgtctcgagctggtcggctgcggcgggacggtgcacgtcgcacgcggccaagagcgggctgtgcccctgcttcttgaggagaaacgcgagcttcgcggccgcggtcgtcttgccggagccctgcaggcccacgagcatgatcacgttgggcgtgcggttctgcgcgagcacgagcttggactccgtgcttccgagcagctgcgtgagctggtcgagcacgatgcgcacgacgttctgcgccggggtgagggactccagcacctcggccgtcatgcacttctccttgcactgcgccacgaagttctttacgacgcggtagttcacgtccgcctcgaggagcgccatgcggatctcgcgcatcgcggagttgatgtcgtcctcggtcaggcggcccttgccgcgcagcttctcgaaggtgttctggagtctgtctgataggctgtcgaacatggttcgttactcactttctccgtcgcccacgagcgcgcgggagaactccagcgcgtcgaaggcctgcaggtcgtcgatgccctcgcccacgccgatgcggtagatggggaggttgaggtcgtgggatatggcgagcgcgatgccgcccttggccgtgccgtcgagcttcgtcacgatgatgccgtcgaggtcgagggccgagttgaactcgcgcgcctggttgaggccgttctggcccgtcgtcgcgtcgatcacgagcacgaccctcacggggatctgggcgcgcttgcgggtcacgcgcacgaccttctcgagctcgcgcatgagctcggggctcgtgtggagccttcccgccgtgtcgatcaggacgaggtcgtccgcgtccttctccgcgcggtcgagcacgtcgtagcagacgctcgccgggtcggcaccgcgctcgcgcgtgacgacctccgtgccggagcgcttgccccagacctcgagctgctcgatggcggccgccctgaacgtgtctgcgccgccgatgacgcagcgcttgccctcgcgcttggcgacgccggcgagcttgcccaccgtcgtggtcttgccggcgccgttgatgcccacgaagagcacgcaggacggcaggtcctcgaacgggtcgacctccgctgggacgaactccttggcgagccgctccgcgagcgcgcggctgagctggcgggccgtcttgaggccctcgcgcgcggcctgctcgcgcaggtcgtccgtgaccttcatggccacctcggcgcccatgtcgcccatgaccaggcggtcctcgaggtcctcccagaagtcctcgtcgacctcgccgcccatgtagaagacttccgcgatcgcctcgcgggagcgcgcgagcccgcgcttcaagctatcgaacatgcccatctaggcctcgaccacctttcccgtcgtcctgtcgaggcgctggctcacgacgtggctgacgccgtccgcctgcatggacacgccgtacagcacgtcggcctgctccatggtccgcctctggtgagagattactataagctgcgtcgtctccttcagcctctcgatcgcgtcgagcagcttggagaggttcgaatcgtcgagcgccgcctcgacctcgtcgaacacgtagaacggcacggtgcgcgtcttgtacacagcaaagagaagggcgagcgccgtgagcgacttctcgccaccgctcatgagcgtcatcttctggatcctcttgccctgcggctgcgccacgatctcgacgccggtctcgtccaggtggtccgggtccgtcatctccaggtgggccttgccgccggggaagagcatggagaatatctccgagaagttcgcgttgaccttgtcgaacaccaccaggaactggcggcgcatcttccggtcgatggccgcgttgatcttggcgagcgccttccgggcctgctcgaggtcagccacctgctcccctatgtagtccgagcgcttcttgagccgctcgtactcgtccatggcgacctcgttcacgggccccatgtccgaaagctcgcgctttatgcgcgccacggtcttctccatggcgacgcggtcctccggctcgggcagcgccagcgcgtcctcgagcacgtagcccctcgacacgatgtcgttgatggcgttctcgacctgcacctcgagcttgccgacctcgaccttcacgttgctcgccacgccgttggcgcggtcgagctcgccctgggccgctctcacggcctcgcgggcgtccgcaatcgtcttcttgagcgagtcggagtccgcctcggcgagcgaggcacggtccttcaggcgcgcggcccaggcgagggcgcgctcgtgcacggcctcgtagcgctcgtgcagcggctccacgcggagcctcagcacgtcgagcgcgcgggagctctcctcggtctgcctgcggcgcttctcgaggtccgccacctggcggctgagctcctcctcgcgcacggcgaggtggttgcgtcgctcgacgatggtcgcaagcttgagcttggcgtcggacagcttgtcctgcgtctcgttctcctcgtgcgacgcgcgctggcgctccgtcgaggcctcctcgagcttgctcgagagctcgctcgtgcgcctctcggcctcgtcagcggccgccttgtggcgctcgacctccttgcgagccttgcccgctcgttccgcggcagcggcgcggttcttggatacctgcgcctgctcggagctggcctggcgcagctgcgcctcgagtctgcccacctcggacgtcgcggacgagagctcgcccttgagccgcgcgacctcgcccttggcgctcgcgctcgcatcgcgcgcgtccgcgagctccgcctcggccgaggatatgcggcccgtcgcctcggcaagcgccgcctcgagctcgcccatgccgtcgcgcagcgccctgatgcggcgcttgcgctcgagcgagccctgctccgcgccgcccgccgtgccgacctcgaccctgccgtcgggaagcaccgtcacgccctgcggcgtcacgtacgtgagcgccggcacctcctcgtgcgccgcgagcgccgcgcggacgtcgtccaccacgcgcacgtcgcccaggagcgcccccacgagcccgcgtgcgtcctctcgcacggtgagctcctccacgatgcccctgccgggggcatcggccgggcgagaagtgccgccctccgccagcgaggcgaccgtggccctgcccttctcgcccgacttgagcgccgcctcgacgagggtcgcgacaccgtcggcatcgcgcgccacgagcgcgaggacgtcctcgcccaggagcgcctccacgatgccctcgagctcctgcggggcctcgaagaggtccgccacgcggcactcgatgtcatttgcctggcgcttggagagggccgccacgagcttgctcgcgttctcggtctgggcctcgacggcctcgagcgccctcagcgtcgccttggacgaggagagcctgccgcgggcctcgccctcgtcggagcgcgcgcgggacacggcgtccttgcggtcgcggatcttggcgacggcggcgtcctccgcctcgcgggcgcgggagagctcctcctccaggcgcttggcgtccgccctgcggccctcgagggcctccttggccgtcctgacgccgtcctcgatctgcttgaggcggctctcgaacatctggtcctccacctcggcgttcgagatctggtcgcgcgccttggcgaaggcgagcgtctccgcgtcggccgtccgctgcgacgcgcgcacgtcggccgtgagctgcgcgaccctcttgccgagggaacgcctgcgctcgcttgcctcgcgcgcggccggaccgagctccgccacgcgggactgcagctcgtcggccctcacgcgggcgtccgagtactcccccgccacgcgctcgtgctccaccgacgcctcgcgcgactggcgctccatggccgataggttcatgcgcatctcggagaggcgcgagaccatgttcttgcccttctcctccagcaggcgcatgtccgagtccatcctgccgaggaggtcctgcatccggcgacgctgctcgccgaggtcgcccacgaagatgcccttctgctcgaggagcgactggtacttctcgaggtcgcggttcttctcgtccaggcggtactgcgccagctcgatggcggcgtcggcctccttgccgcgctccgtgagcacgccgtagcggtcctggagctggcggaggtcgtccacgaggagcgtggtctcgagctcgtcgagctgcttggtgaggccgcggtggtggcgggccttgtcgacctgacgctcgaggggcctgagctgccggttgatctcgcgctcgatgtccttggcgcgcgtgaggttgtcctgcatcgccttgagcttgcgctcggagcgctccttgcggcggcggtgcttggatatgcccgcggcctcctccacgagctcgcggcgctcctccgggcggctcgcgaggatagagtcgagcttgccctggctgatgatggagtgcgtgtccttgccgaggccggagtcgtgcaggatgtccgtgatgtcgcgcaggcgcgacggcgccccgttgatgaggtactcggactcgcccgagcggtacatgcgccgcgtgatggcgatgtccgagaagtcgatgggcagcgtccggtccgtgttgtcgagcacgatggtgacctcggcgaggccaacggcctggcggccggaggagccggagaagatcacgtcctccatcgcctggccgcgcagcatcttggcgctctgctcgcccaggacccagaggatggagtccgatatgttcgacttgccgctgccgttgggcccaaccacgaccgtgaggccggggtcgaacacgagctgcgtcttgtcggcaaaggacttgaagcccttgagggtgagcgacttcagatacacgtcggacggaaacctttctgagtgtggctactctttggcctgctggtagcccaggcgctcgagcgcgtcgagcgcggcggcgctctccgactccttcttggaggtgccggagcccctgcccacgcgcctgccgtccacgaggacgaccgaggtgaacgtgggcttgtgcgcgggaccctcctcgtcctcgagcttgtactcgggcgcgcagcgcatgtcgcgctgcgtcacctcctgcaggcgcgacttgggcgagaggggcctctcggcgagcttgggggacatgtacggggtgagggtctccttcacgaactcgtgcgtgacctcgaagccggcgtcgaggtagagcgcgcccacgatggactcgtacacgttctcgagcgcggagtgcatgccgcgcgcgccggtgcccttctcggactcgccgaagacgatgaggtcgccgatgccgagcttgcccgcgacctccgagagcgtcttgccgctcacgagcgagatcttcatgcgcgtgaggccgccctcgtccatggcggggaactgctcgaagaggtccgtcgccaccatggcgcccaggatggagtcgcccaggaactcgagccgctcgtacgatgccgagacgggcttgccctcgacggcggacggatgggtgatggcagacgtgatgagcgtcttgtccttgaactcgtggccgcaaatcttctcgactgccgccaccctctgatgaatcttcaaatccctgtatccccttagaggctctacgagagctggccctggacgaggtcgaccgtctggccgatggtgttgatcgacgacatgtcggcgccgtcgagcgcgtcctcgagcttgatgccgaactcctcctccagcgcgaccatgatctcgagctggtcgaaggagtccgcgccgaggtccttgagcgtggtggactcctcgagcgttacgtcatccgcgagtcccagcgcgtcgcgtacgcagtcctctaccttctgggcgatctcagagcgttccatgtgggctccttctgattttgatggtgccatacacgacgattgtaccctgctagcgctcctcggcaatcgtgtgggcgattttgtccacaagctcgccgcgcacggccgcggccgtggccagggtgccgtgcttgacggcgtcgacggacgtggccccgtggccgatgaacaccggcgccttcacgccgaggagcgcggcgccgccgtacgcgtcgcccgagaggtccgccgcgatcgacttgagcgccggcttgaggagccccgcgccgatgagcgcgcgcttggactccttcgtcgcgttcatgacgcgcttcatcatgaactttgccgtgccctcgatggacttgagcgcgacgttgccagcgaagccgtccgtcacgatcacgtcgaagaggcccatgaggatgtccgtgccctcgcagttgcccacgaaccacgtgtcgccgccggcggccgcaagcgcctcgtgctccgcaatgacggcctcggagcccttggtgtcctccgacccgttggaaaggagcgcgaccttggggtcctcgacgccgagggcgaccttggagtaggcgcggcccatgtgcgcgaactgcacgaccatctcgggacggacgtcggcgtttgcgcccatgtccaggtagacggtgttcttgccagagagccccggcacggcgcaggcaatggccgggcgcttgatgcccctgatcctgcccacgccgaacgtcgccgcggcgaagatcgccccggtggatccggcggagaagaacccatccgcctcgcccgagcgcacggcgccaaggccgcgcacgatgctcgagtccttcttctcgcggatggcctcggtggggtgctcccccatgccgatggtctgggtggtcacgagcgccgtggcgcggtcatgcttggcgcagaacggctcgacgacgtccccgtcgcccgccatgaggaccttgaggccctggtcctgcgcgagggcggccgccacgccgtcgaggacaacctgcggctccctgtcgccacccatggcatcaacgcagatggtacacatgtcttcctcctcaagctcgcgccgcggcgcatccatacgaaaggagaccgaccccagaagggccggcctcctaggcctcgtctctcatgacgactactcggtcacgacgacctcgcggtccttgtagtagccacagttggggcacacgtggtgcggaagcttaggtgcgccacactgcgggcagacggaacgtgccggagcggcgagcttgctgttggccgaacgacgagtgtgcgtggcgccgcggcccttcttttgcttgggtactgccatcttgaacctctcttagactcactttttgccaggccactgggacctgagcggtcttccataaaacacacgagaagagactataccacgcgcgggccatctgggcggcgcgatagcaattctccacgccaaatttcgcgaagctcacggtattgacgcaattgcggcggccgcgagccgcgaggacgggcgctactcgtccaggtgcaggtccctgagcgcgctgaacgggctcgcgtccatgcggtcgcgctcgcgctcggcctcgatctgcgcgccgtggccgcagtcgacctcgttcaggttggcgccgcagacggggcaaaggcccttgcagtcctcgcggcacagcacgacgaacggcgtctccatcaggagcgcggacgagagcgcgtccgtgaggtcgatcgtgttgtcgggacccacgagagcgaagtccacgtcatcgtcatcgtcctggtcgacgggctcctgcggtgccttgaacaggtagtactcgtccacctcgccgttcacgtcgaactcggccttgccgaggcagcggtcgcaggtgccctctacgtgcgcgcggagcatgcccgtcgccaggatgccctcgcccgcgttcgtgagcacgaggtcgtagtcgatcccctcgggcagcgtgaagtcgtgcccgccgagggagtagcccttctcgtccagatggcccgatacgggcagcgtgtccccagcctcctggaggcgggtgtcaagtatctgcgtgaccctctgcatggcggctaccagttgacgtcgttggactggccgcgggcgccggagttctcgtccagcgtctggcgcacgcgcgtgaccgaggtggtgagggacttgaggttgtcctcgaggtgcgcgaggacggtgtccgcgtactcctcggcgttgtagcgggtgtcgcgctcgtactgcgcggccttgtcgcggatgtcgtcggcctgctgctgggcgaggcgcacgacctcctggtcgcccgcgaggatcatggcctgctgctgggcgtccgcgatgatggcgtcggcctgctgctgggcgcgctcgagcgtctcggcctcctccttcacgatgcgccgcgcgtcggcgaactcctgcgggaacttgtcgcggatctcgtcaagtatctcgtagattgcctgggagtcgacgatcttcttctggccgccgcccgtgagcggcgtcttgccctcgctcacgatctgctcgagctcgccaaccaggctctctatttcctcacccggttgcatacgggtctcctttcgacttccgtgcggcctggcagtgcgttcgcgccgcggtcgcgtcgccctatagtatcagattagcgccagctaacgtcaacacctgcacatttaacgcgtgtggtagtgctcctccaggtggcgctccacgaccttgggcacgaggaacgacacgtcggtcccgagcgacgccagctcgcgcacgatcgaggacgacacgtagccgtacttggggttcgacatgacgaagacggactcgatgtccggcgccatgttgctgttgaggtccgcctgctggagctcgtactcgaagtcggtcatggcgcgcaggcccttgaccacgccgccggcgccgacctccttgcagaacgacacgagcagccccgagaacggcctgacctccacgccgtccgtgaggccgcactcccccagcgcctcgagcagcatgtccacgcgctcgtcgagcgagaaggtcggccccgtgccgttcttccccaccgacgcggcgacccccaccgtcacgtggggaaagagcctgcgcgccctgccgatcacgtccaggtggccaaacgtgaccgggtcgaacgtccccggcacgaccacgcgctctatcctgtcaggcttcatgcgactcccccgcatccgcgttcttctcttccagctctaggatctcgaccgtcgtgatgccgtgcgacttctcgcgcagctgacgcgcgcccgcgagcgcgagccccggctcctttgacgcatgctcgtacagcacgagcgcgcgggcggccagaaggccggaggcgcacaggtcgcccacgaggcggctcacgtccgcgctcgacaccgcgtacggcgggtcgagcaccacgagcgagaagggcgcgcccctcatgcccgggcgccgtgccaggcggaacacgtcccccggcagcacgtgcgagacgccctccgcgccgagcgagcgggcgttcctgcgcacgcgcgcggcggcgccgcggtcgcggtccacgaacgtgcagctcgcggcgccgcgcgagaggagctcgaagccgatggcgcccgagcccgcgaaggcgtccagcacgctcacgcccgcgaggtcgagcccgaaggccgagagcaccatggacgccatggactccctcgtgcggtccgtggtgggccgcgtcacgtcgcgcccgtccggcgcctcgaggggatgccccctccatctgccaccgactatcctcatgcgcggagcacctcctcgaagtacgcgccaaagcggtcccttacctccatcgcgagcggtcgcagctcgtcggacgagagcgtggcgtcctttgccacgatgcgctccgcgtcctcgtgcgcccaggccacgaggtccccgtcctcggccaggtccacgagcctgagcgatacgccgccgtgctgccgcaggcccagcacctcgccctcgtggcgaagccgcaggtcgagctccgcgagctcgaagccgtcggacgtcttctcgagcgcctgcagcctctggcgcgccgtcgtgttcttcttggcggcgcactccaggaagacctcgccaggccagtcgccgcggcccacgcggccgcgcagctggtgcagggtcgcgaggccaaagcggtccgcgtcgtacacgagcatgaccgtggcgttggggacgtccacgccgacctcgatcaccgtcgtgctcacgaggacgtccaggtcgcccgcgcggaacgactccatcgcctcgtccttctcgtccgcggacatcctgcccgtgagcagcccgatacggagacccttgagcgccccgcgcgcgagctcgcgctgcgtctggacggcggagtggatcctggacgccgtggagcgcgacgcctccgggacgtcgtcgagctccgagccgtcgtccttctcgtccaccagggggcacaccacgtaggcctggtggcccgcctcgcacgcctcgcggatggcgccgtacgcgaggtccgcgctctccggcgggatgcacgtggtcttgacgccggcgcccgcacgcggccgcttggtgatgcgcgagcactgcatgtcgccgtagatcgacagcgcaagcgtcctggggatgggcgtcgccgtcatggccagcaggtcggcgcccgcgcccttctcgcgcagggccgcgcgctggcccacgccaaagcggtgctgctcgtcgatcaccacgagcgagagtcggcggaacgcgacgtcgtccgagaggagcgccgtcgtgccgaaggcgacgcagacgtcccccgcggcgatggccgtcgcggcctcctgtctggccttggcgtccgtcgcgcccgtgaccaggcgccacgtgatgcccgcctcgtccaggagcgggccgagcttctgcgcgtactggcgcgcgaggaccgacgtgggcgccatgaccgctgcctggcttcccgtgtccgccaccgccgcgagcgccacggcggcgacggccgtcttgcccgtgccgacgtcgcccaggagcaggcggttcatcacgtggccggagcccatgtccgtcaggatctggtcggccgcggcgcgctgctcgtccgtgagctcgaagggcatggcggccagcagcgcccgcatgcgcgggccgtccgtcgcgtgcgccacgggcgtgacgtcgccaagctccacctgctggcgcgtgcggagcgcgagctgcaggcagagcagctcgtcgaaggcgagtctgcgccgcgcgaggtccttttgcgccatgctcgagggaaagtgcacctcgcgaatggcgcgcgcgagcgtcatgagcccgtgcctggcgacgatccccgcggggagaaaatcggccacgtcacctgcgtccgccacggccgcggagacgatcctcctcatccacgctgcggatatgccctcgcccacgggatgcacgggcaggatgcgcgcgatgtccgccgcctcgcccccgctgccgagcacctcgaagaacggggccttcatctgcttgaagccgtagccgaacgtgaccttgccggaaagcgccacctggtcgccctgcttgagctggtccgcgatccacggctggcggaagaacgtcgcctcgatcacgcccgtctggtccagcaggtagacctccacgatctgcatgtggggccgcgggcgcttgagcgccaccttgtccaccgtcgccacgatggtcgccacctggcccacgtcggcgtgggcgatgtccgtcacgttcgtgaagtcgaggtagcggctcggcacgtgcaggaacaggtcgcgcacgcgcacgatgcccagacgctccaacgcagtgcgtctcgcacccgaaacgtacctcaggtgcgagacgtcatccgtgagcgagcaggtcctcgagagcctctcgcccacctctgcggttgtcgggacgctgcccaccacctatgccagctcttctctactcgatggagaacacgaccggatagagcggctgctcgccacggtgggagtcgacctcgaggtcgggctgggccttctcgacctcgtccagcaggtgctggaacgcctcgtcggaaaggtcggagcccgcgaggatcgtgagggtgtcgccctcctcctcgtcctgcatcttgttgatgagctcgacggtgaccttctcgacgtcgttgcccacgaccacgatcgcgccgccctcgatgcccatgacgtcgccgctgtggatgggcgtgccgtcggccgcgctggagtcgcgcacggccgtcgtgacctcgccgtcgcgcacctcgccgatggcctcggtcatgtccgccacgttgtcctcgaggctgccgtccgggtcggccacgaacatggcggcaaacgcctgcagcacgctcttggtcgggacgaccgccgccttgatgccctcgacggcggagacggccgcctcggaggccatgcggatgtttccgttgttggggagcacgatcacgttcttggcgttgcactcctcgatggcgcccaggatgtctgccgtggacgggttcatggtctgcccgccggagacgatcacgtcgacgccgagcgacttcaggatgtccgcctggccgctgccggccgcaacggccacgaagccgaggttcttctgcggctccttgggcttgggcttctccgcctgcttgtcctcgcggatggactcggtgcgctcctgcgcctcgaggtccatgttgtgcacgaagacgttgtagatctggccgcggtgcagcatgtggcgcaggacgcggtccgggcggttggtgtgaacgtggatcttgtagtcggggttagagcccacgagcagctcgcagtcgcccatggacgcaaggtacttgaggttggcgtcctcgtcgaagtcggggctgtccgcgtggaacaggaactcggtgcagtagcgatacttcgagccctcccagtcgtcgttgatctcgatgtcgacgacgtttgcgacctgcttcttggcgtcggtggagtcgacggtggtcttgaagtcggagacctcgccggccttgccctcgaaggcgttcacgaacgcctcgatgaacgttgccaggccgtatgcgccggagtcgaccacgccgttctccttgagcacggggagaagatcgggcgtgcgggccacggactcatacgcctcgaccacgatggcgtccagggtctcctgcggggtcgccttggccttctccatctggtcggccctggcggagacgtccttcagcaccgtgaggatggtgccctcgacgggcttgcggaccgccttgaacgcgaccttcacgccgttcctgagtgcggcggcgatgtcagcggtcgtggcgtcggggccctttgccgcagcgaggccctccgcgacgccacgcaggatctggctcgtgatgacgccggagttgccgcgggcgcccatgagggagccgtgcgtgatcgccttcgcgatgtcggacatggaggcatcgctcgggagcgactcgatctcgcccacgacggtgccgagggtgagggacatgttcgtgccagtgtccccgtcgggaaccgggaagacgttgagcttgttgatctcgtccgccttgtcggcgacgaccttcgccgcgatggggaagcaggttcggacagcgttggcaatcatattctggataacctcgaattcctgttgggtgccatggcgcgggcgctaggcgcgcgtgcgcattccctcgatgtgtacgcgtacctcgacgtcgtcgagctcggcgatcttcctcagaatgaacttgacggagctcacgaggttgtccgagacagagctcatgttgatgccctgctcgacgatgacgtgcaggtcgatgatgaccttgccaccctcgctagagacgtcgattcccttgcgcagccggtacgtgggcagcagacgggccacgccctcctgctggtccgtcacggccatgcccacgacgccgtagcactcgagcgccgcgtagccggcaaggtccgcgatgcagtcgttcgacaccttgagggttccaggaacgacgtttgccatgtaagtctcctctcgaccacggcccaggctcggctgggcatgattccaaaacataatagcgcagggcggcgtttttcgaaccgcgcgaatcccggcacgtgcgcgtttggtgggacattcgcgccaaacgggagaatgtccaacaccgcgggggcacaatgcctatggtcttcgctacaaaaccaccacaagagggcgtggtctcgacttgcatgtggcgtgcgctgtgctatatttacacggcacttgagagattactggcgctaagcgccgctcgttggaggtcgtaataatgtcgaaggtatgtgatatctgcggtaagcacgctgttgctggtcgctctgttagccactcccaccgcaccgtcatccgcaagttcaagcccaacatccagcgcgtcaccgtcttcgaggatggcaagcccgtcaagaagaacgtctgcacccgctgcctcaagaagggcaacgtcgctcgttccgcctatcaggcgtagcatctggcgagaagcgcttaccaagcaaatccgaggaggtccagcaaggggcctcttttttgtgtcgcggccttgttgcacgagcatatatatgtgagccgggggcggaacgcctcgtccctctcccccggcatctgatttgcaaacgcggcgcggtggccccttgtggctacctcttgaggaggaagcaggcgagcctgcccgcgtggcacgtgacgctggcgccgggcgcggcgacgacgttcgagacgccctcgtcgcccaggaggggcagcgctcggtggtccagctcccacttgagcccgcgctcggacgcgacggtcccctccgccaccgcgatggccgagaagcgcctgcccacgtcctccccgcccagcctccaggtggcaaggcccttcgggctgagcacgcggcagctaaagccgtcctccgccagcagcggcgaggcgtccgccgcggccgccagctggccgatgaccgcgagcgcgtggtcgggcctgccgccggaggcgctcgtgaccgtgagctgaaggcgggcgcccctgcgggcggcctcgtgcctggcacagtctatggccagggccaggtcggtcgcgtacttctccaccgggaacgcgatgtcgcggcccacgacggagcgggcccacgcgacggcgtcgctcgtggcggagtccgcgtcgccgcagaagacgtcgggccgcgcgcccgcgcgcttgagggcgtccgcgccggcatccgcggcgatcacgtagtccgcgcgcgacgcgagattggccacgagctcgggagagctcgcctccggggaacccgccaccacgagcgcgcgcagggtcgtgccgggatgcgcggagtccgggacaccggacgcgaccggcaccgcgtagtcgtccaggcgcgcgaccgagagctccgggtagccgtgcacgaggatgtcgcaggcggcggcgcactcgtccaggtcgcggtcgccatgcgggctgaagaggcagaccgtgtggaggccggccttgcgcgcgctcgtggtgccaaacggcgcgtcctcaaacacccaggtgtcctcggggcggctccccagcacgtcgagcgccgcgtaccacacgtcggggtacttcttgctgcggatcttgccgccggtcgagatcacgtccctgaagtaaccgcggatgccctgcgcgtcgagcgccacctcgagctcggggcgcgtggtggacgacgccacgaccatggggatgcccgcctcgcgcaggctgtcgagaaacgcgcggcatccgggcagcatcctcacgtcgtgcgcgtaggcgcggcggacgcgggccttgagctcgtccacgagctcctgcgatgaggcgccggggatgtagcgctcgtggaagtacgcgcacatctcgttgagcggcagatgctcgctctccacgaagacggcctccgggtccgtcacgccatgccgctgcagcaggccgacggtctcgtcgtgccacatgggcatcgagtccaccagcgtgccgtcacagtcgaagatcgccgccttgaacgccatgttcttctccccgttttatggtataaagcagattccgtgtcacctgacatcgtagcgcagaacttagtgctagattcattcgacgttgggtacataacgccgtgtaaaacgcgagcgagaaatcttgcacatggctttaccggagggttgaaatggctgtatacgattacaagtgcacggagtgcggcaaccagtttgaggtcgagcaccccatgaacgagcatcccgacgtgagctgccccaagtgcgggtccgaggcaaagcgggtctttgttccctccggcatcgtgttccagggctccgggttctacaacaccgaccagaagaattccaagtagtagcccaggcttgcggacgccttccaaggatgtctgaccaggtcagcaagagaataggcgagacaaggggagttccgagcaatcgggactcccctcctttatgcaacgcgaatcgccttgcgctaccttacgcgacgcatgagcgccatgaagtggccgtcgcagtcgaggccgagcgcggaggcgccctccgtgcgcaggaagccccccgcgtccgtcatgcccctcaggacggcgcgggcgccatccgggagagacgccacgcagggcgcctgggtgacgggcactggcgcgaagccgcgtcccgcatcgctggcgagaaacgcgtggacgacgtcctcgtcctccgcccgcaggtcggagcacgtggagtacgcaagcgtgccgcccggggcgacgcgcgtggacgcggccgcgagcatcctgagctggagcgacggcagggcggcctcgggcccctgcacggacgcgcactcgagcgacccaggcgacctcagggtggcggcgcatcgtgcccgtgcccgagcagggggcgtccacgaacacgtgggggaagctgcggcggaggggctccggcacgtccggcgagcccaggagcgtgccgtcgagcacgacggtctgggcgcggttggccagaccgcccccttgggtgcgctcgcgggcgagcttggctttgaactcgaccgagtcgaccgaggtcaggatcacgtggccgccgagcgcggcgttggcgcccgccatgaggagcgtcttggtggcgcggccctgccccacctcgagcatggaatcgacgtccgctgcaggcgccgccagccacgagacgacctgcgccgccgggtccgccggcagcacccgcgccgactccacgagcccggatgcggcgaggcccgcctgcctgccgagcgcgaggcagccgggccacgggagcggcgtgggctcgagcccggcctcttgcaggagggctcgggcatcgtctgccgtggctaggttgaggttggccgcaaccgtgggcacgggcggctccatggccgcgagcgcgaggccgcgggcaccggtctcgagcgactccacgagggcgcgggccagccactgcgggagggccgccacgagggcgacgtcctcggccgagggggccgcgttcttctcgccctggtcgcgaaggcgggcacgggcggcgtccatgcggggcaggtcctccgccgcgatgcgcctgagcactgcgtttgcgaggccgcgggcgcgcctggaggccagacccgcgagctccacgccctggctcacggccgcgcgcgtgggcgtctgcaggtagagcacctcgaacgtggagatgcgcagcgcgtcgcgcaggcgcggctccaggtggccgcgcgtgaggtgcgactcgatcgtggcgtccagcaggccgcgggcgcgctgcgtcccgagcacgaggcgcgtcgcgagcgcgcggtcgcgcggggcgaggccgtccatggcggccgaggtgcgcatgaggtcgcgcgcgcgggcgtggcgctggcggcactcgcccgcgagctcgagggcgacgcgccgtgcgggagagagcctcgccatgctagacgtgctcccagcccaggctcttctggtggaggcccgccgcccaggcggttgcgtccatctcgcgcttgccgtcgggcttgacgcgctggagcctgaccgcgccgtccgcgcagcccaggagcacctcgtgcttgcccaccgcgagctcaccggggcggacggtggcgtcgggtgccgccatgcaggcgcacgtgacgcggacgcccctgcctgcgacctgcatgcgcgcgggcgcggcgtcggtcgaggcctggatgcggcggcggttggcgagcgcgggcgccgcggggtcgagcagcatctcggccttgtcgatcttgtgggcgtacgtgacgagcgcctcgtcctgctcgtgccagacggccgtgccgtcctccatctggccgagggcggccacaagctccctcgcgcccagctcggcaagctcccgcatgacctgggagcagctcttctcgcccacctcgaccgaggcctggcggcagtaggcgcccgcgtcgagctcgtgcacgacgcgcatgatcgacacgccggcgcgctcgtcgccggtgaggaccgcccgctggatgggggcggcgccgcgccagcgcggcagcgtcgaggcgtggacgttgacacagcccaggggcgccacggtcagcacggcgtcgggcaggatgcagccgaaggccgccacgcagatgacgtcgggctccgccgcgcggatgcgcgcgagcacgtcgtccgatatgcggcggcactccagcacgtcgatgccgagctccgttgcccgcgccttgacgggcgagggctcgagccgcctgccgcggccgcgcacggcgtccggcctggtcagcaccaggcgcacgtcgtgggcctccgtgagggccgatagcgagggcaccgcgaagtcgggggtgcccatgaatacgatgcgcatgttcttctcctcccctttgtgcgacagcgcccggacgcgccgggcagcccttacgggcgagaagcgctactccgccgaggtgtcgcccggacgggcgcccgcggccagggcctcgtcgtactcgcgcagcgcggcgatgcgcttgcccggcgtgaggtggtcgaccatcgtgacgccgtgcaggtggtcgatctcgtgctgcaggcagacggcgagcaggttgtcgcgcgcctcgtactgcatgaggtcgccgtcgaggttctgggcctggaccaccacgtggctcgggcgcgtcacgtccaccgtgatgcccgggaaggacaggcagccctcgctgtaggagcgctccgggccgtcagccgtcacgaccttggggttgatgaggacgtaggggttcttcttgctgccctcgcccgcgtagtccacatcaatcacgacgagctgcacgagctcgcccacctgcggcgcggccaggccgcagccgtccgccgcgtacatgtccttgagcatgcgcttggcgagcttgcgcacgtcggcgtcgatggtcttgatgggggcgcactccgtcttgaggcgctcgtccggggacaggacgatgtcgtcgattgcactcatgatggtctccttcttgccccgcgcggcggggcgtacgttgtcaacaaggcttagcgtaccccaaggtgaggcccgcgtttcccgtgagcgctggcctctatcgataccccacgggcgggggcgccggcgggccgcgtcacatcatgtcgtaggcgtccacgtcgatggccacgttgacgccgcgcggcacgcgcacggcacgcacgcacgcgtcgagcagcgggcccggctcggacgcgacgggcgacttgacgagcaggtgcctgcgcacgcggtccttcaccttggccttgaggcagtccgtggggccgagcacctcccagtcccccgcaccagccaggcggcgcctgagctcggccgccacggcgtcgagcacctcgcgcacggcgcgggcgtcgcgtccccagcagatcacgttggtcaggcgcgagaagggcgggtagcctccctcgcgccgctccgccagctccgcgtccacaaagatcgagcgctcgtgccgcgcgaccgcgacgacggcggggtgcgtggcccagtacgtctgcacgatgacctggccaggctcctctcccctgccggcgcggcccgccacctgctccaacaggtcgtacgtgcgctccgccgcgcggaagtccggcagcttgagcgtcgtgtccgcgttcacgacgcccacgagcgtgacctccgggaagtcgagccccttggcgatcatctgcgtgcccacgagcacggcgcactcggccgcgtcgaagcgctcgagcagccgctggtggtcgcccttgccgcgcgtggtgtccgcgtccatgcggatgacctccacgtcttccggcagcagcatgcgcagctcgtcctcaacgcgctgcgtgcccacgccaaaggccgccaggtagcggcttccgcagttggggcagcgcgtggacgggtccgggtaggcccgctgcggccagctgcgcccgcatgtgtggcacaccagggagtgcgtccgctcgtggtacgtgagcgccgtggagcagtgcgggcactcgggcacggccccgcactcgcggcacatgaggaagttggcgaagcccctgcggttgagcatgagcaccgccttctggcgcttctcggccacgtcctgcagggcctccgtcaaaggggcggagaagatcgagcggttgccgcccgcgaactgctgcgtcatgtccaccacgcgcacgctcgggagccgggccgaccccggccgctccggcatgcgcacgcgcgtccacctgacgccgccccacgagccctcgcggcagcgctcgagcgcctcgagcgagggtgtggccgagcccagcaccagcgcacagccgcgctccgcagcgagccgcgccgccacctcgcgcgcgtggtagcgcggggcggactcctgcttgtacgtccactcgtgctcctcgtcgatgatcacgaggcccacgtcgcgcagaggcgcgaacagggccgagcgtgcgcccaccacgacgtgcgcctcgccgcgacggacgaggtcccactggtcgaagcgctcgcccgcggagaggcgcgagtgcaggatggccacgtcgtccccaaagcgcgagcggaagcggcccacggtctgcgcggtgagcgagatctcgggcacgagcacgagggcgccccggccctgcgcgcgcacgcgctcgatcgcgtccaggtagacctccgtcttgccggagcccgtgacgccgtccaccaccacgacgtcgccccggcctgcctcgcacgcgtccctgatcgcgtcgagggcctccacctgaccgtccgtgagcctgtccggccgcttggcacgcgcgctggagagcgtggtcgtctcgtccgcgccgcgcacgcgccggcgcagctcaacccgcacggctccgtgccgctcgagcgcggccacggcggaagcgctccccggcatcgtggcggagagctccgccatgcgcaccgggcccgacgagagcgcctcgagcacctcgcgctggcgggtcgcgttggcccggggcgtgaagcccgcggcaccctccgcgagcgagacccagcgctcgtccacggggccgaccttctcgcccgcgaggtgccatggcgcgccctcggagtcgcgcgtcacgcgcacgctctggccgggcgcgaggaacggccgcagcgcgtcgcagagcgggcaggcgtactcccgcgccatccacgcggccacgcgcaccgccacctcgtcgaacgcgctgggcgcgagcacctcctccacgggcttgagcttgcggggatccacgccctccggctcgcgctcagaagtgcgcacgacgtatcccacggccctcctgtgcgagaagggcacgagcacggtggccccgaccatgcacgtggcctcgagcgccggaggcaccgcgtagtcgaacgcgccctcgagcgcgcgggtcggtatgtcaagaaccacgcctgcgaacaactgcctgacctccgtccggcgcggaccggggcgccggccgccccgcggccgcatgccgcagtgtcgatgttcggccacgggcgggcggtttgcaagcgcgaatcaggctgtctcgttcctcaccatgaaggcgtacgcgttctggaagaagaccttctccgtcacggactcgcccagccgctccgccatcttggcgcggaacgccccgagcttgtccacgcccttgagccagtccggcacggacgccccgtcgaagtcgctccccaggcagacgcagtcctccccgcccaggtcgaggaagtgctcgaagtgggccatgagctcgtcgaacgtgacgtccgtccccttggtgcgccttgtgaggaactccgtgcagaagctcacgcccacgacgccgccgtcgtccaccacggacttgaactggtcgtccgtcgcgttgcggtccacgtcgcacacggccttggaggcgcagtgcgagatgaggatcgggcgcctgcggcactcgagcaggtccgagaacgactcgggcgagaggtgcgcggcgtccacggcgatgcgccttgcctcgaggcggcggacggccttcctcccgaggtcggtcagcccctcggtcgtggagcggccgccgcccagcgcgttcgtgccgttccaggtgaggcccgccatcttgacgccgtccgatgccatcgtgtccaccacgtcgagcgagtccctgagggccgagcacgactccacggtcagcacggcggccaccttgccggactcgagcacgtccgggatcttgcgggcgtccgtcacctgcgtgaccttgtccgcgtgcgcggacatctgcgccttgaagtacttggccgcggcggtgtagaagcccagcgagtcgctcacccacttctcgtccggcacccagatggagaagccttggcagagcgccaggctcgcggcgcgcgcgaggtccacctcgccgtcgttggaggccaggtcgccggagcgcgcgatggcgggccaggacttgtagggctcccagtcgtgcatgcccgtcacgtcgatggtgtcgcagtgcaggtcgaaggccttggtgcggcccacgtctcccaccgcgtcgaccttgatcgccttggcgcgctctatggggtccgccgtgcgctcgcgcacccttgccgaggctgcgccgccggaggagcccgagtcgccggcgtcccccgacccggcgcacgcgcccagcgcgagcgcggagccgagcgcgagcgcgccacccacgaaggaacgcctggttatggacatggacccctcccccgtcgaagagaaacgccaaggcgattctactcgagcgggacaggggtccatgcggtggcgcgggctcaatcgaccagtggccgttcttctccgcgcgtgtctttggcttgccttacgcgagcttggcgacggcggccttcagctcgtcggcgcggtccgtgttctcccacgtgaagtcggggtccttgcggccgaagtggccgtaggcggccgtcttctggtagatggggcgacggagcctaaggtcgcggatgatggcgcccgggcgcaggtcgaagacctcggtcacggccttctcgatcacggagtcgtcgacggagccggtgccgaaggtgtcgatggagatggagacgggctgcggcacgccgatggcgtaggcgagctcgatctcgcagcggtgcgcgaggcccgcggccacgacgttcttggcgacccagcgcgcggcgtaggccgcggagcggtcgaccttggtggggtccttgccgctgaacgcgccgccgccgtgacggcccatgccgccgtaggtgtcgacgatgatcttgcggccggtgaggcccgtgtcgcccatggggccgcccacgacgaagcggccggtggggttgacgtagatggtcgccttggaccaggcgatgccaacctcgtcgaggaccggcttgatgacgtgctcgatcatgtcctcgcggatctgggagagctcgacgtcggcggcgtgctgcgtggagacgacgatcgcggtgacctcgacgggcttgtcgtcctcgtagcggacggtgacctgcgtcttgccgtcgggcctcaggtacgcgagcgagccgttcttgcggacctccgccaggcgctcggcgaggcgctgcgccaggtagatgggcatcggcatgaggacgtcggtctcgtcggaggcgtagccgaacatcatgccctggtcaccggcgccgatcttgtcgatctcgtcctggtcgttggcgcgcgcgaacgtgccgtcgacgccctgggcgatgtcgggggactggccgtggatgaggttcatgacgccgcaggtctcggcgtcgaagccgtacttggcgcgggtgtagccgatcttggcgacggtgtcgcgcacgatcttctgcacgtcgacgtaggcctcggtgcggacctcgcccatcacgacgacggtgcccgtggtggtgaaggtctcgatggcgcagcgcacgttgttgacgttggccgcgatgccgtcgctgtcgacgtagccctgctcctggagcttggcctccttggcgaagatggcgtcgacgatagcgtccgagatctggtcgcacatcttgtcgggatggccctcggtcaccgactcggaggtgaacaggtagttcttgtgtgccatgcgtactccttataatctggcccaaaggcacttgttgacgtaacacatatatgaagtctggtcgaaggattatagcccaactggacgggccgccctccgacccagattgcttcctaggcggacttgcaccgctggggcccctcgtccttctcgcccgtggaatcgccctcgtccgaggcgggcaccggggccacgccgtgcgtcatcagctccatgagcgtgtgcgagaagtcgtccctgggctcccaggcgctcccggcggacacgatcgccgtgcccacaaggccgccgcagaggtagaccgacgcgacggagacgttgacgtcctcgcgcacggagccctcgcgcttgccgcgctcgagcaggcccgcgatgatgccgacgatgcgggacagctggccgctgacggtcgagaagagctcgccgcccatgctcgacatctccaccgtgagggcgagcatgatcgtgctcttggtcctcatgcggcgggagagcgcgaccgcgaggttctgcagcgcctcctttgcggtgtccgactcggatatgaccgactcgatggcctcgacgagctcgtcgcccgacgcggagaacaccgcctccacgagctcggacttgtccgagaagtagtagtagagggcgcccttggacatgtggcagcgcgtcgagacctcgctcatctggaagtccgtgctgccgcgctcggtcatgagctcggccgcggccgtcatgatgcgctcgcgggtcgcgcggctcttgcgcgtcttggaggaggactggagccgctgcttgcggcgctccatcttgccgcccagcgcgccctgcgcgacgctcttcgcgacgcgcacgccctccgcgatctcggccgccgtcttatcgtttaccagacccatgtcgcatccctcgacatcccaaacaacgaggccactatacaacattcgggagatttttgagccgcgttcaaaaatctgggtaccatcgtctatgctctcatagtgggtggattatgctgacccatcccaaagttccaagcattgcgtaccgtcgggcgccggatgccgcgcccttctcgcccttcaaggagacgacccgtgagaaacgcattccgcatattctggcgcgacgtcaagaggatctgccgcaaccccgtggcgctcatcatcaccctgggagtctgcatcatcccgtcgctctatgcgtggttcaacatcctcgcgaactgggacccctacaagaacacgagcgacatcggcgtcgccatcgtgaaccaggacgacggcgccacgataaccggcatgggcaatgtaaacgccggcgacatggtcgtgacgcagctcaagaggaacaagcagctcggctggcgcttcgtgggcaagtcgaaggcgctcgagggcgtgcgctcgggcaagtactacgccgccatcgtcatacccgacgacttcacgtccacactcgcgggcgttatacagggcaagacgagcaaggcgaagctcacctactacgtcaacgagaaggagaacgccgtcgcccccaaggtgaccgacacgggcgcgacgacgatagaggacaccatcaacaacaccttcgcgggcacggtcgcgggcgtcatatcgggaaagatcggcgacgccgcgaccaaggcgctcgacggcaccgctgcgggccagtcgagcgtgctcggcgacatccagacggtcaaggggtcgctcgacgacctcgactccaacctcgcggacgcctcctcgaccatcgactcggcgcgcgacaccgtcgcctcggccaagcagaccatatccgacctcggcaacgtgacgagcggcatctccaccaagctcgacaccgccacctcggacctcaagaccgcccgctccgactcgcacagcctcgcgacgcgcctcaacggcgcgctcggctccggcacgctggccctctccaacatgtcgtcgacggccaactacgacgtgggcgagctcgcgggtgacgccggctgggcgcagcagcggctcgacgacgccatcgcgcagctcgagagcgccctcacgcagacgcaggacatcaagaccaaactcgagtacagccgccagaccatcatcaacatccagggcctggacggggactcgctcacggcccagaacgaggtctccaagagcctcgagaccgagatccagtacctcgtgggcatgaccgacggcatgcagcgccggatcgacgcgctcaagtcgctctcgcaggacgtgaagacgggcgtcatggacaccaagaacctctccgccgccgtcaacaacgccatccagcagagcgcgagcgcgctctccggcatgcagtcggacctcacgaactcgacgctcccgcaggtcgacagtgccctcgacgacttctcggacgcggcgtccggcgtctcgtcgtacgtcgcgagcatgacgccggcgctcagccagctttccgcaacgctcgaccagctcgaccaggtcctcgccaaggcgaagcccgccctccagggcacgcgcgactcgctcaagcgcgccgtctccacgctcgacgggctcgagtccgacatcacggccctgcagacgaccgaggcctacaaggagctcacgagcatctccggcgtcgactccgacgcgctcaagagctacttcacggcacccgtccagctcaagaccaaggccatctaccccgtgcgcaactacggctcgggcgtcacgcccttctacaccgacctcgccctctgggttggcggcttcgtcctcgtggccatcttcaagcgcgaggtcgaccgcgagagcgtgggcgacttcaagccctgggagggctacgtgggccgcgcgctgctcttcgtgctcctgggcgaggttcaggccgtcgtatgctgcgtgggcgacctcatgctcggcatccagtgcctccaccccgtcgccttcgtcgtcgcgggcatggtcgagtcgttcgtgtacgtgaacatcatcttctcgctctcgacggccttcaagcacatcggcatggcgctgggcgtcatcctcgtcatcctgcagatcccgggctcctcgggcacgtaccccatcgagatgatgcccggcttcttccaggcgctcgagccgctcctgccgttcacctacggcaacaacgccatgcgcgaggcaatcgccggctactacggaaactacttcggcttcaacatcgccgtccttctcctcgcctacatgcccctcgcgctgctcgtgggcctgggcgccaggcgccacctcctcaacatcaacgcgctgttcgacaagcgcctgcgcgagacggacatgatggtgagcgagcgctacggcatggacgaggcccacttcaagctcacgaccatcgtcaaggcgctcaccaactcccgcgagtaccaccgcacgttcgaggcgcgcgccgcccacttcgagctcatgtaccccgtgctcgtgcgccgaggcttcatcacgctcatcgtggtgcccgtggccctgaacgtcctcatgttcgtcctgccgttcaagatggtgctcatgacgctgtggatctgctccatgatcgtcatctgcacgttcctcatcgtggtcgagtacttccactaccgcatcggccagaagacccacctgtccgacatgagcgaggacgagctctacgacctgctcggcgaccagctgaggcaggagttcttcgccttcgcccccatcgagaccatgctcatagagaagggcgagaagaacgggcgctccggcgacgacgcgggcgacgggaaccccggctccccctcgggtggagcgcaggaaccgtccggctccgacggcgccgcggacgacgcgccgacggccagcggcgttgaccagacgagccacaagatcggccagcgcatcggcaggctccgcacggagttcgacgaccgccgcaggcaggccgtccagaaggtgaaagacgtgaaggacggggtcaagtccgacgtcatgtccgagatcgcccacggcaccggcgacgccgaggccgacgacaccaagccgacgaagctcatcctcaacgtcacggcctcgctcacgggcaagaacgagaagaggcaggacgagaagaagcagggtcccgacaacggggacgccacggacgagaagggcggtgatgcgaggtgaggaagctcttctcgctcataaagcgtgacttccatcacgtgtggggcaacaccatcgcgctcgtcgtgtgcgtgggcatgatcgtcatcccctgcttctacgcgtggttcaacatctactccgcgtgggacccctatggcaacaccggcaacctcaaggtggcgctcgtcaactcggacgagggctacaagaccgaggtcatgggcgccaacatcaacatcggcgagcgcatggtgtccgagctccagggctccaagaaggtcgactacgtcatgacctccaaggagaaggcgctcgagggcgtgcgctccggctagtactacgccgccatcgtgttccccaagggcttcagcgcgaacatgatgaccgtgctctcgaagaacgtgaagcacgccaaggtcatatatgccgtgaacgagaagaagaacgcgatcggcaccatcgtgacggacaaggtctcgacggcggcgcagaacgccatcgactcgaacttcgacagcgcgctcacgcaggtgctcgcgggggtgctgaccgacctctcggacacgatgacggaccaggagacgctgaacctcgtgtcgcggctcgacggcatgctgggcgacggcgcgaccgagctgcgcaacgtcgcgacgaacgtcgacagctacaagtcgctcgtgagctccacgagcgggctgctctcgagctcgaatggcatgctctcctctgcgacggacagcggcacgggggcgggcgcgctcctgaggaagacctcctccggcgtgcgcaagctggacggcgccgtcgacggcgtgaccgactcgctcaacagcacgctgcagaagagctcggacagcttcgacaacgtgtcctccgcgatcgacgcggcctacgccacggcgggtggctcgaccacgaagctcaaggcggcactcctgaacgtgaagtccgaggtcgacacgcggcgctccaacctgcaggacctgagcaaccagctcaacggcacggacaccctggccaagagctgggagacgaagctcggccaggacggcgaccccacgacgctggagagcgtgtcgaccgtgcggctcacgatcgaggggctcaacaaccgcgtgacgacggcgctgagcgacctgaccgacctctccaacgccctgcagaagaccgcggacgacatcgaccgcgcgagctccgacgccgacagcacgaagtcgcagctccagacgctggtcacgcgcgccaagagcagcctctccggcatctccgacgagtacgagcagggcctgcgcggctcgctcggcacgctcgccaacaccatcgacggcgcggcctcggacgctgacgcgctcgcgagcaagttcgcctcgaccacgagcgacctcgacaagtccatgtcctccacgcagaagagcctctccggcgtcgaggacacgctgggcaagacctcggacaagctgcgcgccgccgctaacgacctcgactccatgcgcggctccatcaagagcgccctcgcctcgggcgacatgcagaccatccgcaaggtgctctcggccgggcccgacagcctcgcggagttcgtctcgtcgcccgtcgagaccacccgcgtggccatctacccagtcgccaacaacggttccgccatggcgccgttctacaccacgctcgccatctgggtgggcggcgtcgtgctctgcgcgctcgtgaagtgcatcccctccgaggccgccatccgcgagacgggcgccaagccgcgccacgcgtactttggcaggctcacgttcttcctggtcatcggcttcatgcagtcgtcgctcgtccttctcggcgacctgttcttcatccgcatccagtgcctgcgcccgtggctgttcctcctgtgcgggtggttcgcctcgctggtgttcatcaacatcatctactcgctcaccgcgtcgttcggcgacgtgggcaaggccatcgcggtgctcctcatggtcatccaggtggcgggctccggcggcaccttcccgcagcagatgctccccaaggcattccaggccgtgtacccgttcctgcccttcgtgcacgccgagaaggccatgcgctgcgccatagcgggcctgtacggcacggactactggctggccatgggcaggctcggactcttcctggtgccgtcgctgctgctcggcctgctgctgcgcaagcccgtcgtgcgcttgaaccattggatagaggagaagatcgagagcacgaagctgatgtaggcacaagggcgcgccccgcaacgggacgcgcccttttttgtccccatcccgcagggtatacagggccaacgtcagactatgtgactacttgatgccgaactccccgagcagggcatcgagcctctccgggtccctaatggcctggctcagctccgaggagcgcccagaatcgtcgagcttctgcgcaaggagcgagaggtcagaaaccgcctgttggcgaccctcctcgcgaccttcctgacggccttcctccaggcccttcttgcggccctcctcgcgaccttcctcaagtcccaggtctcttccctccatgcgggcacgtgcgaagtcgtcgcgatacttctgtgaccacagcatcagattcctcctccacttggggtccgcgcggcgcgtcctgaccgcctggtcgacgcggttcacgtagtcgctttcgactatatcatcgtccgcgaggtatccgagcagcgcgtcaaggctcggggtcgaatcgccccttacgcccctcgcgttgacgaagacgaactccgacccatcgcacatctggagctcgccgtcctggaggcacacgttccggaagttgtagcgcttgtagccaagcccaaaggggtcgtccgcgcagatgaagatcaccacgcggtcccgcaggtcgccgaatgacgcgccgcggtcgagaatcgcggtgtccacgagcgacccgtaatacctggcacgccgcaccaggtagggctggcggacctcgttctgcatctcgacgtcgtaggcattcccctcctcgtcccggacgaggaggtccacgatgccggcgcgggagagcgacccggccgcgagcggctcctggagctccgcgcgctccacgctggcaatcgttgttcccaggataatctcgagcagccccttgcagagctccaggtcgctgaagaccgacccgaacatgaagtcgtccgttatcgtaagctcgcgtgcgtcgcccatgccgcctccatccgtcgaacccatcggggcagccatggtagcagggcgaccttgcgggaggctctccgctgtcttgcgtgagtcttgcgcaacgcgtcacgtctcgtgtggacgctgcgggcgacaggccatcagggaggggctgggctatactagctgagtctgtacgtttttctcgaccgaaaggactccaatcgtgagctcctctgacaccaacgccgacgcccgtcccgtgcgcgtgcgctttgccccctccccaaccggcaagctgcacgtgggaggcgcccgcaccgcaatctacaactgggccttcgcgcgcgcgaaccacggcaccttcatcctgaggatcgacgacaccgaccccacccgctccaccgaggagaacacccagatcatccttcgcgccatgaagtggctggggctcgactgggacgaggggcccgaggtcggcggcgactacggtccctactggcagaccgagcgcctggacatctatcgcaaggccgcggagaagctcgttgccgacggcaaggcgtactactgcttctgcacgcccgagaagctcgccgcggacaagaaggccgcgcaggagcgccacgaccccttccagggctaccagcgcacctgccgcaacatcgacccggccgaggcgcagcgtcgcgtggacgcgggcgagccgcacaccatccgcatcaaggtgcccctggaccgcggcgacgtggtggtgcacgacgccgtccacggcgacgtgaccttcgaggccaacacgcttgacgacttcatcatcttccgctccgacggcacgcccacgtacaacttcgccaccgtggtggacgactccatgatgggcatcacccacgtcatccgcggcgacgaccacctgtccaacaccccgcgccagatcatggtgtacgaggccctgggcgcccccacgcccacgttcgcccacatctccatgatcctgggccccgacggcaagaagctcagcaagcgccacggcgccacctccgtggaggagtaccgcgacgccggctacgactccgacgccttcgtcaactacctggcgctcttgggctgggcgctcgacggtgacaccaccatcgtcccgcgcgacgtgctcgccaagagcttctcgctcgaccacgtgtccaagaacccggccacgttcgacctcaagaagctcgactggatcaacggccagtacctgcaggccatgaccgacgagcagttctcgctcacgcagctcgtgccgcagctcatggccgcaggcctcgaggccggcgcggacgccaaggccgtgtacggcgccaagccgcagtggttcgaccttctctccagcatcctcaagccgcgcaccacgctggcgccgcaggtggtcgagaagagccgcttcctctattggggcgatgacgtgcagttcgacgagaagagcgtcaacaagaacctcgccaaggacggcacgcgcgcctacctcgaggcagcgcacgacgcgctcgagaaggtcgacgccgccggctgggacgccgccgcgatcgatgccgccctcgagccgctgcccgaggcgctcggcaccaacaagcgcaagttctacggcgccgtccgcgtggccgagtgcggcaaccaggtctcgccgccgctgggcgagtcgctgcagctcctggggcgcgacgtcgcgctcgcacgcctgcagaaggccctgccgctcgcaaagtagcgcgtacccacgcctgccgaggagggcttgtaacaagcctgaaataatgagacactaccacgcgtaacgtgtgccaggccgccgacgcccgagtcggcggccttcgttttgggaggcagccgcatgatgaccacgtccgcgttcgagatcctgggccccgtcatggtggggccgtcctcctcgcacaccgccggcgcgctcaggatagcgctcgtggcccgctcgctcggcccatcgcccctcgagggcgtcacgttcacgctctacaactcgttcgcgcgcacgtaccgcggccacggcacggaccgggtgctcgtggcgggcatgctcggcctcgcgccggacgacgtccgcgtgcgcgactccttcgagctcgcgcgcaaggcggggctcgccttcgacttcgtggcgtccgcggacggcgccggcatgcaccccaacaccgtgaccatcgccatgcgtggcgcggacggcaccacgatgtccgtcacgggcgagtcgctgggcggcgggcgcgtgcgcatcagctcaatcgacggcatcgcggtcgagatcacgggcgactaccccacgatcttcgtggcgcaccaggaccgacccggcgtcctcgcggcgctcacgagcggcctttccgccggcggcgtcaacatcgcgaccatgcgtacgttccgcgagcgccgcggcggccgcgcctacaccgtcttcgaggtggacggcggcctcgaccagcggctcctcgagtacctgcgccgcgcgcccaacatcacgctcgcgaacctcgtggacgtccccggtgcctcccccgtcgcgcccgacgcccacctcgagctcggcttcgactccggggcgcagctccttgccctcgcgggcgagaagagcgtgggcatcggggagctgatgcgtcgccgcgagctcgagctcttccccaccgcggacgcggacgccgccatggcgcgcgtgctcgccgtcatgcgcgaggaggtgacggcgcccatcgaggacccgcaaccgtcgctgggaggcctcctgggcggcgaggcccgggcgctgcgcgacggcgcccccaggctcgcgggcgcgctcatgggcgacacgctcaccaccgcctgcgcctacgccatggccacgctggaacgctccgcgaccatgggcgtgatcgtggcggccccaaccgccgggtccgccggcgtggtgccgggcgccgtgctcgccgtggcagaagcactgggcgccactgacgatcaggttgcgcacgcgctctggaacgcctgcgcggtcggcgccatagtggccaggaacgcctccgtagcgggtgcggagggcggctgccaggccgaggtgggcaccgcggccgccatggcggcgtcagccgtggcagagctcatgggcgcggacccggccacctgcctctccgcggcgtcgacggccatagcgaacctgctgggcctcgtgtgcgaccctgttcgcggcctcgtggagtacccctgccaggacaggaacgtcatcggcgtggcggacgccatcagcaccgcgcagctcgcgctgtcgggcgtgctcgacccgctgccgtttgacgaggtcgtggccgccatgaagtccgtgggcgagtcactccccgcggcgctgcgcgagacggcgctcggcgggcttgcggccgcgccctcggcctgctctgcctgcaggcgcggcggctgcgacaggtagacgacacaaaaacggccattccccgcacgccgacgtcgacgcacacggggatggccgaaacttcttgcagccgtggccctgtcgctggtggctactccacgcccagggcgtcgagcagcaggctgcacgcgtcctcgatgcagccgtcgcacgagcgcagcacgggaccgcccgtcatgcccttgagctccgggcagcgcgtgctgccgttcttctccctaaaggatgacacgatggggcgcacgcgcgcgtaggtgcccgccttggtcctggggttggcggtgccgccgctcgcggtgctgctcaggatggcgatggccccggaaagcgcgccgcaggtctcgctgaagccgcccatgccggcgccgaagccctccatcatgcggaagagctggtcctcgtccaggcccgccaggtcgctgcacgcgacggagacggcctgcgcgcagttgtagccggagtggtgcagctcgagcgccctctccacgtagtcctgccgcttcttctcacgtacctcggccatgtgccctccctaatcagtttgcgtccttctgggccattttacgccgtttggaccgcgggtgcgtcggcatcgggctccgcgggctcggcagcctcgggctcggaatcgggcacctcggcgctgggagcgtcgtccttctcgcccaccgaacgcacccgtccgggaatcactctcccgaggcgccatcccccgaggagttctcccgctctagttcctgtgcgaacttggtgacttccctgtgcacacgcaggccctcgtcgacgcgcgacgcaacgatctcctggtcgtcctcggagagctctcccctgcgcgtcaggtagatgccaaggtcaatgccctcaagaacggcgttgtaggcgacaaagaacgcgttggtctcatgcttgcgtgggccctcgagagacgacatgaaagcactcgcgatgcatgaagccatggtcatcatgccctgcgacgacatgccctggcgctcgtactctctaacggggccgcccagcgccatcatggccatgaacgggataatcgccctggtcttgagtggatccaggtccttaaacgcgctcgcgtcgcacggctgcagccgctttgcggccacgaagaagcggtccgcggcctcgatgtcctcggccgtgagcttaccgcccgtgatgagctgggctgtcttgatgttgtcttccgtgaggaactctgccatatgccctccacttcccagcgacgccccaggcgtcgccgacttgcgttcacattgccacatgccaggtctatccgcccgcccgccaggggtcaggcgatccgtggagaagaacgggtgcattcggttgggaaggtacgcgggacgctggcaccaacgtgcctgcgtcgtcttggtctttggttgtgattttgcgttacgtgacagtgaggaaggttaaagcacgtatcaaatgcaacgctcccgaaaagcgcctgcgactaccccggcaagggggcggaggacctttcctccaacgacggaaagtatagcgcaacagaggttgtttgtcgagttaaagcggcatttttctgccactaagccggcgcctcggactaacgtgcagaggggctttgggccacctgggccagagttgcactgtcagtgcgatatagcaggaaacgaggcgcatgtcgcgcgtccaaaacataaaagttcaatccaaaaaacttgttcttctcgcccgcgtgggccgatgcgacagccaaacgaaaagcccccgccagccgatgggctgacggggacctcatgtgcgtggtgtcggaggcgggacttgaacccgcacgaccttttagtcagtcactagcacctcaagctagcgcgtctgccaattccgccactccgacatggcttggtgcgaggggtatgttagcacgactctgccgcgcgcgaggcgggaaatccgatttgtggacgtttccatgcagacgcgccagcgcggtgcccccgcgggaccctagaagccggcctcgtggatcttctggaccgcaaggcgcagacgctctggcggcatgaccagggccatgcgcacaaagccctcgcccgcggggccaaagctcgcgcccggcgtgacgatgacgccggacttctccatgagctcgagcacgaagtccacggagtccatgcggccgccggggatgcgcgcccacacgaacatggagccgtgcgcgttggggcgctcccagccgatggactcgagcgcgtcgcacagggcgtcgcggcgctcctggtaggccatgcgctggcgctccacgccgtcgagcgggcccgtgagcgcggcgatggctacgtcctgctcggggaagaacatgccgtagtccagctggccgtggagcttcttggcggccctcacgatgtcgggcctgcccaccaggaagctgagcctgacgcccgtgacgtcaaaggacttggagagcgagaggaactccacgcccacgtcctgcgcgccctcgtacgcgaggaaggagccgcccggctcctcggtgtcaaacacgatgtcggagtaggcgttgtcgtggatgatcacgatgtcgtgcgccttggcgaactcgatgatctgacggtagacctcgggcgtgccgaccgagcccaccgggttggcgggaagcgagaccaccatgtagcgcgctgcgtccgccacgtcgtccgggatgcccgccacgtagggcaggaagtcgtgctccgcctcgagcgggtagaacgcgagcttggcgcccgcaagcaggctcgccgtgcggaagagcgggtaacaggggtcgggcaccagcacggtgtcgccggggtccacaagggcctggcacacaaagcccatgccctcctgcgtgccgtggcagctcatcaccatgtcgggcgtgatgttgtccacgccgtagcggcggcggtagtagtcgcacacggcgcggtcgagctcgtcgcggtcgtgcagggagtacttccagttctccgggtcgctcgcgctcttgaccatggcgtcgatcaggcgctggtcgggcgcgaagtccggcgtgccgacggagaggtcgaacacctcgcgtccctttgcctcgagctcgcgcctgcgcacgttgagcgccgcgaacacctcgtctccaaacaggtctaggcgcttcgagaacctcatgctgcctcccacctttcgccccagcggagcatgccttgcgtacgttgaacggcgtcgcacggcgccaggcccgcgtccagcgggcgtgcaggcacctgaattgcgacagcttttcattttatacgcttgggcgtcacgcatccgttaacagcgtgtgacacagccacacgccacacagacgggcgagaaggacgcgcgccacgcggccggcgcccgcgcgggggccggcccctacgcgccgccgcagcccctgcagctggggcacgccgcgagcccgcccagggccgtctcgcgcagctccgcgggaagcgccgcgcccacgcgccgcatcgcctccaccacctcgtcaaacggcgcgctgggccgcacgcccgcaagcgccatccgcgcgcaggcgagggcgttctccgcggcggtggcgtttctcttctggcaggggtcctccacgaggccgcccacggggtcgcacaccaggcccaggaggttgcccatggcgagcgccgccgcgtccaggcactcgtgagcactgccgcccaggaggcgcgtcgcggcggtcgcggccatgccgctcgccgtgcccacctccgcctggcagccgccctcggcgccggccacggtcgcgttcctgctcaccacaaagcccacggcggccgcgcaggccagggcgtcgcgcagctcggcgggcctgaagccgcacgcctcgtccagcgccaggatgacgccgggcaccacgccggcggagccagccgtgggcgccgcgacgatgcggcccatggacgcgttggtctcgatcacggccatggcgagcgtcgccgcgcgggcgtccaggccaccggcgtacgcgccgccgcgctccgccagccgcgacagcgcgcgggactcgcccccgatgagcccgcccatcgtggtcgcgcccttctccaacggctcgtaggccgaggcccgcatgacgtccagcacgcggtcgaggtacttctccaccgcggcgcgcgggcgcccgtgcatggcgtcgcagatctcctcgcggcgcatgaacgcctggccaaggcccatgtcgttcgcctccgcatatgagaggagcgcggcgccgtcctcgaagtccacggcgggaagcaggcgctcggcctcgtccgcgcccatggccggcgtgccgagcctctccacgccggggacgccgctctcgtcgcgcgccggcacaaagcgcatgcggctgatgtccgggcttgcgagtatctgcctgcggacgtcctccggcacggggccgtccacctcgagcacgttgaacgcctcgccgccgcgccgcgagcggtacatccacacggagccgatgttgacgccgctttcgcccagcgtgctcgcgatgtggcccagcacgcccggcacgtcctgctcgtacaggatgagggcgttgtactcccccgttatctgcacggacagcccgtcgatcatggtcagtcgcgccgcgccgccgcccagcgactcgccgcgggccgtgagcacgacgccgtccgcgtcgcgcacccacacgtcgacggtgttggggtgcgacaccttggtcgccttgtccgggatgatgctgaacgtgagcgagcgctgccgcgcgaggtccagcgagtcgcgtacgcgcaggtcgtccgtgtggaggcccagcatgcccgccacgagcgcgcggtccgtgccgtgcccgcggtacgtgcgcgcaaacgagccgtacagcgtgaagcgcacctccgcgggctccacgtcgagcagctggcgcaccatctgcgcgatcctgagcgcacccgccgtgtgcgacgacgacggcccgaccatgatgggaccaagcacgtccctcaacccgaagcttctcatgatgcctccgatccccggcccttttggccagcataggtggcaaatgtttcaggttcgtgaggtgactgatgcgcctttgcgtcacgcccgcaccaggtcagtaccgttttttacagacgagaagggcgcgggccacgccgtcgcgacccgcgcccagaggcacgtcagacttgtctgcgacccggaatcccgcacgcacggcgggcccgggatgccgggaggctagtcctcgcggcgacggtcgccaccgcggtatccgccacggtcgccacggtcgtccctgttgccgcggaagccgccgcgaccgccgcggtccccaccgcggaagccgtcgcgcccgccacggtagccgtcacggctgccaccgcgatacccgccgcggtcgtccctgttgccgccacggtagcccccgcggtccccgccgcggaatccgccacgaccgccacggtcgccgccgcggaagccgttgccctcgcgcgggccgcggtcgccctgcctggagtcgcgcttcttggcggccttgcgggcttcctcgcgctccttccagtcggcgccgatctcggcctcgagggagccctccatgcgctcgaggaactccatgagggcgtccgcctcgtcgtcggagaagccgtcaagcgccacgtcgcagagttcggcctgggagggcttgtcctcgcggccctcgtccgtgagcgtgacggtcttggggccggactcgggggcgtcgacctcgacgaggccgccctcggtcatcgcgtcgagcgtcgcgcccagggctgcgccgtcgacgcccaggatcgtggacatctcctgcgtggtgacgccgtccttcatgcgcagcagcgcgaggacgcgacccacgttggggtcggtcgccgcctcctgctcgcgcctgttgtgacgtgcgatacccaccatgtggttgacgacgttcatcttgtcgaggatctcggacttggttgccatgtacttctcccatgcgtttgtctttggcactcgccgtgccgctgtctgctacttgctgctatttggtacgtgctgcttgttgcctgccgcttttcgcggattgctactgcttcttgttcgcgggaccatccttgggcgtggccacgccctccttggttcctgtgctgccggcctgcggcttgggcgccttcttgatgggcacgcggatgccgccgcgcacgaccgtggggccgctcggacgctttgcccccttggagccggttccgctggcggctggctttgccgagccaggcaccttgctcctgagctgcgtgccgctgagcgtcgcgacggtgggcacgcgcttgcccttggacctgccggacaggcgtgccttgaagctctgaacgcgcgtgtagatgctggggccgccgttggagcgcaggcccaggagcgccgccgccaggaacgtgggtccaaagaacgtgacgatacgccagatgaggaagcccgcgctcgtggacgagccgaacatgtggctgtagaacatgatgaagccgccctcggctccgcccgtgccacccggcagcggcaccgccgaggccaccatctgcaccatggagcccgccgcgaggcactcgaggaagtccgccttgatcccaaaggccctcagcacgaaccacgggatcatgtagaggcacccgagctggcacatggtgacgaggagcgtgagcgccatggacccgaggtcgctcgcggcgttcttgaacgcggtcgcgaactccatcacctgcacgttgacaaggtcgtcaaagtgcttggggtccttgagccagccgtgcttggtggcgaagcggatggcccagttgcccacgcgcatgacgaactttgggcagaggcagatcacgaagatgcccgcgagctcgagcgcatgcaccgagaacaccacgatgttcaggaagaacaggtcgccgtacgtggtgaagaagtactccgccttcgccacgagcatgatggccgcaaagaacaccacgccaaactggtacgcgatgaagcgcgtgaactgcgtcgcgctcgcctcgcccacgtcgagccccgagcgcgtcatgcggtagatctgcgacgggatggagcccgccatcatgggcgtgaggttgccaaagaacacgcccgacgcctcgacgctcatgaggtcgcgcacgcccagcggcgagtcgtggtcgaggtagaccgcgatcacgtacgcgaggacgccaaacacgtagtacatgacgaagcagaggcaggccctgaggacccacgagccgtccacctggcccaacgcgttgaggaactgccccatctgccccgatatcacaaggtagaggacgtacaccaccacgacggccaccaggaagagcgcgcccttcctggccttggtctcgttctcctcgttgccgtcgccggcgccgccagccccagacgatgcccgtggcgcggacaccttgaggtgaacctttggcttgacctgtccggcgttcttcgattccgccatggtcctccacggtcgatcggcttcgtggcggctgtctgccaccctgtccaacactctgatgatacccctaaaggaatccccaaaatcctgcccgggaatcccccacccagacactacagacgccaggcggacccagttggcgggcagagggcatgcgcgggcgagagggacggccgcccttctcgtcatatatgcggaaggccgctgggcaccgctgcccccacccacaaaaaaacggaccaggacgccgtcccggtccgatgacgtttggtagcccgtagcagattcgaactgctgatctccgccttgagagggcggcgtcctaaaccgctagacgaacgggccatgcaagcgagccaggcggcccgcggagtacttggtagcccgtagcagattcgaactgctgatctccgccttgagagggcggcgtcctaaaccgctagacgaacgggccaaaatggctgggatggcaggaatcgaacctacactgacggaaccagaatccgttgtcctaccgttagacgacatcccaatcgcttcgtgctgcgatgcgtgatttcttgctgcacctcagcgcgagaaagtaatatacgcgagtccgggccgccttgcaaccaaaacttgcaaatgattttgccttcacaagttctactcatgttgttctgcaaggcgaacgcgacggggtccggccacccggcccgctacggcctcaggctccgcagcagcacctcgcggtcgttagggaggtccccgttcaccacggacagcaggagctccctcaggatcatgcccacgccaggccccgggtcgatgccggtcgcctccatcacgtcgcgcccgctcaccgccaggtcgcccatgcggaacacctcgtgctccgcgatggccttcctcagcacgagggtgaccttgtcgagctccaccgcgtaggacgcggcgctccacaccttggacaccgcgtcggcgcgcttcaggtccagcagcgcaaacgtcagggcctctgccctgcccgggcacgcgttgtcgaacttgagcagcgtcctcctcacggagcgcatcgtgggcttgacgtagtggtcatgcaggcgtacgagcgtgcgggtggacgccacgaggtccgagggcagagcgagccggcgcatgatcttctcgcacatgggggcgcccaccttggggtgaccgaagaagtgcccgcggccgtccggccccacggtgaacgtgacgggcttcgccacgtcgtgcagcagcgccgcccagcgcagctcgggcgaagccatgccgcccgtgaactcctccacggcgcggcacacgtgcgccgtgtgctccagcacgtcgtacacgtggtaggggctgcgctggtcaaagccccgcatcgcgcggagctccggtatggccacgcccaggacctcgggctccgccatgagcgcccagccgatcctgccggtgcggaccatggcgtccatctcctggccgatgcgctcgctcgcgatgtcgtccaggccgtccgcgcactccaccagggcgcgctgcgtggccggctcgatgtcgaagcccagacggcacgcaaagcggacggcgcgcagcacgcgcagggcgtcctcctcgaacctgcgccgcgggtcgcccacggcccgtatgaccccgcgcctcaggtcccccctgccgtcgaacgggtccaggatcccccgctccgggtggtaggcgatggcgttcacggtaaagtcgcgccgggccaggtccaggcggatgtcgtccacaaagcgcacctcgtcggggtggcggtggtcgctgtagtcgccctccacgcggtacgtggtgacctccacgggctcgccgtccgccacggccgtgatcgtgccgtgcgccgtgcccgtgcgatgcacctcgtagccggcggcggaaagcactcgctccgcgtcctgccagtgagccgaggtggtcacatccacgtcgtgcgagggcgcgccccgcagggcgtcgcgcacccagcctcccacgacccatgcctcgtagccggccgactcgagcgcacggagcacccccttgccaaagtccggcagttcatatgccacgtcgtcatagcggttggacatcatgcacctttcgggaggctgcgctcgcgcgccttgtacgcaagtatagacgcatccggcgcccgcgccgctcacgagtgcgcacccgtatgcgcccgtctgccggcaggtgctatcctcgtgtggtcacacaatcaaccttgcaagggggtccacatggatcaggacaacaggacggtcgggacggactgggcagcccagaagaacgcgtccttctcgaccgagagggcgaacagggtcgcgaggaacgccgtcacgtcctccaacgtgatggccgcggctcgggacaccaccaagatgcgcacgtacagcgacacgtacggcatcagcgtccccaagaccgccaagatcaccaaccagcgccagagcggccgctgctggttcttcagcgccatgaacgcgctgcgccacgacacgatggagttcctggacgtcgacaccatcgagttcagccagtccttcggcatgttctacgacaagctcgagaaggccaactccacgctcgagtacgccatccgcaccgccgacctgcccatcgactcgcgcgaggtctgcctcgtgctcgaggacggcatgggtgacggcggctactactcgttcgcgatgaacctcgtgcgcaagtggggcatcgtccccaagtccgccatgcccgagactgcctgcagcaagaactccacccagatgaacgaccagctgggcaggctcgtgcgcaagggcgccctcgagctcaggcgcatgcacgaggccggcgccgcggacgacgccctccgcgcgcgcaagcaggagatcctggccgacgtgcaccgcctgctcgcgacctgcctgggcgagccgcccgtcaccttcgacttcgagctcgaggtgggcgagaagtgcaaggccgaccccgcaaaggtatcggaggtcgagcccgagcccaaggccgacaagggcgagaagggcgagaaggacgcgcccgacgccgcagacaagcccaaggccaagcgcatcctgcgcgactttggcatcacgccgctcgagttcgcgaagcgctacgtgcccgtcgaccctgacgactacgtcgccctcgtctcgatgcccggcaaggaccgcccctggggcacggcctggcacctcacgctgactgactccgtgcagggcggcaggcccaaccgcgtgctcaacgtggcgcccgaggtgcttgacgcggccgccacggcgagcctcagggcgggcgtgccctgcgccatggcctgcgacgtgatgcaggagttcccgcgctacatagacgactacaagtacgtgctctcgctcgacggcctcgacctcgagggcctcttcggcgtcgacctctccatgggccgcgccgacatgatcgacgcgcgcgagacctccctcacgcacgccatgtgcttccagggcgtcgagctcgacggcgagggcaggcccaaggcctggcgcgtcgagaacagctggggcaaggacatgggcaaggacggatacctcgtgatgagcgccgactggttccacctctatggcggcgaggtcgacgtgcgccgcgagttcgtgcccgccgacgtgctgcgccagtgggacgaggcgcccgcgacggacatcgccccgtggagcaacgtctgccacgcgctcggcaagagggactagggggaaccatggcacaggacaacgcggctgcggcccgcacgatcaagaacgtggtgttcgacatgggcggcgtgctcatgtacttctcgggcattgagttcgcgcgcaagttcacggagggcgagaaggacgcgcagtccctggacgaggcgctcttccgcaacccgagctgggcgctgcttgatgccggcgcgatcgacacggacacgatggagcgcgtcgcggcggcacgcctgccggagcgcctccaccccaacctgcacgcgtgcatccacggctggtacaagcaccgccgcaacatccccggcaccaacgacatcgtggcgcgcctgcacgaggcgggctatggctgctacctgctctccaacgccgggaccaacttcatggcgttcaaggacgacatcccggccttctcgcacatggacggctgggtggtctcggccttcgtgcgcctgatgaagcccgacccgcgcatctaccggctcctgacggacgagtacggactcgaccccgcagagtgcctctttgtggacgacaacgccgacaacgtgcgcggtgcggaggtcgcgggcatgcagggccacctgttcacgacgcccgaggcgctggaggcggacctcagggcgcgcgggctcagcttctagcgcgcgtcagaactgcgcaaagcggggctcccccaccttgcagaggtcctctccgttggcgagctcgcgcatggccgccacgaagcgggcctcgtcccccgcacggaagtcgcaggtgagctgcacgtcctccgcgaacacgctgtcgcgcaccttgcccgcgcactcgctcacgagccgctccacgcggccgtacgccgcgtagggaatcacgcaggttacgcgcgttaccagggtcatggtcacgaacttgtcggcctcgcgggcacccgcgagcgccgcctgggccgccgccgtgtaggcgcgcacgaggccgcccggccccaggagcgtcccgccaaagtagcgcgtcgtcacgcagcagacgtccgcaagccccgcgccgcgcaggacctcgagcgtgggcatgccggatgtgcgctgcggctcgccgtcgtccgagcaccgcacgcgcccgtccgccagtacccacgcgggcacgttgtggcgggcgtcgtggtggcgcgagcgcacctcctgtatgaactcctcggcctcacgctcgctctcgacgtgcctgacctgcgcgatgaagcggctccggcggtcctcgaactcccccgtcgcctcgaagcctgcctcgatcgtcctgtagcccgcgtcagctcccatgcgcaccgcctagtactcgatggcgaggacgagctcgccggcgtccaccttgcccggcaccgccggggtcacggccgcgaggtcctccgtgttggtgacgcacacgaccacgtgcgagtcgagcccgctcttgcggatgagccccgggtcgaagcgcatgagcggctggcccgcgctgacgtgctgacccttgcgcacgaggcgctggaagccctggccgcgcaggctcacggtgtcgatcccaatgtgcagcaggatgtctgccccgccctcgtccgtcacgccgatggcgtggtcggtccccgtggtcacggacacgacgccgtccacgggcgagaagagcacgtcgccctcgggttcgatggccatgccgacgccgagcgcccccgaggcgaacacggggtccggcacctccatcagcggcacggcctgccccgccacgggcgcgaggaccttgccccttccgccgtcgacgtccaacgcggcgggaagtccttctcccccgccaaacacgcgctcaagaaaccccatgcaaacccttcatccatatcgtctgaagccattgtacagatttgcgccccgcggcgcccgtctgctacaatcgcctgtgcgaagtgggccagacgatcgcgggacgcgcaagcgtcatgaggaaagtccgggctccacagggcaggaggcaggccaacggcctggcggggtgacccgacggaaagcgccgcagaaaagaagactcccgctgctcgcgcaagcgagtgagagaaaagctgaaacggtggtgcaagagaccaccagcgtcgtagtgatacggcggcttggcaagccccctccggagcaatcgcaaataggagcgccatggtgtggcccgcactgcgctcgggttgcgagctagagggcgtcggtaacggcgtctgtagataaatgatcgtccacgacagaacccggctcataggcccacttcgcttttctttacctcttattgcggtggctgcggcggcacgtgcttacaccaggcgaagcgttgacaaccgtcgagaagtgggtacattacaagtagtggcattgatgcggtgaccttacgggggccgcgtccagggaaggcgactgcccatgcgggtggtcgccttcccccttattctgggaggaagaattgggaaagccatttctcacaatcgagcagcaagtctcgctgctcgagtcaaggggcatctcaactgaccaggacacgccgcgaatcctctgccgagagggatattattccattgtcaacggctacaaggattcgttcatagaccaggccgcaacgagtctcgcaggcgacgacagattccttccggataccaagttttctgacatgtacgccctgtttgaatttgacaggacattacgggaattgacgttccattacctgattcgagcggagtccaccatccgcacggccgtcgcctattgcttctccaacgagcatcgcgagaagaacgcgtatctgctgcaggactcctactgcacaagagccgagtatgcctccatcgcaaggcgaaccaagacggattatgcgtcagaagtctctggactcatcacggtgctctcaaggaccatgcagcgcagtaatgcgggattcatcaagcactatcgagaagcgcagggagacgtaccactttgggttctctgcaacggattgacgttcgggaacatcgagcacatgttcaatctcatgaagtcgaacgaaaagattgcggtctgcaagatggtcgcaaggtccaccgggagatcgggcgggaaactcggatacctcgatgtcagtaccatgacgatcgctctcgaggcactggtcaagtttcgaaacatctgtgcccatgatgagaggctgtactgcgcactcgttggaggcaggaagcaaatcaactacgctcgcatggtgaagtatctggagtggttcctcacaagggaggagtttgacgaatacatatcccgccttgtcgacgagttggacgagagcatcaagagaaacgagaaagtggcatccgtaatagagccactcggcttcgcggagctaagctccagtctaaagaatcgacaaatcgaggaaaaagacaaccagaagtaggtacgcacccatgccgcatgtcacgctcacaaccaagaggctcctgctccgcccctggacggaggctgatgcccctcggctcttcgagctctgcagcgaccccaaggtcggtcccgcctgcggctttcctccccacacgtccgtggggcagagcctttcggccatacgcgacgagctttccaacgacgaggcctacgcggttgcgctcgccggtacaggcgaggtcatcggctgcgccagtctgcgctttggcgacgacgcgtgctcccttcgcgatgacgagcccgagctcggcttctggatcggcagcgcctactgggggcgaggcttcgcgaccgaggccgcccgcaggctggtaggccacgcgtttctcgacctgagctgctccgccgtctggtgctgccactacgagggcaacgaggcgtcgcggcgcgtgcagcaaaagctgggcttttcctacgtccgcacgaaccccaggggcgacacgcggctgggatataccctccccgaggtcgagagcacgctcacgcgcgccgcctttgacgcgacgcgctagggcgagaaggacgcacgccgcacccgcgagccaagcgcacgcgatacgattcgaacgggtgtaccatttttcgaacgggcatgctatactgagcagaacggttgttcgtagttaggcttgcccatggacacactcacgaagctcggcattcttgcggaagcggctcggttcgacgcggcctgcacctcgtccggcgtgacgcgcgggccgtctgcgggcaaggtgggaatcgccagcggagcggggctctgccacaccttcgccaaggacgggcgctgcattacgctcctcaaggtactcatgagcaacgcctgcagctacgactgcgcctactgcgtgaaccgcagcagcgcgagctgcaggagggcgacgttcgagccacgcgagctcgcggagctcacggtggacttctacaagcgaaactatatcgaggggttgttcctgagctctggcgtgctgggcacaccggataacacgacggagcgcatgatcgagtgcctacgggtgcttcgggaggagctccacttcaacggatacgtccacgccaaggtcatccctggcacctcgcccgagctcatcgagcggatcgggcgcctggcggacaggctgagcgccaacctggagcttcccagctcgagctccctctcgaacctctgcccggaaaaggacccgaagagcatcgtgagctccatgtcgcagattcactccgagcgcgaggaggagtcgaggcgcctcctggcggacccacgccagaaggcggcactcgccaagaggcatccacggggcaggaggggcgcttccgacgacgtctcgaacatgggactcaggctgaacgccgcggccatgacgctgcgtccaagggacgaggtgggctcacgcaggcgaaagttcgcgcccgccggccagtcaacgcagctcatcatcggcgcgtcaccggaggacgacagccacatcctcaggctgtccgcctccctgtataggaagttcgacctgaggagggtgttcttctcggcctacatccccatgatggacgacagcaggctccccgaccagcagacgccggttcccctgagacgcgagcacagactctatcaggcggactggctcatgcgctactacgggttcaacccggacgagctcgtgacgccggaatcgccctggctcgacctcgaccttgacccaaagctcgcctgggccctcactcaccaggaaaggttccccgtggaggtcaatgccgcgagcctcgaggagctgctcagggtgccgggcataggcccgatgggtgccaggaggattattgcggcgcggcgggcgaagcccctcacgttcgaggacctcaaggcgctgaacctgactttgaagagggctcgctacttcatctgctgcaacggcgttcgtgacaggcaggcaccactggacgagggactcatcaggagcgaggtggcaaagggtgcaaggcagagcaagtacaacaagacccgtcgcgtcgctgagggacagctcagcttgttctgaccggaaggccgatacgacctccacggaggtcctcaaggctgcgcaagaggtacgcgacgccatctcgggtggcttgcgcgtcgcgctctgctgcaacggcagcctcgagtcaatcctttctggtgtggggattggctaccttgcgcacgctcccgcacgcaagctgcgactctgcaaggcggaggcggcccagcccgcgctcgacgagcgcctcgtgaacgttcccgccgcctcccttgacgggaccgtggcgtttgccacgcgcgtctatcgcgggttcgagaggcgcgtcagcgccggatgcccgctcaagaggtcgggttcctgtcccgcgcactgcaagggctcctgcgcgactaggctcgcgctcgcggcggccaacgacgatgacggcgtgccccaggcgatacacgagtacgttcgcctgggattccaggtcggcccgcagatcagaaacatgctgtccgacgccacggtggcaaggctcgacaccctcgcgcggtacacgctgaccgaatgcgagcacacccggcagttcgcgcgcttctcgctccttgaggacgggtcctacttctgctcgtttcgccccaaggcggacaccatacccctcaccggcggctacttcgccgcgcgcatgagggacgagaagttctgcatggtcgacccagcccacctcgtcgtggcgctgcacgagccagggcagaggcgctgctcggtgtcgagggtcgacccggacctgtgcggcgagctcgcctccgcctcgacccagaccgcagagggcgagaagtacgttcatgccatgtggcggcgcttctacgactcggttggtcttgacggcagggacgcctcccagcgtgggtacggcctcagggcgcactggatgcccaagcgcttctggggtggcctcgtggagctctcgcccgaggcgctcgacccgggtgccgtcgtgcccgccgcgtattcgccaaccggccgcgggcacacaaaagcagccgtcccccacctcgggcaggggacggctgagtctcaaacctagctgcttgcggaggaaggcgcacgattgcgcgtgggtacctccgggcgacctaagctagtccaggtcgctgaagtcgttggcggcaggagcgggcgcatacgtggtcgcgtcgacgtcgacggcgggagccgcgggcgcggggtgtgcgaccggcgtcggggccacgacggagtcggtgtgcgtggtgcccttggagccgttggggacgctcagggtctgctgcgggaagacggagtcggcgtcgtccatgaagtgctgcaggagcttcttgtactcggtgcggaagtcctcgcgggactgcttcaggcgatcgatctcgtccagctcgttctgcttctcggcgagagcctgacggatgacctcgcgggccttctggtcggcctcgttgcggatgttctcggcgttcgtgcgggcgtccgcgacgagcttgtcggcgctctgctgcgcgacgatgagcacctgggagatctggcgctcggaagcggtgaactcgggctgggacacgggagcgggggtgacctcgaccggcgtggccatgctggtctgctccttcagctgcgcgacctgcgcctgcgccgccgcgagctgctgctcggaggtggtgagcctgcccttgaggtcagcgatcttctggagcatcgcgtcgacctcggaggcaacctggtccaggaagacgtcgacctcgtcggtcttgtagccctcctcgtgcttccccgcctgagagaaggtcatgttctcgatgtctgctggagtgatagccatctttgttccctttcaactttgtacgtgctacgtcagcagtgcggcgagccgcctacctcagtatatccccacttaccaaattagctgctggatgagctgaagaaccaatattgcgacaaagggcgaccagtccatgccggctacgggcgggatgaaccgcctgaagaggttcacgaacgggtccacgatggtcgagagcgccccgtacaggtctgccacgaacccgttgccgctctggacgaaccacgagagtatgcactgcacgaagatgagtatctcgtagaagttcaggagcctgttgataacgtacgcgatctgcaagagtcgtcctttcgagtagctaggcgttcgcgagctcgcgcgtgcgcgcgagggcggcgtccgtcgcggcgtaggcgctctgcacgagctcgggctccatggccctcagccccgcagccgtcgtgccgcccggggaggtgaccttctccatgtaggcgcgcgggtgctcgcgcgactcgaggagctgggcacacacgccgcgcatggtcgcgagcaccatctcgcggcagtccgccgcaggaaggccgcgctccacgccagccctgacgagcgcgtccgcgaagagcgccacgtacgcgggaccgcagcccacgaccgcgccctccgcgtcgagctggtcctcgcgcatgaccttggcgacgccaagcgcggagaagagctcgaccgcgcggctcacgtcctcctcggacgccgtggttcccgggcagacggccgtcgcgcccgagagcacctgcacgggcaggttgggcatcgccctcacgacgcgcgacttgggcagcagcccctcgagcgtctggagggacacgccggccgcgatggaaatgacggtgcgtcccgcgagctgctcggcgacctcgcccacgacggcgggcagcacctgcggcttcacggccacgaccaccacgtccggatcctgctcgagcatctgggaggcctccgcgaacgtggccacgcccttctcgtccagcggaacgagcttctgcggcgacgggttgcacgccatgacgtgcgaggcgtcggccgcgcccgacgtgacgagcccggacgcgatggcgccgcccatggcgcccgcgccgatgaccgccacggtgaagttgatcttgcccatgtcggctacctctcgatcgtgccgtcctggaccagcttgttgatgtcggcgtcggaaagctccatgccctgcggggtgatcacgaacacgcggtcgcccagctcgtccacctggccgccgatgccgcaggaaagcccgaggcagaagtccaggatgcgcttcgcggtctcgatgttggtgttcttgaagaccaggaccaccggctggttggtgcgcacgcggcgcacgaccatctggacgtcatcgtacgagacgggcttcagcacgtacggcggcagcttgccggagctagcggggcgcgggaccggcttgaggccgatgtccgcgggggtgtggccgcccgtggagttgcccaggacgccctcgtgggcgggcgtgtaggacggcgtctgcggaatggcctgcgtctcgccggagtagtcgttcgcggcgggcgcagggcgctgcgcgtactgcgggttgggcgacggctgcgggcgagaaggacgctggtagtcctgtcggtacccgttatcgtacggcgagggggcaccgttgccgccggcaccgttggagcccacgggcctgccggagcgcgtgtagacggagacgctctccgcctcggggcgacgggtgttgccgagcagtcccacgccctgctgctggtcgttgctgcgcgcgggcggctcgtcgtagtcgtcgtcgtagtagtcgtcgtagtagtagtcgtcgtccttcggcccggagatcttgtccctgagcgaatcgaggaagcccatttcgtcctcgccttcccggaccgtgtcgagcaccgtccgaagtcgttcgcctcaccgtctggccagtggcctggcaggcgtccctctacctaacctcatatgccgggctgaagaccgttctacccagcctcactatcgtggaaccctcttctatggcaatcggataatcatcgctcatacctgaagacagggttgaaagctcgagtcccgagcgctcgcgcatcctgtcgcgcagctcgcgcaggccgctgaacgtcctcctggcggcgtcggggtcgtgcgcgggcgccatggtcatgaggccctcgatcgagatgccgccaagacccatgagcccgtcgagcgcctcgagcgcctcgtccggggcaaagcccgacttggactcctcgccggagacgttgacctcgagcagcaccctcgacacgatgccgtgcgcctcggagcgcttggacaccgcctcggccagctgcgccgaggaaatcgagtggatgagccccacgcggccaatcacgtggttgatcttgttcttctggaggttgccgatcatgtcgaagcgcacgccggccatctccgggtggtccgcctcgatccccgcgagcttgcggtcgagctcctgcgggcggttctccgcgaacgcgcggtaccccgcctgccaggcgagtgcgacctcctcgaccccgacggtcttggagacgcccaacagcgtcacctcctccggtgacctgccggccctcgcgcacgcatcctgcatcctctgcaggatctcggtcctgcgttccctcagaaagtcgaggtaccttgacctctcctcctcagtcacgcgatcactcccccactcgcaaatcgaaagcgtattgaatcgtccgtgtcagcatcccatgcaggcgagcgcgccgtggcgtccgcacgcgccgtgctccgccctgtacgagaagaacctgtccgtgctgctcgcggtcgagatcccacagtcgagcacgttcccgctcggcacgcccgcgtccgccagcgcggcgcgaatcgcagccgcgaggtcaaggtgccgctcggagctccgcacggcgggaccgaactcggcctcgaacctctggagcagctcggcggacacctcgtagtcctcccccgtgatgtgcggcccgatgtaggccgtcacctctgaggtggcgcagccgcactcgcgcgcgagcgtgcgggccgccttggctgcgatgcgcgccatggtcccgcgccagccggagtgcgccacggcaaagccgcccggcgcaacgaggatgatggggacgcagtccgcaaagcacaggagcaccggaacgtgcggggccgtgcacatcacggcgtcgcagccctcgcgggcgcggcgcgcgacgtccgccgcctcgcgctcctcgcgcaccacgacgacctcgtcgccgtggacctgcttggggaccacgaggttcctggcaaagtcgccggcaccaagcgcccccagcgcgagcatgcggttcttctcgaccgcctgcggatcgtccccgcaggcatcgcccaggttgagcgaggcgtactgtcccgtcgagacgccgcccgtgcgctccgtgaacgcgagggacaccccgtacgggtgggcggcgtcgaccagcagggtcacgccgtcccgtgtctgtcgcgtgagctcggccacgatgcgtcccgcctagatgcggctgtgcttcaggaactcggggacgtcgaactccttgttgatgtcgttgttcggcttgggagcggacgtcgcgcgggtcgactgggcctggctctgcgcctggcgcccagaggcgggacggccgttcgagcccctcgaggagcccctggacgagccgcgctccgtggagaacgtcgggagcggggcctggatgttggagtcgttgaagccggtcgcgatgatggtgacgcgcacctggtcgcccaggctctcgtccacgaccgtgccgaagatgatgttcgcctcggggtcgacgttctgcgcgacgagctcggcggcgtcattgatctcctggatgccgaggtccttgttgccggcgatggagagaaggacgcgcgtggcgccctcgatgccgacctcgagcagcgggctcgagattgcctcggaggcggcatcggaggcgcgggtgtcgccggatgcgacgccgacgcccatcatggccgtgccggcgcccctcatgatcgtgcagacgtcagcgaagtcgaggttgatgaggccggggaccgtgatgaggtccgtgatgccctgcgtgccctggcacaggacgtcgtcggccatgcggaaggcctcgaggaaggaggtcttcttctcggagaggtcgagcaggcggtcgttcgggatcacgatgagcgcgtccaccgcctcggagagggtctggatgccctgggcggccttgttggcacggggacggccctcgaacgtgaagggcttcgttacgacgccgacggtcagcgcgccgatgtcgttcttggcgatgtcggccacgacgggggctgcgccggttccggtgccgcctccctcgccagcggtgatgaagaccatgtcggcaccggcaagggcctgcttgatgtcatcgtgggagtcctcggcggcctccgcaccgacctcggggttggcgccagcgccaaggcccctggtgatgtccccgccgatgtgaaccttgatgtcggcgtcggagatcgcgagcgcctgggcatcggtgttcacggcgacgaactcaacgccgcggatgccctcctcgatcatgcggttgacagcattggtaccgccgccgccaacgccaacgaccttgatgactgccaggtagttgctcgggatgtcgttgtccatcatgcttcctccttgcttggcgacggtcttggggacgtcgtccgtcttatcctcggatgccgccccgtcgatctcgatggtgaccttagcggtaccgccctttacgttcttgttcccgtgctgcttcatttcggttcacgtctcttgcttggtggtgctctcaaagtgctgctcgaaaccgactggcaaaaccctaaacctcaggtagagccatatgcccatctcaaagcgcgctatatttgcacattgtgggcgacttagtcaacagttttgtgaaagttgtgaaaacagcaggtagataccgttattctcgcctgtcgaatccctgaagtaatgcctgagggttatggaaatcgcgactctcaaccttgagctgagggtcgcgattttagcccacacgccatgtctggcagctagttgcccgatgtgcccgtcgtgccggttgtgctcgtagagtcggtcgttccggtactcgtgctcgagctcgtggaggatgtgccggaggtgtcggccgacgatgttcccgtatcgctcgaagagctgtccgaggtgtcgctcgaggatgagctggaggagtcgtcgttggcgctggcgaggtccgtacccgtcacgcccgtgcccgcgactgcgtacttggagtccacgagccggtaggcgggcgacgagggcacacgcacgttgatgtacgtgagcttgccggagtacttggagatgatctgggtgatgaccgcctccttggaggcgatgttcgtgggggagccgagggagacgacgacgccgctcttgagcgtgcagctgatgctctcaaggctgctggcggagaagctcacgatctgcttcgcgaacgccgtgctgaactgctcgcggtacgagctgacggccttgaggacctccgcgctcgacgccgagcccgccatgggggtgatgctcgcgggcacgtccgtgatgagcatggcccccgccttccgcgcggccttgagggccacgtcgttcacggagtcgctctcgcccaccttgatggaggcgggctggatccagacgttgtcctcccccaggtaccacaccacgtcgccggcgctcatgaccacgagggcgctcaccttgcgctccgtaacgacaatcctgagggtgtttgggaactccttctggtaggagaccgatccgacccaggggttcttctcgaggttctccgtcaccttggcctcgtcgaggttgaggagcgtcgatcccttgggtatcttcgcgagcttggcgatgctcgccttgctcatgtgcttcgtggcgaccgtctcgacgttctcgatcgagaacacgggcgtgtaggagagcacgaggtagcccacgagggccacgaggagaagtgcggctaccacgattcccgcgatgatgccgcggcgcacgaccacgtccgacccgggcctgtttgcgccggacgcccttgccggggcggcgtcccccgtcgcggggcgcgtcgtgggacgtgcggtgggcgtgcgcttggtgggcctcctgctgtcgggcatgcttccccctacgcgccgaatcccaggcacttcacctcgggcacgaggtcgatgccgtacctgtcgagcaccgtgtcgtgcacgtggctcatgacggcgatcacgtcggccgcgcgggcgccgccctcgttcacgatgaagttggcgtgcacgtcggacacgcacgcgcccccgaccgtgtagcccttgagcccgcacgagtccacgagctggccgacggagcgagagccggggttcttaaacacggagccgcacgagggcttgccgagcggctggcggagcctcctcctgctgacgagggcctccatgcgctcggcgacctgggacttctcggcctcctcgagcgcgagcgtcgcctcgaggatgatctcgctcgtggggatgttggtgtagcggtagccccactcgatgtcggacgcggcatagcggtgcaggccctcgcccggcctgagggtcacgacgtcgcgaacgcgcgacccgatccaatccctgcgggtgccagcgtccatcgatatcgcgccgcccaccgtgccggggatgcccaccaggcactcgagcccggagagcgagtgcgagagcgtgtccgtcacgagccgcgcgagcgacgcgccggcgccggcggtgacctcgcagccgtcgaaggctatgcgggagaactccctgccgagcacgatgacgcagccctcgtagccgcggtcggaggcgaggatgttggaccccttgccgaggacgacccactcgacgccctccttgcgcaggatctcgatgatcttgagcagggcggggtacgagttgaccgtcacgaagagcgcggccgggccgccgatgcggtacgtcgtgtggtggctcagccgctcgttgcggctgacgtccgcgtcataggcgcccgagagcgccatgtatgcgttgaagacgctcaaactaggctccggtttcctcgtccagctcgcgcttcgccttgatgaaggaggggccgatggaggtcacgtcgccggcgccctgggtgatgaggaggtcgccggggcggcagacctcgacgaggtggcgcacgacgtcgccgcgcttggggatgtaggtcacgtcggggacgtggcccttctcgaccaccttgttggagaccgtcttgcccgtgacgccggggatgggcgtctcgcccgcggggaacacgtccgtcacgatgaggacgtccgcgtcgtcgaacgcggtgccgaacatgtcggcaagcgcctgtgtgcgcgtgtagcggtggggctggaacacgcagacgatgcggtcgaactgcaggtccttggcggctgcgagcgtcgccttgatctcggtgggatggtggccgtagtcgtccaccacggtgatgccgtcgatgtcgcccacgtgcgtgaagcgacggtgcgcgcccttgaacgaggacagcgcgacggcagccttctggacgtctgcgccgagcacgtcggccacggcgatggccgcggttgcgttggccatgttgtggcggccggggttggccatgatcgtgacgctcacggactcgccagagggcacgcgcacgctgaagtgcgaggcgagcttgtggtgctcgcccggctcgggcacgcagacgtagtcgttcttctcgtcaaagccgtacgtgacgaccttgcggcccgtggacttggcgagctcgacgtagtggggcacgtcgccgttgatgatgacggtgccggcgtcgcccacgaggtccatgaacttgcagaaggtcttctcgatgttctcgagcgtgccgtagtggtcgaggtggtcggcctcgatgttggtgatcacgacgacgtcggggtcgaggtagaggaacgagccgtcggactcgtcggcctcgcacacgaagtagccgcccttgccgttgcggccgttggtgccgtactcctcgacgatgccgccgatgaggaacgacgggtcccagccgaggtggtcgagcatggtcgcgaccatggaggacgtggtggtcttgccgtgcgtgccggccacggccaccgtcttcgcgtcgagcgagaggtacgagagcatcttggccctgggccacacggggatgccgagctccctcgcgcggatgacctcggggttggtctcggggatggcggaggaggtcacgacgacctcgggagacacctcgtcgatcgtggaggcgtggtgccccacgcgcacgtcgatcccggccttctcgagctcgcggacgtagcgggactccttcaggtcggaccccgttaccttgcagccgcgctcgtgcagcacgagggcgatgccgctcatgccggcgccgccgatgccgatgaagtgggcgctgttgacgcgcttgatgtctttgtccatctggaacctctctatgcatgaagaagcggcccacgtgccgtgggctcgcataacactctagcgcaacgcgggctcttgcgtgaggcttagcccctgagcgtcgcggcgctctccacttggtccgcaagcgccatggctgccttgtcctgcgcgaggcccttggcggccttgcgcatggcgtcgcggcgcgcggcgtcgtccacgaggcccagcaggtcctccctgaaggcgggggtgtcaatcgcgtcgtcggccagcagcaccgccgcgcccgcgtccacgaggtagcgcgcgttggtggtctggtggtccgccgtggcgaacgggtacggcacgagcatgctcgggaccgcgagggccgcgatctccgcgacggacgaggcgccggcgcgcgacagcacgaggtcggcggccgcgagggcctcgcccatcttgtcgatgtagggcatgacgcgccagcgcgcctgctgctcctcggtgagcgcaaggttctttacgacgtcctcgtagtccgccttgccggtggagtgcaccacgtagaggtcgggacgggacagcagctcgtccttgagcgcgcagacgccctggttgaggtggcgcgcgccaaggctgccgccaaacaccagcagcatggtcgcgtcctcggggacgccaaagtcgcggcggccgtcagcgtggctcgcctcgatcacgctcttgcgcacggggttgcccgtgaccacgatctgcgtgccggcgcccaccttgtcgcggaacgcgtcgatcgcgacgggaagcgacacgcacacggtcttgaccttgcccgccgacgtcttgttggcgaggcctggcacggagttctgctcgtggatcacgcaggggacgccctgcttgtggcaccagttgatgagcggcagctcgatgtaggcgccaaagcccacggcgacgtccggcctcgactgcgcgaagtgcgccccgatggtgcgctccgcggcgcgcatgcgccacagcgcggacacgagcgtccacggccgcgagcggtcgaagcccgtcacgtcgatggggttgaacgggaagcccgccttggggacgagcgtcgactcgagcttcttgggctggccaaagaactcgacctcgtgcccgcgtgccctcagctcctccgcaagggcgagcgccgggttgatgtgaccggcggtacctccggcggcaatcgccaccctcaagctatctgccacgccagttgctccttccgcgttcctcgcgcgcgtcgcgcacgccgcgcacctcgggaccgctctcgtgcttcctcagtcggtcgctcgcactcggtcccaggtctatgcgcgtgcgcccgtttttgtcggaagtgactctagcaccattcgcccgcgcgcgcatctcgcgctccctcctgagggactccgggctcgtcgggtcctgcgggcgcgcctcgtcgcgacgcgcgccgccgcccagcaccgtgaagcgcgacctgccacgaggctccgtcggggcggacgccgtcccgtacgggcgagaagagcgtgcgctcctcggcgtgggctcccccacaaacgactcctcgcgccggggcgcggacgtgacgctgaactcgctcctgcggtcgtcgtactccgtctgcggcagcttgctctggagggacaccgacagcacgatgcccgccagcatgagcgagctcatgatggacgatccgccgtacgagacgaaggggatgggctttccagacagcgggaagagccccagcacgcccgccacgttgagcagcatctgcgccacgatcaccacggtgcagcccatggccgcgagctggcccgcgaggtccggcgcgtagcgggcgatctcgagccccgcccacagcagcgccgcgaacgcgcagagcatgccgaccgtccccacgagcccgagctcctcgccgatcacggcgtagatgaagtcgttgtacgccatgggcaggtaggagtacttctgcttggacatgccgatgcccacgccaaacaggccgccggagccaaacgcgtagaagccctgcacgatctggtagccggtgccgtacgggtccgagaacgggttgagcatcgtcatgacgcgggcccgcgagtagggcgtggccatggacacggcaatcatcgcggcgaggccgatgcccaggattcccaggcagagccttccggaggcgccgccaaagtagagcatgaccacgagcgtcacgcccaggatggtgaccgtgcccttgtccggctgcaggaagatgagtcccaggggcacgagcacgcccagcgcgaggaaccacaggagctcgcgcgtggagcgcgtcccatcctggtagtagtcgctgatgaggttggccgccacgaggacgagcgtcacctttgcgaactctgagggctgcaggttcacggggcccagctggatccagcgcgaggcgccgtaggcgtccgcgcccgcgaacggcgtcatcacgagcagcaggaggaacagcgtcacggcccactccaccacgaggagcttcctcagccacaggtggtagtcaaagtaggccagcaagaacgcgagcccggcgccaacgcccgcaaacgccacctggcgctgcaggtagaacgcggggttgtagctcgagctggacgacgtgagcgccgatatggacgacgacgagtagatcatcgtgatgccgaagagcgtgagcagcaccaccgcgcccagaaacacgaggcgcggcaccatgaagcgcgcgggcgtgccaaagacgtaccggtcggcccagggaccgctgcccctgccgccggaccgcgggagggacgaccgccccagggactcgactcgctccatccgctacataccacccttcgtgccgccgagctcggccacgtaccccttgaaggcgcggcccctctcggccatgttcgagaactcgtcgaacgacgagcacgcgggcgatagcagcaccacgtcgcccggctccgcgtccgcgaccgcggcctcgaaggcctcgcgcaggtgcggcgccctctggacgagaagtgcgcccccctcgccctggagctcgtcctcgagcgcggaggcgatcctctcccccgccgcgccaaagcagacggccgccttgcactttgcaacgacgtcgtggacgagcgggcccaggtccgtgcccttgtcgtgaccgcccagaagcagcacgatgcggcccttggggaacgccgtgagcgccttctggacggagtcggtgttcgtggccttggagtcgttcacgaagcgcacgccgcgcacctcgccgcagggctcgatgcggtgctcgagcgcgcggaaggccaggatgcccttctccacgtccgcgtcgggcacgccgagctcgatggcgagcgcggaggccgcgagcgcgttctgcacgttgtgctcgcccttgatgggcatgctgtcgacgggcaggagcacgtgctcgtcgccgtcgaggcgcacgcagagcctgccgtcgcgcacgaaggccgcgcacgtgacgtccggcgagggcacctcgtgcacgttgagcgtgaggacgcgcaggccgcgctccctcagcctcctgatgacggcgcggcaccacgagtcctcgtcgctcacgatggcgaggtcgtccgcggtcaggttctggaagatcttctccttcgcggcggcgtacgcctcgatggagccgtgccactccacgtggtcgggcgtcacgttgagaaggacggccacgcgggggtggagccgcctcgtggtcgcgagctggaagcttgacagctcggccacgaaccactcgtcgtccgggcggtcgcgcagctccgccgtgcagagcgtgccgatgttgcccacggccacggcgcgcatgcccgccgtgcgcaggagctgcgtcgcgagcgtggtcgtggtggtcttgccgttggtgccggtgatgcccacccacctgcgcgggctctcgcgccaggcgaactcgggctcgccgatgacctcgccggagcaggcgacggccgccttgaagaagggcgagaactcggaaatgccgggcgaggccacggtcaggtcgtagcgcccggtcacgtcctcggtgccgagcacgacgcgcgcgcccttctcctccagctcgcgcgtgacgtcgccctcgtgggagctggcgccgccgtacaccgtgacggaggacacgcggccctgaggctggtccagcaggtagccggccacctcccgtccggtcttgcccaagccgagtacgcagacgtcgccgagcgacgcgtcggattgacgagccattgttggggcctccctagcgaagctggaagtagagcgcgaacccgaggaccgcgaacgcggcggagacgatccaggagcggatcacgaccttggtctcgctccaccccttcttctcgaagtggtggtggattggtgccatgaggaagacgcgcttccccgtggtcttgaagctcacgacctggatgatgacggacagtgcctccacgatgaagaggccgcccatcacgagcgagcagatctccgtcttggtgagcacggccagggccgcgaaggcggcacccagcgcgagcgagcccgtgtcgcccatgaagatggacgcggggtagcagttgtaccagaggaagccgacgagcgcgccggagattgcagcggcgaagatcgcgaggttcttctcgttgtagctgaaggcgaccatactcatgatgagcatcaccacgagcgtgcagccgccggcgaggccgtcgaggccgtccgtgaggttgacggcgttggagaggcccgccatgaggagaaacacgaacagcatgtacagccacggcaggcggagcgtggcgccgcccaccacgacggtgctcgtgagcacgccgaggtcgagcacggcgccgccggggaactcgaccctggggctcacgcggcagtagttgacggcgaccacgcagaacgcgaccgagatcaggatgaggccggccatcttctgcgagggcgtgaggccgagcgagcgacggtgcgcgacgctctcgatgtcgtccagcaggccgagcgagccggtgaggaacgtcgccagcaccgcgaggatcaggtcggtggtccacgtggcctggatgaagcacgtgacgagcaccgccagcaggatcacgacgccgcccatggtgggcgtgccctgctttacgaggtggcgctgggggccgtcggccctgacctgctggccgatgccctcgtgcttcatcatcttgatgaagaagggcatgaccacgagcacgatggccgccgcgatgacggccgacaggaagacctggtaggttgggtagcttggatttccgaacatcaggccaacactcccttgacgaacttgtccagaccgacggacctcgagcccttggcgagcaccaggtcgtcctcgcgcagcaccggcgccatcgtcctcacggcggcgtcgacgtcctcgaagagctcgatcctatcctccgagaagcccatcgtgagcgccgcctcgcgcatctcgcgcgcgtcgtccgtgcccacaaagaccagcaggtcgagcggcttggctgccgcgtacgcgccgatgtagccgtgcaggcggcgggactccgcgcccagctcgcccacctcgcccaggacggcgacgcgcctgcccgtgcacgacatggtgcacagcacgtcgagcgccgcggcgatggagctcgggctcgcgttgtacgagtcgtcgatcatgcgcggcttgccgacctcgctcacgacctcgagcctcatgcccgtgcgcggcatgctgctcatggcctcggccgcctcggcgcggtccacgcccagccggtcgcagatggccatggccagcaggaagtcgctcacgacggccctgccgggcacgttgaggctcacgtcgcgcctccagccgtcggcaaaggcgagcgagaaggacgggcagccgtcctcgcccacggtgacgccgagcgcacgaacgtcgtccttctcgccctggcccacgtgcaggcactccacgcccgccggacgggcgtactcgccctcgatgagcggcgcgaagtcgttgtcggacgtgagcaccaggcaggggcgcgcgggcgcgtctgccgcgtcagagggctgcatgccagatatgatctcggccttggcgcgggcgatgttctcgcgcgagcccaggaggccgatgtggctcgtccccacgttcgtgatgacggacacggtgggcagcgccgccgcagcgagccgcgtgagctcgcccttgtggttcatgcccatctcgcacaccaggacctcgtcctcggcgtctgcgcccaggaccgttatggggagcccgatgaggttgttgaagttgccggccgtcgcatgcacgcggtagcggcgcgcgaggcccgcgcgcagcatgtccttcgtggtggtcttgcccacggagcccgtgacgcccaccacgacccactgcgggttcatgcggcgccaggcgcccgccagccggagcatgaactcctcggcgtcgtcggcctcggccctcagcacggcgcagccatgctcgcgggcgagcgccagcacgtcgtcgcccgcgggctcggtcatgaccactgccgcggccccggcctcgatggccgcgggcgcgaacctgttgccgtcgacccgctcgcccttgaagcacacgaaggcgttgccgtcccccgcctcgcgggagtcggtcgtgacgccctcgattctggcgccctccggcgcgtacgcgacgtctgcggacgtcgcgcgtgccatgtccgacacggagatccttaccattccatcacctgtcaacttcccctggcgactagcccgcatcgggcgacacgcccatgtctgatagggcctcactcatgatagtagagaagagcggcgcggccgaagaggtcgccaaatatggagttccattgagtcccacgtacaccaggacgtcggggtcgtcggcgttcgcgaagccgatgagcgagctcacgtacttgttcttcgcgtagccgcccgactcgtcggcctgctcgcccgtgccggtcttgccggccacgtcgtagcccgtgacctgggccgcctgtgcggtgccctccttcacgacggtgcgcatcatgtccgtcacctggctggcggtcttcttcgagaccgagcgcccctcgctcttccacgtgaccttcttgcccgccttgctcaccaggaagtgcggggtcacgatcttgccgccgttggcgatggagccgatggccttcaccatctggtccagcgggatggcgagcgactggccaaacgacatggagcccaggctcgcgccgtcgtactcgttcagctgcttcacgatgcccttgacctcgccggggtagtcgatccccgtcttggtcccgatcttgaacttcgcgatgccgttcgcgaagcgctcctcgcctatcacgtcctgcgccaccgtcgccatgccggcgttggaggaccgcctcaggatctcgcgcagcgtcatctgcatggtctgcgtgcgaccgtcgtcgtcgcccaccaggtcggagccgaccttcaccttgccgggcacggtgtaggtgctgtccggcgtcatgagcccgtcctcgatgccgatggcggccgtcagcaccttgaagatggagcccggctcgtaggatgaggacaccggcttcaggttgagcgcgccctccgcaatcgtggacgtgtccgtgatgttgaacagcggggtcgagcaggcggcgagcacctcgccggtcttcgggtccgtcaccatgacggagccggagtctgccttgtaggtgctcacgccctgcgtgatggtcgtctcggcgaccttctggatgtcgatgtcgatcgatatgacgatgtccgtgccgttcttggccttcttgatgacctgggagttgcctcccgcgatcggcgtcccgcccgagccggtctcgagcagcatcttgccgtccgtgccggagaggatcttgtcgtagtacagctcgagcccggagagccccttgccgtccgtgcccacgatgcccaggatctggccacccgtcgacccgtacgggtagacgcgcttcatgtcgtccaggtagtagacgcccttgatcttcttcttctcgagcttcttcttgatggcgttcgcgacgtcggtgtccacctggcgcttcacgtagctaaaggacgtgttgcccatgagcttgtccacgtagtccgtggccttgccgccgagctcgtccgcgatgatctccgcagccttcgcggggtcgttgacctccttggggttgcagtagatggtcttgcactccttgctcatggcaaggacgttgccgttcctgtcgtatatggtcccgcgcttggcctggatcgtgatctcgttcgtccgctgcgcctccgccttggacgagaggctcttggcctccacgacctgcaggtacacgagcttgccgcacacaacgaccatgattgccgcgaagacgagaaggacgaccctcatcatctgctcgtacgagctgtggtcggggcgcctgactccgcggtcgcccctcatgcgcgaagtgggcgcctcgtcgtacgaggcgcccgccacgtcaaagcggcctctgcggccgttcctatttccgtatcgattgctcacggcagaagagtttacgccgcgtcggagcccgtctgcgtgccgtcggaagactgcgcagcatttgcagaatcggtcgatgcggactcgtcggtcgtggcggcggacttcttcgagctggaggtcgagatggagccggagtcggcgctcgtgctggagtcagacgtcgtggccgagctggaggtagagtctgaggctgaacctgaagtagaggttgaggtcgaggttgaagctgcgctcttctcgcccgagacgctcatgctctcgctcgaggtggaggggaccatgccgtagttctgggtcgcgatggcgttcacgcgcgagctgctgctcagcacggagcgctcgatcttgaggtcgctgttggtggtctcggcggtcttgatcttctgctcaagggagctggaccccatcatgttcgagaccgcggccgccgtgagggcgacgcgtgccacgcccaccgcggcgagcacaagggcacaggcaatcacgagcttgaagcggctccagaacgtggtggagacgccgcggcggacgcgtgcgtcgagcccgccgccctcgacgacctcgaaggagcgtcgcgggtcctcgcgaggccgctcgtatgcgtttccatagaagctgtatgcctcggagcccaagttggtcatcttctgttccccttagatgccagtgccaccgcttgcggtggcacgtaggtgatgcgttggtggttcgtttaagctgcgttgtggtgcgtggtgctgcgttttagtggtgcttgggcaaacggccgaggccggatgcgttggttcaggtgccctcctcggtggtgtccaggcggacggccaccctcatgagcgcacttctcgcccgggggttccgggcaacctcatcgtcgctcgcgacgatgggcttcttggtcctgacgcggactatcggcacgtggccgcacacgcacaccggaaggtccggcgggcagatgcaaccctgcgacatctccgagaacacgtgcttgaccacgcggtcctcgagcgagtggtacgagatgacgcagatccttcccccggggttcgcccacctgacggcggcgcggagccccttgtcaagcacgtcgagctcgtggttgacctcgatgcgcagggcctggaaggtcttgcgcgcggggtgtccgccatgccttcgggccgccgcggggatcgcctgcttgatgacgtccaccagctcgagcgtcgtctcgatcggggccttctcgcgcctgagcaccacctggtgggcgatgcgtgacgcgaacttctcgtccccgtagacacggagaacccgggcgaggtcggcttcgttgtagtggtttatgacctctgctgcggttagggtgttgttgcccgggtccatgcgcatgtcaagcggggcgtcctcgtggtacgagaagcccctctcggggatgtcgagctgcggggaggagacgccgatgtcgaacaggaagcagtcgacgccgggtacctccgccttgaccaggagctcgtccagggagccgaagttccccttgaggaagcggtgctccgcccccgggacctcgccctcgaagcgcctcgcggcggcctcgagcgccatgtcgtcctggtcgatgccgatggagagtccgtccggttggatcctcttggccatctcgaccgagtgtccggcccctcccagggtgcagtcgcaaacgacctcccccggcttggggtcgagctcggccaagacctcgctcagcatgacgggaatgtgccgatattcttgtgtcaagcggtccaccccctagtcgtacatcaggctgtcgagctcgtcgatgctcgcgtccagctccgccacggtcttgtcgtagtcggcggcgtcccagatctcgaagtgatccgtgttgccgacgaccgcgacctcgcgcgtgatgtcgcacgaggcgagcgccgccgcgcccagctttccgagggcgatgcgccccgcagagtccagctcgaccgtcatcgtctttgcgttgagcaaaaagcgaaggcgctcgtccttcttgttgcgggggttgtagccgttgggaaagtagctctcgacccatgcctggtgaccctctggagtgaagccgaggatcttgcctccgaggggaatgaggcagactttctccccaaactccttgcgaaacggtgccggaagggtaatgcgctgcttggcatctagattgtgcttgtaggtgccagtcagatacatttgccctcccctcgcgctccgcagggcgtccccctcgaaaacgtgacacatactatagcccatttccgacaccctgcgacaccaatcgacactttaaaacacccaagcggtccaaatcgcccacccatgccaaaacgtggcctcgcggtggccccacatgttgtgagaacggatgtttggaaacacaaacgccgaggattgccaagcgcggcatccccggcgtttcctgaacgatttgtggtggaattgtgactgtgcccctgagctggccttttggggagaatatcgcgttttcccagttgagtggccctgttatggagcgccacggcgtgccacctgcggccctgcgcggtgggaggccgtcccactcgcgacacctcgcgacccctggcggtccaatgtggggtcgtggtgggaggccgtcccactggcaggcccgctgggacgtgtccttccgtcccactgacatcacgctggaggcccgccagaggcccccggctagacgtcctcgcccttctctacggcctcgccaccattggatgcggtggatgccccaccctggtccacgtgccccttctgctcgcgtgcgcgcgggtgcgcctcgaggtagaccatgcgcacgtgcgtcaggtcgatgtgggtgtagagctgcgtcgtggagatgctcgcatggcccaggagctcctgcacgtagcgcaggtccatgccgccctcgagcatgtgcgtggcgtaggtgtgtcgcagggtgtgggggtgcaggcccttgatgccaactatggcgccgtagcgctcgaccatgcggtgcacggcctggcgggtgatcctgccgccgcgctcgttgaggaagacggcatcgccggagcggctggcgttcgccagcacggggcgccagtcctggaggtacgcggcgagggcgcgcttggccgtgcccagtatggggacgacgcgctccttggagcccttgcccatcacgcggaccatctcgtccccgagcatcacgtcgcgccggtcgagcccgcagagctcggacaccctgaggccgcagccgtacagcacctccaggatcgccttgtcgcggtggaaggccgcctgcggccgcgcgtccaccctgcccgaggcgagcacctttggcgacggctcgagctcggggcggaacgggtcgtccagcaggctgaacacctgctcgcgcgagagcacctgcggcaggcgctcgggccgctttggcaggggcaggcccgcgctcgggtggttctgcgtgatctgctcccccaccatgaacttgtggaagccctttatggcggaggcggccctctggacggaagacgcggcgaggcccgcatcggtcagccccgcaaggtgggcctcgatgtcgagcctcgtcacgtcgtcgggggaggttatgttcttctcccccagaaagtctatgtagcgcctcaggtccctgccgtacgacgcgaccgtgttgcgcgagctcccccgctcgatggcgaggtagcccaggtactggtcgagcgcttcggcaaggtccatgggcaggatgccgctagtccaccgaggacgtcacgtcgtggcggtcgatgccctcgtgggacgcgatggacgcgcgcacgaactcgcggaagagcggcgccggcttggtcgggcggctcttgaactcggggtgggcctggcttgcgacgtaccagggatgcacggactcgggcagctccaccatctcgacgaggcggtcgtcgggcgagaggcccgagatgaccagacccgcgtcctgcagctgctgacggaaggcgttgttgacctcgtagcggtggcgatggcgctcgtagatgaggtcggcgccgtaggcctcgtacgcgagggtgtcgtgcttgaccttgcaggggtacgcgccaaggcgcatggtgccgcccttgtcggtaacgtcctcctggtcgggcatgagcgcgatgacggggtacggggagtcgggggcgaactcggcggagttggcgccgggcatgccggcgacgttgcgggcgaactcgctgacggcgacctggaggccaaggcagatgcccaggtacgggatcttgtgctcgcgggcgtactgcgccgcgaggatcttgccctcgacgccgcgctggccaaagccgcccggcacgaggatgccgtcatagccctcgagcgccgcgtcggcgttctcgctcgtgagctcgtcgcccgcgatgaggtcgatcttgacgttgtggccgaagtagacgccagagtggtgcagggcctccgtgacggagaggtaggcgtcgggcagctcggtgtacttgccgaccacgcagatcctggtggtgtcctcgagcttcgtgcaggcgtgcatgcggctcgtgaagttgtcccactcgctcatgtcgccgtcgcggacctcgaggccgagcttctcgagcgccttgacgtcaaagccctgcttggacaggtggcgcggcacgtcgtagatggaggggcagtcggagttctcgaacacgcaatcctcgtccacgtcgcagaagtgcgcgatcttggcgcggatgggtgcctcgacctcgtggtcggagcggcagacgatgaagtcgggctggaggccgagcgagcgcatctccttgacggagtgctgggtcggcttggtcttgacctcgtgggccgcggcgatgtacgggacgaggctgacgtggatgacgagcgtgttgcccgcgcccttctccttgcggaactcgcggatggcctcgacgaagggctggccctcgatgtcgccgatggtgccgccgagctcggtgatcacgatgtcggcgccggtctgctcctcgatgcggaagaagcgctccttgatggcgttggtgacgtgcgggatgacctgcacggtaccgcccaggaagtccccggcgcgctcgcgacggatgagcgactggtagatggcaccggtggtgaagttggagttgcgggtgaggttctcgtcgatgaagcgctcgtagtggccgaggtcgaggtcggtctccttgccgtcctccgtcacgaacacctcgccgtgctggaacgggctcattgtgcccgggtcgacgttgaggtaggggtcggccttctgcatcatgacgcgatagccgcgcgccttgagaagcctgccgagggaggccgcggtgattcccttgccaagtgaggagaccacgccgccggtaacgaagatgtgcttggtcatcttgagaccttcccgtaagaaatttactctacggggcttcatcttaatgccaaacggcctgcgacgccgccccgaatccggacaaatccaaactgcacggaacctgcgaaagtcccgcaggcgcggtccacgagccgcgtgccgcgagcctgcgctactccgccgcgcgggccgcctccgcgtccgcgagcatctgccgcgcgtggtcgagcgacgcctggctctggtcgccggagagcatcctcgcgacctcacgcacgcggtcctccccctcgacctggtggatcgtggtcctggggacgtccgcgcccacctttgtcacgaggtagtgcgcgtccgccatgacggcgacctgcgccaggtgcgtgaccacgatgacctggtgcgtcctggccaggcgcgccagcacctgcgccagcgcgacggccgtggcgccgcccacgcccgcgtcgacctcgtcgaacacgagcgtctccgtcgagtccgcggagccctgcaccaccttgcacgccagcatcacgcgcgatatctcgccgccagaggcgatcttgcggagcgggcgcgccgtgagccccgccgctgggcggtacatgagctccacgcggctcggcccctgcgggccccactggcgcctgggcaggcgctcagtcgcgacctcgagctcggcggtccccatcacaaggaacgccatctgctcggtcacggcctttgcgagctcgggcgctgcggcgtcgcgcaccccgtcgagggcgtcggccgcggcctccaggtccttctcggccttgtcgcgcgcctgctcggccttgcgcacgcgcttgccgccgtcgcgggaggcgcccaccagctcggccgcgcgctcgcgggcgagaaggacgtcctccatgcgcggaccgtagctgcggagcagcccctgcaacgcggccatgcgcgcctgcaggcggtcgagcgcctcggggtcgaagtcgatgccgtcctggtactcgcgcaggccgctcgccacgtcctcgatgtcgatcagcgcgctctcgagcgtgtcggcatacgtgccgagcgcctggtcgtagcgggccgcctcgcgcaggtcgcccaccacgccggagagcacgtcctccacgccgccgtcgccggtcacggcctcgcgagcctgtgcggacgcgcgcagcagcgcctcggcgtgctcggcgcgcggcagcgtctcctccaggccttcgagctcgcccggcttggggtccacctcgtcgatcttgcgcaggacgaagtcggcctcctccaccttgctgtccgcggcgcggctcatctcgcgcacgcgctcgagctcctcctcggcgtgcctggcggccttgagcgcctcttggtagcgcgtcagtgcgtccgccgcgtcctgccccacccaggagtccaggaggtccacgtggcttcccgtctgcagcagcttctgatgctcgtgctggccgcagatgtcgatggtcgcgccaacgccgcccgcgagctcgcgcacggaggccatgtggccgtccacgtccacgcgcccgcggcccgacgcctcaacgcgcctgcgcacgacggtcccgtccgggtcgccgccgcgcacgaagatcctgccctcgacctcgagcccgtccgcgccctcgcgcacggccccggcgtcggcgcgctcgcccatcaggagctttatggacgagaggagcgcggacttgccggccccggtctcgcccgtgagcacggtgagcccggccgccggccggatggtcgcatcctcgatgagggcgacgtttctgacgtgaagctcgtcgatcatgtggctattccttgccccttccgtagaacacgcgggaaacggactggtagaagctctttgagctgcggtcgagcaggatgaggtcgcccgggccgcggcggacggtcgccttgaccggcaccgcaccctcggccacgatgggctggccgtccgcaaagaacagccgctccacgttgcgctccgggttgatcttgagctccaccacgtcggtggacgaggtcagaaacgcgcgcgccagaatcgtgtgcggcgcgacgggcacgcagaccatgccctggaactcgggcgtcacgatggggccgccggccgccagggcgtatcccgtggagcccgtcgccgtggacaccacaaagccgtcgccgcgcagcgtgtccacgtagtggccggacaccgacacgtcgaacacgatcatgtctccgcgcgagccatgcgtgagcgagaggtcgttcagcgcgaagcgccgcttggtcaggcgcgcaccgtcctcggtctcgaactcgacctcgatgtcgagcgtcgtgcggtgcgacgcgtgcatccggtgcgcgatggcgtcctcaacggtcgaaatcgcgtcgtcgggacccgcgcaggtcaggaagcccaggtgcccgtaggacacgcccacgagcggaatctcgctgtagccgacgatcctcgccgcacgcagcagcgtgccgtcgccgccaaacgataccgcgagccccacacccgtggtgtccaccaccttgttgggatagagcttcttgtcgtgggcccactgcacctcgacgtcatgggccagaagccagccctcgagctgcttggcgcccttcatggcgtcggcacgcgcgtagttggggaccaggagtaccttcacgggcgaccacttccaaccgtcttgggaaatcgtgcaagacgagtgtatcacccgcgcgcgcaagaccgctcagcggccgcgcgaaagcgccacctcgccgcggagcgcgacggcgtccaggtccaggtcgcacgtctccggcccgggggcgcccgtccttctccccaaaagcaggaactcgcggttgcccttgtggcccgtgatggggctggggcacgcgccgacaggctcaaggcccacggccgcgaacgcctccgcgacctcgcggagcgtccgcaggtgcacggcggggtcgctcacgactccgccctcccccacctcgtcgcgcgcagcctcgaactgcggcttcacgagggtgagaaacgcggagccctcgggcctcagcatctccatgaccgcggggaggaccgtcttgaccgacgtgaacgagacgtcgcacacggcgaggtcgatcgtgttgcgattggagtcgtctggcaggtcgaccatgttggtgcgctcgcgcagcgtgacgcgtgcgtcgcggcgcaggctccagtcaaactgcgcgtagcccacgtccacggcgatgaccgacgccgcgccgtgcttgagcaggcagtccgtgaagccgcccgtggagcatcccacgtccaggcacgaaagcccgctcgggtccacgccaaaggcctcgagcccgcgctcgagcttgaggccaccgcgccccacgtatgggatgtgcccgcgcacgtgcagcgctatgccgggcgccacctgctcgcccgggaacgtgagcctccggtcggaggtggacacgtcgcccgcgagtacggcgcgcatggcgtcgtctgtggtggagaagaacccctgcgccaccagctcggcgtcaagccgcctgcggcgcgccaccctaggacttcccctcggtcggctcgtccgtgcccttctcgcccgcctcggcaggcgcagcggtgccgttctcggcctccttggccgactcgcgcagcttggcctcctcctcgggcgtgaagtccgtccggtcgaccatgtccacggccttcgacccgagggcgatcgcctcgtcgaagaggtcgagcgagcgctcgagcgacgtgtccttgtcgcgcacctgcgacacgatctggtcgagcctgccggttatctggtcgaaggtcttgtacgcggcggtgtccggcttggccatcgctactcctcgggctcctggggctcggccgcgtcagcctctgcctgggcgtcgccctcgaggggctcctcgtccgcatccgcgggctcgtcaacctcggcctcagcctcctgctcggcgcgcttcttggcaagctcgcgagcctccgcgatcacgtccgtgccgttctcgagcttggtcgccacgcggccgaggacgccgttcacgaagcgcgaggactcgtcggagccaaaggccttcgcgagctcgacggactcgtcgatggtgacggcgattgccacctcgtccacctcgagcatctcgtacagcgcgaggcggagcaggttgcggtcgacggcgggcatgcgcgaaacgctccagttggaggacgtcgcggagatgaccgcgtcgaggtcgcccctcatgtcgtcggcgccacgggcgagcatctcgccaaaggggtccagcggaccctcggacagcgcatagtcgccgccctcgaggacctcgtgtaccgtcctgtccgtcgcctcggcctggaagaggagctgcagggcctggcagcgcgcaagcgtgcgcccgccaaaatgaatggacttctcagacactttttgggttactccttgggaaagacgaggctgtcgatgcagacgtccacggcgcccacctcgacgccgacctgctcgttcacggcgttggcgacggcctcgcggaccgcggccgcaagcttggtgaagggatagccgtagaagaccgcgaggtgcacgcagaccctcaggctgccgtccacgacctcggactcgacggcggcctccggggacacgctcctgctcgtgaagaccgagacgaggttggaggcgatgtcgttgcctcccacgcgcgccacgccctcgaccttctcgcaggcgcagctgacgatcgtcgagatgacgctcttggagatgccgataccggcgacgtagagctcggtttcgctcatgacccgtcctttctcatgtgtcgctgccgacacaaatgccttgcacaagtatagtcgctcgccaggaggcgcgctgcgttccgctagcgaaaggcccgcgttgcgccgtgcgcagccgcgggccctcagactatccgcaggatacgttcaaaaccgctagacgcgctggacaaacttgccgtcgcgcgtgtcgaccttgatcttctcgccctggttcaggtacatgggaacctggatgacggcgccggtctcgatggtggcgggcttggtgccgccctggacggtgtcgcccttgaagccggggtcggtgtccgtgatctcgacctcgatgaaggtgggcggctgcaccgcgtacaggacgtcgttcgcgtactgcagcaggcaggtgtcgttctccttcaggaacttgtcgttgtcgccgatgagctccttctccacgggaatctgctcgtaggtctccgtgtccatgaaccagtaggagtcgccgtcgttgtagaggtactgcatctcgcgggtgcgcatgtcgacgctctcgaacttcgcggactgctggaagttctcctcgttcacgcggccggtgcggatgtcgcggtacttcgtgcggacgtaggtgttgcccttgccgggcttgacgtgctgtgcctcaagaatgacgcagtccttgcccttgatgttgacgcccagacccaccttgaggtcagtaatgcccagagttgccactgttgcctactttctgcgtacaagcgcgcccaaccacggggcgcacggattcacaacgaaccaatagtgtagcccacaagcgaccccacgccatccccatatgcgcagctccacatatacaacaggcccatggtggctggggcatcgcctccgtcaccatgggcccgttgggcctcgtctcgtatgtggcgagaagaaccgactacttgcgcttgaacacgctcccaaacgcgccaggaatccccttgacgccggccttcgccacctggaggacgttgggcgacttgaggagcctgtccgccggcacgtgctcgcgaatcgcacgcagcgtggccttgttgtcgcgggtggagaaggtgaagtgaccgttcctcttcgtaaagatcgcgaagcgcgtgattctcttcttgccaatcacctcggccgagacgtagtcgacctcctcccaggggatctggatgaagtcctccttgttcttctcgttatagaactcgaaggccttgtcaccaaccatcacgtcgccgtaggtggtgaacccctgcaggaacgtggccctctcggagtactccacgttcgtgttcatagatattgccatggcgtccaaccccctcgcctatcgggcaatcgccccttgcgtacacaagaggccgcacccccatgtggccaaacgagttcagcttaggggatgcggccttgattgcaaagcccactcgcgatccttcgcgagaagaactccttacatgaagccgatgacgcgaccgaggataccaacgccgaagaggcagaggatgatgacgatcggggagaccttcttcttcaggagcttgcagacgagcagcgtcaggccgagagccgcaaggcccgggatcagagaatcgaggttctgctgaagggtcgtggtcttggtcggcgtgagggacaggccctggttgaagtactggtcaaacgcggactcgatgcccttgtagccagccgggagcttgttccagtggatgtaggcagcgctgtcgagcttcacgttggagacgaccggggtgaagctgatggagacccacttctggaccagtgcgccgatgatgaacataccgaggatggaggcgccctcagtcaccctgccgagcaggccgccagagaggtccttcgaaatgtcggtaccgaccttgtagccgaactcctgcgagtaccacaggaaggcaagacggatgatgttccaagctatgaagaacagcagcgggccgacgatgctgccgccgagggcgagcgatgcgcccagtgcgccgaggatcgggcgaaccgtgtaccagaacagagggtcgccgacgccggccagaggacccatcatgccgaccttgacgccctggatggcctggtcgtcgatgggggcgccgttagcgcgctcctcctccattgccagggtcacgccgatgacgggggcggacatgtacgggtgcgtgttgtagaactccaggtgacgcttcagcgcctcgatctggtcttccttcttgggatagagcttcttgatggccgggatcattgcatagcaccagccgccgttctgcatacgctcgtagttccaagagccctgcaggtactggtgacggttgcagactgcacgacgatcagcgacggtaaggtgaatgccgttctcgttcttgatgtcttctgccattgctttcactccccttcctactcgtagtcgtccaggatgtcaccgagcgggtcgccagagccggcagtggagccagcaccctgcttagcgagctccttgaggccgaggtagatgatggcgaggcagccgccgatgaggccgagggcgatgagggtgaggtccttcagggtagcgaagacgaagccgaggacgaagaacggccaggtctccttggtagccatcatgttgatgaccattgcgtagccgacgcaggcaaccatgccgccgccgaccgtcatgccgccggacagccaagcaggcattgcctcgaggacgccggtgacagcctgagcggggatgaagcaaagcgcggccgccgggatggcgatacgagcgccctgcatgcagatggcgccgatctggagacggtcgatggcgccgaagtcgcccttctcggccgcggcgtccatgccgtggacgatggggatggcgagcgtacggcagatcatcgtcaggaacaggcctgcgacggaaagggccgtagcggcaccgattgcggtgttgatggcagcggtaacgtccttggtgccgccgttgagggcgagcatcaggatgatgccggaggcgacggaggcgagagccgcgtcaggggcgacggcagcgccgatgttggcccagccgagtgccatgaactgcaggctgccgccgaggatgatgccctcggtggggtggccgcagacgaggccgatcagcgtgcaggcaacgattggctggtggaactcccactcgtccaggatgccttccatgcctgccaggaatgccacgatgatgacaagcacgatcgaaataggattcatgaacttcctccttctttctatcgaggcccttaggccatgttcttctctttgagaagagcccagatgtcatcaaccttgtcgctcggcaccttctgcacgtagaagtgcgtgccgttgtcgcgaatcttcttgaggcactcgacgtcggccgcatcgcaggcgattgcctggttgacgacggtcttgccggcggaaccggccatggagccgatgcagacctccgggaacttgacgcccttctcctccgcctcgagcaggtcctgcggggtctcgaagaggaccattgccttggttgcgccgaagcgcgggtccttgtcgacctggacgagcttgtcgatggggatgacgtggacgtggactcctggaggggccgcctgcacgatcatggtcttgcgcaggtcgtcgtgggcgacgccgtcggacacgacgaggatgcggtccggctggacctgcttcgtccatgcggtcgcgacctggccgtgaaggagcctggtgtcgatgcggacgtaagcgtacttgatgtgaccgtcaccaagcaccgttccctcgggaatggcaccctgtgcgaccggcttggccgctgcagccgcgggggcagccgtcttgggctcgagctcctccggcttcaccttgactccgtcacgcgcctccgagaagacctcctgcatcacagcgacggcggtgtcggcacccatgcgggcaccatacgccgagacgagcatcggcaggttcaggccggtaatggcgacccaatcgtcgtgcccctcctcgctgatgagacgggagacctggttgaagggagtacccccccacaggtcgaccaggaataagacgtgctcctggtcgtcgaaagtggcgatcgcgtcaagcagcttcttgtgcatgtcgtcgggacccatgtcaggcgtcaagacgacggccgcgacgttcttctgcggaccgaagatcatgctgcccgattccatgatgccctcggcgaacttgccatggcttgctaggacaatattgaccatccaacttcctcctttacgtccactctgcttcctacagatccaatgcggcacgcgtgcaggcttcacgtcttccttaccaattgcgcacgattgctccacatcggggaatagtgtacaccatgtggactgaaaacgcttccataaaggtaatttgccgcttggcgatttggtccattccaaaagtttggtatctttacctgccatttaaacgaaaaagtgcccgacagacaaaaccgtctgtcgggcagcaattgactcaacctgaattacgtgttaacagtcgataacgcgcaggtcgtgagaagagcggccgaacggcttgtagccgtcctcggtgatgacgcccgtgtcctccaggcggatgccgaacttgccaggcaggtagatgccgggctcgtccgtcacgacggaaccgagcgggcagggcttgtcataggtgcggccgaggttcgggcgctcgtggatctggagtcccacgccgtggccgaggccgtgcttgaagtagtcgccgtagccggcgtccgagatgaccttcaccgcaaggtcctgcatgtccttgccgatgacgcccgggtggatggcggcggcgcaggtctcgttcgtgagcctcaccacgtcatacaccttctgctgctcctcggtgggctcgcccagcaccacggtgcgcgtcatgtcggcgtggtagtcgtggtagccagcgccgtagtccatcacgatcatgtcgcccttctgcaccttgcgctcgccgggctgcgcgtgcgggttggcaccgttggggccgctcgcgatgatgctgtcgaacgagatcgagtccgcgccgtgggtgagcatgtaggtctcgagctcgaccctgatctgctgctcggtcaggccgggcttgatgtagccgcagatgtggtcgtaggcgtcgtccgtgatctcctgcgcgcggcggagcagcgcgagctcctcctcgtccttcacgacgcggagcttgtccgcgatgtcgtcgtgcatgcgcgggttgaggcagtcgacggaggccttgttgcactcccgcctgaacgcgtcgaagaacgcgaggtcgagcgagtcctccaccgcgacgacgcggctcttggtggcgagcacgcgctgcgccgcccaccatgcggggctcacgatgtccatgtcgatggtccagccgctgtcgtcgcccatgcgctccaggaacgtgccgtagtagcgcgagtccgtgtgcagccagaggccgtcggccgtgatgaaggcggtgtgcgcagtctcgtcgtcaaacgtgcgctccgcgcccgtgagccagcgcaggtccgggttgttcctgatgatgacggcgtcgtagccgcgctcccccatgagtgcgcggagcctctccacgcgcttgaggcatgccttggtgtctgccattcccgttcttctccaatcgttatgagttggttgttgccagattgatagccggtgtgggcctagtcgcgctcggtggcgtgcgcctcgcaccatgcggtgaggttctccatcatgagctcgtcctccaccaccgtcatgcgcaggcggccgatggagtgcggcaggcacaggtggaagcgcgtcgagcgagagaagcggtcggccttcatggcggccagcagctcggcagggtccacctccccctcgaactcgccgatgctcagggtgtcgagcagctcgtcctgcatgagcacgtcgtccacgtccatcgcgtcgaggctggcggataccctcgcggcaaagcgcatggcctcccccagcctggtggacgcgggtacggtgccgccagtcagcttgtcgagcgcgcgggcgaacgtctgcccgtacagcagcgagttccgggacgagagcgacgtggaggacaccaggtgcccacgcgacttgagcgtgtcgagcgccgcgtcgatcacgtcggcgtcgccgcccgtcatcacggcgtcggctttgttccacagcgcctcgaacgtgtcctcgttctcggcgatggccgatgccaccatgagcgcgcgaccgagccgcgacgtctcggcgtcgggcgagaggtccatgacacccgggtcgcagagcaggtacttggtgtacgtggagatgccggctatgcggctcacgccgccgacgtcgagcatcctcggggtcgtggcgacctcgaccatggcgtccaggtcgagcggcacggccgcaaacggcactcgcccgcaccacatgccgcacgcctgcgcgagcatggacagcgtgtccacgtcgcccacgcccagcaccaggtcgtcggccgtgatgcccgcgtcggccaggttcccgagcgcatccgtcagcgcgggcagggtcctggccacggggccggccggggcggacatcctgcgcaccttaaagccgccgtccgtgagctggcgcctgatgcgctcctcgagctccgggcccacgccctcgcccaccacgtaggcgcacaggtgggtccttcccacggcggacttcaggagcttccccatggtctcgaccacgtccgtgccatagcgcacgtcgcacgacccgccgggggcgctcacccactggcgtgccacgtcgtcatacctcttgcttgcgtcactcatagcaggcccttctcccacagcagctggcccgcctcggacgccacctgcttgaacgtcttgttcctgatgtcgatcgttatgtcggcctcgcgctcgtagagcggcctccgcgcgcggtacaggcgcctcgcgcacccctcgtccttgaagtcgggacggatctcggggtgctggatctgccgcagggagtcctccacgtcgccgtccagaaagacgaccgtgcccatctggtgcatgagctcgcagctgcgcgcgccctccacgatgccgccgccgcagctcacgagcagcgacttgcgcccgcggagcccctcgagcacctgcgcctcgagctcgcggaagcgcgcctcgccctcgctcgcgaagatctggcacaccgacttgccgcacagccgctccacgagccggtccgtgtccacaaagtccctgttgaagaggcttcccaggttccgcgcgagcgtcgacttgcccgcgcccaggaaaccgacaaaaaatatgtggtcgcagccctcgtggaccacgtaccccgtgtcgctctgttccatgtaaagacccaatgctatcgtctgcttttcgagacgattctagcatcccgtgccgccggctccgccctcagctgccgtccccataggtcttccccctcagcacgacgcgctcccctatcctgaagagctgcgtgtaccagaggtcgcgcctcgactgcggccgcaccaggatggtgcgcacgcccgcgaggtttccggccagcatgtccgtgaagacctggtcgcccacgaggaccgcctgctcgcgcggcacgcccagcttagccagggccacgtccacggcaaacggcgcgggcttcatggcgtggtgcacgcagcccatacccagctcggccgcggacgcgcgcacttctcccccatggaagttgttcgagatcatgcacgtcgctatgccggcggcgcgcacatcgtcgacccagtcgcggatctcctgcggcacctgccacgtgctccggggaaagcacgtgttgtcgcggtcgagaagaacggccctcgtgccccagccctcgagcagggccaggggtatctcgtccacgctgccaaagtagcggtcggcctcgaggagcttcatgctagttgctgctcttgctcgagccggagctgctctggtcggacttggccttcgcgatggcctgctgatgctcctcgtacgtctcggagaacgtgtggttggagtagctgccgttctcgatgatgaggaagtagtagtagttggtcttcgcgggcgaaagcgcggcctggatggacttgatgctcggcgtgcagatgggcgtgggcggcagccccttgttgaggtaggtgttgtaggggctcgactgcttgaggtcatccgccgtgacctccccgcccgtcacgtaggccatggtcgcgtcgctctggagcggcatgcccttctgcaggcggttgtagaacacggaggccaccttggtgcggtcgtcgtcgttcacggcctcgcgctcgatgatggaggcgatcttcagcacgtcgtagtcggacacggtaagcccgtacgtgctcttgatgttggcctcggcgatcgcgaagtcgagcgatgccacgttcttctggtacgcgtccagcatggccgtgatgaccttgtccgccgtgaggttcttctcgctcccgaagtcgtacttctgcgggtacaggaagccctcgagcgagtcgttctgcacgttggccaaaaacgcgtacttgtcggagtagttgcttgcctttgcctgcgcctcgaagtcgctcgcctttatgccgagcgacttctgcacgagctcggccgtcttcttgaccgtgaggccctcggagatcgtcaccgtgccctttgacgagttggggcccgtgacgagcaggctcaccacctcggacacgtcctcgcccgtcgtgaagttgtacgtgccgctcttcatgctcgagtcggcgttctggcgcttgacctcggtcgtgaacgtctgctcgtcgctgatgacgccggcgtcgagcaggatcttggcgatggcgctgccgccggagccctcggggatgttcaccgtgacgctctggccggccttggtggtcttggtcttgctcgagcccatgagccgcggcaccacgagcacgcccgcgatggccacgatcgcgaccgcgatcagcacgaagggcagcaccctcctgcggctcctgcgcctgtccggcttcctctcgtgcctgccgcccgcggcgccgcgcgccctgcgcgtggtctgcgcggtgcgcgacgacatgtgcgacccgtttgcggagcgcacgcccgtggcgcccgtgcgcgatatgggctggcgccttccggtggcaccggcgggagcggcctgtgcctggcgacgctgcggccttgcggcccgctgcctgcctgcgccggcctgcgtggcctggccctgcgtcgggcgagaaggacgcgcctgcccggcccgggccgcctgcctgcggccggcgggggcgttgcccgacggtctgttggagccgcccctcgcgaagtgggcgcccctccttgcgctgctgtcagacatgtgtgagctaccccctatgggcgtcgagccaagtctgcaggaagagcgacgcggccaccatgtcgacccgaccgcgcatgctcttctcgctcagtccctgttccctaaggatacgcttggcctcctgggacgagagcctctcgtcctcaaactccaaaggaagcccgcaggcgtctgcaatctgtctggcctgggccatgatcctctgggcctgcgggccatcctcgcccgcaagcgtcttggggcgcccgcacacgagcacgtcgggctcgtggtcctgcacgatgttccggaaggtccgcgcgttctggagcacctccgcagcgggcagcaccttcacgggcacggcgatggtgccagaggcgtcgctcgccgcgatgccgatgcgtacctcgcctatgtcgagcgcgagcgccctcacacctgccccttacgccccgaggagcttcttggcggcgtcgagcgcggcgtcgatgccggaggcgtccttgccgccagcctgcgccatggtcggcctgccgccgcccctgccgccgacgaggccggaaatctccttcacgacgtttccggccgagaagcccgcggacacggcgccgtcggtcgccgcggcgagcagcgccaccttgccgtcggcctcggacgcgagcacgcaggcgcagtccgcgccgatcttgtcgcgcagggtgtcccagacgttgcgcaggtccttgccggagatgcccttgaggtgcgccacgacgagcttgtaggcgcccatgtcggtcgcgccctggagcgcgtcggacacctggttggaggagccgcccacgagcgcggccttgagcttcttctcggcgtcggcacgctcgtccttgagctgctccacgcgggcgagcacgtccgcgggacggcacttgagggcgccggcgacctcgtccatctcggccagacgctcgtccacgtactcgagcgcgccggcggaggtgacggcctcgatgcggcgcgagttggagccgacggagctctcgctcacgatcttgaagaagccgagctcggcggtgttgcgggcgtgcgtgccgccgcagagctcgcgcgagaagggcttgtcctcggtcccgacggacaccacgcgcacgacgtcgccgtacttctcgccaaagagcgccacggcgccggaggccttggcctcctcgaggcccatgaccttggtcacgatgggcttagccgcgaagatctcggcgttgacgaggccctcgatgcgggagagctcatcggcggtgacggactcgaagtgcgtgaagtcgaagcgcagcctgtcgggggccacgagcgagccggcctggctcacgtgctcgccgaggacggccttgagcgccgcgtcgagcaggtgcgtggccgtgtggttgcggcggatgagctcgcggcggccgtggtcgacggatgcctcgaccttgtcgcccacggcgacggtgccgctcacgacctcgcactcgtgtgcgatgaagccgccctcgcggtgcttggtgtcctcgacgcgcagctcgacgccctcggccgtgagcttgccggtgtctcccacctggccgcccatctcgccgtagaacgtggtcttgtcgagcacgacctcgaccttctcgccctcgtgggcgtccttgacctcctggccgtccctcacgagcgcgacgacctcgcagccgtcgagcacgtcggagtcgtagcccgcgaactcggacgcggagaggcggtcggacagcgccgcccagacgttgttggccttgccccaggcgtcgcggttcgcggtcgcgcgggcgcgctccttctgggcgtccatctcgcggtcgaaggcctccatatcgaccttgtggccgcggctctcggcgatctcgcgcgtgaggtcgatggggaagccgtaggtgtcgtgcagcttgaaggcgacctcgccgggaaggacggcgccctcgcccagcttgtcgagctcgttgccgagcatggcctcgccggcgttgagcgttgcgccgaagcgctcctcctccgccgtgatgatgccgtcgatgagggccttgttcgtcacgatctcggagtagtgctcgcccatgatgcgctcaacctcgtgagcgtacttggtgaggaaggcgccctcgatgccgagcaggcggccgtggtagacggcgcggcggagaaggcggcgcagcacgtagccgcggccctcgttggagggcaggatgccgtcgccgatcatgaacgtgacggcgcgggagtggtcggccaggatgcgcaggctcttgtcctgcggctccttggagctgccgtggtactccttgccggagaggcgctcgccgagctcgatgagggaggtcatgacgtcgccctcgtagttcgagcccttgtgctgcatgatggcggccatgcgctcgaggcccatgcccgtgtcgatgttgcggtgcgggaggtccggcatggagccgtcctcctggcggtcgtactgcgtgaagacgaggttccagaactcgaggtagcggtcgccgtcgtcaccgggcttctcgccctcgaactcgggaccctggtcgaagtagatctcggagcaggggccgcaggggccggtcgggccggcagcccagaagttgtcctcctcgcccaggcggctgatgtggtcgtactcgacgccgtgggagtgccacagctcgacggcctcgtcgtcgtccttgaagaccgtcatgtacaggcggtccttgggcaggcccaggtggtcggggctcgtgatgaactcccacgcccaggcgatggcgtcggccttggtgtagccgccgaagctgaagttgcccagcatctcgaagaaggacaggtggcgcgcgtcgccgatgttgtcgatgtcgttggtgcgcaggcacttctggcaggaggtcgcgccaatctccttcatggtcttcgtgccctggtagtactccttgaactggttcatgccggcgttcgcgagcagcagcgacgggtcctccgggatgagggaggaggacgggtagagcttgcagcccttgccctcgaagaacttgaggaagtcgtcgcggatctccgcggtagtcatggtcttgtagtcagcagtgctcatggttctccttgtagtggccgcgcggggcggcctcgtcggcataattccgctagcgaataatactacgatttgtcaggttcgttgcaaacgcgcaacacggctcagccgttcttctcctcatcatgcgcacggtccgcgccgcgcttgccgcacctgtcgaagcgcttgcaggcacggagcatcgcgtcggacacgtggccccgcttgcccgcgggcggctcgtccgcgacgggcgacttggcccctgtggcgtccacgagcctcgagctctcgaagaaccggtcgtcgtccagcgcgtcgaaagccggctcgacccgcccgtgctcgtcgtggaacggcgtcccctggaagatggcaccgtcgtaggagacgagccggcgaccgctgctcgactcgaagtagtacacgaagacgctcttgatggccgcggtcaggggcaccgccaggatcatgcccaggatgccgcccaggcagttgccgatgatgaggcccagaagcgacagcgccgggtggatcttcacggcggagcgcatgacgaggggcgacaccacgttgtccgtcacgttctggatgacgatggagccgacgagcgtcacgagcgcgagcatcgggttgtcgaagatggcgaccagcacggcgaacgccacggcaatccactcgccgatgacggggatgatgtgcaggaaccccacgaggatggccgagaggcccgcataggggtgcccgatgagcgtgaggaagacgaacgtgacgaccccgtcgaacacggacgtgatcacggtgccgcgcatgtagccgcccatggagcggctcatgacggcgagaaggacagagaatccctgctcgtggcgcggtcccgcgatcgtgctgaactcccttgcgatcgttgggtagtccttggcgaaccagtatgcgaggacgaggccgaggagcatgataccgagcccgttcacaaacgagaacgcgctgctcataaggccggtcgagagcttggtcgcaagctgggaggacagcttgacgcccaccccggagagtgtgctcacgagctggttcacgctttgctgaacgtccttggtgttggcgtttccgtagtgggtccagaattcgttaagccacgagcgaaccctatcggcataggtgggtacctggcccagcacctctccgagctgctgcacgaagggcggcgtcaggagcacgagcacgacgaccatcacggcgatgagaacgagcacggacagcagggcccccagcgccctgctcatgccatggtcctcgaggaagttcgtgagggggctgcagatgaaccccatgatcgcgccggcgagcaggagctccacggccgaccagacatagcccatcgcgagcacgcagatcacgaacactatcgccacgccgatgaaggcccacgccctcacgccgacgcacttcgcccgggcgagcttgtcagcccgtccggacgtcggatttccctcttcctgttgctgcaccatgcctccacgcgccccgtcagcgcatcagcccgtcggggtcgatcttctcctgcaccttcttgagcgtcctgcggaggaggcgcgacacctgcacctgggagatgcccagacgcttggcgatctcgacctgcgtgaggccgtcgatgaagcgcatgcggatgatctcctgctcgcggggcgagaagtccttgatcgtgtcctcgatgaccatgcggtcgtccgaggccgccaggtcctcgtcctccgtcgcgtagtggtcaatgacggcgggcgcgtcgtcatcgtcgccctggcccgttccctccagggggacggagctgtacgcgctcgaggactccatggcctccagcacctcgtccaccgaggtaccgagcgcctttgcgatctcctcgacggagggcgcgcgctgcaggtccttggtgagctcgtcaataacctggttcaccttggacgagagctcctgcagcctgcgcggcacacggaccgaccagcccttgtcgcggaagtggcgcttgatctcgcccaggatggtgggcgtcgcgaacgtcgtgaactcgaggccgcgggacaggtcgaagcggtcgatcgccttgatgaggccgatcgtgccgacctgcacgaggtcgtccaggggctctcccctgttcttgaacttggacgcgaggaacctgacgaggttcaggtggctcatgatcagctgctcgcgggcgtcctcgtccccgtcctccttgtagcggcggaagagctccctcgtgcggtccttgtcccacgcgagcttgcccttgggcatccgctgggacgagagcctgccacgcgggcgcacggcgtgcgtctggtcgctagcgggcatcggcgccaccaatcttcttgacgagcctgagggtgtgcttctccgtgacgtcgcagctgtcgcagaccgcctggagcagcagctgcacgaggctcaggtcctcggcgccctccgcctcggaggcgtcgcggtcgccgagcgagaagtccatggacacctcgtccggggcaagcccgaacctgatgtcgcactccgccggcgccgtcgcgcagctgtagacgaagccctcctccgcggccatgcgcaggtcgtcgacctcgtccacgttcatgtcgcacagcaccgcgaggtttgcggccgtcatgcgcacgacgcgcgcgaactccgcctcggcgggaacgctgaggctgatgctcttctctgccatgtggttctctccctattcctcggacgcgctgtccgtcgcatccgatgccttgtcctggccggcctccgccttgggggcgccgtacgtcacatagccgacgttgcgcggctgctccgcgggagctgcctccgcctggggctccgccgattcgggctcgccctcgcggcccttgccctcgatcgcgtgcggggcgtcagccccggcgccgcgcaggtggctggggcgctgctggggcacgcccgtgagcttggacacgacgtggctcacgccgtccgccgcggccgtggtgacctggttgaccgcgtccgtcacgccggcggccgtgccggagaccgtcgagacgtcgcccaggatgccgttcaccctgcgcaggctctcgttggcctcgtcgagcgcgtcctgcgccttcgcgaccatggggtcgacctgcttgatgctcggctgcaggtcgtccatggcaccgtcgagcttcgcgatgacgggctggacctgctcgatggtctcgttcgcggagcgcgcgacctcgtccaccgcgccacgcgtcttgcggatggtgagcgcaagttccacgagcgcccagattcccgcggcgaccagcacgatcagcaggatgctcaggggtgacatctccatcgccttgcccttctcccttggttgcgggacgccccgcctaccaaacttcgcttgaacttcctagattctacccattcgacttgggtttgccacgcccgcgtccaccggcgtcctcgaggtcctggcggtcgcgcgcgctggcctcgacgcgccacgactcccagccgcggccgctcggcctgtagaacgcgccgcgctcgagcccctcaggcaggtagcgctgctcgacccatccgagcgggtagtcgtgcgggtagaggtactcgccgtagttctcggagccggggcggtggcggtcccgaaggtagctggggacctcgcggcgcgggccctcgcgcacctccttgagcgcggcgtcgatgccggcctccgctgcgttggacttgggagcgagcgcgacgtagatcgccgcctgcgcgaggttgatgcggcactcgggatagccgatgacctcggcggccctgaaggcggcctccgcgacgaggagtgcctggggatcggcgttgccgacgtcctcggacgcctggatcatgatcctgcgcgcgatgaacttgggatcctcccccgcgtcgatcatgcgcgcgagccagtagagcgcggcatcggggtcgctgccgcgcatggacttgatgaaggccgatatcacgtcgtagtgcatgtcgccggccttgtcgtagggaaggccgtgccgcgggttggcctcgagcacgtgctcggccgtgatcgcgatggggaccgcggacgccgtggtcccgtccttctcgcccgcggcgtcgccactggccgccccatcgagcttggccgcgtcgtcggggctggcggggccgtccttctcgcccgcggtgggcgtggccatctggctcgcgagctcgagcgacgtgagcgccgcgcgggcgtcgccgccggccatggtaacgatctcctgcagggcgtcgtcctcgagggagaacctgcccgcgaggccgcgctcgctcgcgagcgcgcggcgcacgatggtgcggatcgagtcgtcatccaggggcgacagctccacgacccgcgacctgctgatgagcgcggagttgacctcgaagtaggggttctccgtcgtggcgcccaccaggaccacgacgcgatcctcgaccgcgtgcaggagcgcgtcctgctgcgcgcggttgaagcggtggatctcgtccacgaagaggatggtgcgccggccgcccgtgagcaggcgcctctcggcggcgtccacctcgcggcgcaggtccttgaccgtgcccgtgatggcggagacctccacgacctcggcatgcgtggtgttggcgatgatgcgggcgagcgtcgtcttgcccgtgccagcgggcccgtacaggatgaccgaggatagcgtgtcgtgctcgatggcgcggcgcagccacgagccggggcccacggcctccgtctggcccacgtactcctcgagcgactgcgggcgcatgcgcgcggccagcggtgccatctgctgcctgagccgccgctcctgacccgagaacaggttgtccatgcgccctcccctacggcctcacgccgtcgaagtagctgcggttggggaagatctgccgcgcctcggggaagacggcctcgcaggtcgccacgaagtagtcgtccgtcatggcgctgatgaagtccaccacgcactggtcggggtcggactcccagtcgtagctgcgcccgtagtacccgaggcgcctgttgatggggccgatgtggtgcctgaatatggcggagtcctccgccccctcgcgcagcgcctcgagctcgtggtcgtacagcttggagaagagctcgcgcaccgggcccgcaaagtcgccgttgacctcggccgagccatagatcttctcgtagttctcgcgcttggcgcgcgcgagctccgcgaagccctcctcgctcatggcgatgtagggcttgccgaggctctgctccaccacgtcggtcacgaacgcggagagcgcccacgcgttgtaggcgccgccgagcccgtcctcgaagctcttctcgtccgcaaggcccgccctgatggcgtcctggcggtccttgcccacgtaggcgatgatgtcggatatgcgcatgacgcagccttcgagcgtcatgggccgcaggtgcgatatggcctcgtcgccggactcccagcagccctcgaccacgcggtcgaacgtgtcgaagtcgttgaggccgctcgtctcgaagcgctggcgctcgaactcgccgttgtgacagatgacgccgtcgagcgtctggagcgacacgttgcggccgtcgagcacgtcgagcacgcgcacgctctgcacgttgtggcggaaccaccggcccgtgcgctcgtggaagacgtcgttcaggaagcgctcgccggcgtggccgaagggcgtgtggcccaggtcgtgcccgagcgatatcgcctcgatgaggtcgaggttgagccccagggcgcgcccgatgtcgcgcgcgaccctgccgacgagctgctcgtgcaggccgcggcgggtgatgtcgtcgttctggcggaacgagaacacctgcgtcttgccgttgaggcggttgtacgcgggtgcgtggacgatcttctctatgtcgcgcacgaacgcggggcggatcacggtgtcgttgtcgcgctccgcgacgtcgcgcctgatgacggccgcgtcggcgcaggcgtagtggctcatggccccgcccctgcgcatgtcgcggatgcgcgcctcggtctcgggcgagacgcgcagcggcatgtgcggcgccatgcggttgatcccctcgccctggttctgcgttatggacatgtgacacccctctggtcttctttagcaccgcataccctaccgcaaacggcggacgtcattccacaaatctgttggttgtgtgacggatgcggcacggacggcggctactcccccaggagccagcacgcctccgtggccggcagcaccgtgaagccgagcttgcgcagcacgcgcagggccgcggcgtcggcctcgcccacgcagcaccacggcgtgcggccctcccccagcagctggttggccttggccgccacgagcgcgcccgcccagccgtggcgctggtgctccgggaagacctcgagcgcgtccatcgcgccccacgggtcctcgcccacaaaggcgacaagccgcgcgtcctcgtcaaatccgcccaggtagcggccctgccgcagcagctcgagcgtctgctcgtcgctctggcgctccgggtgcgacatcctctggcgcacggccgagaggtcgccctcgcccagcgggcggatcagccggccgctgggcaccttgacgctcgccttgcgcttgagcgtcgccacgtggcaggcctccctgcggccgagccccagcgccagctggaggtcgtccgccacggagggctccaggcagagcacgggctcgtgcggcatgagcacggacgccacgtcgcgcgccaggacggcgtcgtgcccccaggccatctgcacgccgcccgccgcgcggacggcgaccatgccctcctcggcatgcgtgacctcgccaaggcccctggccaggcactccgccatgggaatcgtgcgacgcggcgcgcgggcgagaaggtcggccgcccttctcgacagctcctccctgggctcggccccggcgtccatcgcgagctccaggcggcgcgctatctgggcgcagccctgcgcgccggggtgctcgtagccgtcagcgaggagcgccgcgtcgtggtcgaggaggccggcaccctccaccacgcgcatctgcccaaactgctcggcctgcgcgcggatgacctgcggcacctcggcaaagcagctcatcttgtgggatgcgtacgcgtcctcgttgtgccacatgggcgtgagcacccacgtggggacgtcgccccagaggcgcgacacctccgccaggtacgcccgcacgtcgcggctcaccaggcgctcgcggcagggctcgtagcggtagttctcgcccagctccaccacgatggccgccgggtcgatggcgcgcgccaggccaaagagggtcccgggctggaacacctggccgcccacgccctggttgatgacgtcgagcccgcggcgctccgccagcagcgtgggccacgcgagcgcggggtcgtcgcacacgaagccctgcgcgatgctgtcgcccagaaccagcaggttccgacggcgctccacgggccggatgaagctgccgttgcccgcgacggacctgagcgtgcagccacgcaggcacggcagccacacgcgcacgtggtgcgtgtcgcccatgccggggagctgcatgacgccgctcgcgggcgccgccgccgggtcgtccagcgtgaaggccacgtagtcgtccccgtccgccggcacgcgcacgcccagccggcgtccgtccacctcgcacgagagcccgtcgtgcatgcgcggctcgaggcccctgcgctcgtccacgtacttgagggcgtcacgcgtgcccacaggctccgcgtccagcgcgacctcgatcgcgacctcggaggagtcggtctcgaactccaggcagacgcccgccgtcgcgcgtgccatctggcggtacaggcccgggtgccacgcctggcagctgcccagggcgcgcatctgctcggccgagaagcgccacggcctcacccagccctcgagctccgggctggtgcgcacgctgccgtgcaggagcggagccgcgtccgcccccacgagggcgaagccccgcgcaccctgttccatcatgtcccgaagcctcatcggcacccctcgcacgagccacaccggccctggggcgcgggggtggctcttctcgcctggttcttgctagtcttgcagatagcttagcatcacgcggtacgccccaaccagacgctcgaggctccagctcgcgtttgtcgggctcgtggagggcaggcgcgtggcggggattcccagcgtgggctcgatcaggcgcgtgtacaggcggtgggacgtggcgcccgtgcagaagatcgcctgtatgggcgcgcggtcgagcacgcgagcacgcaggtcgttggggacggggtccttgatcgaggcgtcgctcgcgcccgtgatcgtgcagctcgccagcacgtcgtccagcgcaaagtggcgtcgcagcgccaggtcgcggcaggcctcgcgcccacggggcggctcctctccccacagcgcggccatcacgcgccagaagcggttctgcgggttgccgtagtggtagcccacctcgcgcgacttggggctgggcatcgtgcccaggatgagcacgcggctctgtccgtcacacaccggcgccaaaggcgagtccacgtgggtgggcacgttcctctggcccgtcgccttgcggctgcgtgcgcacacgcaggctcactcgccctcgcgcacgggctcgtacgtctcgagcccgtcgtcgagccgcagcatcagcaggttgccaaagccggcaccgcccgcggcgccgcagtcgatgtcccagcggtccgtgacgccgcccgtctccgcgcgggcgcccaccttgaccatgcggcagaggccgttctcgtcctcgggaaggcggtccggaaggtccgccatgccgcgcaggtacggcgtgggcgtgtggcccgccaccacaatgggaccctcgccctgctcgtcaacaaggccggtcggcgtgccccagaagtcctcgcggatccacagcaggtcctccgggctctgcgccgccagcagggcgcgcaggtcgtcgtcgctccagcccatggccaccacgggttcgccctcgcggctggggtcgggtgccgcgccgcgctcaaagcgcacgcccggccgcacgcccgcgtgcaccatcacatagggacggccgcccacaaacgtgtaggcgtacagcgggaggtgggccacccagtccaggaggtcgaccctctcgccctcgggcagcgccgcaaggcccgtgcgcgtgctgatgccgccgttgatctcccagttgacctggttcatgccctcgtcgggcgcctcgaggaagctcagcatcaggtcctcgtggttgcccatgagcaccgtcgcgttcctgaggccgcggcacacctgcatcacgcccacggggtcgggaccgcggtcgatcatgtcgccgagcatgaacaggctgtcgtcgtccgacggcgagacgcgctcgagcagccggtcgagcgtccccctgtgcccgtgcacgtccgaaaacacgtaggtagccatcaagtgtccttccccgttgcggcggcgcgcgccgtcgtcaacagtctagcgcctcaggtgcccgcgcgcacgtcggcgcgccatcgcgagcttccacgggtcgatcgcgcccacttccacgtacctgccgcgctcccgcttgcccagggactcgctcagccgcacctggcgcaccaggtccgccatcgtgcccgcaaagcggtccttcttgaggtggcactcccacaccacgagcacggtccagcccgcctccaccagcagcagcgcgtcgcgctcgtcacggctcacgttgcgccggaacttctgcgtccagaactccacgttggacttgggaagcggcagcgcgcaatgcgggcagcggtgccagaagcacccgttcacaaagatggccacccgcctaccgggatagcagatgtccggcttgcccggcgccttcttccagtgcaggcggtagccgcccagccccgcctcgcgcagggcctgcctcaccttgagctcgggcttggtgttcttgctcttgtttgcctgcatcacatggtgcgtggcctcgctcaccaagacggcctacgcccccaccccgggctccgatggcccctccgggtcgtccgggtccgcgtgctggcccgagaagttgaggttcctcgtgagcgcctccgcggccgcctcgtcaaactcgagcgagaagaacgcgtccaacgcgcccgcgacctcgtcctgcgcgccctggtacagctgccagaagccgtccgtgctgacggtcccgtcgaacgggtttctccacgggcgcccctcgcggttgtcgaagtcggaggtctgctcggcgcggtcgcggtgcgccatcgcggcgtacagcgagtagcggctgtgccccagcctgcgctcgatgggtgccagcacgcgcgtcttgccctggttgggcgtgtagaacaggcgctgcaccaggcggaacgacttcacggcgcgcgagtagcagtccagctcgagcgtcttgctgtacgtccacaggttcatatagaagtagagcttgtcgatcacggcgagcgtctcgtcgtccgcgcgcaggatctcgcgatagggcctgaacgagcgcaccgtcatgccggtcttggagaagagcaccatctcgtccaggtcgcgctcgatctccgcgtgcacctcgtcgccgtccgcgcgggaaagccccggcacgcccgcgtcgcagatgccgtactggtagtggtacacgagcgggtggaccgcgcggtcgagcaggtagtggcagacaaagcccgcggcatacgcgttgcccaccggacgctcggcgcggttcagcatcgtgagcgcgtcgcgcagcgacaccacgagccgtgccgtgcgcgcgtggtgcatgagcccgcccacgcggttggacgcgcccacaaacgggtccgccaccaggtagaagagcgggtccggcccctggttgcccaggaggaacgcctgcctctcctgaatcgtcacgaatccgcgactctccgcgacgccggcgtaggcgtccttgccaaagaagtcgtgcgtcatgattgcgggcatgcgagactctcctaacaaaggcggcagtgccgcccccggtcgtgtgtcggagtcaagtatcgcagatggctgcgccttatgcacgtgaatccatgacatatggacgcaacgcgcgccacctgtgcgcgggcgtcactttacgcaccgcttacggtagcgtttcccgagccttgccacccctcccctaaacttttcatcacctatgaaaagggaggacactgccaatggcaaacagcaagttcacaaaggccgagaagagctggatcatgtacgacgtgggcaactccgcactcgtgctcctggccacaagcatcatccccatctacttcaagtcgctggcggatggcccggcgctcgtggcgtggagctacggcgagaccatcgcctcgctcgtgatcgcgctcctcatgccaatactcggcagcatcgcggacatgcagggcatgaagaagaagttcatcgtggccacggtcgcgatcggcgccgtcgccacggtcgcgatgggcatcccgaccggcgcgatggcgtttctcgtcatctacgtggtctcgtcgatatcgctcaacacgtcgatcgtcttctacgacgccctcttggtggacgccaccacggacgagcggatggacgaggtctcgagccagggctacgcctggggttacatcggcagctgcgtgccgttcatcgcgtgcctggccgtcgtgctcacgaggccgtttggcatgagcctgcaggcggccatgcaggtctcgttcgtgatcaccgccgtgtggtgggtcgtcttcaccatccccatgctcaagaacgtcgagcagacgcactacaagccgcgcgaggaccacgccgtgtccaaggccatccacggcgtcggcgccacgctcaagaagatctgggccgacaagaccctgcgcaacttcatcatcgcgtacttcttctacatcgacggcgtgcacaccatcatcaagctctcgacgagctatggctctgacctgggaatcgacggcacccagctcgtcctcgcgcttctcgtcacgcagttcgtggccttcccctccgccatcatctacggcaagctgggccacaaggtcggaaccaagaagatgctgctcgtgggcatcgcgggctacacgttcatcacgctgttcgcggcgttcttcctcaagagcgccatccagttctggttcctcgccatcatggtcggcctcttccagggcggcatccaggcgctgagccgctccgagtttggcaagctctgcccaaaggagcacgcgaacgagtactttggcttcttcgacatctttggcaagtacgccgccgttctgggcaccttcatcgtgggcacgatgaccatgctcacgggctccggctcgctgggcgtcttctccatcgtgatcctgttcatcatcggcttcttcatgatgcgcagggtgccggagagggagtccgcggagagcgcggagtagccgcgcgccagagactcgcaagtttgggcggtcgtcggaaacccggcggccgtcctttcatgtgcggtttctgtacttgctggcggtgctaggtcgaccgtcgccctaccttggcagcgcgtcctcgggaatggtgagctcgccgccggagcgggcgatggcctccatcaccttcgcaacggagtcgtccgcggcgtcgccgatgtggtagcgcgcggcaccctgggcgacgcgggtcccgttggacaccgcgaacgaggcacccacggcgcgcagcatcgccacgtcgttttccgagtcgccaaagaacgcgacctcgtcgcgcgagacgttgaggtactgcaggaggaccctgagcgcgctcgccttggtccagccatggggcagcacgtcgaagaacgacggggcgggcttcacgaagtcgaactccgggaaggctgccgcgagcctgttcctgagctcgcccatcgcgtcagcggactcgcccaggtaggcaaagccggcggtcaggatctcgtcgtcgggcacgctcgcaatctcgttagtcgccgcgagcgtgattcccgtccttcgggtgtacgcctcgacctcttcgggcgtcgtgccgctgatgatgaccctggcccggggacgcccgccctcgtccggggcgggaacgtacgcgacgagcgcgtagtcgggattgcccaggcagaaggcctcgagcctcttgagcgccgcgtggtcgagagtcttcgcgagcacgcgctcgcggtccacgtccacgatcttgccgtttgccatgatgcccgtcgcgtagcagctgtcgtcgccgccaaagaagtcgtacaggtcgacgggctcgcgccccgtcgcggggccgaactcgatcccggcctgcctcagctcgtgaatcgcgcgaatcgagcgtggcgagacgcggtcgtgtccaaacggcttgagcgttccgtccatgtcgcacagcacgagcttgatcaaaatgcgtccaacccccctcgagtcgcgcgcctacgcagggcgcgccgcagcgtacgttctggcggagaagaacatgccccatgcacggggcctcgtccttctcccctgccccttattccccactatacggtccgtcggcgggcgaaaccgtccgaaagcgaagccctcacagacacgctaccgcggcattcgcaagcatgcgaatgccgcggcaactaaacgtttgagccatgacccgcatatcgccgacgctggattcgcactacgggttgaacccgtacagcaagccggccacgattccgccgtacatgaccacgtaatgcacgcaatagagcgcaccgtagaggaacgcggcatggtaggacggctcgaccgagctggcggcgaccatgagaagcgcaagcaccacgtagagggccactattactattgaaatcagcttcctcgtgcgggaccaccctcgcccatcagcagggccactcgccttggatgagcggagtctgccaccaaggaactttcccagcgcgaagagcaggattgggatcgcaacgacctcgaggaccgtcgcatagcggaagtcgtagtacgtccccggtatgtctcgcaggaaggcgacgtaaactagagcgtacgccccggccaacgcgacgggcaggtacgacagggcctttcgggtgggcgacatttcagctcccccaatcacgatgggacgccagcgcatcggtaccgcttgacctgaaggtaccctgatatctgggctatcggtcgtttttttgcaggcgtgcccaaaggcggcccgagcggagcgactttgggcggaatgagcgattggcctggcgacccgcaagtgctactttcagacttggagagcaagcgcacgtgtcgtgaggtcgggaggcatcgcccatgcgtgacacgaacgagcatacggaagacggctcgcacgggggccccgacgtggcgacgctgctcgaacgcgtgcgcgagaccatctgccaggacccaccacggcccgccgaggcccttgccgccattgccgcgctcgcgccccgcgtggccgaggtctccgcgaccgaggccgtcgacctcctggagcgcgcggccacgtttgggccggtcgccgtggtggacgccgtgtgggacgcgttcgacggcgactttgcctacacgggctgggcgctcgcgctggcgctgcgctgcgcgaacgaggacgtggcgcgcgacctcatggcccgcggggtcgacatcctgggcgactaccgcaagccgcgcaaagtgcgcgcgctcatgccgcacgagggcacgttcacgcgcttcgacctcacgcgcgagagcccgacgctcttcctcaacaacatggaccacaccgtctgcacggaggtgttcgagccgttcacgggcatggagcagctggccgggcggcccttctcgcgcaagctcgacatggcgcgcacctgcgcgtgcgtgctcagcatcgcaagcgacgggctgtttgacgcgacggccttcgacgacgtgttccgcgcggccatggtgcgcgcgtggcacgcgctgcgccacccgtcgagccgcgaccccaagcttgcggatgtctgctttggcctgggcaggagcctgctcgagctgcaccgcacgcgcggcatgggcgacggcaacatcgagctcgtgctgggcaacctcatcgtgccgcgcgcggacgaggacgtggtcgccttcgtgtgcgacgtggcgcccgaggtctttttggggcggctctccatgctggactggctgcgccaggacgtgggcctcgtccgccgcatggtgccccacctgaggccgggcacgcccgcgcagaacgcgccgctgctcaagatcatggcggagcagggcttcatggcggagctcgaggtggtcgccggctggcccggggcgctcgatcccgagtccgcccgtgccgcgatggaggcagcctccgccgccgggcacgccgaggccgcgacctggctcctcgcgcgcgtgcagggggtggagaaggacgcggcccccagggccgtgcacctggcctctggcccgggcgatatgccagtggcagcgcaatcgcgccatgtaccagcggaaatgccacagcctgcaccagtgccggacgcagcccagggcgcgcccgagcccgtgccggtggcgcccgtgccgacccccgcccccgacgcagacccgcatgcggacgagcgtgtcgccctcgcgcggcaggtgctcgacctcgcccgcgggctcatcgtggcggacaaccccttcctcgcgtccgcgttcgcgcacctggatgccgcgccgcaggagacgacagcaccctcgggactccccctcgcgaccaacggacgcgtcgtcacgtttgacgcccgcgcaatcgtgggcgacttcgcccgcacgcgcaaggcccccatgcacgacctcatgcacgtgctcgtccactgcatgatgctccatcccttcgtgtctagcaccgtggacgccgcctgctgggacctcgccgcggacgccgtggcggaggccgtcacggccgaggtgctgggcccgcgcgagggcgaccgcggcaggcacacccaggccgtgatcgaccagatggagtccacgctcggccgccgcatcacggcggagcgcctctaccacgccctgcgcgccggctccttcgccaacgcgcgcgaggactgggcgcggctcctcgcggtggacgaccacgccgcgtggcaccccgcccccacgccggagggcgcgcagtcccaggccggcggcgactcccagggcgatagcggcaacggctcccccaacgcctccaaccagcccggcggccaaccgcagggcccgggcgagcccacgccccagcccacgggcgagaaggacgcgccccaccaggctgcagactcccccgttaccagcgacgatgccggggcctcggcctcagacggccccctgccccaggaggcggccgcggcggaggacgccgcgtccttctcgcccaagcggtccgccgcacaggccgcacaggccgcgcagtccgcacgcgagggcgcgtcccagtcccaggcgcccgcccagccgcaggcaccgcgcctcacgcccacggagcgcgagcgcgcggaggcggactggcgccgcgaggccaagtccgtccgcgtcaacctgcagacgctcatgcgcgggcgtggctccaagctgggccggctcgtgggcgagctcgaggtgagcacgcacgagcaggtggactaccgcgacttcctgcggcagtttgccgtgcagagcgaggagctgcgcctttccgacgacgagttcgactatgtgttctacacgtacgggctttcgctctacggcgacatgccgctcatcgagccgctggagtaccgcgacgagaagcgcatacgcgacttcgtgatcgtgatcgacacgtcgagctccgtcacgctcgacgtggtgcagcagtttgtggacgccacgttcgacgtgctcacgagcgagtccagcttctcgcaaaaggtgaacgtccacatcatccaggcggaccagcgcgtgcagagcgacaccaagatatcctcgctcgcggatctcgaccgctggcggcgcaacatcaagctcgtgggctttggcggcacggacttccgccccgccttcacctacgtgaacgagcttttggccgccggcgagttcgacgacctgtcgggcctcatctacttcacggacggctggggcatttacccggaccgcatgccgccgtacaagaccacgttcgtgttctacgacgaggaccaccggccggagctggtgccgccctgggccatccagatcacgctgcacccgggcgagttcgagtcgatgtcggtctactagcccggccgcacgacccgccgccaccgccgtgctaccatcaacacaccaaacgagggagcgcccatggacatcaaacaggcaaccaggcaaatcgagggcgctgtgcgcgcctacctcagcaaggacgagcacggcatctatcgcatccccacgcagatgcagcgtcccatcatcatgatgggccctccgggcatcggcaagacggccatcgtgagccaggtcgccagccgcctgggcgtcaacttcgtgagctactccatcacgcaccacacgcgccagagcgcgctggggctcccctacatcgcccaaagcgagtacggcggccgcacgtacaaggtcagccgctacaccatgagcgagatcatcgcggccacgtacgacgcggtggagaagagcggcatccccgagggcatcctctttctggacgaggtcaactgcgcgtccgagacgctcatgcccgccatgctgcagttcctgcagtataagacgtttggccagcaccgcctgcccgcgggctgggtcatcgtgacggccggcaacccgcccgagtacaaccgcgccgcccgcgagttcgaccccgccatgatggaccgcatgaagcgcatcgacgtggagcccagcctcgacgcgtggatggagtacgcgctctcgcacggcatccaccccgccatcagcacctacctcgcgagcaagcccaagaacttctaccgcgtgcgggccagcgtgcgcggggcccagctcgtgacggcgcgcggctgggaggacctctcccgcatgatctgggcctaccgccacgagggcatccccgttgaccaggacctggtggcccagtacctgcaggaccgcgagatcgcggaggacttcagcctctacctcgagctcttcagcaagtacgaggacgactacaaggtcgacggcatcctcgcgggcaacgcgggcaagaagatcctggaccgcgcccgccaggccccctttgacgagcgcatcgccctggtcaacctcatgctggacgcgctcctcacctccgcgcacgacgtcgacgcgcggcaggaggcgctggcccatgcccgcgaggacgtggcccaggcgcgcgaggagctttccggcacgccgacggcggccgtcgcggcgggcgagaggatctgctccgcggcccagcgcgcctccgaggacgcccgcgccgagggcaccgcggacaccaggcgccagaccacgctcgcggagcgcgcggagctgctggacgaggtccgctccgccctcacccgctgggcgatggacgccgccaccgtcacggatggcgccgggctcggcgtggccacaggcgcgctcgacgcgcggcaggaggccctgggccagctccaaacggagctcgcggggcggctcgaccacgcgctgggcttcctggacgatgcctttggccgcgacgggcaggagctcgtggtcttcgtcacgcacctggccgtcgacccggcgttcatgcgctttgcctccgagcacgcctcgagcctcctggcggagcacggccaggcgctcatgttccacgagcgcgggctcgacctgctcaaggaggcggacaggctcaagtaacgcgttagtccacgctcttgagtgactccaccatgtcgacgcggtcgaggcgtggcctcatgagcaggagtatcgccacggtgaaggccatggcgagggcaaaggcaaacgcaaagctcagggggtgtatttctcgcccgaacatgacgtagtcgacctccgccgtcgtgatgacgaagcgctcgagccacgagcccaggagcatgcccagcgcgtcgcccagaagcgcgatgatcgcgatctcgcggtagacgtaggcgtgcacctcgcgccgcgtgaagccgagcacgcgcaggctcgcgatctcgcgcacacgctccgacacgttgatgttggtgaggttgtacagcacgatgaacgccagcgcgcccgcgctcacgatgagcaccaccacgaccatgtccaccacggagagcgtgtggcggtacgtgctgatggtctgccgcgtgaagctcacggtcgagacgccggcgatgtcgtgcagggcatccgacgtgcgcgactccgccttggagccgccggtcacgcgcgcgtacacggtggagaaggacggggttgcccccatggcgcgcctccatgcacgccggcccacgtacacgtagttgcccacgtagttttccgccacggcgtccaccttgagccggacgcccttgcccgtggcgttgcccacgtcgtcctgccggtacaggacgatggtgtcgcccgcgcggatgccatagaggctcgcgagcttctccgtcaccacgacgctgtcctgcccaaacgcgattgccgcgcccgacgtgcggtcgcgcagcgtcacggcggatgcgagcttggacgccgtctgcggcacgaccacgctcacgcgcgtcttgtccgtcgcagcggaggaggagcccgtgccgcgtgcgagcatcgtgtccgtgtgcacgcggacgatgccagtcgcgtcgcccttggagcgcaggcacgcgatggcggagtccacgtccgcctgggccgcgccgtccgccagcgtgaccgtggcgttatagcgcacgatgggaccgaactgcctgtcgatgatgtcccagatcgagtcgtgcaggccaaagcccacgagcagcagcgcggagcagcccgcgatgcccgcgagcgtcatgaggagccggcgcttgtagcggaagaggttgcggaacgtcaccttccacgagaaggacagcctccgccacagcgggcggacgcgctcgagcaggatgcgcttgcccgccttgggcgcgcggggccgcaggagcgcggcggggacctcggccaggctcgccgccacggccacgagcgtggacgcgagcgtgacgcccacgcccaggccgcccgccgcgagcgccgtgcccacgtccaccggcagcgggaactcgagcgtgggcaccacgtagatgacggagtacgcgtccatcacgatgcgcggcagcacctgcgtgagcacgcagatgcccagcacggcgcccaggccgctcgcgagcagcgcgtagcccaggtacatggccgcgatgcggcccttgccgtagcccagcgccttgtgcgtgccgatgcgctggcggtcgtcgtccacgatgcgcgtcatggtggtgagcgccaccagcgcggccaccaggaagaacatcgccgggaacaccgtggcgatgcggtcgaggcgctccgtgtcggcctcgtaggtcgtggcgccctcgctctggctgcggtcgagcgtgtagacgtccggcgcggccatggagtccacctgctcctgcgcggccgcgagctgctgctgcgcggcggagaggtccgtgctcgcgccggccgaggccgcctgcgcggcggctgcctgcgcggccgccacctgcgcgtcgagccgggactgcgcctgggacttgagctccgcgagccggtccgcggccagggagccctcgatcttctccacccggtccttcaccttgtctaccgcggactcgtacgcggaggagccggacacggccgcgcgcgcggagcccaccgtgaggtaggcgtccgtgtaggggtagtccgacgcgaaggtggacgccgtcacgaagacgtactggccgatggtgccggagcccaggcgcgtggagccaaacgagccggtgtaggggtagtcgggcgagctcaccgtgcccacgaccttgagcattgtggtcgagaggatcgtgctcacgtcctcggacgcggacaccacctccacggtcgagccgaccttgatcttgcgcgtcgcgtccgcggagacgacgcactcccccgccgccttgggccagcgacccgacacgagccgcgcccggttgaggtaggagccctttgaggacgagacggcgtaggccgacgtggccttgctcttgcgcgcggcgtccgcgtccacggacgtgacgcgcaccgcgacctggtcgctgccgagcttgcacacgacgtcggccgtgcgcgaggccatgacctgcgagacgcccttgaccttggagaggcgctcgacctgggcgtccgagaggcccttggtggagacgacgcgcaggtcccagagggcgctgccgtcgtaccagcggtccgccgcggcgcgcatgtccgggccgcacatccgcaggcccgcatagaagccgcagcccagggccacgatgcacatgatggccaggaagcggccgagggagccgcggacgctccggacgagctcggtcatgtacgcggagcgggccatgggctaccactccacctgggaggcgtcgctcgggtggtcgtttgtctcgatggaggcggcacgcccttctcgcacgtgtatgacgcggtcggccatctgcgtgaacgcgaggttgtgcgtcacgatcacgacggtgcggccgcccgccttgcagctgtcctgcagaagcgagaggatctgcttgcccgtgcggtagtcgagcgcgccggtgggctcgtcgcacagcaggagcttggggttcttggcgagggcgcgggcgatggcgacgcgctgctgctcgccgccggagagctgcgccgggaagttgtcgagccggtcggcgagccccacctgggcgagcacgtccgcggcgggcagcgggtcgcggcagatctggctcgcaagctctacgttctcgagcgcggtcaggttctgcacgaggttgtagaactgaaagacgaagccgatgtcgtggcggcggtactgcgtgagctcgcgctcgcccatgccgctcacgagctggccgtcgagcctgatcgtgcccgacgtgcaggagtccatcccgcccaggaggttgagcaccgtggtcttgccggcgcccgagggacccacgatcacggcgagctcgcccttctttatcgagaagctcatgccgtcgagggcgcggacctcgacctcgccggtgtggtagaccttgctgacgtcctcgaactcgacaaaagacatggcgcaccccctgcacgcattgtcccacgcgcagggggtgctctttcctacggttcaacggacggtacgaaacgacggcgctgccgcccaactgtcggcttgacgatgcggttcgaccttgggcgctactcgccgcgcctggcggccttgcgtgccttgcgggcgtcgcggcgctgcgtgagccccatgtagaacagggcgacgcccaccaggaggcccacggtgagcaccatcatgcccgcgatggacgggaaggtgttagagaggtagagcacgaagcccgcgaccacgacgacgatgcccaggaacatgaagaggcccgcgtggcccttgccggcggcctgctgcggagtcgcgccgaactcggccctcacgccgctgtccgcggcctcggccgcacgcaggaaggcgggctcctctccccactccgcggcgtcggccacgtcctggcagagctgtgccacgccgccctcgtgcaggcccttgaggtgcgactttgccgcctcccaggccgccttggaggcgtccgtggtcgcgacggaggcgggcacggcggagaggagctcggcgtcggcggtcgcgccgccgaggaccagcacctcgtcgcggccgacgtccagcctgcgcatgagctcgcgcgcgccgtccgcgcgcgtggtggcgcgcgtcggcaggaccatgccgtcggccacgagctcggcaccgttcctgagcaccgcgttctgcaggcaggactcgtcgcccccgaggagggcgagggcgtcggcgcgtccgcgcgcgctcatcggggcgaggcggatgccggcgtgcagcacctggtggagctgcgcgatcgtctggcggtcgagcgggcggccgtcgcgggttccgagcgcatggtccatgtcaacgagtacgagcctaatcaagcggaagccttcctcttgggtccaatgcctggggtatcgttccccaaatgatgacatcatccctcaagacggcgtaccgcgcagacatctgcagaaaagaggcatcaacgggtggggacgtcaagctcacctcacatccgcatccgcgcgaggcgtctggcgcaggagttgattcgactcagttgcatccagtcgagggttttgtgtgtttcacggaccaaagtggagccaacggaagaccccgcgccactccatcactgtccgaaacgcacaaaaccctgctggccgttaggctgccacaaggttttgtgtgcccgtggctcagagctcggtcccatccgcactgccaaaacgcacaaaatcccaggcacgatgcaaccgcgtcaaatcaactcccgaagacagcgcgtgctagccgcgatggttggggtcttccccctcggcagcgccgtcgtcccacgtcttgggcggctcgtactcgccgcggcgcagaacctcctcctcgcgctcgcgcagcagctggcggtagccgggcagtgggtcgaacgggatgaagatcttcgcgcgctcggacatgggcatgtgcggccgcgccaccacgtgcccgccgtgcgcgcccggcgccttgctactccccactacgatggcccccaatctgtccgttgcgctcgacctgcgtcgcctcgggaaggaggtcgatgcccttgagcagcgagttcttgccaaacttgtgcttgatggcactgatggcctcctggcgcttgcgctcccgctcgagcttggccccgtcctcgaagagccccatctgcacgccgctgtcctcgggcaccacgccgcctagggacatcgtcagccggtggatgggccggtccgggtcggccacgcgctggtacaggtcgaccacggcccgcaggatttccgcgcgcgagttcgtgggcggctccaggcgctcggaccccgcggtcgagaactcgccccagcgggcgcgcatcccgtgctcccccacgcggccctccgcggcacccgccgtcatctgcctgcggagctcgtccttctcgcccggcgtgagacggtagcccaccatgagcgagacgcccgtggccacgagcccctgctccacgagcttgagggccaggtcgtccgccatctccttcgcgaccaccaggccgcccgcgtggtccttgtcgcagcccagcacctgaccggaggagagcgacttgtccttggagcggtacgccttgatgtccgcgatggtcacgggctcgcggccccacgcgtggtcgatcagaatctccgcgtccacgccgaacatgcggtacagcggctcctgcgggtacaccgcgagctgccccatcgtgtggatgcccagctccgcgagccgccgcgcgtagccggggccgatgcgccagaagtccgttatggggcggtgcgtccacagcgtgtcgcggtacgactgctcgtccagcacgccaaagaagtccgggctgtgcttggccgtgatgtccagcgccaccttggccaggtacaggttggtgcccaggccgcacgtcgccgggatgcccgtggtgcgcaccacgtcctcgcggatgcgctcgcccagctcgcgcgccgtgcagccatagagccccaggtagcccgtcacgtcgatgaacgcctcgtcgatggagtacacgtgcatgtcgtcgggcgagacgtagcgtaggtagacggagtagatgtccgctgagcgctccatgtacaggcgcatgcgcggcggcgcgatgatgtagtcgagcccctccgggatctcgaacaggcggcagcggttgcgtacgcccttcgccttgagcgagggcgagacggcaaggcatatggtcttgctgctgcgcgtcgcgtccgccaccaccaggtccgtggtcatggggtcgagcccgcgggccacgcactccacggaggcgtagaagctcttgaggtcgatcaccaggtactgcctctggcgagaaggacgtgccgtccctcccgccgcgctcccctgtgccgccacgctagccctggtagacgatcttctgcttggtggcctcgacggcctcctcgcccaggaagtggcgcaccagctgcaggcccagctccacggcggtgccgaggcccttgctcgtggtcacgttgccgtccacgacgaccgggtcctgcagcaccgtggcgccgtgctcggaaagcacgtgctggaagttggggttgctcgtggcattgcgaccctcgagcaggccgagctccgccaggatcgatggcgccgcgcagatggccgccaccgggcggctgctcttcacgaagtccgtcacggccttgcacagcggctcgcacgcgcggaggttcttggtgcccggcatgccgccgggaagcaccagcatgtcgtagtcgtcaaagctgaagccctcgtccgtgatggaggcgtcgcacaccacggtgacctcgtggctcgaggtgacggcgaggttgcccgtgatggacaccttgtcgcacgggacgcccgccctgaagagcaggtccaccagcaccagggcctcgcactcctcgagtccgtccgcaaagaagaccgccacgcgcttgtcggttgcctgcctgaacatgtgagcctccccctgccccgtcggggcctcaagttggaattctcgttcttctcgtccgtaccacacgagcatagcatccgcggcggacacgccgccgcgggccggatgccacgcgctcccgctactcgctccgcagcgactccaccgggtcgttcttgctcgccttggtggaggggatgagcccgcccaggaacgtcagcagcacgctgataccgatgagcgcgagcgccgcctgccagggcaggatcatgatgttggggatgttcttccactgcagcacgaagtggttgacgggcacctgcgccacgagcaccaccaggatggcgaacacgcccgcgatgaggccctcgatgatggtctcagcgttgaacacgttggccacgttgagcttcgaggcgcccatggcgcgcagcacgccgatctccttcttgcgctccagcacggatatgtaggtgatgatgccgatcatgatcgagctcaccacgagcgagatggacacgaaggcgatgagcaccatcgatatcatgttcacgatgtcggacacggagctcatgagcgagcccgccacgtcggagtactggatcttctggtccgcgtggcccgccgcggcgcgcttggcgttgtagcggtcgatgaacctcaggacggcctccttgtcgtcaaagctcttggggtagatcttgacggccgaggggtcggaggcctcggcgtagcccagcttgctcaggttgttgtcgtacgtgagctggctggcgttgacgtagttgttgaggagcgagcgcaggtcctcctgtgtcatgttgacgtggatggcgctcttgaacgccgcgggatccacggagaacccgttctgaagcgcgctcgtgagcgtggacatcttctgggatatctggctcgatatcgtgctggcgagctgcgtgcccatggactgcgtcgcggcctccatctgggactccatctggctcgcgagctgcgtcgccaccagggacgcggcctgctgcatgagggagtccacctgcccgcgcacgtagtcggccacgtaggccatgtacttctcgtacgtgtcgttcaccgcgttgaacgtgtcgtcgcccaggctctggcgcaggccgtccatggcctgcttggcctcgtccgtctgcgcgtaggtcgcccacgagtcgtccgcgccctcgggtagcgtctggcgccatgccacgtagcccgtggcgagcgtcgtggcggcctggctcgcggcctgctgctggtccggcgtgagctcgaccccgctctgctgcgcataggtggagaagggcgtgacccccgccacgatgcgctgcacggtgtcctcgctcagcatcgagtcgatgggcgaggtgtcgatcctcatggcggaggggtcgaagccggagctgtcgaggctcaggccggacaggtcgatctgccccaggctcgccgtgtccacggcggaggtgttgatcgtgaacgccttcttgagcgcgtcctggtccaccgtgaagagcttgctcatgtcaaaggttccggaggacttctgcagctcctcgaaggtcttgcccgtgaacacgtccaccttggggttggcgcgctgctcgcgcacgatctgggaggacgcggcgcgctgcatgagctcgctcgtgagggccggcgtgtaggcgatgccctcgctcaccagggaggtgcgcgacccgctcctgggcctgatcacacccaccaccttgagcttgatgccgctgcccatcttctgcttgaggtaggcctggtcgtcgctcatgtccgtccacgtgccctgcgaggcgttcttctggtacaggtcggagggcgccagcacgctgaaggtcatgcccagcgcgtcatcgtaggtgaacttgcgcttcttctgtgtggagacgtccaccttctggccgctcgtggcctcctgcaccatgcgctccatgtcctccgtgttatagaagcccagcgcatacagggtgtagtcgcttatggatcccttgcggtcgagcacgagcacggcctcgtccgccgccttgggccagctgccgcgcaccagcgtcatgttgtccctgaggagcgactggtcgctcacgagctgcgtaaaggagctggaggaggacgtcccggccatgagcatcgagcccatggcgccgccggaaagcgtgctcgccacgtcggaggggttcagctgcacggccttgcccgagctgtcggtcctaaagacctgcggcgtcacgtcgtagtcgtactccacggcgttggcgttcttcctaacctgccccatgtgcgcgtccaggtacttcttgaacgacttgaggtcgttgctcttgacctgcgcgaacatgtccgccatgacggagcgctgcttgatggtggaccccttgcccgaggcatcctttgcgctcgccgcggaggcggactcctgccccatggccttgctcaggtcaaagctgctcttcgtgatgctcaggggatagctcgaaagcgcgttctcctccgtgcgggcgatgtagttgttgacgccgttggaaagcgccaggatcgccgcgatgccgatgatgccgatcgaccccgcaaaggccgtcatgaacgtgcggcccttcttggtcatgaggttgttgaacgaaagcgcgagcgccgtcaagaagcccatggacgcgcgcttctcgcccttgtgccgtctttcgcgtccgccctcgggcgagaaggacgcgcccttctcccccgcgggcaccgccgtcgcgccgggcatcgccacggtcgcatccgcggcgcccgcggccgcgacctcctccggcgtgaggggccggctgtcgtccaccacgcggccgtccttcacgcgcacgatgcgcgtggcgtagtcctgcgcgagctcggggttgtgcgtgaccatgaccaccaggcggtccttggagacctgcttgaggatgtccatcacctggatgccggtctgcgtgtcgagcgcgcccgtgggctcgtcggccagcacgatgtccgggtcgttcaccagcgcgcgggcgatggccacgcgctgcatctgcccgccggaaagctggctcgggtgcttgtgcaggtggtcgcccaggcccacggcctcgagcgcctccgtggcgcgccgctcgcgctcctttcggcccacgcccgcgagcgtgagcgccagctccacgttggaaagcacggtctggtgcgggatcaggttgtagctctggaacacaaagcccacgcggtggttgcggtaggtgtcccagtccttgcttgaatagtccttggtcgaggtgccgttgatcacgatctcgccggagtccgcgtggtcgagcccgcccaggatgttgagcatcgtggtcttgcccgacccggacggccccaagatcgccacgaactcgctgtccctgaaggcaaggctcacgttatcgagcgcgacctgcgtaaagtcgtcagtcttgtaggccttgcggatgttcctgagctcaagcatgcgtttcccttcggttttgacagggaaagcttacccacgggcggccgcggcagccgagttcagcttcgcttcacctttgccacacacagccaaaccagcgggccccaggtccgcacgtaaaggcgacggacgagaggaacgcgccccctcgcccgccgccacgcctcagccgcaggtgtgtgccgcctctgccgcgtgccggctagagccggtcggccatgtcgagtacgaggcgctcggtcttctcccaccctatgcaggcgtccgtgatcgacttgccgtagacgccgccgcccacgggctggttgccgtcctctatgtaggactcgaccatgaagccgcggaagatcttggcgatgtccgccgagcggctcacggagtcgagcacctcgttcactatgcggggctgctccagcgggcgcttgcccgagttgtcgtggttgcagtccaccaccacggccgggttctcgtacttgccgtgcaggtaggccgtcgcgaggcgctccaggtactcgtagtggtagttggggtagttgatgccgtcgagccccacgtagccgcgcagcagcgcgtgcgcgaaggggttgcccgtggtgtggacctcccagttgcggaagatgaagtcctggggcgcctgcgccgcgtagatcgagttgagcatgaccgcggtggagccgcccgtggggttcttcatgcccacgggcacggggatgccgctcgccaccaggcggtgctcctggttctccacggagcgcgcgcccacggccacgtagcccaggaggtcgatcaggtactggtagttgctgggatacagcatctcatccgccgtgaacatgcccgtctcctccacaacgcgcaggtgcatgtggcggatggccttcacgccctccagcaggtcgggcgcgccctcggggtcggggttgtgcaggagccccttgtagcccgtgcccttggtgcggggcttgttggtgtacacgcgcgggatcacgaggatcttctcgctcacgcgctcggaaagcttcgcgagcctcgtgacgtagtcgagcacggagtcctcgcggtcggccgagcacgggccgattatcagcaggatgcggctgtcctcgccgcggatgatggaggccacctgggcgtcaaacgccggcttcgccttggccatctcgggcgataggggcatcgcctcgcggatctccatcggtatgggcaggcggcgcttgaactccatggacatgcgtttctcctccagatttcgctcgtgcgcccgggggggcgcggctcccgccgtgcggcgggttccgtgattgtcccacgaatgcgccgcggttttctgtccggcaggttaactttttctaaccctgccaccgcgatgggtgcctttttcgcggcgcgggactcccccgcaagacaacgggtacgatacaagggtcacacacggcaccaaccacgactgaaggaggaaggaatggcctgcaccaccctacttgtcggcaaggcggccagctacgacggctcgaccatcatcgccaggaacgaggactcccccggcggcgtcttcacccccaagaagttcgtcgtcatcaagcccgaggaccagccgcgccactaccgctccgtcctgagccacgtcgagttcgaccttccgcaggacccgatgcgctacacctccgtccccgacgccacccccaaggacggcatctgggccgaggccggcgtcaacaccgccaacgtcgccatgagcgcgacggagaccctcacctccaacgagcgcgtcctgggcgcggacccgctggtcgagctcgtcaaggccaagggcacccccggcgaggacggctacgagcccgaggtcccgggcggcatcggcgaggaggacatggtcacgatcgtgctcccctacgccaggtccgcgcgcgagggcgtggagctcctgggctcctacctgcagaagtatggcacgtacgagatgaacggcatcgccttcagcgacgtggacgagatctggtggatggagaccgtgggcggccaccactggatcgccaagcgcgtgcccgacgactgctacgtcaccatgcccaaccagctcggcatcgacgagttcgacctcacggacgcactgggcgagaagatcgaccatatgtgctcgccggaccttgcggagtggatggacgccaaccacctggacctcacgctcgacgtggtcgacccggacgatgaggacgaggatgagggcgaggacgccgactggcccgacgccggccaccgcttcttcaacccgcgcgacgcctttggcagccacagcgactccgaccacgtctacaacacgccgcgcgcctgggccatgcaccgctacctgtgccccggcctgggctgggacgacccgacggtgggctggaaccccgaggacgacgacatcccctggtgcatggagccgccccgcaagctcacgatcgaggacgtcaagtacgcgctgtcgctccactaccagggcacgccgtacgacccgtacggggcccgcggcgacgcctccacgcgcggcgcctaccgccccatcggcatcaaccgcaacggccagctcgccgtgctgcagatccgcccgtacgagcccgaggcctgccgcgccgtccagtggatggcctatggcagcaacgccttcaacgcgctggtgccgttcttcgccaacgtggactccacgccagagtacctggccaacaccacgccgcacgtcacgacggagagcttctactgggcaaaccgcctcatcgcggccatggcggacgcgcactacaacagctgcgcgcgccacatcgagcactacaacgaggccgtcacgtccaagggccacgcggccgtggccgcggccgacgccaaggtggacggccgctccggcaaggccctctcctataaggaggccacgcccgtgctcgaggaggccaacgagtccatcgcggccatgctgcgcgagcagaccgacgagacgctctccaacgtccttctcaccgcaagcctcggcatgaagaacgccttcgcgctgagcgaccactagcgggagctccacacacgtcgcaagtcgggggccgcgcgagcaacgcggcccccacgtcacgggaggagggacgcatggcaggaggacggacggacgggtcccgcgagccgtactttctggacgacgaccgcgagcgcgcctaccgctcgctcgtgcgcgccgtcaccaacctgggctaccccgaggagttcgcctacgtcatgtcaggcgagctccgctcggagggcgccatgcgcaggctcacgtcctacctcgtgaacgcgcgtcccgcgagcccggaggagatcgtggacgagatgctcgccatcgtccagaaccgggacgcctgggttgagcaccagatgcgcgagcagagcaacgcccgcctcacgcagtggtacaaccgcccggaccgccccgagccggagcccggcgacgcggacggctcggacgaggggccggccgcacagggcggctcgtggcagggcggcgacgcgaaccaggacaactagcggcgcactggcgcggcaccaagggaattatcgagggagaagagcatggcacagggcaccaaggcaaacgcgggcgcggacgcgccccagtacagcaccggcgaggagatcgccaactccgtgagccacggcgttggcgcgctgctctcgatcgcggcgctcgtccttctcatcgtgagggcggtctcgcacggcggcggggtgcacctgttcgcggcgctcctcatgggcatatcgctcgtgctcgagttcctgttctccacgctgtaccacgcgctgcgcccacgcaaggccaaggccgtgttccgcgtgttcgaccacagcgcaatctacctgctcatcgcggggagctacgcgccgttctcgttcatcacgctgcgcgaccacggcggcgtcacgctcggcatcgccgtcatggtcacgtgcgccgtgggcatcgtcgcggagtgcttcctgcgcgagcgccagccaaagtggctctcggccgccatctacctggcgctgggctggctcgtcatcttccacatcgcggacatctttcgcctgctgcccacgccggccttcgccctcctgctcgcgggcgggctcagctacaccgtgggctgcgtgttctacgtcatcaagaaggtgccgtacttccacttcatctggcacctcttcgtgctcgcgggtgccacgtgcatcacgctctccgcgctgctctacgtggtgtaggcccacaacaatgcccgccaggcgcgtcgcgcctggcgggctttttgcgttaggccagttgcattgtcgcgctaggccagcttgatgcccatgagccagccccagcgcggggtcaccgtcgtgccgtagtaggatatccactcgttcacgttgatggtcctgatgtagcccacgttgtccatcatcacgccgccgcccacgtagatgccaatgtggccgtagatcctgcccgcggcggtgtgcgagtggctcgagaccgccacgatcatgccgggcttgaggtctcccctgttggagctcgtgcaccaggcgttgtacatgtcgcaggcgttgccgctggcgtatcccaggccggcgttgttgaacacctgagaaacccacattgcgcacagtcccaggccgggcgagggcgtgctgtggcaggcgttcacgacggcctgctgcgagcccgtcgtcgcaccgccgtcgctgatggtgcccgtcacgttcgaggccgcggcaccggagctcgcccttgccgccgccgcggcggcctttgcggccgcggcctgctcggccttctccttcgccatggcctccagctcgctgtcgcgctgcgccatgagctgcttctgctggtcgttgaggtcgctcaggatcttctgggtctcctgctgcttggactccatctccttgagctgctgcttctgcgtcgcactcagggtctcgagctgggccttctgcgcgctcagcgtgtcgcgctggctctccaggtcctccttcagcccctttacctcctggatcatcttgctgtcggactcgctgatcttgtccatgtaatagacgttggactcgaactcctcaaaggtggaggacgagaagagcacgtccagggcgctcgtggagcctgactggtagtctgcggacatgcgcttggcgaggcgctcgcgcttggtcttgagctccttctccttcttgtcgatgctcttctcgacggaatcgatcttgtcctgcgtcgtctcgatctggtcgagcgtgtccgactgcttcttcgagaggctctcgtactgcgcggcgatgtcgtcgagctccgcctgcaccttctggacctgcttctcgttggcgtcgatctgggagttcgtcgcgtcgacgtcgctctggtccaccgccagggccgcatgcggcgcaagcgtcgccagcccggcaccaagcagcagcctgagcgcgctgcgacgcgtgaggttgttgagctccaaggcgtcccccgtttcgtttcgtttgatctgcgtttgggcgcgtttttcacacgccaccacatgctagcgccacgtgcgccgtggccagcgagtctccgtaactttaccactgcgcgccccgcttgcgagcgcggctcgaccgtctgccgacggaacgattgcccccgcttacggaaatcagctcgtaaccccaaggaaaccaatcccacacaaacctacaatcgagctttgtgttccgagcgagccgcctgcggtgggacggcaatcgccactttggacgccgcgtggcaccgggcgtggcagacggaagggggctcgcaccatgagcggcccagacacgggaacggcaggtttggacgcgggcgagaagaacatgccccaggacacggggcggcgtgcgcgcaagaagcgcaagcaccagatgctctcgtcctacaccatcctcctcatcatcacggtggccatcggcatcctcaccatggtcatggcgcgcttcacgcccgccatcaaggcggtcaaggtgtcggacatcatcagcagcccggtcaagggcgtgctcgacggcatcgagatctcgctcttcctgctcatcttcggcgggtgcatgggcatcgtcaacaaggtcggcgccatcgagaccggcatccgagcgctcgtgaggcacctcgagggccgcgagctcgtgctcgtccccgtcatcatggcgatcttcgcggtcctgggctccgcctacggcttctgcgaggagaccatcccgttctatgcgctgctcggctccgtcatgtacctcgccgggtacgacacgatggtgtcgtccgccacggtgctcttcggcgcgggcgtcggctgcctcggctccaccgtcaaccccttcgccaacggcgtcgccatcgccaccctgcacgacaaggggatcgagtgcaatcaggtcgtcatcatcgcgctgggcgccatcctctgcgtcatggcgtactgcgtctcgctcttcttcatcctgcgctatgccaagaggatccagcgcgacaaggggtcgtccatcctctcgctccaggagcgcgaggcatgcgagaaggacttcggcagcaacggcggcaaggcccttctcaccaaggagaactccaccctctcgcgcacccagaaggtcaccctcgtgctcttcgcgctcacgttcgtggtcatgatctgcggcttcgtgccctggaaggacttcggcgtcaacgtgttcgacgcgggcgcctcctcgcacgaggagaccacgcagctctccggcaagcagatcgaaagcgactggaacggcaacgacgacatgacgggcgactacggcgagatcacgtccgtctccaagggcacgagcgccaagaccacccagaccgtggaggactcccagagctggaccggctggctcaccggctcctccatcggcgactggtacttcaacgaggccagcacctggttcttcgtgatggccatcgtgatcgcgctcgtcgcgcacctgtccgaggccgaggccgtggacgccttcatcggcggcgccggcgacatggtgggcgtcgcgctcgtcgtgggcctctcgcgctccatcgagctcctcatgaacatgtccggcctcgaccagctgatcctcacctcggcgtcgcacagcctcaagggcctctcggccatggtcttcacgccgctctgttacctggtctacctgggcctctccgtcatcatcacctccacctccgccctggcgtcggtctccatgcccatcatggggccgctggctcaggtcctgcacttctcgcccgacgtcgtcgtgatgatcttcgtcgcggccaacggactggccaacctgttctcgcccacggccatcttcctgccgggcctcatgctcgcgcacgtgggctacggcacgtacctgcgctgggcgtggaagcccatcctggtcataggcgtcctctccgtcgtcatcctcacggcggccatgatgatcctctgacccaaaccccacacggcgccggtccatacggtgccgacgcgtcttggcagcgcctcccgggagccccgcagcgggtttccgggaggcgccttcagttggccaaaagctcgtgtccagcttgcaagaagcattgcgcccgtcgcatgtcaccgcgcccacctgcgcttacgcagggttgtgaagcggtatcactaccgtgacggccgcagccgatgcggcgccaccaaggcgagggagaagaacatggccagccaagacagcaagggtcacgccaaccgcaacacagccctgccgacggcgcgcgggacgaggccccgcgactacgcggagttcctccgcagggcgggcgccgtcgtggtgacgggcgccctgctcgccacgctcgtaccggcaccggccatcgcggcggagtcctccaccgcctccggcacgtccgcgaccgccacgcagcccggctccggcacgccccccagcaagccctccggctccggccagggcgggggcggcgccaacacgcagagctacgactacacgggcagctactccgccacactcgccgccaacggccagagcgtcagctccaagggcaagtccctctcgtccacagagtctggcaagaacgtggccctcgcccagaacggcggcaccctcacgctcaccaaccccacgctcgccaagtccggggacgacgacaacggcgacaactgcaacttctatggcgtcaactcgatcctgctcgccgtgggctcgggctccaaggcgcaggtctccaagggtactctctccgccacgagcgagggctccaacggcatcttcgcgacggactccgccacggtctacgccaacggcaccaccatcaggaccacggcgggcaactcgcgcggactcgacgccacgtacggcggcacgatcgtcgccaacaagatggtcatctccaccaagggcgaccacagcgcggcgctcgccacggaccgcggcggcggcaacgtctccgtcaccaactccacgctgaccacggccggctccggctcgccgctcctgtactccacgggcgacatcgaggtcaacaacgtcacgggcgcggcctcgggcagccagatcgccggcatggagggcctcaacaccatcctcgtcaacaactccacgctcacgagcacccagaccggcaagaccgcgtccgaccccgttgccaacggcgtcatcatctaccagtcaacctccggcgacgcggacaccaccacgggcgagaaggccaccttccaggtcgcgaactccaccctgaggagctccattacctcgggttccatgttctactgcaccaacaccacggcgagcatcgtcctttccaacacgaagctcgacttcgactccgacaaggcggacctactgctcgccacgggcaacgactccaacaactggggcagcgcgggctccaacggcgccacggtcacgctcaccggcatcggccagaccatgaccggcaacatcgaggccgacaccatcagccaggcggacgtgtacctcaccaagtccagcacctggagcggcgccgctgccatcaagaagaacgccacgggctccacgtccgagtcgcccctcaacgtgcacgtggacaagacctccacgtgggtcgtgacggccaactccaccgtgtccaacctcacggtcgccaagggcggcaaggtggtcgactccaacggcaggaccgtcaccatcgtctgcgacggccagaccgtggtcgagggcacgtccgacgtgacggtcaccgtcaacggcacctactccacggactacgactcctctggcgcgggcaccctcgcgaccagcacgatcgaccgctccgcgttcgacaaggcgttcggcacgagcacgtccttctccatgaagaccgcctcctccaagacgacgtcctccagcacgtccggcagttcctccaacgcggacgcctcgagcagctccgccaccgcggcgtcgtcctccgacggcggtgcctcggtccagcagttcttcgcggccatcgtctcgttcttcaagggactcctcggcctcggctagccggctaggcaagccccagcagcccggcagcgtcagcctcgcccagcgcgagagcgacccagcaccccacgccgagcgccggcccccacggaaagacatccccaacacacggcgcccgcacgtcacttccccccgacgtgcgggcgtccgcttgcgtgcgcccaagccgccgccacccgagcggcacgcgcacccaccgcctccagacaagtgcaagccccacgccgagcgtgcaggcaagtgcaagcatgagcgtcatctgcgcggggccaaggtacaggcccgcgacgcccacgagcttgacgtcgcccgcgcccacgcagccctcccccagcaggcgtgccaccgcgagcgagaaggccatggcgacgcccaccacgcccgccgccacgagcacgcgccccgtcgcccccagaagggccgccgcgagtcccatgccccgcagcagcccgtcccacacgaggcaggccacccgcaccgccgcggccacggcaaggcacccgttggggatgcgcatccacgccaggtcgaaggcggacgcccacaccaggcagcagcacagcaccagcgcggacgtcgcctcgccgggctcgggccacgcgggggtgccgcccccgcccgcgagcgaccatgcctccacccccaccacaatggcgcccgcgagcgcacccgcaaggcgccccatcgcgcccggccttggcaccccgtcatcacccgtcagaccggcgccccacgcgcacgcggcccgcacggacgcctcccccacgccggctccaacggatgccgcgaccacaaccgcaagcgtccaacacggccattcgccccacacaacaagcccgcccatacgccctcccatccgtcgtgcctcgggacgggagattctacgcgccgcaggccaccgcgcgtaggttaaattcgcgataacaagagttgacgtgacgcggcccgcgatacaatcgcaagacaacgccgcagagccactgcctggcgtgggacattcgaggaggtcgccatgggcgatgcgccgcagaatccacaggacgagcttcacaggaagctgcaagacttacgcgcatacctgcgccagctcggcagcgttgcggttgcgttctccggcggcgtcgactcgaccttcctcaccaaggtcgcgcacgacaccctgggcgaccacatgatggccctcaccgcgagcatccgcggctcgcgtccgcaggaactgacggacgcgagcgagctctgcaagcgcctgggcatcccccaggtcgtgatcgagtacgacgagctcgaggtcccgggctttgcggagaaccaccccgaccgctgctacacctgcaagcacgcgctcttctcggagctcaagctcgtcgcggacgccaacgacctgcgcttcgtggccgacggcaccaaccaggacgacctgggcgactggcggccgggcctcaaggccctcgaggagctcaacatcaagagcccgcttcgccacgcgcacctcaccaaggcggacatacgcgcgctctcgcacgagatgggcctccccacctggaacaagcccagcgcggcgtgcctctcgtcccgcgtcgcgtatggcgagaagatcacggcccaaaagctcgagcgcatcggcagggcggaggactacctccacggcctgggctttggccagctccgcgtgcgcatccacggcgcggacggcctcatcgcgcgcatcgaggttcccgagggcgacctcgcgcgcctcatggagcccacgctgcgccaccaggtcgtttcacacctgcgcgagctcggcttcgcctacgtgacctgcgacatgacggggttccgctccggctccatgaacgaggtgctcgagcaggagtagggccgaacccgatacaaaccagcatccaccccgcaaggagggcagaggtcatgtcgagaaaagcatatgtttcaaagtgcgagccagcccagaggatgtacgagtacgacgtgcagctaaacgccaccccacgctttgtgaagacgggcgaatacgatatccgcacggcctcggctgccggcaagttccagcgtctcgtgaccgcaatagaggccagccccctcgtgaaggctgacctctccggtgcaaccgaccgctccgtcgccagaacgcttgcggaaaagttcaatagctgatagacatcccgttgcgtagggataacgtgctcagaaagtccctatgcctcgcgcagccagagcaggcgccccgcgcccctcgcgatcttaccctgcggaaactcgatcgccgcaacggcacccttgggaaacggcaggtcctcgccacacagccatgcgaccatgttccgcatgaagggcacgtggcccaccgccacgaccgtacccgcgtccgacgcgcgcagctcgctcaggaacgcctcgtcgtcttggtcgtacagtgactcgtgcgggatgccctcgctcgcgtccacgcccaacgcatccgccacgacctcagcggtcatctgcgcacgcacggcggggctcacccagagctccagctcgccgcgcggctcgaagtccgcaaacaggcctgggtaggacttcctcagccgctcgaggccctccggggtgaggcggcgcgccttgtcgccagccgcccccttgggctcggcatccccgtgacgaacgagcaccagcaggctgaccatgtccttctcccctccgccgcgccatccgcggtcgcggcacaacgctacttgttctctatctttcccacgttcttgatgaggatggacacgtagccctccgcgtccgtcgtgaactcgatgtagttggagtcggaggcgtactgcgaggggaacgtgatctcgatgcccgtgtcggtctttatcttgtggttctttgccaggcggttggcgacgccgcgcttgacggggacctcctcgggaagctccttctcgcgggacacctgctcgtagcgctcctgcagctccggctcgtcctcaaagaccttcttgcccacggtctccggcgcaaacgactcgtccacctcagcgctcgactgcaccacggccttggcgtgggcgacggcctccgtcacgttgacgccggcctcctcggccacgtccgccacgatcttctcgaccgcctccaccacctcgcggctcgacgcctgcacgctgcactggagcagcccctcggggatgacctggcgctcctgcgtgcccacggtgcgcaccttgtcgtggaagtcgatgctgaagtcgcccaggtcgaccagcacatagctgtcgaccttctgcgtggggctcggcagcgtggagtcctggcgcaggatctgattctgcggggcgcccgtggcgtccgcacccaggtcgtggatgaacgcctgcttcctgggcaggagcacggccgcaaagtacctgcggctcaggtcctccaggtccggcgcctccgcggcggcctcggccatcgcctgcgccaccgcgccgccaccggcctgctcggccttcgccttcatgtcctgcgtgtccgtgaagtcgcacaccaggaggtcgcactcctccaggtcgtcgcagcggcggagctcctcccacaggtactgcgccacctgctgcgacagctccgtgaagcccacctgcccagccacgtagccgtggagcgcgtccgcaaagccgctctgctcggaaaactggccgtgccggctctccgcgttcgagctgatcttgcgcatgtatcgctgcacgtacgacttggttgcgcgcgtgtccaggtcaagctcacgctgcgagaaggacgtgcttcccgactcgaagtcaaaggcatgcaggatcgcatggctgatgtgcatcatgttctatcaccgtctggctctcccgcgacgggaccgcccgccgcgccgctggtttgccgaatcaggataccaccgccggcggtgaccatgcccgcctagagcctgcggccgtacaggtagatgacgcccgcgtcggggtcgccgtagatgccgcgcttctcctggatgagcctgagccccttgtgctcggagaactcgcaatcggagtccttcgtcatcatggtgaagaagcccctgcagttgtgctcgcagaagcgcatcacggcatcctcgatgagggcggagccgatgccgttgtgcctgtacgcggggtcgaccacgcagaggttgagctccgcgtcgccgttgctgtagccgcgcgagatgaagacgtcggccgtcgtgtacatcctcaggcggctgaagagcagctcctccacgttgggaccgccgatcttcgcgcgcttgcgtgcgggccccatcaggtcctcgaagcgcttctcccagcgctcgttcttctctatcgcgccgtccttcgtgaagccgccaaagcaggcgcccaccaccctgagccccttctgggccacgatggaaaactgcgagcgcctgagcgaccccgccgtgaagaccctgccaaaggtgatgcggtcgtagacgccctcgacgtccgaggcccacgtgcgcgcgcagatcctcgccaccgcgtcgaagtcgtcatccgcaaagggtcggtagattacctcgctcttgctggtgtccgttggcattgcgacttcccttgcgactgtctgctagcaaacgagtttgaaattcatccactagagaaattcttttttcttaccatcaatttagcgcatattcagcaatcgtggtaccaggcgtctcatgagcggtaccgctatacgggtgactgtctatgcacaatggtgagaaatactatcatgaggctcccgcaaaggggagccaaagcaaacgtccgcgtcccggagcacgaaaacgccccaacatgtacacatcgcgtcgagcgggcgagaaggacgcaaaccaaagggggcggcaccttggccgccccctcgaggggtcttgctttacttgccctttggactctcctcctaacagagcatgtccaattgaccaactgaactcgcccggaatctcggggacctgcgtgacgctcaacgcctcatcgggtggcgttcaggtaccttcgcggtcgaccggttctgccgtctgtctgctcgaagaccgtgcgaatctcattccgctgacgatgggctctctacctacccgctaagcgtagacgggacgcgcgatgccttccgcgaaggaccgaggatggcactcgtctctgttcactggcatcacctcccgctccggccgccgatcaactttacgtgcggctctttcttgtcactgtcagtattgcccagttcgggtggaagatgtacacgaatccgtgttcaaccgcgcggacggtcgcgtttgggcggcaggcggtagcacccgccgcccacggcggctacctaggtctcatcatccttctcgcccgcgtcggacgccgcatttgcactggccttgcgcttgcgcacgacggcgtaggcaacgcccgcgaccacgaccacgcagacgaccgcgacgaccgtgccgttgccctggtcctgcgacgcgccaaagtctccgtcaagctgcttggagtagaccgcggccgtgaggtagcggtagtcgtcctgctggtgcgccttgttcgtgagggtgttcgcgaagagggcgatgtctcggccgtccttctggtagtcgacggcctggatcgtgtcctgatacttcttgatgtcgtccttgggcatgaagccctcgaccagcgggtcgtccgtggtcttgacgagcaccttggagccggccggcgccttcttgatgtagcctccgccatagccgtacatgaggtggtcgccctcgttggcgtaggtcgccgtgatgatgtcgcccttggggaactcgacggtgccgaaggcgtcaaagcccagccagtcgccgccgctcggcgtgaaagagaacttgcccgcgagcttgtagtccttaacgaactgcagcgcgtcagccgtgtacgcgacgtagggcgtgccggactttaccttggctgccacggccttggcattgacggggtactggctgcccacgatgatggtcgcctcgtccaggtcgtctgtcagctcgaagcccatctgcttggcgagcgcgaagtcatcccagttgccgttggtgttcaggcggttctcgtagtcggccatgcccaccttgttgcccgcggcgtcctgctggaacttggcgtacgccttggggacgtaggccttgatggatccgtcgatcctctcggccgcgggcgcctcgtcggcctccgtcacggtcaggacgtagtcgcccttgaccttgcccaggtcgtccgacttgaccacgtagtcgccctcgtgcttgcccttggtcacgagtcccacggtcttgccgtccttgagcagggcgttcacggccttgatggcctcgagcccattgttcttgatcacggcgtagccgcccttgcccgtgacctcgctcctctgcttgggggccttgtcgatctccttcattccggcggacgagaaggacccagccgtgcggatcgtgtccatgtcgaacccgcggaactgcgagaagttggtgacaggctcgctgtagagcgaatattgggtccagtcgctgatgacgaggttggggtagagcgcgcagtttgccatgttgcgcttggcctggtgcatgtccaccacgatcgtgcctgcggggtagctcttctcccccaccttgacggccttggtggtctggctcacctgcacgtcattgtggatgaggaagtttatggtctccgcggccgcggcgcggttcttctgcagcttggggtccatggggatgacatagtactccgggaagaagtttccgttggtcttgccgttggcgtccttgctgtcacggggacggaacgtgtccgcctccgcgcccttctcgtccttctggttgacgtagtagggacggatggagtccgcgtcgatgttctggacgccgcggcggaagcgctcgagctggttgttgaacatgcggtccttgttctgggccacgaagccggcgttgcccatgaagccgtagcgcagcgcgtcgaccgcgtccgcggtgccgtagggggcctccacggtgtaggcgttggtgccgtgcatcatggcgtactgcggcgtgtagctggtggacatgtcgtcgaagggcgcctcccagaagcgggtgccgtcatcctcgagcttgaggtagtcgcgcatgggcatctggacggagttgatcgtggggttgttggcgattgccgcgcccatgaaggcctcgccctgcgcgagcgccgtgtcgatgaagaggtcgtactcgttgttggggtcgtgcgtgggcgagcagggctcgacctggaactgctggtagtagccgtggacctcgtgcagggagatggggtcccactcgctgatgaggccgctcatggcctgggtctccggctgggtctggtacgtgttgtcgcggttgaggtcgaagccgttgccgttggtgcggacgtcgtccgtgcgggcgtccacgttctcgctcgggacaaggatgtagaacacgtcgtccagtgacttcgaggggtcgaaggtctgcgtgtcggagtcgtagtacttctcgaactcctggtcgctcaggtcggaggaggcggtgtccgtgtccgcgccgtcgtagttggtgccgtggcccttgccgccgtcgccgcggatgtagccgatgccctggacgtcgtcctttatgaggtcgctccagacggtgcggtcatggtccatctcggtcttgagctctgccttgccgtcggaggtgaggcccgtggcgcgacggtactcgacgggcttgttggccacgaggtcgcgcgcgaactgtatcacggcgtccgaggccacgatctcgtccgcgtggacgttgctgtagacgacgggcaccttgtagctgagcttgcctgccgcaaggtctgcctgcacggatgccgggtccttctccatgcgctgcttgagggcctggtagtcgtcgaggtcggacttctgcttggacacgaagagcgcgcgcatcggacggccctttgcggacgtgccgaaggtacgcacctctgcgtacagtccgttggccttggcctccttcgcgagcttggggagctccgcgtcgatgtcctcctgcgtggcgaacacgtcgtaggggcgcagcgtcacgcttgtcgaggcggcctccgtgccgtcgacgtcgcaggccagcttgtaggtgcccacatagtcgtacattgacgcgcgaacgaactcgcgcgagcgcacgtcgatcccatcgagcccctcgtagagctcgcggttcttgaacgtcacgacgacggagggggtgccatcgacctcctgcgcggagaccttcacgtcatagaggaagtcgcgcgacttgcggaccttctcgtccgtggtgatgccgttgccgccctccgcggcgccgtccttggtcgccacggtcttccagtcgaacagcttgccgcccagccactggttggggtaggtcttcttgctgaactgccccttgccgcggctgagcgtccagctgaccttgccatccttgacgagcctcttgagctcggacaggctcttgccctcgaccggcgcaaccgccctgaactcgcgcccctcgatcatggagatcatcggggtcgacgtgccgtcgtacgcggcgtccgtgcgcgtgaacgtggccttggactcggactgcgtggccgactgcgacgccgtggtcgtggcggccgtcgccacggttggcgccacggcctgtcccaagctcgcggcgagcatgaggcccgcgacgatggcgccgcccgccttgcgaatagaaaccatcccatcccccttagcaagatgtggacccacgggaaggctggggcagagtatccagtccttctcgccctcaaaacgacggaattcaggttactttgatttgttttgttatgttacagatttgtttcagtgctaggtgagcgttgcgtttgcgtcggtgtgcgatgcgttcgtaccagaatcaaccgcattcgcgcgctgcatgcaatatcctatattctcacggtttcacaacgtctcggcaggtctttttcgcaacgctgctttcgatgcggccaaatatgcgcagacataaaaatctttgcgcgggacgccgctgcaacgctcacaatggaggggtgagaagagcgtggcgccgcggcccgcggcgcggattggggtgcagcatgaacaggacggccacgtacggtgtggcgaaggacggccgcgcggtctacagcaacgcgtggctcaggcacagcttctacctggacgcgtcgcagcagcgcacgtgcacgatgtaccggtcgcgctacgtgctgggcgtggcggccggcgcgctggtgtgggtcttcaccaagagcttcgtcgcgctggtggcggttcccgtcgccctcatcctgctgatgagctacctgttctactatcacttcctgaccagcctcgaggtcgccccggacgacgacgcggcgctgcccgtccgccggcgcatgagcctcgtgcagggaatcgtgtacgggctcggcggcatcgcgtgctgctgcctcatggtcgtgaacgcgcgcgcccaggacttcacgggcaccacgctcaccgtcaactacgttgccgcggcggccgtcgcgatcttcggcgtgtggcagatgctgaggggcatcgtcgagcgcggctaagcgcgggcagcgtgcgcaatcttgcagactgaggaggacgccatggcagaggacctttccaacatcacgatgatgacctacgtgcgggagaccccggaccaggtcgagaagaacgtcggtcgcaggcgcgagctcgtcgggccgctggtggacgagttcgcccgcggcaagtacgactccgtgctcgtgatcgcatgcgggtcgagcgccaacgcgagccgctgcgccgcgccgttcatgcgcaagtgcctgcaggcgccggtcgtcgtcaccacgcccggcacgttcctcacctcggacttcctccccggcgccaacacgctgtgcttcgtcatctcgcagtccggctgctccaccaactcgctcgaggcgctcgaccgcctgcgcggggcgggccgccgcgccatcggcgtcacgggcaaccccgactccgacttccgcgaccacgcggacctcgtggtcgactacggcgtcggcacggagtacgtgggctacgtcaccaagggcgtgacgacgctcgccctgttcctcatgctcttctcactcgaggccgcccacgacctgggcaggctggacgacgccgcgtacggtcacatcgtggacgagctcgagctcgcaccggagcgccacagggcggtccaggccgcgacggaggagttctacgccgcgcacctcaaggacatgctctcgatccagaccaactacgtcatcggcttcgaccaggcctacggcatcgcctgcgagggcgcgctcaagttcggcgagaccatgaaggtcccctcgttcgcgctcgaggccgaggagttcaaccacggccccaacctgcagctcgaccccacgcgcacggtcttcgtggtggacgacatgaaccgcggctcccgtcgcactcacgagctctaccgcgcctgcggatgcatcacggaccacacgtacctcgtgacctgcggcgacgccgacgcgccggctgatcccaacgccttccgcgccagcgtgggcaccatcggcgagcctacgctctccccgctctacatgctgccgttcttccaggtcatcgcgcaccacgccaccgacgccctcggccgctgggacgacttccccctcatgtcggagtacaagaagtgcgcccccagcaagacggaccgcatcaaggacgtcatgcccctgctctagccagaggctcagacaggcgcaaacacgtgcaaacacgtacgcggacgagaagaacgaggggccgccggtcggaacgcatccggccagcggcccctcccgcgtgcggcgatgttgcgtgcgcggcctagatgccgtccgagaagtcgtcgtccccctcgggctcgggctgcgcaagctcgaactgcacgacggacgcctgcatcgcgtccttggcgagcttcgtgaggtcgtccaggcccgtcaccgcgtcgcgctgcgtcacgcactcgacgagccctcccaggttgacgcccgcgaccacgcgcacgtcgcccagaggcacgcccagcgtggcggccgtcttgaagggcgtgccgcccacgaggtcgcacaggacgagcacgccgtccacgtcctcgcgggagcggagcctctccagcgccgaggtcatgttcttctcaagctccgccgtgccggcaagagacgtgaagtcgatcgcctcgtacgcgtcctgcgggccgacgatgagctcgagcgcgctcgtgatgcccgaggcgaagttgccgtggcccgtgacgatgatgcctaccataagaccctcccaacgcgcccgacggggcgcgaaaacgtgcgggaccccgcaccccgcgtgcgaggtcccgcgaccatggaacctaagccatctgcaaggcgtccgctacatccagttgagcagcgacatcagcaggccaaacacgatgaccccgccgatgacggcgatggtgttgacgtgcttcttcttgaagagccagtagatcaggaacacggtcgccaggggcagcacgttgggcagcagctggttgaacacggactggaccgtggtggagccgacgccaaagacgagcttcttctggaactcgaccgtgacgtagctcgggatcagcgcgccgatgaccgtggtgccgaggatgcccgcggcgccggtgaggtacttggtcgcggtgccgaccttctcgaccgccttggagccaaggttgtagcccaggtgcgcgaaccagatgcgcgagaagccgacgaccaggtagatggcgatgaagaccagcgggccgagcacggagcccgactttgcgagcgagcaggcgatgcccgccgtgatgggcagcacggtgtaccagaacagggagtcgccgatgccggccatggggccaaagaggccgttacgcacgctggagatgagcttgcggtccgtgcccttctcctccatcgcgaggaccatgccctgcagcagcgtcgccatgtgcggctccgtgttcatgaactccatgttgtaggtcatgaactcgctgaggtcctccttggagtccccgtagatcttcttgaagcctgggatcatgttcatggtccagccgggggcctgcatgcgctcgaacgagaacgcgatctgctcggtgagcgagttgatgccgagctgggtgatgtccttcttgctgagcgtcttgaggggctcgcccttcttgttggtgggattagatgccatcagagtcgcctccgtcgtctattgcagcagtaccgcactcgtcaaagcgcttctggtagcggtagtcgatcgccgcgagcgccgcaccgacgatagccacgggcagcacgttgggcatcttgaggaacgtcgccatgatgaagccgatgaacaggtacgggtaggtctcgggcttcagcgtgctgagcagcagcatcgcgaggccgaccgcgggaagcaccccgccggcaatctcgagcccgtgcgtgacccacgtggggaacgagttgacgaacgcctggatgggcgcctgcagcgcgtaggtgcagaggaagatgacgaagccgcagaacacagcctcgaagatcgtgacgccccagatgaggccgttgaagtgcttgacgtcggcctcggcggcgtacttgtcgagcttgtgcggcacgaaggagtagaccgtcttgaagaggattccgattccctgggcgagaagtgcgaaggggtacgagagccccagcgccgtctcgggcgtcttgcccgtcgtgtacgcgaggacgacggtcatgatgcccgcaaacagcgggtcgggcggcacggtgccgccgacgttggtcatgcccaggtaggcgagctcggtcacggcaccgcaggtgacgccgagctcgacgttgcccaggatgatgcccgtgaagaacgaggcgaccattggcctgaaccaatagaaggcctcggtctgctggtcgaattggcatatggcgccaactatgaacagcagaagcccttgcacaagtgtaagttgcatgcttcctc

SEQ ID NO: 236 - DNA, 8468 bp, Unknown
  Metagenome-assembled genome
gcggcctgctgctcggccgtgaccgcaaagaactgctggttggaggccgagtggccgtacggctcgtatcccagggccaccaggccgtcgcgcagctgctccgccagcgcgttggcgtgccgcgcgagccgccagtacggcacctcgcccttctcgtccgcgttggccgggtcgaaggccgcctcgaactgcacgcccagcagccgcccctttgccatgaggccgccgcgctccttctgcaggtaggggaaggcctcgcgcaggcgcgggtcgcgcatgaccatcgcctcgccaaagagcatgccgttcttggtgccgcccaggtagaacgcgtcaaccgtgtgcgcgatgtgggggagcgtgaggttgttctcgctcgaggtgagtgcggacgcgagccgcgcgccgtcgaggaagaccctcaggccatgcccgtgcgcccagtcgcagatggcgtcaagccgctcgcgcgtccacacgccgcccacctcggtcgtgtccgtgatgtagatggcggccgggcgcgtcatgtggcggccggtcgaggtctggaagcgccagacgcgctccgcctccgcgggggaaaggaacccgtccgcgtcgcgcgtggggagggccgtccggcccgtggcacccagggcgccggtctcgtgcaccacgatgtgcgcgtcgggcgtgcagatcgcgccctcccagtcgcgcagcatgccggaaagcgcgatcacgttggcggacgtcccgccgatgcagaactccacgtcggcctcgtcctccgtcagcccgcaggcctcgcggatcagccggcgcgcccgctcgcagtgcgggtcgccctcggtgtagcccacgcactgctcggcgttggtggaaaccagcgcctgcaggatctggggcgcggcgccctcggagtagtcgttcctcagcatgtgcatggcgtctcctgtccgtgtggggtggcggtctggcgggtcgtggcccgttcgttccatcttacggcgccggggctcgcattggcggaatccttacctgttaccacggcaacgccctcgcgcccttcgctacgataaatttgtctgatgtctatttgggctcatcggtcgggggcatgcatgctggacagaagggaattccttacctgctcgcttgggatggcggggctgttgcttgcggggtgctccacgtcgggcaccgcgggggatgactcgtcctcgtccggctcggcgtcgtccgcaaagtcctccaagctcaaggtcgtggcgctttcgcagtcgctcgcggacatggcgctccttgccggcgcgaccgtcgtgggctacaccgcggacgcggcggagctcaagggcctcccgtcctcggccaaggccgtcggcaccctcgtgcggcccaacctggagcagatcgtggcgctcaagccggacctcgtgctcctctcggcggacatccccacgcaggcgcgcctcgagtccggcctcaagcaggccaaggtctcctacaagaacgtcgtggtcaactcctttgcggactaccgcaaggccatgcgctcgctcacgcaaaggaccggccgcagcgacctctatcgcaagaacgtcaccaacgtcgccaaccgcatcgccaaggtaaagaagaagggcgccaagctccccaaggtcacctacctggccatccgcatggcatcatccagcgagcgcgtgctcaattctggcgcgcacttcgactgcgaggtgttcgacggcatgcgcatgaccaacgtcgccacgggcaacagcgccctcgacaacctctccgtcgaggcgatcgttgcggccaacccccactacatcctcgtcacgcccatgggcgacgccacggaggccgaggacgccttcaagaaggccttcgagtccaagcccggctggtccacgctcgacgcggtcaaggccggccgcgtgcacatgctccccaaggacctcttccagctcaagcccaacgaccgctgggacgaggcctaccggtacgtgctcgacatgcgcaagaaggagggctagcccgtgacgggcgagaaggacgcacccccgctccccaaggcgtcggcttggccccacgcctggctcgctgtgggcatcgtcgtccttctcgccgtgtccttcgcgtcgctcgtcgcggggacgtccgagctctccgtgcccgcgctgctgcgggcgcttgccgccggccccgccgccggctcgtccacggccgccacgatcctgtggggcgtccgcatgccgcggctgctcgcggccctgctctgcggctgcgcgctctcgtgctccggcttgctgctgcaggccgcgctcgacaacagcctcgccgcgcccagcgtcatgggcgtcaactccggcgcggggctcctgtgcctggtcgcggggctcgtggccccgtactccgccgcggcgcgccagctggggtccttcgcgggcgccatgctcgcggccctgctcgtctttgcggtgtcgcggcgcgccggcacgggcaagaccacgctcgtgctcgcgggcgtcgccgtgtccagcctcatgagcgccgggatcgacgccatcgtgaccgtgcggcccgacgtggtgacggaccgcgtctcgttcacgctcggctccgtggcgggcgtctcgtactcgcagctcgcggccgcggtcgtgcccgtggcggcctgcctcgtgccggcgttcctcatcggcgtgggcgtggactcgctcgccctgggggacgaggtcgcgcacggcctcggcgtcaacgtcagggcctaccgcctgggcgccctcgccatcgcggcgctgctcgcggccagcgcggtctccgtctgcggcctcgtgagcttcctcggcctcatcgtccccaacgtggtgcgcctgcgactgcgctgcggcctgcgcggtcggcttgcggcctgcgccgtgtggggtgccgcgttcctggcgctgtgcgacctcgtggcgcgcaccgtcctgtacccctacgagctcccggtcggcctcgtgctgtcgctcctgggcgcgccgttcttcatcatgctgctcgtgcggcgccaccacggctttggtgggggtggtcttggtgcttgagctctccaacgtcacgtcgggctacggcggcgccttcgcgctcaacgtccccgcgctcgactttcccgatggctgcgtcaccgccatcgtcggcaagaacggctgtggcaagtccacgctgctcaagacgctcgcggcaatcatcccgcaccaggggagcgttcttgtggacggccgcgagctgggcgggctctcgcacacggagcgcgcgcgtcacgtggcctacctgccgcagcagctccccgtcgccgcgatggacgtggtcacgctcgtgcgccacggccgctttgcgcgcatgggcgcctccaaggtgctcggccccacggacaacgaggccgtgcgcgacgcgatggaggccacgggcaccggcgagctcgccaccaagcgcctggccgaggtctccggcggcgagctgcagcgcgcctaccttgcgatggtcatcgcgcagggtgcgcgcacgctccttctggacgagccggcgtcgcacctggacccgtaccggcaggtggagctcatggcgcttctcgcccgtctcgcggaggggggtcgctgcgtggtcctggcctcgcacgacctgccgtccgcgttctccgcggcggggcgcgtcgtggtgatgcggcggggcacggtcgcgtgctgcggcccgcccgcggaggtggcggcgcgcacgggggagctccggcgcgcgctgggggtcacggtcagacgggaacaggcagagggactcctttggccgtacgtgttggcaaggtagccggtccgccggcttgggattgcgcggcagcggacggcgccgcgcaagaggaaggaagaacatgggatacgtgcttgacaaggagggcctcaaccggacgctagacgccctgtccgaggacttcctcctgtacgcgcccgtccggaaggtgggcgagggccgcttcacggacgtggacgtcgtccgctacgacttcgtgcgctcggtggacgacatcgagctcgacgccaagagcgactacagcttcaaggagatcctgacgccgctctcgcagacgctcttctacttcacggaggacgaggttcacgaggccggcggccttggcgcgcccggctctcccgcgggcacggccgacgaccgccccgtgatcgtgttcctgcgcgcgtgcgacctccacgccgtgcgccgcctcgaccagatgtacctgggcaacggccccacggacacgttctacgcccgcatccgcgaccgcgtgcgcttcgcgctcctcggctgcgaccacgcgttcgcgagctgcttctgcctcgacatgggcaccaacgtcgcgcccgaggggtggctcttctcgctcgaccgcgccggcgagggctttgcctgctccgtcgcggacgatgccctggccccggcctttgcggccaatgcccagggcgagaaggacgtgacccccgcgcacgttacggaaaacgaggttcacgtccgcgtgccgtccaaggttcccaactcgatctacaaggacccgctgtgggacgagtacgacagccgctgcatcgagtgcggccgctgctgcatcgtgtgccccacctgcacctgcttcaccatgcaggacgtgttctacacggacaacggccgcgtgggcgagcggcgccgcgtgcaggcaagctgcatgatcgacggctacaccgacgtcgcgggcggcgcctcgtaccgcaagaaggccggcgagcgcatgcgcttcaaggtgctgcacaaggtgtgggacttccgccagcgctttggctacgacatgtgcgtgggctgcggccgctgcgacgacgtctgcccggagtacatcagcttcgcggcgatcgtgaacaagctgacggatgcctgcgagtgcgaggaggccaaggatgagtagccagaccgttcagtcgaacccgtacgttcccttcccctcgcgggtgctcgaggtcgtgcgccacaccaagaaggagtacaccttccgcatggcgttttccggcgacgtccgccccggccagttcttcgaggtgtccgtccccaagtttggcgaggcgcccatcagcgtgagcggcatcgtgcccggcgagtccgtggacctcaccatccgccgcgtcggccgcgtcaccaacgagatgttcgacacctacgcaggccagacgctgctgctgcgcggcccctacggcaacggcttcgacgtgagccgctacgtggatggcgagtgcgtggtcgtggcgggcggcacgggcgtgagccccgtccgcggagtgatcgaggcgctggcccagagcgcgaccccggccgacaagcacgtgatcgtgggcttccgcagcccggacgacatgctcttccgcaaggacctcgagcgctgggacaaggcgctcgacctcacgctcacggtcgacggcgcgcccgagggctacgcgggcaacgtgggcctcgtcaccaagtacattcccgacctgcccctgcgcgacccctccacggctcaggccgtggtcgtcgggcccccgccgatgatgcacttcacggtgctcgggctcctgtcccgcggctttgcggagaagaacatctgggtgagccaggagcgcaagatgtgctgcggcctgggcaagtgcggccactgccgcataggcgagaagtacgtgtgcctggacggccccgtcttcaactacaccgagagcaaggacatgctcgactaggagggcaacatgattcaggacgtcaacgtcaaggcgctgaagaagaacgccttccgccagagcaaggtgcgcggcgagaccgcaagccgcgtgcgcgtgcccggcggcctcgtgagcgccaagagcatggcgcgcatcgtcgagatcgcggaggagttcggcaacggcgagatcttcctcaccaaccgccagggcgtggagatcccgggcatcaggctcgaggacgtgcccaaggtgaacgcgctcctgcagcagatcatcgaggacacgcagatcaaccaggaggacacggcccacggctacctggcgagcggcacgcgcaacgtggtggcctgcccgggcaagcgcctgtgcccgtttggctgctacgacaccacggccttcgcgcagcgcatggaccacgagatcttccccaacaaccgccacgtcaaggtggccttcacgggctgctccaacgactgcgcgcacgtggccctgaacgactttggcatcatcggcatgaccgagccgcagtacgaccccacgcgctgcatcggctgcgggcagtgcgtcaactggtgccagcgccgctccgtgagcgcgctcaggctggtgaacgacaaggtggtgcgcgacgaggaccgctgcatcggctgcggcgtgtgcgtggtgtactgccccacgcgcgcctggacgcgcagccccgagcactacttccgcctcaagatcatgggccgcaccggcaagcagaacccgcgcctggccgaggactggctgcgttgggtggacgaggactccatcgtcaagatcgtcaagaacacgtacgccttcatcgaggagtacatcaatcccgacgccccggagggcaaggagcacatcggctacatcgtggaccgcgtgggctttgacgagttctgcaagtgggtgctcaaggacgtggagctgcccgagaagtgcgagcgtgcgacccgcgtgtactggggcgggaagcgctacgaccgcgagaacgacctcaggtaggggagccgtccttctcgcccgcgaaggcacgcgccacggcgggcgagaaggacgcatgcggacccgcgcggtacctgcgtgtgtttcagacacgtctcaagcgcgtgatgagtgcgtcagagccagtttgccgtagtagactcttttccacctcgcgcgggggcgcgtggttaaaggttctatctaaggagttttgagatggagaagaaggacatcgactggggcagcctcggctttgcctaccagcccacggactacagctacgtttccaactacaaggacggcaagtgggacgagggaaccctcacgaaggaccacaccgtgacgctttccgagtgcgccggccttctccactactgccaggaggtcttcgagggcctgaaggcctacaccaccgagagtggcgacgtggtctgcttccgaccggaccagaacgcgcagcgcatgcatgactccgcagagcgcatcgtgatgcccccgttccccgtcgaccgctttgtggacgccgtggagcaggtcgtgaaggccaacgccgcctgggtgccgccctttggcaccggcgccacgctctatatccgcccgctcatgttcgcgaccggcgacgtcatcggcgtgaagcccgccgacgagtaccagttccgcatcctcgtgacgcccgtgggcgcctactacaagggcggcgtcaagcccgtcaaggtgcaggtctcgcagtacgaccgcgcggcacctcatggcaccggcaacatcaaggccggcctgaactacgccatgtccctctacccgagcgtcctcgcccacaaggccggctatgcggacaacatgttcctcgacccgcagacccgcacctacgttgaggagtccggcggcgccaacttcctcttcgtcaagaaggacggcacgctggttgttcccaagtccgccacgaactccatccttccctccatcacccgtcgctccctcgtggacgtggccgagaagatgctgggcatgaaggtcgagcagcgtcaggtccgctttgacgagatcgaccagtttgtcgagtgcggcatgtgtggcaccgctgccgtgatcagccccgtgggcgaggtcgacaacggcgaccagaagatcgtctatggcatggagcatgttggccccgtgatgaagaagctgcgcgagaccctgaccggcatccagtccggcgagatccccgaccagtttggctgggtccacaagatcgacgtggagtagccgcaggcagcgctgctgacggcgcgacataggttgcatccgggcgggagccggggccgtgggcctcggctcccgttgcatgttggggtgggctggcggcggttggcgcggtgcggcggaaaaatagcgcgttggaagtcacgtttagatgcgggtgatggtgcggacggaaacctgtgcgtcgtattccacgtttaggaaaaattgctcgctggattccacgtttagctgaggggcatccttcgagcgggcaaatgctacgttgctttccacgtttagccaaacttctgcgcttgattccatggttagagcggtacttcgccaaattccacgtttagggggcctgtgggggcgataaacgtggaatcggacgtagcacctgttaaacgtggcattggacgtagttttccgaggcagcagccagcgggcgcgaagctgcgccgcgctgcctcagcagaaccgcccgtccttgcgggcttccaagaatgcctg

SEQ ID NO: 237 - DNA, 8653 bp, Unknown
  Metagenome-assembled genome
agttcatcgaggagtgctggaagtggcgcgagcagtacggcggcaccatcgtcagccagatcaagcgcatgggctgctccatcgacttcgacgacgagaagttcaccatgtcgcccgagttcagccgtgcggtccgcaaggtcttctgcgactggtaccatgacgggctcatctaccgcggcaagcgcatcgtcaactggtgccccagctgccgcacggccatcagcgacgacgaggccgagtacaaggacgaaaagggccacctctggttcctgcgctaccccctgaccgagccggtcgacgggatcgagtacgtgaccgtggccaccactcgccccgagacgatgctgggcgacacgggcatcgccgtgagcccgcaggacccggacaagcagaagctcgtgggcaagaccgtgatgctgccgatcgtaaaccgcgagatccccatcttcagtgactggcacgtcgaccccaagttcggcaccggcttcgtgaaggtgacgcccgcacacgaccccaacgactacgcgatgggccagacgcacaacctcccgcagatcaacatcttcgacgagacggcgcacgtggtcgagggctacggcgagttcagcggcatggaccgcgacgagtgcaggaaggccatcgtcgactggtttgacgagcacggcctgctggaccacatcgaggacctcgagcactccgtcatgcactgctaccgctgcggcacggcgctggagccgtggctgtccgagcagtggttcgtggccgtggacaagctcaaggagcgcgcgaccgaggtcgtgaaggacggcgaggtcaagttccaccccgatcgctggacgcagacctacctcacgtggatggacaacctcaaggactggtgcatcagccgccagctgtggtggggccaccgcatccccgtgttctactgcgaggactgcggctgggaggacgccctcatggaggacacggacgtctgccccaagtgcggcggccaccacgtgcaccaggacgaggacgtgctcgacacctggttcagctcgcagctgtggaccttcgccacgcagggctggcccgaccaccccgagcagatggaggggcaccaccccacgaaggtcctcgtgaccgcccgcgacatcatcgccctgtgggtcgcgcgcatgatcatgagctcgctgtacttcacgaacgagattccgttccacgacgtgtacatctacgcgaccatcctggccaaggacggcagccgcatgagcaagtccaagggcaacggcgtgaaccccatggacctcatccagaagtacggtgcggacgcgatgcgcttcaacctgctcacgctcatcaccaacaaccaggacgtcaagttcgacgccaacatcgacaagaagacaaaggagctgattgacagcccgcgcaccgagcaggcccgctccttcgtcaccaagatctggaatgccagccgcttcgtccagatgaacctcgccggctacgagcccggcgcccccaaggccgagacgcccgaggacgcgtggatgctcagccgcctggccaaggtggtggccgactccacgaggcagctcgagcagtacgagtttggcgactacgcccgcaacatccagtcgttcttctggaacgaggtgtgcgactggtacatcgagctctgcaaggaccgcctgctgcacggcgagcccgcggagaggctgcaggtccagcgcaacctcgtgtttgtcctcgacacgtccatgcgcctgctgcacccggtcatgccgttcgtgacggagagcgtgtgggacaagctccccgcctccggcctcgacgcgcacgacgcgcagttcctcatggtcgccaagtggcccgagcccgacgactttgccaagttcgtgaacgagaaggccgagcacgacttcgacctcgcaaagcgcgtggtctccgcggtgcgctcgactcgcgcccgctaccgcctgtcgcccaaggccgagctcgacgtggccgtccgctcctctgcggatgacgcggcggtgctcgaggcgcagcgctcgttcatctgctccgtcggccgcgtggaccagcttgccctcggccacgagcaggagaagcctgagggctccgtcaccgtcgccgacggcacgctcgagatcttcgtggcgctgggtggccttgtcgacctcaaggccgaggcggcccgcctcaagaaggagctggcaaaggccgagaaggacctaagctccgtgagcaggaccctctccaacgagggcttcgtcgcgaaggctgcacctgccatcatcgagaagaagcgtgcccagcaggccgagctcacgaccacgatcgagcagctcaagagccagctcgcggacttcgagtaggtcctgacgggtcagcatcggcttcccacgcagcgtgagacgcacatgaagggcggtcgccggcagtgccgacggccgccttctgcttcgggtgccaagcgaggatgcccgagattctcgctaggagcgtggatagaacctccagtagaggtcgggaagcgacggacgatgcctgccgcccacgtcgaccagcttgccgtcttggatgaagtacgcatcgtcgcaggtctcgtccaggtcgtgtaggaggtgcgatgacatgaagacgcagcgcccctcggacgcataggcgcggatgcgctccgacgcgagctcacggttggttgggtcgagggcgttcatgggctcgtccatgagcaggacaggcgactgcgtggcgagagcgaccgcgatggagacctgctggcgcatgccttgggagagcgtgccgatgcgcttgtgcctgaactctgcggcgcccatatccgcgaggtagtcatgcgagtcgtcgcgacggccccataggcatcggatgaggtcgagcatttggtccggtgtgaggtggtcgtacaggatggcactgtcgccgggaagcaggaagaccatccgccgccacgcggcctggtgcgtggggtccgcctcttgcacttcagaacggaccgcaagcgatgcggacatggccgatggcttgcgcggcatgcccgcgagtgccgtgaggaacgtcgtctttccatatccgtttggcgcgacgaatccgacgacgctcttgggaccaagattgaggtctccgctcacgatgggctggttgcgcacgtagccgacctttgctccatcaacacgaagaagccagcccgacctggccacgtcgggggagccgccgcgagcgtgtacgaacgagtgcgcgaggcgcgtcgtacgcacgattacaccggccagccccatgagcaacgccgtcatgcagatagaggccgtgccgaggggggcgctcgcgcctgcgatgggaatcgcgttcgtggcgccggtaccacccaacctcccgaagattcttcccgcggagaagtacgtggatggtaagacagcaaatacgttcgggaagagggcgccaaggctgtagctgttgtcgagcaatggcggaaccagaaggaagagccccgcaatcatgaccgaggatgaccggagcgaggccgaaagggagcagagcgagcccagacagaagcctgcgatgaggaagaccgctgcgtaaagcaggagctcctggccaattgtcgatctcacgagcgcgtcagcctgccagtagatgacggggtatgtgacgtctcccgagccgtttcggaccgtcgctagggcaacggccgggagcatggggacgaaagagcatgccagagcgagaagggccccaaaggcgccgaagtacagccacgttcccagaggggagaacggcgcgtgggagaggagcctagagcaggcgcactcccttgcgacggcccagagcaggacgaagggcgcgagcaggagtaggggcgagggcacggtgccaaggtagaaggcgcgaaggacgaggcccggcaggtcggaagttccctcgtacagggtgggcgaacgaagcccgcaaacggtgtcgagaaacgcatgcgtaaaggtgtcgagtctccccgccgccgaatcgcctgactgcccctgggctttctggctcttgagtaaggcaaactcgtaggagcgcacttccctgcagtaggcagcctagtccttctcgcccattatcctgtcgagcttggacatctccctgtggtccgcatcggtcagctcccggccgctgtaggccaggttctgctacgcgtcgtagtagctgtccctggagtagttgtacgaggtgtcggtggcgatgggaatgagcgtcgcgagcatcgcgacggcagcgatggttacaagggccgtgagcagccaacgcctcctggctaggagcgaatgggacttggcaagacctgcagcggacatgacgtcccccccagggtcggaatgcaaactgagtaggaccttagcacaggtcggccatatggttcccagcttgtcggtcgactgggcgctcgctcccctttcgggcgtggcacctgctcgccaccgtttgtttccgctcgtggaaacgttgcgcgtcgcgcgctgcgctcggataaagtggttcaaagcttgttgacttcaagtgccggcgcacgggaaaggggcccgacgtcggcggggagggagccatgcacaaagagttcctgatgggaaaccaggcgatggcgttgggggcgctcgcggccggggtcgacgtggtggcgggctatccgggcacgccctcgacagagattctggacaccatcgccaagcgcaacccgggcgacgtctacgtggagtggtctgtcaacgagaagtccgcgctcgaggtggcggccggcgcatcctacgcgggcgcccgctcgctcgtgaccatgaagtgcgtggggctcaacgtggcggccgacccgctcatgagcctggagtacattggcgtcaagggcggcatggtcatcgtggtcgcggacgacccgggccccatatcctcacagaccgagcaggacacgcgcacgtttgcccagttcagcaaggtgccgtgcctggacccctccggcgtggccgaggcctatgccatgatgggtgacgccttcgagctttccgagaagtaccacacgccggtgttcctgcgtccgaccacccgcgtcgaccacggctacgaggccatcgacgtggccgacccggacgagtaccaggcgacctccccggagggcttcgtgaaggacgcgtcgcgctgggtcatcttcccgcggctttccgtgcgggcccacgcggacatcgagcggcgtaacgcagagctctcgcacgagctcagcggctacgcccgcaaccggatcgactgggagcgcggccacggcgatgcggcgcccaaggacgacgccgcggcgatgggggcgcgtacttctcgcaaggcaatcgcgacgcatggcatcaactacacctacgtgcgcgacaacctggccgagggcgagtgccgcgtgctgcgcgtggcgacgccgtttccgttcccggacgacctcgcgctcgatttcctgcagggcgtggacgaggtcctgtgcgtggaggagctcgatcccgtgatcgagcgggccctcgtggcgcttgccggcaggcgccacctggacgtggccgtgcgcggcaagctcacgggcgacgtcaagccatccggtgagaactccgtggagtacgtcggcggcgtgatcgacaagttcctgggcaggggagaaggacgcgccgccttggccgccgaccccgccgtgggcgccgccgagccaccgcagctgcccgtgcgcccgcccgtgctctgcgctggctgcccgcaccgcgcgagcttctatgcggtcaagcgagcgatgcgcggcaagaagaccatcttctgcggcgacatcggctgctacacgctgggcaacgctcacccgctcgacatgtgcgacacctgcctctgcatgggcgcgggcatcaacatcgcacagggcgtgggccacgtggagccggacacgcactgcttcgccttcgtgggcgactccacgttcttcgcgtccggtatcacgggcgtggtgaacgcgttctacaaccaggccaatatgacgctctgcgtgctggacaacgccaccaccgccatgaccggccaccagccgcacccgggcacgggctggacggccatggggcagaaggtcacgcccgtatcgatcgagcgcgttctcagggccatcggcctcaccacggtggagacggtggacccgctcgacctggaggcgacggccaggaccgtggcgcgcgtggacgcggagcccggcgtcaaggccatcatcttcaggagcccgtgcgtgttcctgtacaggccaagcgcgcagagccacgtggaccccgcgcgctgcgtgggctgtcagcgctgcgtcaagcagctgggctgccctgcgcttgtgccgcaggcagacggcagggtggcgatagacggctcgcagtgcacgggttgcacgctgtgcgagcaggtgtgccccacgggcgcgatatccggaggcgtgagggtatgagcgaggcaagcgtgacgaccgtgaccccgcaagccgcgggcgagaaggacggggccatgcgggccgacatcgtgctctgcggcacgggcggccagggcaccgtgctggcgtcccggctgctcgccaccgcggccatgcagcacggcctccccgtcaagacggccgagaccatcggcatggcgcagcgcggcggctccgtcttcagccacgtgcgcatcggcgagggcgtcgcgggtcccatgatcggccgcggcagggcagacctgctgatcgccttcgagccggcggaggccgtgcgccagctgggcttcctcaagccgggcggcaccgtggtcgcgagcaaccgcgccgtggtgccggtatcggccatgaccggaggccccgcctaccacctggacgaggtcatgtcctacctgcgcacgacggtggaccgcctcgtggtggtggacgccgccgacgcggagcgcgagctgggctcggccaaggtgctcaacgtgctgctgctgggcgcggccgcgcgcacgggcgccatcggcttcaccgtggaggacgtgggccgcgccatgcacgcgtgcgtgccggagcgcttctgggagctcaacgaccgcgcgctcgcgtactcggagcgctacgtgtaggccgtgccacgacgccgcagcaggggacaccacaagagcaagggattgccatgcagatatctgacaagcagctcgaccaggtcaacacgcagatcgcgcgcctgcgcgcgtcggacaacttctacgggcgccgcctcaaggaggagggcatcacgggcgtggcctcggccgacgagttcctgaggctgcccttctcgtccaagcaggacctccgcgacgcctatccgctgggactcgccgcggtcccggaggagaagatcgtgcgcatccactcgagctcgggcaccacgggcacgcccgtgatcgtgccgtacaccgccaaggacgtggacgactgggcaacgcagttcgcgcgctgctaccagatggcgggcgtcaccaaccgcgaccgcgtgcagataacccccggctacggcctgtggacggccggcatcggcttccaggccggcgcggagaagctgggcgccatggccatccccatgggccccggcaacacggagaagcagctccagttcatggtggacatgcagtccacggtcatctgcgcaacgtcgagctacgcccttctccttgcggaggaggtgcagaagcgcggcatgagggaccagatcgcgctcaggcgcggcgtcatcggctccgagcgctggggcgagaagatccgccgccgcatctgcgacggcctcgggatcaaggcgtacgacatctacggcctgaccgaggtgtacggccccggcatcggcatcagctgcgacgccaacgacggcatgcactactgggacgactacatctacctcgagatcgtggaccccaacacgggcgagtccgtgccagacggcgagtggggcgagatcgtgatcaccacgctcgtgaaggagggtgcgccgctcatccgcttccgcacgcacgacctgagccgcatcatccccgggccatgcccctgcggcagcccgtacccgcgcatcgacacgctgcgcggccgctcggacgacatgttcaagatccacggcgtcaacgtgttcccgcgccaggtggaggaggtcatcgcgtcgttcccgcagctctcgagtgagtaccagatccacctctcgcacctggagggccgcgacaccatgcgcctgtacgtggagacggacggcacgcagaacttcctggagctcgcggacgaggtcgcgcacgagtgccgcaaccgcatcggcttcacgccgctcgtcaaggtggtggagctgggcgtcctgccacgcagcgagaagaagaccaagcgcgtgttcgacgagcgctacgagtagcgcctgcggcgccgggggagaaggacgcggcgccgccggatgtacagcttgtgcgatgcgtgaccaaatgcggattgtgcctggcagcctcccccggtctgttacaatctgtcacgatgctgtgggttcctgccgctgggctttgggagccgtacgtaaaaggaaaggccactaagacatgtcagatcttctgaaccagatcatcacccccgaggtccgcatggtcctctacctgatggtcgcgtgcatcgtgatgctctaca

SEQ ID NO: 238 - DNA, 1613 bp, Unknown
  Metagenome-assembled genome
tacgcgttgactttctcgttccacaccaattcttgaatgtgatattgcggctatgttttgcgcctgctgcaataattcgctaaaaatcatacactactcgcttctctctttttctaattttatttttagaaattatgaaataaacagctttacattcaattctgctatggtacgacgacgtctattaaagcaagttctaaataaaattatgattctatttaagtgataatcatccaaaaccattaaccatacaccaatctcatgacctaaatacttgcaccaccgccaccagatgaaccgccaccgctagaagaaccgccgccaccgaaaccaccaaaatgatcattgttattaaagagccaggctaagatggaccataattgccaactgcgcccccaaggactgaacataaatccaataacaataatcaggccaacaagttgtagaatattcttcacgttgaaaatactacgattggaattcatcctattttgataacccttatcagattttctatcattcttgtatccgtaatgcctgtcgaccaatgttgtgatactactgaacgttttttgcaatccctgattgacagtctcagttgaggtagattttaactgacttttattactggctaaaatttgtccagcctggctatctgtgacgacatcttctaatccgtaacctacttcaacacgaacattacgcttcccatcatttaaggcataaagaattaaaataccattatccagttttttttgaccaataccccactttgaaaataaatcggccgcatattgatcgacatcagaatcaccagtagattttactaccgccaacataatttgcggtttgtccttggtttcggcatattgttgattctttgtactaaccaaatcttgtgtctgtgaatttagtaaatttacttgatcaaaataattatcagtcggtatgctaggtaaactggccgcctggacaaaagttgtttgaagtagcagcaaaaaaggtaataacaaccatagccacgcattcgttctttttcggttcacgatgtccacttcctagttgtctaaatcaactttaggtgccttatcagcattcgaatttgctttgaattcagctttctggcctaaacccatcgtagaagcaaaaatatttttgggaaaagtaactacattttgattgtaagtcttaacttgttgaatataccgacgccgctcaaccgcaatgcgattttccgatccttccagctgggtcatcaatgtcgcaacattagcattcgacttcaaattaggataattttcttggatcacattgattaaagtaccaactgaactattgattttattatcggccttggctttttctttaactgttgttgcgctaccgtaacttttccgtgcatcagcaatctgaccaaaaactttttgttcctgactcatgctgcccttaactgcacttactaagttaggaatcaggtcgtagcggcgttgcatcacattttccacttgactccattgcgcctcgacttcttgattctgtttagccaaactattataggtttcaacacttattgcaccaacggccgcaagcgctattaaaatcacgcctaagct

SEQ ID NO: 239 - DNA, 12624 bp, Unknown
  Metagenome-assembled genome
cgctctggtacacatcgcctataaaagagaagcaggccgcgcggaatttgccgcgtgacctgcttaaactcaatggtgaccccggtcggattcgaaccaacgacaccaggtttaggaaacctgtgctctatcccctgagctacggggccgtgcctagccattctatcatctcttggctggcaggtgaaccagtttcttacttatgctgctcgtgcctctggttccgcttggcgcggcgcgcggccttggcctcgtcgcgctctgcctgctcgcgggcaatctcgttggcctcgccgcgcagcacctgcgtgaccttcttgttggtcatgcggttcgtcgtggcctcggccttcttgcgcatgggcctgacaacgcgccagtcgtacacaaaggccgcgatgatcagaccgtacgcaaggatcagcaggatgaggagcacgacgttgagtgccgcgctgctcgcaaccgccttggggtacacgttggggatgagccacgagacgatggtgcacacaaagccggagcccagcaggccccaccacaccttctggctcttcttgtagcccggcgtgtcgtgcaggagaatctgggacgcggaggtcctgcggtcctgctcggtcctgcgctcctgacgggcgcgcttcttctcgtccttcgtcatctccacgggcgtcttgcccgcggtggaagcggaggacttgcccgcagagctgccggcagagacgaccctcacgccagcggcggcctcgcgagcgggcttcgccctagagacggacctcttggagaaacccgtcctctcggagtcgccggcctcgtccttctcgtccttatcgtccttcttagcgagcggggcgttggctgcggcggcttcctgcctggcgccgttgatggtatcacgcagagacatgggactccttcatgggtgcaaacttcttgccggtgatgagctcgaagacctcctggtagcgctcggacgtgcccttgatcacctcggccggcaggtgtggcggctggccgttcatgtcccagttcgccttgagccagtcgcgcacgtactgcttgtcgtagctgggctggaccttgccgggctcgtagccctcggcgggccagaagcggctggagtcgggcgtgagcgcctcgtcgattagcgtcagcttaccgtcgatgaagccaaactcgaacttcgtgtccgcgatgatgatgccgcgcgtgctcgcgtactccgcggcggtggtgtagagcttgagggaggcgtcacgcagctgagtggcaacgtcctcgcccaccagctcggcgcagcgctcgaagctgatgttctcgtcgtggtcgcccagggcagccttggtagacggcgtgaagatcggctcggggatcttggatgcctcgaccaggccgtcgggcagcttgatgccgcacacggtgccgttctggtcgtaggtcttcttgccggagcccgtcaggtagccgcgcacgatgcactcgatggggatggtcttggccttcttgaccagcatggagcgaccggtcaggtagtcggcgtacttctggtactcctccggatagtccttcacgtccatcgagatcaggtggttgggcatgatgtccgcgaacttgttgaaccagaacgcggagatgcgcgaaaggatctcgcccttgtagggaatctcgtcgggcaggatgtagtcaaaagcgctgatgcggtcgctggcgaccatcaggaggctgtcgccgcagtcataaatgtcgcgtaccttgccgtgagaatccggtcgaagctccatggctcccatgagatttctcccctcattgcttggatttccgtctatgcaagcgcatagccactccattgtaatggattggccctaactggcacatacgtcaccctgcgcagacgccaaatcccatggcacatacagggagaaggacgcgcggcacccgtcgctactttgccgtggtctcgggcttggtcttatgctccaggggaacgtgcagcgtgaaagtcgtccccttgcccagctcggactcgacggagatgcttccgttgtgcttgtcgatgatctccttggtgagggcaaggcccacgcccagtccgccagacacgcgctcgcggctcgcatcggagcgccagaagcgcgagaacaccctcggaatgtcctccttggcgatgccgattcccgtgtcgcgcacggatatcttcatgccgttgcggccctcctgggcgatgctcaccacgacccagccgccttcgggcgtgtagcgcatggcgttcgacatcaggttggtcacggcctcgcgcatgaggtcctggttcacgtccgcgtacagctcgtggttgggcgtcttgtcgtcaaagcgcaggcgcaggccgcactcgttgaagagctgctcctgcatggacaccaggctcttgagcgcaaagaccatgtcggtcttctcggtctggaacttcgtgttgttctccacgcgggaaaggtgcagcatcgcgtcgaccaggcgagaaaggcgcctgacctcgctcgctacggtctccaggtgctcgtcgtccgccggcagcacgccgtcctgcatggcctcgaccgtggcctgcatcgccatgagcggcgtcctcagctcgtgggcaacgtcgctcgtcagcctgtgctcgaacttgatgtcgcgctccagctcggacgccatgctgtcaaacgtctcgcccagctggccaaactcgtcgtttcccttgaggccggtgcgggccgtcaggtcgccgttcctgatctgcctcgcggtggaggagatcttctggatggggcgcgtgagcgcgcgcgaggagtagtacccgatcaggcacgcgagcacgatggagacggacgccgcaatcaggatggccgtgtaggagttctgcctaaaggccgcgtcgatcttggtgatgagtgcctcggagccaaacgcccacaggcgcacggtgcccacggtcttgccgttctcgtccgtcacctttgcggagatgatgtcgttcgcgttcgacgggacggggttctgcgtcgcgtccttggtcatcttgccggaggccgccctgttggcggcggtctcgtcgtaaatcaggacgctgtccgcgttcaggatctggatgctgatgtcgggataggcggacacggtggtcttggcatactcgatcacgctcttggaccacttgccgccgcccttgtcgtactgcgtgcccagggtctcggcagtctgctgcgcaaggcgctgcatgttctgtttcgtgtacccctggaactgctgctcccacacgatggcgagcacgagggaaaggatcatggcggtcatgacggcagtcagcgcaaagaagaacgccatcctgcccctgaacgaggcggtgggacggtgctctccatcgtcgtgcttgagtgtgctgtactctgccttgttgtccttgggcttctcgcccttggactttgacctgtgctcgtcgtactcacgcgttgtgtctatgtcggccacgccttacgcctcgcccctcgcctcgagcagcgccgggcgctactcggagtccgccttcttgtccttcttgtcgggacgctgcggtgcctcgaagcggtagccaacaccgtggacggtgtacaaccagcgcgggttgcgcgggtcgtcgcccagcttggcgcgcaggttcttgacgtgggagtcgatggtgcgctcatagccctcaaagtcgtagcccaggaccttctccacaagctccatgcgggtatagacgcggccgggatagcgcgcgagggtggtcagcagcttgaactcggaggccgtgaggtcgacctccttgccctcgaccatgaccttgtggcccgagatgtcgatcacgaggtcgccaaagtcgagcacctcgagctggggctcgctctccgcatgggcgcggcgcagcaacgcgcggacgcgtgccacgagctccctgggcgagaagggcttgatcaggtagtcgtcggcgccaagctcaaggccgatgatgcggtcctcgacctcgccctttgccgtcagcatgatgatgggcacgttcgaggtctcgcggatggcgcggcagacgcgctcaccagagagcttggggagcatgaggtccaggatgatgaggtcgaaggagtgcttctcgaactcctcgagggcactctgaccgtcaccaacgccacggacgatgtagttctcgcgctcgaggtatgccgcgaccgcgtcgcgaatggtcttctcgtcttcaactagcaggattcgcttctcttccgaagccatggtcggtctcctctgcacggtgattctgtattgcgctctttaagcgctttttttgtgataccctctctattttaccgcggaaggcgccttctcattcctagaactaaagggaaaatacgcggacggagaccgaggtcgggagtccggtgtcctggtccttgatggtcgagaaagtcacgaagtcgtccacgctgcccatgctggccggatactcgccgtagtccacgcagcggttcttggcagagaggaccgagtacttgcgcttgtccgtgtcgatcacaaagtaggaggcgcggctcttcaccacgtacgtgccgtccttgcccgcgatgggcgcgtacggctcacgcgagagcgccacaaaggggccgtccccgtggccgatgtaggagcccatcgtccccaggagcccaccggagtcgtagctcgcctcgatggagaacgcaaagtcgtcgccaatgcggacggcgttcatgggcttgacggtcgagggcagcacgagctggtccacctgcttggacaggctgtcactcactttgtaggcggtaatgccgtagtacgtgcccttgtccgcacggacgcgtggcgtgagcgtcacggtgccgtcggaaaccgcgggctccgtggcaaacctgccgggggactcgatggccgcgcgggccttggagtcgccaagcgtccacacgtagcagacggagctcttggcggtcttggttcccgtggtcgagggcatcacgagccagatcacgcgatcccccgtgaccgcaaacagcggcgggtcgtagttcttgttcgcgcgccacagtgtcgtggcgtcgccggaaatggccccgtcggaaaacgcggcggcgtacaggcaccacctgtgcgtgagcaggtcgagctcgctccaggcgtacacgctgtccgagcaccggacgtcgtatatgaccatgttggagtcgttcttcgtgtacgccttgctcacgacctccgcgagctcgcccgtcttgatggagagcgcagagcccttcaccatgggggtcgcggaggagcccgccgtcgtcacgggaagccacgtgccctcgccggcgtggagcacgttgccggtggcgatggtgtactccttgctcgccttgaggctcgagtcgacggacttgtacttgctcttgttcgtcttggggtcgatcacgtagtcggcggacttgtcgttcaccacggtcgggctcttgctgtcgctctgcgtgttgcgaccgcagcccgcgaccacgcctatgacggccgccgccgttcccgcggcagcgcccgccctgaagagacccctgcgggtcatgctatgtctggccccgtcgcgacgcatcggccgctagcgtccgctcttctcgagcgccgcctgcgcctcttccaggccgatggtcatctggtcggcgcaggaggtcttcctgatgccgcaggtgttgccggcgagcagctccaccacgtcgcgcacgggcatgccggcggtcagcttgccgatggccttgaggttgccgttgcagccgccctcaaagctcacgtgctcgatggtcttgccgtcgtcgctcaggccgatgtgtatggcgcgcgagcagacgccgcgcgggatgaagtcgtagtggaacatgcacgtcctttctgtcgggaacagtatacccagccgccctggtcggacgccccagcacacaagaagaccctcagccaaagccaagggtcttctcacctgcctttaccttgtctgccggcgcggactgcgcacggcgtctaccagccgctagtcaaagctgagctgctccagcctgtcgaacaccacgccgatgcggccgaggaagctccacgggtcaaagatcttgtccagctcctccttggtcaggtggctgcagcgcgggtccgcctcgagctttgcgcggaacgtggtgccgttggggtcgcactgctggatctcgtgccaggtcgccatggcgttctcctgcacgatcttgtaggcctcctcgcgggtgatgcccgtgtcgaccaggtgcagaaggaccttggacgagaagatcagcccacgggtcttgttgaggtttgccagcatctgcgcgggatacagctgcaggccgtccacgatgcggatgaggcactggaacatgtggtccagcgcgatgaagctgtcggcctgggccacgcgctccgcggaggagtggctgatgtcgcgctcgtgccacagcgccacgttgtcaaaggcgacctgcgcgttggccttgaccacgcgggaaaggccgcagaccttctccaccgtgatggggttgcgcttgtggggcatcgcgctggagcccttctggcccttgcggaacggctcctcggcctcgagggtgtccgtgcgctgcaggttcctgacctcggtcgcgatgcgctcgcaggtggccgcggtggtcgcgagcacgccggccaggtaggcgtggtggtcgcggctgatgacctgcgtggacagcgggtcatgcaccaggcccaggtgtgcgcacacgtactcctcaacgcgcgggtcgatggagctgtacgtgcccacggcgccgctgatcgcgccaaacgacacgttcttgcgggcgtccttcaggcggtccaggtcgcgcttgagctcccacgcccagctgccaaacttcatgccaaacgtcatgggctcggcgtggatgccgtgcgtgcggcccacgcacagggtgtcgcgctcctcgaaggcgcggcgcttgcagatctcgcccagcttgcggcagtcgtcaatcaggatgtccgtggcctcgcacagctggtagcagagcgccgtgtcgcccaggtctgagctggtcatgccgtagtggacccagcggctgggcttgggctggccctcgggcacgtcggcgtcgatgtaggagcccatgttggtcaggaacgcgatgacgtcgtggttcgtcacggcctcaatctggtcaacctcttccttgttgaagttggcgtggtcgcggatccacttggcctcctccttggtgatgccgctctcgcccagctcggcatgcgcctcgcacgcgagcacctcgatctcctgccataccttgtacttgtgctcgagagagaagatgtttcccatctcggggcgggtgtagcggtcaatcatgcggacttcctctcgtgtggcgcaggcgcggcctgctttgctgggcatcgcgtacgggttgattctaccgcgcaaaggggccccgcacgtgcagggcccccatgctcaaaagactgtcacgcccacatgggcgtgggcagcgggcgagaaggaccgcgccctcccccgctacaggctcgcggccgcggcctcgtcctcgcgcaggccgtcccgagcctcctcgagctgctgcctcacggcgtcgtggccggtgccaccgtatgtgtttctcgcccgcgcgatgcccgccgggtcaaggtccttggccacgtcctcgtcaaacaggtcgcttgccgccctgaactcgtcgatcgtgaggtcctccaggcccttgtggtgcttctcgcagtacaggaccagctcgcccaccacctcgtgcgcctgcctaaacggcatgccgcgcttggccaggtagtctgccacgtcggtcgcggccgtaaagcccagcttggcctccgcgagcatcttgtccttgtggacctcccaggtgtctatcatgccctccatgcacaccatgcagtcgcgcagcgtcttggcggagtccattgcgccgcgcttgcactcctgcaggtccttgttgtaggcgagcggcaggcccttcatggtcacgagcagcgccaccaggttgcccaccacgcggccggacttcccgcgcgtgagctcggcaaagtcggggttcttcttctgcggcatgatggaggaccccgtggagtacgcatcgctcagcgtgatgaagccaaactccgtggtggaccacgtgatgatctcctcgcacaggcgcgagaggtgcatcatgctcacgctgcaggcatacagcaggtcaagcaggtagtcgcggtcggaaaccgcgtccatcgagttctgtatcgggtggtcaaagcccagcagctccgtggtatagaaccggtcgagcgggtacgtagtgcccgcaagcgccgcggagcccagcgggttggcgtcggcgtcgtcgtaggcgtccacgatccgcttgaagtcgcgcgcgaacatccagtagtacgccagaaggtggtgcgagaagagcacgggctgggcgtgctgcatgtgcgtgtagccgggcatgaccacgtcgaagttcttctccgccgccttgatcagcgtggcgcggagcttacagttctcttgcgcgagctcggccagcatgtccttggcgagcaggcggatgtcggtcgccacctggtcgttgcgcgagcggcccgtgtgcaggcgcgcgcccgccgcgccaacgtccttgatgaggcgaccctccacggccatgtggatgtcctcgtcgttcacgtcccactcaaaggtgccggcgtccatctcgcccttgatcttctgcaggccgtccacgatcttggactcgtcctcctgggatatgatgccctgcttggcgagcatccgcgcgtgcgcgatggaagccgtgatgtcttgcgcgtacatgctcttgtcgtcttccagcgaggcgccaaactcctgcgtgaactcgctcacgccctgctcaaagcggccggaccacagtgccatagatctctgcctttctgtatcgcccgacatggaaggggcccgcacgaggcgggcccgcccagcttggatggtagttcttctcaccgcgcctcccgcctggaccgagtcatgttttccaggcgagaaacgcggctcccacaccggtggcgctatgccacgtggatgttggcgttctgcttctggagctcgtactccgcggcggggccctgcgtcttggaccacgtggtggccgcgagcgtgtgcagctcgatgaagcccttggaggcgctgcggtcaaaggtgtcgccctcgccgtaggtcgccaggctgtagtcgtacagggagtaggcgctcttgcggccggtcacggtcatgctgcccttgtagaacttggccttgacctcgccggtcacgaacttctgcgtgtccgcgcagaacgcgtccagcgcctgcttgagctgcgagaaccacaggccgttgtacacggtggtcgcccactgctggtcgatcatgtgcttgtacttgagcgtcgcgccgtccaggcacatggtctcgagggccttgtgcatgttgatgatcgcgagggagccggggcactcgtacacctcgtggctcttgatgccaaccacgcggtcctcgatcatgtcgaggcggccgtagccatgcttgccagcaatcttgttcatcttgatgatgaggctcagcaggtccatcttcttgccgttgagcgagaccggcttgccctgctcgaagccgagtacgacctcctcgggctcgtccggggcgctcatcgggtcggcggtcagcgtgtagatgtccgtagggggctccttccaggggtcctcaagggcgccgcactcgatggcgcggccccagaggttctcgtccagggagtacggcttggccgccgtggtgggaacgggcacgccgtgctgcttggcccactccatctcgtcctcgcgggtgtggaggtcccactcgcgcacgggcgccaggatcttgagctcggggtcgagcgcgtggatgctcgactcaaaacggacctggtcgttacccttgccggtgcagccgtggcagatgtaggaggcgccggtctcgtgcgcgatgtctaccaggtgcttcacgatcaggggacgggacagagcggatagcagcgggtacgtgtcctcgtacatgccgtttgccgcgatggccttggtcaggacctcgttcgcgtactcctcgcgcatgtccagcgccttggagtacacggcgcccatgccgtaggccttcttctcgatccaggtgaggtcctgggcgtcctggccaacgtttccgcagatggcgaccacgtcgaggttcttctcgatctggagccacttgaccatgacggaggtatccagaccacccgagtatgccagtacgaccttttcctttgctgctgccatgatagacacccctgtttccttgtcctgattgcctgtttgggaaaatgcagatagatatggccacggggctgtgccccggttgtttgcacctgcgttttaggtacaaaaaaagcctggcaatgccaggcgtctcagttgtccagattttaggctatatggctatgcctcatcggaccggagtgagcacgcgctggcgtcgcagcgtggtacgtcgatcctggcgtcggagggagttgttcatgttggatgcaaatgccattgtaaaactcccctcctgattcttgccactggatgagcctcagtagccgcctttgttgtgtgaacactttagcggctcaaacgctaccgatggccgagaatcttgcaacgagacacgttcgtaacaatttgcacacacagtgcttacgttttcccaccagcaggattcacgtcatctacgtgcgcaaacttgcacttagctgtcgcccgtggcggcggttaccgtccttctcatcactattcataccattgcatagactgtcgagaaggacgcgacgcacgtcgtggcggccctcgcgggatgctggcgacgcgtgccccaaagtgaaaaagggcaggtcacggcatctgccatgacctgcccctggcttgcggtggtgggtcgtgagggcctcgaaccctcgaccttgggattaaaagtcccctgctctgccaactgagctaacgacccgttacggcgtacgcgaaatcataccacgtgggaagcctactcggcctcccaagcccagctgccgttgcaaaacacgggaacctcttccccggcgggcgtcacgcccgtgacgttgaggtcgtccgtgccaatcataaagtccacgtgcgtggtggactggttcacgccctggacgagaagggcgtccttgtccaggtcgagcccgccctccaggcactcggggaagccggtgcccagggcaaggtggcaactcgcgttctcgtcgtacagcgtgtcgtaaaagagcaggccggactggcggatcggcgtcgtcttggagataagcgcgcactcccccagacgacacgagttctcgtcggtctcgataatgtggcgcagcacttctcgcccgacggcggcgtcgtactccacgaccttgccaccctcaaagcgcagccagaagtcgtccacgcgctgtcccgcgtggatgagcggcagcgcggagtgcaccacgccgtcggcgcgcatgcggtccggggaggtgaagacctcctccgtcgggatgttggggaagaacacagtaccgtccacggtgcggccggcgccaccctcccagattcccttggggttcaggcccagcgtaaagtccgtgccgttcttggccacgtagtgcagccggtcgaaggcatagccgttgagcaggcgcttgttcttctcgaactccgcgttgtgcgtctcccagtcctgctgcgggtcctcaccatcggcgcgggccgtcttcaggatcgcgagccacagtcggtagtacgcctcgtgctcggagcagtcggaaaagaccttccttgcccatgcctttaccggcgctccggcgatgcaccagacgttcttgccaaagtccatgccgttgcggaaggaaaggcactgcgtgttcctcgcgtacgcggccgccgcgggcttggcggggtcgatgccggcaagcgcctccgggtcgctgccctcaataaagaggaaggacgcgcccgcctccgcaagggagttgagctgctcggccttccagccgggaacgtgcctgaagtactccgtcgggacgttctggaactccaggcggctcatcacgtcgtcaccccagatcacggtcacgtggcccgcacccgcgcgatacgcgttccgcaccacgcggcgcgcaaagtcggcgcactccacgggcgactggaccacgacctcctgtccctcgcgcacggccagccccttgcggaccagcagctcggcgtacctgtccatctgcgcgtccaggccctctatagccagcgtgcactcctcaagcgtcatccccatgcgcttctcctcccgtaaacttcgcactggtccgcccggcaccgccacaggcggcgccttccacgcggactcatatgcaacaaatgaatacgggccctcagaggggcccgttgcatgctctggagcgggcaacgggattcgaacccgcggatgatggcttgggaagccattgccttaccacttggcgatgcccgcatgtgcaagaggattctatcacagcttccaaatccgtcccacccaaatgtgcc

SEQ ID NO: 240 - DNA, 34678 bp, Unknown
  Metagenome-assembled genome
ggagcgtgacgttcttctcgcccgcgtgcgccgtgtgtgctatcctcacgcacaggcaatgacggagaggttcgcccgtcgcgtgcccgcggacagagagggagcccaccggctgagaggctcccacgggggttgacgagcgaagttcactccaccagccgcgaccttaacgccgcttggcaagtagggaagccgtccgccccacggaacggggctcaacgagtgggtgctcgcgagagacaacgtgaacgccaatcaaggtggtaccgcggataactccgtccttgagccatgtgctcgggacggttttttgttttgaagggggatttctgaatgtcgatgtccgaagagctgaacgccatccaggacagggtccaggaggcgctccagaacgcgcacagcattgacgagctcgagaagatccgcgtcgcggcgctgggcaggaagggctcgctcaccgcgatcatgcacatgatgggcaaggtcccgcccgaggagcgcccggccatgggcaagctcgccaacacggtgcgcgccaacgtggacgcggccatcaagcaggcgcgcacggagctcgccaagagggcgctggacgagaagatcagcgccgaggccgcggacgtcacgctgccgggacgccgcctctcgccgggcacgcagcacctcatcaaccagatccgcgaggagatcgaggacatcttctgcggcatgggctacaccgtggaggacggtcccttcgtggagaccacctactacaacttcacggcgctcaacgcccctgaggaccaccccagccgctccgccaaggacacgttctacgtggtggacaacgcccccgagggcaaggagaagcacgtcctgggcgagtcggacgtcctcctgcgcacccagacctccggcgtgcaggtccacacgatggagcagaagaagccgcccatctacatgatctgcccgggtaccgtcttccgccccgacacggccgacgccaaccacctgccccagttcacgcaggtcgagggcctcgtcgtggacgagggcatcacgtttggcgacctcaagggcacgctcgactacttcacgcgcgagatctttggcaaggaccgcgccacgcgctaccgcccgcacttcttcccgttcacggagccgagctgcgaggtcgacgtgagctgcggcgtctgcggcggcaagggctgtcgcttctgcaagaacacgggctggctcgagatcctgggctgcggaatggtcgaccccaacgtcttccgctactgcggcatcgaccccgagaagtactccggcttcgccttcggcatcggcgtcgagcgcgtcgcggcactgcgctacgacctgcccgacctgcgcatgctcatgaccggcgacatgcgcttcctcaggcagttctagcgggcgcgcccgccggggcgcaaaagactacgagcggggacgccaggtcccctgtgtggaaaggcaacaagcatgcgtgtctcttatgagtggctcaagtccatggtcgacgtgccggaggacccccaggacctcgtgcacgagttcatccgaaccggcaccgaggtcgaggccgtggagcgcgtcggcgcggacatcaccaacgtcgtgacctcccaggtgctggagaaggtcccgcacccggactccgaccacatgtacgtctgcaagatggacgtgggcaagtacaacgtggacgagaagggcgagccctgtccgctgcaggtggtctgcggcgcccagaacttcgaggtgggcgacaagaccgtcacggcgctcgtgggcgcgacgctgcccggcgacgtcaagatcaagaagggtcgcctgcgcggtgtcgactcctatggcatgaactgctcgagccgcgagctcgggctcgacaacgaccactccggcatcatgattctgcccaaggacgcgccggtgggcgtcgacttcctcgagtggaagggcctcacggacaccgtgatcgactgcgagattacgcccaaccgccccgactgcctttccatgtgcggcatggcggtcgaggtatcggccatgctcgacgaggacacccacatcgagctccccaagatccagcacgaggacgcctccgccggccgctcggccgacctggtggacgtcacgatcgacgacccgagcctctgcggccgctacacggcccgcgtcgtgcgcggcgtcaagatcggcccgagccccgagtggctcgcccgccgcgtgatcgcctgcggcgcccgtcccatcaacaacgtcgtcgacgtcaccaactacgtcatgttcctcacgggccagcccctgcacgccttcgacctcggcaagctgggcgagcgcgacggcaagcgccacatcgtggtgcgcgccgcgcacgacggcgagaagctcacgaccctcgacggccaggagcgcacgctcacgaccgacatggcggtcatcacggacgacggcgcgacccccgtggcgctcgccggcgtcatgggcggcctcaactccgagatcgacgagaacacggtggacgtccttctcgagagcgccgtgttcgacagcggccacgtcagccgcacgagccgcaacctcgacctcatgagcgaggcctccatccgctacgagcgccaggtcgacggcgccgcgtgcgccacggtgagcgacgtggcagcagccctcttcgagcagtgctgcggcgccacggtgtgcgagggcatggtcgacgtctacccggcgcccgtgcccgcaccccagatggacctgcgccccgaccgcgtccgcgcgctctgcggtgcccccatcacgaccgagttcatggcggagcgcctcgagcgcctcggctgcacggtcgagcgcggcgcggacgagcacgcccccatgcacgtcgtcgcacccacgaaccgtcccgacctcacgcgcgagatcgacctcgtggaggaggtcctcaggctctggggcgagggcgacgtcgagcccacgctccccgcggcaaggaaccacgccggtggcctcaccgtcgagcagcagcgcatccgcaagatcggtcaggtgctgcgcgcgagcggcctctgcgagacctccacgtacaacttcgcggaccccagggacctcgagcgtctcggcatgagcgaggagggtcgcggcatccccgtgcaaatcatgcgccctctcgtggccgaccagtcccagatgcgccgtgacatgattccgggactcctgcgctccgtggcctacaacctcgaccacggcgtgcagaacgtccacctgtacgagatcggccgcgtcttcttcgggcacgagcacaagagccagccggacgagcccagctacgtcgccggcgtcatgtgcggctcctgggatgacgaccagtggaaccgcaagtaccccaagctcgacttcttcgacgcaaagggcgtggtcgagaacctgctcgatgcgctgcgcatcaccaaggtgcgtttcaaggcggccgaccccgagcgctacggctggctgcagccgggccgcgcggccgaggtcctggctcagggtgagctcctgggctgggtgggcaacatccaccccgagagcctcaaaaacttcgacctcgacgtccccgtcgtggccttcgagctctccgtccaggcgctcctgcgcctcgccaagcgcgagctcccgtacgaggaggtgccgacgctgcccggcgtctccatcgacctcgcgctcgtggtggacgagtccatgaccgcggagcaggtgatccagcgcatccagagcgccggcggcaagctgctcgcggacgtgcgcctcttcgacgtgtaccgcgacgccaagcgcgtgggcgagggcaagaagtccctggccttctcgctcacgtaccgtgcggccgaccacaccctcacctccgaggaggtcgagaaggcccacaacaagctcctgaccaaggtcatgaagtcgacgggcggcgaggtccgcagctagatcgcgtaactccggcaccccacgggacgcaggccccgcggggtgccctcgtgtgcggagggcggggcgtcgttcccgggatgccgttttgacgcggaacggtcgcgcttctcgcccgccgcatgacgtcttgttagaatggtccttatgccaagttggaacatacatatcgcccatgtggagcgcctgcttgcgcgcgacggtgccgaggcgctgggcgtccgggaccccaacgcgttcctctttgggaacctggtaccggacatctacgtgggctacctcgtgagccccatcaccaagaagatcccgtaccggacgacccactttgcggacccggcctacgtgccgcagcccgcgtactgggagttctgggagaggtacgcgcgcccctcggccgacgccgccgggcgggtgtccgacgtggtgctgggcgcgtggatgcacctccttgcggacaacgtgtacaacgcgcacaacaaccgctacatcgcggagcgcggcatcgccccgggggaggagacgcgcaagcgcaagcaggcggacttcgcgctgtttggcaggacgctggacatctccacgcagctgcacgcggacgacgcgctgctggcgcaggcggcggcgtttccgcagtacgccatcgcggagccggacgcccgcgcgaccgtggcggtcgcgaacgacgtcgtgcgcgacaaccgccgcgagcacgtcacgggcacgccggactactgcatgctgagcgcggagttcttctcgtccacgttcgagcgcgtctgctatcttatggagcggaacctgaaggcgtacgcacggcacggcgccctttggtgcggagactttggaagcgacggcaacgcctagcgtcgcaaaccactggaacaatagcggaaggtgcggcacgggccggggagcttgggtgcggcacgaaaggatggcctaatgcccaggttcgacaagtccgacggagagctgctctacgtccaggtgtcagactacgtgcgcgagaagatctactccaaggactggggcgtggacgagcccatcccgtccgagcacgagctgatggacatgctccacctctcgcgtggcaccgtgcagaagggcatcaggcagctggtggacgaggggctcctcgtgcagcagcgcggccgcggcacctttgtggtgcagcccgtgatggcacgccccagcagcaacaggctgctctcgtttggcgagtccatgagcgcacagggtataaactacatcacgagggtcgtcaggtgcgaggagcgcaaggccggcccgctgtgcgcgaacaacctgcagatcgaggagggcgagaagtacctgtacctctgccgcgtgcgctacgtgagccatcgcgccgtcatgttcatagagagccacctcaacctgggcgtgtgcccggggctcgagaagtgcgacttcgagcacgaggcgctgttcgcggcggtggagcgcacgagcgggcacgagatcggccgctccgagatggtctacaccgcccgcacggccggcaaggtgcgcgggggctacctggagtgcgacgagcacgcgcccgtgctcgagctcgaccagctggtgcgcctcgacaacggcgtccccttcgagtggggcagcgtctggctgcccgccaacaggtgcgtcatcagcaacgagacgcaccgcgcgtgaggcccgcgccgcgggcgtgagtcccgcgcgaaaacgtcatagggaggccttatgagctggtacgaggaatctgtcgtatatcaggtctatccgctgggacttctgggggcgccgtaccagaacgacggcacgagcgagccggtgcaccggctgccgaggctcgtggacgacggctggatcgaccacatggtcaagctcggcgccacgtgcctgctgctcaaccccgtcttccagagcgagtcgcacggctatgacaccgtggactacacgacggtcgaccgtcgtctgggcaccaacgaggacctgcgccacgtggtggacgcatgccacgaggccggcgtcaaggtccttctcgacggcgtcttcaaccatgtgggccgcggcttctgggcgttccaggacgtgctcaagaaccgccaggccagcccgtacgcggggtggttcaacatcgactggggcgccaacaaccagtacgacgacggctttggctacgactgctgggagggcgtgccgttcctggtcaagctcaaccacggcaacttcgagctgaacgactacatcgccaaggtcatccgcgactgggagcaggagttcgacatcgacggcctgcgcctggacgtggcgtactgcctggaccgcggctttttgggctacctgcgccgcatcgccaacgagctcacggccaagcgcacggagcgcctgggcgagagggacgggaagttcgtcctcgtgggcgagaccatgtttggcgactacaaccagtggatgggtgacgacctctgcgactccgtcaccaactacgaggcctacaagggcctgtggagctctgccaactccgccaacatgcacgagatcgcctactcgctggagcgccagagcggctcgcacccctgggacctctacaccggcaggcatctgctgaacttcctcgacaaccacgatgtgccgcgcatcgcgaccaagctggacgacaggcgccagctcaagcccctgtacggcctgctctttggcatggccggcgtccccaacgtctactacgggagcgagtgggggatcgagggcgagcagctccccggcgaccacgagctgcgtcccgcgctgggcgccccggagtggaacgacctgacggactggatcgccgcgctcgccgcgtgccgcaagccgggccatcccggcgccgaggcgcttgcctggggcgactacgcgcaggtggccgtgcagcccaagcagctgctgttccagcgccagagcgagcacgagcggctcttcgtggccgtcaacatggctgacgagccctacgtcttccacttcgacgcgggctgcggcagggcgaccgacgtgattgacggctcggatcacgactttggtggcggcagcggggtcgcgcccttctcggcccacttctggctctgcgagaggtagcgagcgccgcctgcagcctgcctgacagcgtggccggcagcttacggtaaagatatctgcgagaagaacgtggggacgtgccttcgggtgcgtccccacttcgcgtcgggcatggcttgagcatccgcgtcacccctgcgaaaacgagcgggaaagaagaagccgccccgatcactcgggacggcttcctgatgatgcccgtggccggtatgagctactgggctactggatctgcgacaccatggccatgttggtggacgtgatgtagtcaccctgagacggcgaggtctgcgggtcgccggcggtcacgacgacgaggtcgccggtgtcgacaatgccgtgctccttggcgacggtcagcgcgttgtagcaggtcgcggacagcgagccctgctcggtcgtcttgtacgcgtcgacgccccactggaagcaggtcttgcggatggcgtggttagagggcgacatcgcgatgatggggatgcggggacggaagttggagatcaggcgggaagtgcggccgctgtgcgtcgggcagacgatgcacttggcgttgacgcggtcggcgacctcggcggcagccaggccgatggcggagttgacgttgcgcatgccgccacggtcgtggtactcgcgacgctcgggcaggtacttctcggtctccttgcagatggaagccatcatcttgacggcctcgacggggtacttgccggcagcggtctcaccagagagcatgacgcagtcggtgccgtcgtagatggcgttggcgacgtcgttgacctcggcgcgggtcgggcgcgggttgcggatcatggagtcgagcatctgcgtggccgtgatgaccggcttgtagctctgggcgcacttcttgatgatcatcttctggacgtgggggacgtcctgggcagggatctcgacgccgaggtcaccacgggcgaccatgcagccgtcggaggcagccaggatctcgtcgaagttcttgacgcccagggcgctctcgatcttcgggaagatgtagacgttgcgcaggccgttgtcggcgcagagcttgcggatctcgtcaacggcggcggcgttgcggatgaaggaagcggagatggcgtcgatgccgagctcgcagccaaacatgatgtccgcgatgtcctgctcggtgacggaggggaggccaatctcgacgttcgggacgttggcgcccttcttctcgccgatctcgccgccgttggtcacggtgcagtgcatgtcgttgccctcgacgtggtcgacctcgaggcccacgaggccgtcgtcgatcaggatgatcgagcccttctcgacctccttggggaggttgaggtagtcgagggagatgtggtgcgcgttgccgtgccagtcctcggtggtgggctgggcggtcacgacgatctcgtcaccggtgttgacggtgaccttctggccgccctcgagtaggccggtacggacctcggggcccttggtgtcgagcataatggcgacgggaatgccgagctcctcggaaatcttgcggacgcgctccatgttctggcggtgataggcgtgagagccgtggctgaagttgaagcgtgcgacgttcatgccgttcttgatgagctcgcgaagcacgtcgtcactctcggtggaggggcccatcgtgcagacgatcttggttctcttggtagacatacgtttcctttctaaacatatggaagggcgggtcgcaagcggcccgcccgtaaacgctttcagccgctcgcgtactattgtaagccgctgactatggcttgtgttgacaacgtgcaaggttttggtaatgaccccaattagtggtcaagtcagccctgccggacaactagcagacgacgctgcggtcgctgaactcctcgcccttggcgtagcgctccgcgttgtcgagggtgacctgagcgatctgctgcagggcctcgtaggtgaagaacgcctggtgagaggtaaggacgacgttggggaaggagcagagcctcgccgtgatggagtggcccaggatctggtcctcgcggttctggtagacgttcgcgttctcgccctcgtagacgtcaaggcctgcggcgccgatcttgccggagcggatgccgcggatgagcgcctcgatgtcgaccaggccgccgcgcgcggtgttgaccaggatgacgccgtccttcatcttggcgatggtgtcgtcgttcaccaggtggtagctgtcctcgttgaggaaggcgtgcaggctgatgaggtcggcgttctcgtagatgccgtcgtagtcgacgtacttgtcgatgatgccctcgtcgacgagcttctggttgggatagaggtcggagccgaggacggtcatgccaaagcccttgcagatgcgggcgagcgcggcgccgatgcggccggtgccgatgatgccggcggtcttgccgtgcagggtgtggccgaccaggccgtcaagcgagaagtcgttctcgcggacgcggatgtatgccttgtggatgtggcggttggcgcagagcgcgagcgcgattgcgtgctcggcgattgcctcgggggagtaggccgggacgcgggtgaccttcatgccgatggacttcgcgaagtcgacgttgacggcgtcgaagccggcgcagcgcatcaggacgaggccgacgcccatgccgcgcagaatctcaagggtcatggccgagatgtccgcgttcacgaaggcgcacacggcatcgtatcccttggcgagtgcggcggtcatgggggtgaggttcacctcggtgaagtcaacctggacctcgggatagttgggaagctccttcgagaaggacttcttgtcatatccacgcgtgccatagaaaagaaccttcatgcctgatcctttcgtcgtggcggtgactggccgccttgtccgggcgttacgcccatcacgtgcaatcgctgacacaaattatagcgaggatgtaaacctttggcgccgtgttggtgcagcccattggcctttgtgcgcatttgtctaccccacggcggtcaactctcggggcgcggcgagtctcgccgccaaacctgtacggtgaagcgtgtacgtttgcgccgccacagcacgcgggcgagaagaaccgccgcctcggctgcaacaacgacgccgcgttcttctcgtccgcccctgttgccggcgacgtcgctgccgcgggcttttggatttccttcgcaggcgggggcgtggttgtgcgttttgcccccgtgcgggtataatcacttcgttcattgttggcgcatgcgatacggcagccttggtgagcccttgcccctcctggggaattatgatcgggcatcaatctatcgcgtgctcgggcgcgccccgggcgtgcccccgtacccaggagggaagattgaaggagtatctggaagactccgcccacgtgctggcggaggtcaagtcggacgagacggcgggcatcagctccgccgaggcggccgcccgactcgagcgtgacgggctgaacaagctcaaggaggccgagaagaccccagtctggaagcgcttcttcgcgcagatggccgaccccatgatcatcatgctgatcgtggccgccgtcatctccgcgctcaccggcctcgcgcagggcgacgcagacttcgcggacgtcatcatcatctgcttcgtcgtcgtggtgaacgccgtgctcggcgtcgtgcaggagtccaaggccgaggaggcgctcgcggccctgcaggagatgtcagcggcccagtccaaggtcatccgcgacggccagctggtcaccgtcccgtcgtccgagctcgtcgtgggcgacgtcgtggtgctcgaggccggcgacgccgtgcctgcggactgccgcatcctcgagagcgcgtccatgaagatcgaggaggccgccctcacgggcgagtccgtccccgccaacaaggtcgcgagcgtgctgacgctctcgcccgacagcgacgacgtggcgctgggcgaccgcaagaacatgtgctacatgggctccaccgtggtctacggccgcggccgcgccgtcgtggtcgccacgggcatgaagaccgagatgggcaagatcgcggacgccctctcccaggcgactgacgaggagacgccgctccagaagaagctggacgagctctccaagatcctctccatcggctgcatcgtcatctgcgcgctcgtgttcgtggtgacgtggatcaagcacggcacgggcttcttcagcaacatgcctctcgtgctcaacacgttcatggtcgcggtctcgcttgccgtcgcggccatccccgagggcctcgcggccgtcgtcaccatcgtgctctccttcggcgtcaccaagatgagcgagcaccacgcaatcatccgcaagctctccgccgtcgagacgttgggctgcacccagatcatctgctcggacaagacgggcaccctcacgcagaacaagatgacggtcgtgtgccactacaccgaggaccaggacaggctcatgcgctgcatggcgctctgctccgacgcaaagtgggacgacgagaagcaggaagccgtgggcgagccgaccgaggcagcgctcgtggcggacgccgcgaagctcggcttcaccacgggcgatctggacgccgctaacccccgcgccggcgaggcccccttcgactccggccgcaagatgatgtccgtcgttaacgtctccccggacggcaactacatccagcacaccaagggcggccccgacgtcgtcctggcgcgctgcaccacggtccgcaccgccgatggcgacgtgcccctcacgggcgagcgtcgcaagcgcatcatggaggccaacaaggccatggccgacgacgccctccgcgtcatggcggccgcccgcgtcaactacggcaagaccgctcccgccgactactccgccgaggcgctcgagcacgacatgtgcttcctcggcctctgcggcatgatcgacccggtccgtcccgaggtgaaggacgccgtggccgaggcccacaacgccggcatccgcgtcgtcatgatcacgggcgaccacatcgacaccgccgtcgccatcgccaaggagctcggcatcgcgcaggacaggagccaggcgatcaccggcgccgagctcgacaagatctcggacgaggacttcctcaacgacgttgagaagtacagcgtctacgcccgcgtccagcccgagcacaagacccgcatcgtcgacacctggaagaagaaggacaaggtcgtcgccatgaccggcgacggcgtgaacgacgcgccctccatcaagcgcgccgacatcggcatcggcatgggcatcacgggcacggacgtcaccaagaacgtggccgacatggtgctcgcggacgacaacttcgccacgatcatcagcgcgtgcgaggagggtcgccgcatctacgagaacatcaggaagtcaatcgccttcctgctctcctccaacctcgccgaggtcatctccgtcttcgtggcgtcgctcgtcggcttcaccatcctcgagcccacgcacctgctctggctgaacctcgtcacggactgcttccccgcgctcgccatggccatggaggatgccgagcccggcctcatgaggcgcaagcccaggagctcgaccgacggcatcttcgccaacggcatgggcctcgactgcatcatccagggcatcttcatcggcgcgctgacgctcatctcctacttcatcggcctgcatgtcgagggcgtgcccctctcggccgtcctctccggtaccgacaagggcctcgacggcatgaccatggcgttcctgacgctctccatggtcgagatgttccactcgttcaacatgcgcagccgccgcgagtccgtcttcaagctccccacgcagaacaagtggctgtgggcctcgttcgccgcggcgctgttcctgacgttcgtcgtcatcgagacgccgctcgccaaggccttcgacttcgcggagatcagcgcgtacgagtacggcgtcgccatgctcctcgccttcctgatcatcccgatcgtcgaggtctacaaggccatcatgcgcgcggtcgagaagaacaaggcctaacgcatggcaaagcgcgctcacaagtctggtaagcgccgggttcgcgccggtggggtggacaccgccctgccggcgctctcgtccctctccgacctcccgtccttctcggatctaaggccaagcgagcggcagcgttccgctttcgcggcggaggccgaccgtgcggtccgcgagggcgaggccgggcgagaagagctcgacctcggctgcgtcgtccgccttgaccgcggctttcccgcaatcgtcacggaccggggcgtgtaccgcgccgagttcgcggcgtccctcaccaagggagacgacaactcgcgcgtcgccgtgggcgactgggtctgcgcgcgcctcccggaggggcacgacatgggcatcctcctcaggatcctcccgcgcgaaagcgacatcgcccgctggaagggcggctcccgcggcgagcgccagacgcttgccgccaacgtagacgtggtcctcgtgacgcaggctctcggcccggagccaatttccgtggagaggatcgtgcgctccgcggtcatagctcgcgactgcggtgcggacgtctccgtcgtcctgaccaaggcggaccgcgccggtgtggccatgctcgagcacgacgttgcgctcgtgcgggatgtgctcggtgcggacgtgcccgtggtcgccacctgcgcgggcgccagccaggaggactcgtccgagctcgccggtgccgcccgcgactgcggcatcggctggggcgagggcgacgtgcgaggcctcgtcccgcgcggcacgctcgccatcgtgctcggggagtccggcgccggcaagagtacgctcctcaacgcgctcctcggccgcgacgccctccagacgggcgccgtgcgcgcctccgacgacatgggccgccacacgacggtggcgcgccgcatggtcgcgctgccgggcgccggcgtcatcgtggacgagccggggctcaggagcctgcccctcgtcggccacgaacgcggcctcgcaaaggtgtttcccgaggtcgcggaggcggcgcagacctgccgcttcagggactgcacgcacacgcacgagcccggctgcggcgtgcggggcgcgttcgaggcgggggagttctcccgcgcgaggttcgatgcatacgtttccctcgcatccgagatgcgttccagcgcaaagacgctcgacccggacgtcgtgctctgaccaacccacacaaacggtccccgcacccatgcctagctgcgcctccccaggtgcagctaggctaaatttatgcacaagataactgcaagacgaatttgaaaagtcaccgctaaatcggcgttttcggttcagactcttattcacgtcgctttgatgtcccgcgcgcgtgagggggtccgccgtgtcacttcgattcaggctcgtgttcgccggttcctgcgcagtgctcgtccttctcgccttcgtggcgtacggcaacagcgtgcgcgccgaggccgaaaaggtgaggagcgaggccatcgcccgctacggcggcgaggttgtgagcctcgtggtcacgaactcggccctcgagcccggggacgtggtgggcgagaaggacgtgtcggtgcgcgactgggtgtccgacctcgccccgcggggcgcaatcacgagcctggacgacgtgatcggacgcgaggtgacggtgcccgtcggcaagaacgcccccgtgacgaagctcgcgtttcgggattcggcgcacctggccgacgtcccctccggccacgtggccgtgagcgtgcccgtaacggacaagctcggcgtctcgcgcggcgtgccgcagggctcgcggctccttgcctacaaggtttcggacgagggttcgacgctcgtgtgcgacgacatcgtcgtgctctcggccccagcgaaggcctcttccataggctcgagcgcgcagctgacgctcgcagttgcgtcgaagcaggtggcggccgtgctggacgcgagcgggaagggcgacctcaggctcgtcatgcccgcggacgacgtggacgcaccggcaggcgatgcggcgaccccgccgtcctccgaggactcgtccgggtccgacggcggcaagtcacagggcaaccagagtgactcttctagtgggtagggggtgctgcgatgagtgacaggtgggtcggctggacggccgatggctgcaggggagagctcaggggcgcgctcgcgacggtgaggccccacgcgacgatcacgttcgcgtcaagcgcctccgacctcaggcgcaggctgcggttcgaggacgcggagacgtcgggggcgatcgtgggactgagcgaggccggtgtgtcggacatgaacctggcggcagccattgcacacgacggcgtggcgggagaggtgatcctggtcacgaggcatgcctccgggtccctccggtcgcgagccgcccaggcggggataggcatggtgattgacatgagcgaggtcgatgccgcggccgggaggcccggggctgtaggaagcgcgggggttgcgcgggaccttgggggcctcccggccgtggcggagggagccatggcggacgacgtgccgttcgacctggacgagcctgacgtcggaacgggctccgaggtatttgatgacgagccaggggcggaccgtcccggcgcgaggcgcggcgtgacgctgacgttcgcctcggggaggggaggcgtcggcaagaccacgctggtcgcggcatgtgcgggaatcgctggcacttggggcatgagggtcgccgtggtcgacctcgacctctcgtgcgggaacctctacgtcgcctttggcgtcggacgtccggtggacctctcgcgacttggcgggcgtgcccccgcgacgcgcgaggtcatggggcggagctgcgcgaggctcgcggatgacgtgtacctctggggcccgtgcgagcgccccgagatggccgaggaggtgatgccgcaggtgggacggctgctcgagtacctgtcgcaacggtacgacctcgtgctggtcgacacctcgaccaccttcacggacgcggtcgcggaggcggtgcagcgggcggacagggtccttctcgtccacgacgaggctcccggctccgtcgggtcggtcggaagagcgagctccctggtggtgcggctgggggtcgcacgcacgcggctcgtgagggtgtgcaacgtggccgacccgcggcagagggaggtcgtcaatcagattgtcgccgctggcgcgttggagggtgcgcagtcgttcagggtgctcgacggcgggttcgaggtcgcggaggtcgccgcggcaggcggcatggccacgctcgtcgaggcggacggtcccatggtgtcgagcgtcaggtcgatgctcgcgcgcatcctggcggagcttggcgccctgccggatgcggaggacgcgcagcgtgccgccagggacacggcgcgcagggagaggttcaggttcttctcgcgtaggagggagacggtctgatgtcagtgctggagagggtcaagacgtgcgagtccagggcgacggacgaggggcgggcgccccaggggagaagcgaggagtaccggaggctcagggaggacctgaggcacgagctggtcgacaggctgggcctgtcggcgatcgcgtccatgctgaggtccgtgagcgtgccgcaggtgcggcaggagctcgaggtcacctgccaggcaatcctgaacgaggcgcacttctcctcgctcatgcgcagcgagcaggcgtcgatcacgaacgaggttctcgacgacatctgcggctacgggcccatacagaggctgctcgacgatgacagcgtgagcgagatcatgatcaacggcatcggggcgctgttcttcgagcgcaacgggaagatcgagtcggcccagagcgtcttcgagtcgaaggaccagatcctgatggtgatcgacaggatcctggcaccgctcgggaggaggctcgaccggagcaacccgctcgtggacgcgcgcctcgcaaacggggaccgcgtgaacgccgtgtcggacacgatcgcgctcaacgggcccgtcgtgacgatcaggaagttttccgaccgcatcacctcgctcgaccgtctggtcgagctggggtcgcttcccgcatggtacgcgcagctcctggcgtgggcggtccattcgagggaggacatcgcggtcgcagggggcaccggctcgggcaagaccacgctcctgaacgcgctgagcacacagatcggtatcgacgagaggatcgtgacgatagaggactcggcggagctccgcttcgactcgcatcccgacgtggtgaggctcgaggcccgctccgcgtcaatcgagggcacgggtgagataagcatccgcgacctggtcaagaacgcactccgcatgaggcccgaccgcatcgtcgtgggcgagtgtcgcggcgaggagacgatcgacatgctgcaggccatgaacaccggacacgacggctcgctcacgacgctgcatgccgggtccgcccaggaggcgatcctcaggctggtgctcatggcacgcttcggcatggaccttccgacagatatcatcgaggagcagattgcctcggcgctcgacctcctggtcatgtccgccaggtacccggacgggacccggcgcatcacatcgctgagcgaggtctcgaggggcgagaagggcggggtgcgcctgaacgagtgcatcagctacgaccaggtcaccggggagtgggagctgctgcgcgagccgagcttcgtctcgcaggccctgcgttccggcgagctcacccgcgaggaggtggagaggtggaggtgccttatgtcgccgttggctgcctgacggcgttcgtcgcggctgtcgtcctcctgggtggtgagacgaggagaacccccaagggcctgctctggctgacgacgaggcgtcgccttcatgccgcgttctcccggatggcggacacgaggccagtgtcgttcctggactccaggtccgcctggcacaaccttggcgcggagctcgccgcatcggagtcccgtcgcgtcgagcgggacgcgagacctggcttgccgcaggtggcgcttgtgacggatgccaggcaaggcgtggccgcgactttagcggcgggcgtccttctcgcctgcgtgctgtgcctggtggcgacgtccgccgtcggcgtgcccatagcggcgatcgtgctcgcggtaggcgtgcccatctgggatgggacgaggcagcggagggaggccagggtgctcgctcaggagatgccgggggtcttcaggaccctcgcgatggccatgggatccggggagacgctcgcccaggcgatcgactacctcggcagccacgaggcgggccctgccggcaggccgtttgcgcgcgcctccctgaggatgcgctgcggggactcggccagcgaggcgctggccggcctctcggaggagctgcatgcgcctggcgtgggcctcctgaccaccgcgctgctcatctcgcagcgcacggggagcccgctcaagtccctcttcggccatgccgcgaagctcgtcgagaggcagggcgagttcgagcgcatgctcgaggtcaagaccgcccaggtgcggctttccgtgcgcatcgtctgcggcctgcccgtcctcatgatcgcgtcgctctcgctcctctcgcctgacttccgggcggggctcgcgacccccgcgggcatcgtgagcatcctcctcgccatcgggatggacgcggcggcgctgctcatcatcaggcgcctgatgcggggtgtcgtctgatggacgcggcactcctggggagtggggccctggcgtccgcgtcgaccttcgccctcgcgtacgcgctggtctccggcgatttcggacgaggcggggagaaggacgagggctccctctcgacattcgcggcggacgtcgagaggcggcttcgcgccattggtcccatcgcggaactggaacgcagggggagggatgccgcgcggaagggcacctgcctgagggaccttccgtcgcttctggacgtcgtgacgctcggcctctcgtctgggctctcgttcgacgcggcgctcgcactctactgcgagcgctacgacaacgagcttgcggcgtcgttcgcggaggcgatgctctcctggcaggtcggtgcggagagcagggccgaggcgctcgggaggctcgcgggggagctcggcgtcgacgcgctggcgagcttcgcgtcgacggtcacgcaggctctggagtttggctcgccgctcgcgtccgcgctcgaggcgcaggcgcaggcgataagggaggagcagaggtcgcagctggaggaggagatcgagaaggtgccggtgaagatgctcatcccactggggaccctcatcgtgccggcgatgctcatctcgatactcgggcccctgttgggggcgagcctctcgctgtcgtagggaccgagtgggcctgacgaattgggggtggtgccgcaagggcgtggtgtgaccgatggatgcgaggagacgggagcgaaggatgatggagcgactcaggaacgacgtcatggagacggcttgggcagtctgggcgggtttcgttgacgaggagggccaggggaccacggagtacgcgatcctggtcggggtgctcgtggtgattgcaatcctctcgatcgtcacgttcaagggcaaggtgcagcagctctgggacgcgatagcaagcggcattgggtcgctgtgagcaaggctcacgggagggcggggaggcggtggccactcgcggtcgcgatgctctgcctcgccctcctgggcacccttgccgcaagggaggctatcgtgcgggacactggcgcaacgtcatcgcaacgcgagacctctacgggcgagaaggacggcgcccgtgaccgagcgaaggatggccaggacgcggccgggggctctggcagcaaggacaaagggactcggggtgacgcgacctcggctgccgcggcggagggcgagggggtgtcgacgcgcgtgatgcgtggcggcgtgggacccgttgccaagaaggtgctggctggttacgaggattcgtccgactgcgtcctcgcgagggcgggctacgtggaccttctgggaggtgcctggtcatgcaccgtcgttgggggagattgggtggacacggtggtcgtccgcgctcggaaggacaggcggtcgtgcgaggtgaagaccgtgaggatggacgcctcgacctgggagcgcgaggcgacggagctgtgaggagggggatggtgcaccatggcatcgcttgcttccagaatcgcgcggtgccgtaccgggggtccgagggacagtcgaccgtcgagtacgcgctcgtgctcttcgccttcctggcgtcggtcgtggcgcttgcgaaggtcgtcgactgggcgagctccggagggctcttctcctccgtcacgtctgcggggtcccactccgttggcgagggactcctcaaggcactacaggacgttcttctctactgaggcggttgtcgcatcggaaggcggccaggcgaccgtcgaggcggcggtcatgcttcccagtctgatgctcaccctggcgttgctcgtgcagccggcctgcatcttcttcacgcgggtcgtgatgaggtcggcggcagccgagggcgtgcgggtcgttgcgacggactatgacggcgaccttggggattgcagggagttcgtcctcaggaggctgcgtgccgtgccggatgcgccgctcttccacgccggcgggagggaggattggtcggttgagctgagtcgccatggaagcagggcgagcgtcgagatcgtgggacacgttcggccccttcctctgctgggcgtcgcgctctcggcatttgcggaacacgacggcaagggcatcgtgctcagggtctcggtgacggagacggtacgcccgagctgggtgagggggtcttatggggagtggcaacggatatggggctaggcccatggaacgggcacgcctcatgctggacttgttcctcaggcgggacgggggctacacgacggtcgccgtcgccattgcgctcctgatgagcgtggccctcgcctttggcgtggcggtggcggagtggggcatggcgcgatctggcgacgtgcaggaggtggccgatgccgcggccatgtcaggggagaactgcgtcgccgctttctgcacggtggcccaggtgcttgacgcgtgcgtgctgagcatggggctcctgggggtgatcgtgtacggggctggcatggttgtcgcggcggtccccatcctgcagcacggtgccccaaaggtgttggaggcgggcaggaagatcctggacacgaggaggaggttcgcgaagtccgcatccgagggacttgagcggttggagaaggcgcttcccgccctcatcgtcgcgaactccgcctccaccgtgtccgcgaactcgaggggggacgtcaagtatgcgggccttgccgtcccgtatccttccgagtccaagtcggacttcagccatttggacgacgagctggatgacaaggagatggaggaggccgcgaagaagctccaggaggcgtcgaagaggaagaaggaggccatggagcgtgcaaacgaggcgaaggaacgcgcctggagggcggataacgtggacgacccctcttgcatgaggggacgcgccctatcgctggcaggcctggacgatgcggcgaacccctattactcgagcccggcatcctggaagttcgacttcgcgcgcctgcgcgccgtgaactattacgccgcgcgatcgagggaggagccggcgacctcgggttcggcggacaacatccaacgctccagcgcgagggccgtcttctatcgctttgcctacgacgagatctcgggagcggtgtgcgaagagggggagaaggtcgatatccagttgcccgaacttccccatacgaccgacatggtgagggggaccgatctctatacggacgcgtcgtggccgtgcacgaccgaggaggacgggacgacgctccactgctccctcgcgtgtccgggcgccacggggcccttcgcgggagacgcgtcgcttgccgacatcgactccggcgtcgtgaagcgctgcgaggagtgccgaatggacgcgcaggcgatgggaaacgtcgcggacgcgtcgacgaacatcaacaacggcttcgaacactactggcggatcgtggtcgaggcttccaaggattaccagaaggcaaaggaggacgagcagagggccgagaaggacatgaaggaggccgccgagaagtgcgagtccgccttcgagaaggcgatgcgggtcctgagcgtcgaccgaccgaagctgtgtccacccggcgcatatgggtgcatcggcctcgccacgcgcggtgccacacagctgccacgtggtctgaccagcaggttcctcaagacgggtaaccttccgggaggagtcgccgtgtcaggtgccgtccttgcgcccgacgagcacaccgacggccacaacgtcctctccagcgtcttcgatgggatagagaggcctgacaggacgctcttctcgggattgctcgacggaatcggggacctgtggggatcgctcctcgtcggatatggctccaagtacggcgatgtgagtgcggccgcgaacaggttcctggatgggataggtggagtctttggcgagaaggtcgcaagctggctgaggggaaagatctcgggcgtcatcacgagggccggcttcgagcctgccgacatgcggctcaggaagcccgtgctcaccaacagccagcacatcctcgacaaggcgggcgtgtccaagacggcggaggtgaggtcgttcatacagacactgcccgaggacaatgccggcatcgtccgtgcgtgcaaggccaagctcgtctccattctcgggagcatgggcgaggtcacggtcgccgagatacccatcccggggctcgacggcgtctctatcccgctgacgatcgacctctcgaccatagcggagatgatcggatgagacttctgagagacgaggagggacagatgaccgtggagcttgcagtgatgcttcccgtcatggttgccatcggcttgcttgtgttcaacatcgtcaagtatgcggaggcctgtgccgcattcgacagggtggcactcgatgccgcggtgacgcatggcgtgtcccccgccggcgagcagagcggcacgaatgcggtcgaggaggtcgagagcacgatacgctcggcgttggactcgaagcaatgcgaagtagaggtctcggcgtccggtgcctcagggtccaagcgacggagggaggggctcgcctttcccatctcgcccctcctcaccacgtacacgtgtcgactgcgcttccatccttggccctgtcaggtctcgattgcgggcgtcggcttctcggtgccggtctcgcttacgcacgagcgttccattacggtcgaccgattccgtcccggggtggtgatttagatgaggtgcgtgcagatcgacgtcgaggaaggcagccttggcacgttcgacgtgctggagacgtggcccgagaggctcaaggggctgctcggcgacgtgggcggctcaaggcaggtgctcattgcggactgcgggtccatacataccgtgggcatgaggtatccgatcgacgtcgccttcgtgaacagggacatgagggtttgcctggcccgaaggcgcttgcccccgggaagggttctcggatcgcgcgaagccagcttcgtgctcgagaggcgcagcaatcctggcatatggcctgtcgagggggactatgccctcgtcgagggcgaatggagcttgggagggcaatatgggcgagaaacgaattgagaccaaggtgtgcccccgctgcggcgaggagctattctccgacatggacatctgctatgggtgcctctacgacttcacgcatccgccgaactccgtcgctggagctgccatgcctcctctcgacgaggtgcggacatgggcgggggagggcgattcggaagatgacgagcagcaaatcgacgaccaactcgatgcaacgcttcccctcgacatgccggcgcgtgacgtcggcgtggagggtgctgggggactctgggtccgttcctcggacatggagaccaaggtggacattccgccgggagggctgatagtcggcagggcgcctgactgcgacgtgatactccactccatcgccgtgtcgagaaggcatgtctccttcgagatcggccagggttgcctggaggtgaggaacctgggcgcaaagaacccagcgacggtcggcggcagggagatcactgatacgtacatgatgaagcggggacagacggtgagcgtctgcgggacgctctttacctatgttggcgagaaggcatagagaagggcgacactggccatttcgaagccagtgccgccctgaacggaagctatgttgccagcccctcaggctacatgggcatcgtcgtctgctggacgtaggtgcgggtgaggtacttctggtcaaggctgaagaggccctgcggggttccgccgaagagcttgtagtccgagatcaagtcggaggcgttcgtctcctcctcgccctgctcgttgacgaaccagtcgagcatcttcatggtgcggaagtcgttcgcatcataggcggccttgtagcacttgttgatgaggctcgtgacgtactgctcgtgctcgtagccagcctcgagcggctcgaggtcgttggagaactccttgtccggcttgtcgatggcctccatggtgggcttgtagtcgttgtcgaggaggtagcgacgcaggatcttcgcgtgatcgacctcctcctgcacctggatcatgtaccagttcgcgtagcccttgagaccgcggtcctcgaagtagtccgcaaaggtcagatagaggtatgcgctgtagagctccttgttgatttgctcgttcagtacgctgcttaccgtcttgtcaagtgccatctaaaatgctccttcgctattggcgaccatctttccggcgtaaccttgccatgaccttctatacccctttggctctggtatattttcgtccaaagtgtctggattcaaacggtagggagacttcacacatggtcgctcgattcggaattcacgaacgctcttctcgtctggcgccgttgctcgttctggtgctgctgctctgcagcttcctgtccgtctgcatcgccatcccggtgacggcgagggcggatgactactcgatcgacaaggtgaacatcgacgcgacggtcgcggcggacggctccgtggcggtgagcgagacgagggagttcgacttcgacggatcgttccacggggtctattggaagatcccgaagggcagctatgacggtcaggagatttcctgcaacgtcggcaaggtgggcttggtgtccgatggctcgctcagcgagttccgccaggtcagcgagagcgacgccgactacggtgaggacggaacgtacgtcgtaaccgacgagggctcatacctgaagctcaagatctactccgcgcacgaggacgagacggcgagcttccagatcaattacaccctcacgaaccttgccaggcgatactcggacacctcggagctgtactggaagttcgtgagcgacggctgggacgtcgagagtcagaacgtgacctgcacgattcaccttcccgtccccacggggcaaaccgtcaagggtggcgacaacgtgagggcatggggtcacggaccgcttgacgcaagcctcaagttcaaggggaacacggtcgtgtacaccgtctccggagtgggaagcgacgagtacgccgaggcgcgcatcgtcttcccgacgtcctggctctccaatgcgaattcggtcgacaagagtgtgctcgactccgtgctcagtgaggagaaggaggccgccgagaaggcgaatgccgagcgagcccgggcacgtgccatccagtacgccgtaacggcaatcggtgttgcgttggcagtggggtccatcgtcctgaccgtcatgcgtcttaacgcctaccggcagagtcataagccgcagttcgatgacaagtacttccgcgacgtgccgacgaatgaccaccccgccgtgctcggggcgctcctgaacgacggacaccccacggaggacgacgtgacggcctccctcatgcgtctcacggacatcggggccatgacgctcgagagagtggaactgaaggagaagggcatcttcggtcgcgaaaagacgaaggaggactaccaacttaccagggtggtccaccctcgcgaggtcaagaagagcaagagcgaggaggcagtcgacaacgcgactctcaagctcctgttcaacaagatcggacccaaggtcaagggtcgcgagaagggcgagctgctcttctcggacttcgagagggtcgcagacagcaagcctgaggcgtacaacgatgcctatgagtcctggaagacggaggtcgaagcccaggtcattcagaggggcttccagaccgatgcgcatgggaacgggaagggtctgcttgccttcctccttctggcggacatcgtgcttgccttcgtgaccgtggtactcatggtggaggagacgattgccgtcggctggggccttgtggcagttgtggcgctcgcggtggccgctgcgtttgccggcatcacgattggcagcatggacgacctttcacccgaggcggtggaggtcatcgcgaagctcaaggcactcaagcgctggctgaaggacttcacgcgccttgaggaggccgtgccgcaggacgtcatcctctggaacaggctcctggtcatggcggtgtccctcggcgttgccgaagaggtgatcgagcagctcaaggttgccgctccgcaggttctgaatgacccgggcatgatgcccgtctactgctggtacctctatcccacgtctcccatgggatcaccggcgtcgaacctggggtcgagctttgcctcggcgcacaaggtcagtacagccgcgctagcgaagtcatcgttcagctcggctgccggtggcggtggtggcttctctggcggcgggggcggcggcttcggtggtggaggtggaggcggcgccttctagtattggcatcgccagcggagatgacctcaaagtcgaatgaggcatctacctgcggacttcaaaattcttccatctattttcgagaatgttgttgacctggctggaatctttgatatattaaacaggcttgcaagcgagcaagtgacggctgggtagctcagttggtagagcaggggactgaaaatccccgtgtcaggggttcgattcccttccccgccaccatgaagatttggccccgtacctgcggaaacgcggtacggggcttcttcattttgctgaaagaaatggccgtgggtacaagatgggtatcaaatgggtattaacgaccaccctatcgattcgctatcggttttgaataacgtaccccttaccgtgtccgccccatgcttctgaccgccgcgttactctcgtaaagctgcgcagtgtccagtgcggcagtcgcactggacataggctacggctgagctagtaccggaccttgaactgactgtcccccttgacgggagggatgtcgttcttctcgtctatcacgtactcgatgggatagcgcgaccaggccttcgtgaacgtcgcgaagaaggtggagatctgctcctgcgtgccctggagctccatcgtcacggtctcccagtcgggctcgtttctgacccagccggtgcagcccgtctgggtggcgcagcgcgaggcggtccagcggaagccgaccccctgcacttctccccggaagacgaggtgtaggcgtcggatgccgtcgggcgcggggttggcggtcttgtcgtcggttacgttggccgtgttggcgtccgatttggcgtggtggtttgaccagggccatatgccgtctgcgcgggccatgcgttcctccaagggtcgaaatgcgtttatagccgtacaatagcaccatgcgaaacttcgatggcgaggtaaggttcacatgaaggccaagttcaacctgatgacggattccacgtgcgacttctcgattgaggacgtcaagcgggcggggatcacgtacctgccgttcacctacacggaggacggcaagggcgacaacgcgctctcgggcccggatgacctgtttcagtcgataagcgcccacgacttctatgagcgcatccgctggggcgcgacgcccaagacgtcgcagccctcgcagctcgtgtacgaggaggcgttccgcaaggcggcggagctcgacgttcccaccgtgctgctcacgatctcgagcggcatctccggcggctacaacggcgccgtgaccgcgcttgaccgcgtgcaggaggagctggggcgcgatctgcccatctacatcgtggacacgcttatctcgtccacgtcgttctacctgctgctggaggagggcgtgcgccagcgcgacaagggccttacggcggaggagttcgtccgttgggtggaggacgcgcgctaccacgtctggaccatcttcatggtcgacaacctggacacgctgcaccgcggcgggcgcatccccaagtccgtggcgctggtgtcatccgcgctcgacgcgaagccgctgctctcgtggaagctcaacggcgagctcacgatcctgggcgtgacgcgcggccgcaagaagggcatgcgcaagatgtgcgagtactacgagaagcaccgctcccagctgcagtacccggccgtggcggccatcggcaacgccgactgcgagaacgacggcctgcgcctgggcgccatgatcgcggacatagacgactccgtgcgcgtccttccctccacaatcgggccgaccatcggctgccacgtgggccctggcatgctgtcgtgctgcttctggggcagcgaccgtcgcgagcgcaagaacgcgctcacgggcaaggtcaagggcgttcgccagggctagcggctgaccggcgggaatgggcgatcacatgagcatgagcagaaggggcttcctcgcgctggccgcctcggcggccgcgggcctcgcggcgtgcgccaagccgggggagtcaaacaagcccgaggacaacaaggtcgacctgaacgagttcaaggacctcgagctggacgactccaagtggatgtacgacgacgccaacgactgctactaccagctagggcttccgtactgcaccaagccggcggcgggcaactacgaggcgctcgccatcttcgtgcccggaaagtacttcaagggcgagaagaacggcagcacgtggagctgcaaggtcaaccccaagggcaaggtgggctcgtttaccgcgagcaccgcgcccgtggtgatgcccgtcaactccgcgcggctctcgtccgagggctgccccacggcctactcctacgacggcctgcgcacctacctcgcgcgcggcctcgtgtacgtgtacgcgggcttccgcgggcgctcgggcggctacgtgagcgactcggaggagcagtactccggcggcgccccctggcccgtggtcgacctcaaggcggccgtgcgcttcctgcgctacaaccgcgactacctgcccatcaaccccaagcgcatcttcgtgtttggcctgggggccggcggcggcgtcgcggcctgcatgggcgcgctgggagattccggggtcttctcgccctacctgagcaagatcggcgccgccacgcacgacgcggatggccactccatttccgacgcggtgtacggatcggcgtcgtggtgccccgagacgtcgttcgacgcggcggacagcggctacgagtggatgatgggccagttcgcgaccgacgacacccgcaaggaaggcagctggaagaagctcctctcggacgacctggcgggcgcgtacggcaagtatgtcaacaagcttggcctcaccaacgacgacggcgacgcgctcaagctcgagtccgtgcaggatggcagctaccttgcgggcacgtactacgaccacctgcagaaggtgatcgagggctccgcggagaagttcttctccaccacgagcttcccctacaccttcacgccgggacgcctggtggacacagtgttcccgggtgaccccaacctcgacacggacagcgccgtcgcgatcgacacggtgacgggcgaggccgtggacacgaccaccacggccgcggctgcgtcgccctccgcgacgacgggcgccaccacgggcgagaagaacgactcctcgggctcggacaccacctcgggcacggattcctcctcgggctcgggcacgtcgtcaacgtcgaccgactcgggtgccaccagcggcacgggcaccggcaccaccgccacgggcgtgagcgtggtccagtccacggtgtacgacaccgcggagagctacgtgagcgcgctcaacaaggacgagcgctggatcacgtacagccccagcgccggcggcgtatccataacgagcctgtgggacttcgtcacgcactgccgctccaacgtgcgcggcgtgtgcgcctttgacgcgctggaccgctcgaccatcgccaaccagctctttggcgtggacgacgactcgagcctgcactttgacgagacgctagccgacctcctgaaggacaacgcgagccgctatgcggagcgctcgggctttgacgacgacctcccggacgactgggagaaggacgtggccaagctcgactcgctcaacacggacatggagtcgcgcgtggacgccatgaacccgctgtacggcctctgcgggcactacgcgggctttggctcgtgcgaggtggcgccgtactggcgcgtcaacacgggcctcttccagacggcgacctcgctcacgacggacgtgaacctcgtgctggcgctgaacgcctacgacggcgtgaagagcgtggagttcaaccccgtgtggggccgcggcttcgagcttgccgaggtgagcggggacgcccagaccaactttgccgagtgggtggtgtcctgctgcaagtgacggccgcagctcctctcaaaaggtaaacgttacaacctacaccatgcgccaggcatgcgcaaggcatattcgccataagcttgagattttttggcaaatgtgctagcattactctcatataagcgagaggagtgctgcgtatgtacgaagtcggccagtatgtcgtccatccgggccaaggcgtctgcaaggttgaggcaatcgaggagaagccgcgggcaacgtacatgctcatgcccgttggcgggcgccatcccatgcgcatcagcttcccggttgcgagcgaggacaggctgcgcccgatcatcggcagcgagcaggccaaggagctcataggcgagtacccgcagcttcccgtggagaagctgggcaaccacaccaacgccctggaggagcgcttcaaggacgagctgcgcaacgggacctgcagggacgccgtgcgcatcgccaagacgttccacgcccgcatcgcggaggtaaaggcatccaacaagaagccgcccgtcgtgtacgagcgcatcttcaagcaggcgagcgagcgctcgctgcaggagctcgccgtcgcccttggcatgagcgtggacgacgtgcgcgagctcttcctcaccaagggcgaggacgcgagtcagaactaggtccttctcgcccggcgaccgcccttcttgccaacgcatcccccttgtgcgcccgtttgccgcccacgtttcaatctgggctcaaacgggcgcgcttggcaggcggtcgcccgcccctcggatacaatgggggagaagagcaacccgcgcgctcgcagacgcgcgcatgacgccaatgggggaccgatggcagacacgaacgagaatcccaagaccagggcggtcatcaccgtgcttggcagcgaccgctcgggcatcgtggcggcggtggcgacggcgctgtcgcagcacgacgccaacattctggacatctcgcagacgatcctgcagggcacgttcacgatgaccatgctcgtggacctggccccgtcggacgtcgagttctcgcagctgcaggagcagctggacagcctctccaaggagataggcgtccagatcaccatgcagcgcgaggaggtcttcaagttcatgtaccgcctgtaggcggattgcgcccgcccgtgaggtgggcgtttttctcgccataaaaatttaaaggagacgacatgcccctgcactttgatccgctggcccagcggccgcggcactacctcacgcccgagaacacctccatgttcgagcacgtgctcgaccagtaccccatgccgtccgtgggaattggcaggccggaggtgtcggacctgctgtacgagggcgggcgcaacgtggacgtggtgccgccggagctgtacgcccgctacgacgtgaagcgtggcctgcgcaacgcggacggctcgggcgtgctcgtgggcctcacgaccatatccaacgtgcacggctacaacaaggtggacggcaagatcgtgccggacgagggcgacctgacgtaccgcggctaccacgtggcggacctgatccgcgcggcgcagcaggaggaccgctttggctacgaggaggtgtcgtacctgctgctcacgggcaacctccccacgccggcgcagcttgacgacttccgcgcgcgcatcggcagccgccgccagctgcccgagggctacctgcgcatcttcccgcgcaccacgttcagcccctccatcatgaacgtgctgcagcgcgcgacgctcctgctgtgcgccttcgacaacaacccggacgacacgagccccgtgcacgaggtggacgtggcgctgtcgctccttggccgctggccgcgcgtggcctccgtggcgcaccaggcctacgccgccgccaagacgggcgacgtgcccgttgtcccgcccgcgcgcgaggacttcagcatggccgagacgatcctggacgtcctgcgcggcgacgagggcttcagccacgacgaggccatgatgctcgacgtcatgctgatgctccacgcggagcacggcggcggcaacaactccacctttacgtgcagggtcctgagctcctccggcacggacgcctactccgcctacgcggcggcgctgggctcgctcaaggggcctcgccacggcggcgccaacgccaaggccggcgagatggtggacgacgcggcggagcacattgcggactggtcctccgacgaccaggtggccgactacctcacgaaggtgcttgcgggcaaggcctttgacggcaagggcctgatctacggcatcggccacgcggtctacaccaagagcgacccccgcgcgcagatcgtgaagggctacgccaaggccctcgcccagaagaagggcacggccgacgcggagaagttcgagctcatcgagcggatcgagcgcctggcgcccgaggtcatgcgcaacgagcgtggcatcaccaagccgctgtgcgccaacatcgacctctacaccggcttcgtgtaccacatgctgggcatcccgcgtgacctctttaccccgatcttcgcgatcgcgcgcatgtccggctgggcggcgcaccgcatggaggagctctatggcccggctcgcatcatccgcccggcgtacaactcctacatgaccgagcgcccctatgtgcccctggcggaccgcaggtgagcgctgcgggcgagaaggacgtggcgactggcctgcagccgggtgcgggcgcgccggccggggctggcgcgaaggccggtgcgggtgcgccggccggggccgacgtgcgcatcgtgtttgcggacatggacgacacgttcctcgcgcgcgacaagagcgtgccggagcgtaacctcgcgcttctcgacctcttggccgagcggagcatcgcgtttgtgccgtgcacgggacgctcgtaccgggccgtgagcgaacgcgtgctcgcgcatcccgcgacggcgtacgtggtgggctcggacggcgcggccgtgacggacgtgcaccgcaagggctcgccccagacggcgcgactgagcgcactgggcaagccccgcgcgctggcgctgtacgagcgcgtgcgcgagctgcccgtgacgtttgacgtcttctggggcggccacatctacgtgagccgcgagcgctacgacctcatgcgcggcttcgacgtgaccgaagccgaccgcgccatgtactaccgctaccgcacgcccgtggaccaggacacgccgcagctggtcgagggcctgggcggcgtggagcgcctcacgctctacacgccgacggtggacgtgcgtgcgcaggccatcgccgcaatcgaggccgacccgacgctccactacacgtactcgagcccctacaacctcgaggtgatggacgccaacacgagcaagggtgccgccgtgggctggctgctcgcgcacctgggcatcccgtgcgaggcgtccgtgggctttggcgactccccgaacgacctccccatgatggaggccgtggggcgcggcgtggccgtcgcgaacgcctacccggaggtgcgccaagccgcctcggacacggcgccctggacctgcgacgaggccgctgtggcgcgctacatggagcgcctgctggggtaggcacgccacgggttcagccgagaagggcgatgcaaaaggatcgggacccgtcccttgcgaggcgggtcccgatttctgtt

SEQ ID NO: 241 - DNA, 1258 bp, Unknown
  Metagenome-assembled genome
cgattgtgcttatatcactgatgaagaatttgagtatttagtggctaatctgacgaagtatctggggttagtctctaaacaagtcgctttaaccaataccaccccaaataagcgctatgttaatgggaaaaaggttgaagaacattacgccattatcatgactaaagtcgtgccgactaaagagaaactagccagcttacctaaattacagcaacaagtctatgacttggttttaagaacgacgttagcgatgtttgctgatccgtacgagtacgaggaaaccaccattattacccaagttggtgacgccaattttaaagcaaccggtaaggtcccaactaagcaaggctggcaagctttatttaatgatcacaaagccgaccagcaagaagcagcaactttaccgctcgttcaccaaggcgatcaagtccaagcaaatctgcaaacgccgcaaaaagaaacgaccccgccggtaccatttaccgaaggtaccctgattacggccatgaagacggccggtaaaacgcttgatgatgaagcagcccaggcgattctcaaagacgtgcaaggcattggaacgagtgcaacccgggccaatgtgctggaagtgttaaagaagcgcggctatttagttactgaaaagaacaagctccacgtcagtgaagcggggattactttatgtaaagcggttgaactcgaacccttgttaactagcccagagatgacagcaaaatgggagcaagcgttacaacaaatcagtaccgaagaacgcaccccggataactttttgagccaaatcaaaaagttcgtggaaaaattgattgctgatgttcccacgcaattgactggcagtgcagccattaagcaacaaatcgatcaccaacagcaagcgcaaaaagttgccgaggtgttcttagaaacaccacaagtaactgtcataaataaacaaaagttttacattgtgaaacccaagcaaggcgaagactttaccttacccaagaaatggagcagcaagacgctcgggaagaccgcaattaaagcgttggtcaccaagggggaaacgagcaaattaaagggtttcaagagcaaaaagggaaagttgtttgacgccaagttaaagcttgacggccataaattaagttttgattttgattagaacctgcctaccgccctgcacgttgtttcggttggtgaactcgtcatttaggtttacttttcaaaaaccaaaaagtgaacctaaccaacgagtgtaattgta

SEQ ID NO: 242 - DNA, 57328 bp, Unknown
  Metagenome-assembled genome
ccgcagaacctctccggcggccagcagcagcgcgtcgccatcgcgcgcgccctctgcaccaagcagcccatcatgctgctggacgagcccacctccgccctcgaccccgagatggtgagcgaggtcctcaacgtcatgatcgagctcgcgcaggagaacatcaccatgatctgcgtcacgcacgagatgggcttcgcgcgccaggtggccgaccgcgtcgtcttcatggaggacggccagattctggagcagggcacgccggagcacttcttcacgcaccccgacaacccgaggtgccaggcgtttctcgacaagatcctgtaggagtgggtatgagaagaacgcacattcccgcgtccgacgccagccttgcgcgcggcaccgccgtcgcgggcggcgccacagccccgggcggccgtggcatcacgaggcgcggcttcgtgtcgctggcgggcgccctcgcgctgggcgccgcggcatcgtccacgctcgcgctcgcgggctgctcgggctccggctcctcgtcggggcagggcctcaaggccatcaagagccgcggctacctcaactgcggcgtcaagaccgacgtcatgggctacggctaccaggacaccgcgaccggcaagttcaccggtatggagatcgacatctgctacgccatcgcggccaaggtgtttggcgtgagctccgccacggcgcgcaggcgcgacctggtcaagttcacgggcgtgaccgccaagacgcgcggcccgctggtcgattccggccaggtggacctggtatgcgccacctacacgatcacgcccgagcgcaagcagtcgtggaacttctcggacccgtactacacggactccatcggcatgctcgtgctcaagagctcgggcataaagagcgtggccgaccttgacggcaagatcgtgggcgtgggcgagggggcggacaccaaggcgcaggtgcaggccatgctcaagagccagggccacggcgacttcaaggtgagctacccgcagtacctggactatcccacgctcgcggcggcgctcgcgtcgggcaacatcgacgtcttcgccatcgaccgctcgatcatccgcacgtacgtgaacgactccaacgagctgctcgagccaaagctcgtgtttggcaagcagcagtacggcgtgtgcacggcaaagtcgtcaaccgagctcacgaggctcgtcaacggcgtcgtgggcacgctcgtctcgtccggcgacatcgcgcgctgggccaagaagtacaagctcctgtaggaggtcgcatggaactcttcgatcctgggcgctgggcccagacgctttccaactcggacctgctctggcagggcttcttcttcacgatccaggtctcgctcgcggggcttctggtctcgctcgtcatgggcacgctgctgggcgtgttctccaccacgcgctcgcgcgtgctgcgcgcaatcgcccgcgtctacgtggagttcttccagaacacgcccatcgtggtgcaggtcttctttgtctacacggcgggccccatgctgctgcaggccatcacgggcgcgtcgcacgtggtgaggatcgcgcccttcgtgctcgtggtcatctgcgtgggcctctaccacggcgcgtacgtggccgaggtcatccgcaccggcatcgaggccatcccgcgcggccagatggaggccacgcagtcgcagggcttcacccgcgtgcagggctatcgctacgtgatcctgccgcagacgttcaggatcatcctgcctccgctggccaaccaggcgctcaacctggtcaagaacacctcggtcctcgcgctcatcgcgggcggcgacctcatgtaccaggccgacatcatcgtggccgacagcggctacctgcagggctacatcgtgtgctgcgccatgtacttcctgatctgcttcccgctcgccatgctcgtcacctggctcgagaagcgctccaaggcgccccgcaaggcaaaggccactcacgccgtgcccgccgcgaccgcggacggggaggtgtagcgcatgcaggtcttcaccccaagcaacgtcgccttcatgatgcagggcttcctcaacaccatcatcatctccgcggcgtccatcgtgctctccatcatcttcggcacgctgctggcgctcgccaagtcgtactgccgcggccgctgggcctggctcaagtggctcgtgaccgcctacatcgagctcttccgctgcacgcccaacctgctgtggatcctcatcttccgcttcacggtgcagggcgacaacatcctcgtgtcgatcctcacgttcacggtcttcacgtcggccgtcatggccgagatcgtccgcggcggcctgaacgccctgcccaagggccagttcgaggcggcgcagtcccagggcttcggctttgtggacacgatgcgcctcgtggtgctgccgcaggcgttcaagatgatcgtgccggcgctgttcagccagtgcaccacggtcatcaaggacacctcctacctgcgcggcatcgacgtccacgagttcatgcgcaactccgccgtcgtcatgggccaggcctccacgctggcacagatcctgctgctctatgggttcgtccttctcacctacttcgtgctgaacttcgcgatctccctcatggttagggcataccagcgcaagaccgccgcggcgtagcggccgtgaccgccgcggcgcagcggccggcggcacaccaagcggccgagaagggctaccctgtgaggggacggcccttctcggccgcggcaaaaccactatcgacacgatcgaaaggcaagcatgccaaccacgaacgcatacgacgccaggcacagcgcggacgtcgccggctcagccaaccccgccaaccaggagcccatcgtcatctccatcgcgcgcgactacggcgcggaggggcacgaggtgggcaagctcctcagcgtgatgctggggattcccctgtacgacaacgagctgctggtccgctccgcggcgcgtaccggggtcgacgtcgaccagctcgccgcggtggacgagcgaccgcagcacgggccgctcgcgttcctgcccgacagcatggaccagcgctcgggcgcggaccgggcgttccaggcgatccgccaggtcatcctggacctgggcagcacgcgcccgtgcatcatcgagggccggctttccgactacatcctgcggcgcaaccccaacctcatatccgtgctggtcacggcgccgctcgacgtgcgcgtggagatcgtgcgcgcaaagcacggcatgaccacgcacgacgcgagcgccttcgtgcgcaagcgccagcacgagcgcgagcgcttctacacgcgatacagcaacggcaagtgggacatgtacacggacaaagacctggtggtggaccgctccgtgttcgggcgcgagggcgcggccaaaatcatcgccgcggcgtaccgcctcaaggaggagcagctcggcagggcgtagcgggcggcaacgataacacagctttggactgatggccgggctctgtgccggagacgctggcacagaacccgggctttttgggtgcagcctggcagcggggctgggtcctgtgccacgacgcggccgacccctgcacagaacccactggaccttgcccggccgagcaataacgactgggttctgtgtcatgtccggacggccgatgcgagttgtggccggttctgtaccaagccataaacttctttacatatggtgcgaggcgtctacctctgatcatgtgtttcttaagcagtcggctttgcacagaaccctgagtatcttgctgcggggtggtacagaacccaaggctttcggtcggggacaggtcgaagccgcacagatcccaatggatttcaccgggccgcgcaaagtgagcggggttctgtaccaagggccgatgacgaagcgcacagaaccctgtgaaccttgcactggggcgcaaggacgttggggttctgtgtcgctgccgggatgcgcgtgccagtattgggcggttctgtgcccgtcataagcaccttaatttgtgtcgcgggatcgctaccttgagacatatgtttttgaatcggatgccgccgcacagaaccctaccgattttgcggattggtggtacagaaccccgtccttgcaatctggggcgtctccccaccgcacagaaccctctcgagtctcacaagccgcgccaacaggttggggttctgtgccgctatcgcctgggcacgtggtacagaaccgaggcgaccttgcgggcgctgcgggcaacggcggattctgtgccacgctggggttcgcgtatggtacagaacccagtcggcctttgtggctcacgcaaggtggggagggttctgtgcggtgccgatggtacagaacccgtccggttgggcaacgggcgagaagggcgggtcctgtgccagccgcctgccacggcccggcggcgttcgcatcgagcgcaatttgcgtccgcgtcccgcgctacgatagatgccgtcaatcgaaggggaggactcatgccgctcaacatcgtcaccacggaggaccagaggctcgttggcgcgcccgcgctggcggcgttgcgaagggccgtgggcgagaagggccgcgcgacgctgctggtgccggactttgacaggcagctcgacgcctgccgggagctcgcggcgcagggcctctcgcttggcgtgactgtgaccacgcccggtgcctgggtgcgcgagcgttggcaggtgtggggcgacggcaccaacgtcgtggagccgctcgcgcgcaccgtcgcgctgcagtcgtcgctggccgccgcggcgcgcgagggcacccccgacgcgcccgcctacaacgccggcacggtccgcgtgctctcgacgctcgcgtccgccgcgctgccctgggtccccctccgcgaggacggcaccgtggatgcggacgcgctcctcgaactgggcctcacgcgggcggaggcaaacgtcgtccgcgtgctcgaccgctacgtggcgctgctgcgcgagtcctcctacacggaggagtccgtcgccatggcgagcgtggtcgagcgcgtgtgcgcggccggcgcgcaggcgtcgctctggcccacggcgttcgttggcttcgacgagctgtccaagccgcagcgcgagctcgcgctgtccctcgccgcgcacacggacgtgactgcggtcttcctttcggcaaacgaggccgcggccgcgggggcatcccgcgcggcggcgtcccttgaggatgcctgcgccaagcggggcatcccgtgcacgcaaacgggcgagaagggcgacgccccggggtcgggtcacgctctggagcccggccccatcccggtaccggaccgcgtcccggagctgtggcacctgctcgaggccctgttccggggcgacgagcgcgtcgcggcggagggcgccgtgtctctcgccctgcccgccggcccgctggcggaggcggaggccgtcacgcaggaggtgctctcgctcgcggcggacagctgccgcagcgtggtcgtggtggcgccggacaccgtgcgcgcctggcgcgagctcgtgcccaagctcgtcgcgcgcggctgcagcgtgcgcgggcgggtctccgtgcccgccgcgagcctcgaggccctgcgcgcgtacctggagttcgcgagctccgtcgccgtgctggcggagcttgacgccacgtggcccgagcccgagcgcacggaggagggcaccatcgtccacctgggcgacatgagctggtggccgccgcggcacgtgacggacttcctgctgtgcgacgtggcgcacgtccccacggctcgcgcgtggaacctcgaccgcgcgtggcgcgcaaaccgcctgctcacgcccgcggacgtgctgcggacgctgcagaaccccggtgcgacctcacccgaggttgccgcggccacgcgcgagctgctgcgcggccggctcggatcggcggcgtccaagctgttgcagccgtacgtcgcgcggctggcgccggtgtcttccgccgcggcgggggagaaggacggcggtcccgccggcagcgccaaccccgccggcactcgtgccgccgccagcgcgcgcccggtcgactacgtgaccgacgacgacggcaacgtcgccgtcacgtggacgcgcgaggacgacccgatggcggacgtctgcgccatgggttcgctgctggccgtgctcaacgtggcaggcaccctcaaggaactgcacttctccgcggatcccaaggcggaggaccgcgtgtcgctggcagacctggtgcagcgctcgcgggaggcgctcgcgggcgtgtctgtgcggctgcgtccgggtgtggaggccaagggtgcatcgcccgtcgcaaacgtgcaggtcatgggacctgcggatgtggctcggctggcggtcggctccgtggatgcggtcatcgtgtgcgggcagagcgcggcggagtcgcccgtggagcccgcggacgacgtggcgagcgccctgaccgaggccatctgccgcgagcccgcgcccgacaccatggcgcaggcacgcgcaaggttctggcgccagatcgccgcggcgcgccggcacgtgacgctcgagcgcagcggcaacgacgccgcgtccaagccgcgctacccctccgtcatgctgacggagctgctcgcgtgctacgacgccgcggacgacggcacgtccaagagcgagaaggacgagcatgacgacaccaagcccaagcgggtcctggcctgccgcgcgcaggcggagaccgaggccgtcgccaacctcaacccgagcggcacggcgcctgctgaaccggtcgcgcgcgagggcgtggcgccggccgggcgcgtgacggacgcggcggcgcgggcgctcgtcaacgtgccggtcgaaggcaagcccgagctgttggacggcaggccgtacctctcggcctcgcagatcgagtcctacctggagtgcccgtacaagtggttcagcctgcggcggctgcgcctgcgcgactcggacgcgggctttggcccgatggagatgggcacgttcgcgcaccacgtgatggaggtcacgcaccgcacgctgctggaggaaggcctggccgccatggaggcgcgcggcgaggtcgtgccggacgtggcccaggacctgacgacgcccgtgcccggttcgcgcgtgagcctggacgacccggcggggctcgagcacgccaaggagctcttgcaccagatgctggccgcggacctgcgcgcgcagttcatcagcaccgggcgccacgaccgcagccaggccttcgtgccgcacaccgcacaggacgagggccagctccgcacgctcgagcgcgacctctgtaccgcgctcgactacgaggcggggctgctcgacggcttcgagccgcggctcttcgagtgggacttcggccacaagggcgacctggtggagtacgcgggcgcctggctcaacggcacggtcgaccgcgtggacgtggacgcccacggcggcgccgtcgtgatcgactacaagcacaaggggttcaacggcttcgcgcgggagtatgccgcgttcgccggcgcggacgacggcaacgggggcgcgcccttctcgctcccacggcgcgtgcaggcgctcatctacgcgcaggtggtgcgccggcacttccccaacctggccatccgcggcgcgacgtacctcaacacccgcggacaggaccacgtgctggcgggcgcggtggacgagggccagatggagcgcgtgtttggcgtgcaccagcccaagaaggccgcggcaaaggccatggcggtggagaggaacgcgggctttggcacggagcacgcccggggcatggacgccctgctcgacgcgacggaggaggccatccgcgccgccgtggcgcgcatgatggagggcgacatcgaggcggcgcccgtggacgcgagcgcctgcgagcactgcccggtcatgaactgcgagaggaagatcaccaagtgagcggcttcgaccttgaaggactgaacgacgagcagcgcaagatcgtgacgaccctggaggagccgctgtttgtggaggcgggcgcggggtccggcaagaccttcaccctcacgcggagggtggcgtgggcgctctcgcccggctccggcacggacggcaggccttttctggacgacctgtcgcaggtgctcgtgatcacgttcacggacgccgccgcgcaggagatccgcgagcgcgtgcgctccacgctgcgcgagtgcggcatgcgcgagcagacgctccaggtggactccgcctggatcagcaccatccacggcatgtgcgggcgcatcctcaggcgccacgccttcgagctggggctcgacccgcagttcaagatcgtggagggaaacgacgccagcgccatcgaggcgacggccctggagcaggtggtgggcggcgcctaccacgacgcgcgcggcgcgcgggagggctcgcccctgcgcgaggcctttgcggagtacacgctcggcacggcctcggccgatggctgcacggggctcatgggcgtggtgcaggacgtgcgcgccgcggcccgctccgtgccggatggctacaagggcctgacgtttccgcaggcagacagcgtgtctgaggtcatggcgcgcctcgcggaggagctggagtcccttgcggcgcaaaagctctcggacgcggcggaaaggaaggtcaagccctccctggacgccgtgagggggttcatggagctcgcgccgggcaggcgcacggcggccgcggcgcgcgacacgcttgcggcggtgacgctgccggcgcgcgggggcaaggccttccaggagcagctggacgtggccaaggacgcgctcgccgaggcgagggcgtgcgtccttctcgcccgtccgcgcgcgtgggtggatgacatcgtggcgctggcgcagcgggtggacgagcgcgtggccgagctcgagcgcgaggccggcgtgctttcaaacgacgaggtcgtgagcctggcgcttagggccgtgcgcgacaacgacacggtgcggagcgactacgcgggccgctttaagctcgtgatggtggacgagttccaggacacggacgccacgcagctcgagctcatcggcctgctggcaggaaaggatgcccagcacctggccaccgtgggcgacgcccagcagtcgatctaccgcttccgcggtgcggacgtgggcgtgttccacggcaggggagaagagctgcccccgtcgcagcacgtgcgccttgccgtcaactaccgcagccaccgcgacgtgctgaggctggtggacagggtctgcggcgggcagaacggcgtgctcaagggcttcatgcacttggacgccaaccccaagcgcgacgacaagtaccgcgcccgcgacctgccgcgcatcgacgtggaggtcacgcgcggctcgggcacgcgcggccaggtgagcgccacgcaggcgggcgtggccgcggccgccatcgcggacaggctcgcggagtacgcggcccacggcgagcggccgggcgacatggcgctcctcttgggcaccacgaccaaggccgcggactacatcgacgccatccgcgcgcgcggactcgagtgcgtggtcacgggcggctccacgttcacgagggcgcccgaggtcaaggtcatggcgaagctcctgcacgtgctcgcgaaccccaaggacacgaaggcggggctcttcccgctgctcacgagcgagatgttcgagctcgacgcgagcgacctcgtgcagctgggcacgcgcgcacagcgcgagctggacgcgcccacgatgcgctcgatcgaccgcgggctcgagaccatggcgttcttccatgacgccacgccgtccgcgcggctctcccacgcgcacgacgtgctcgcgcgggcgcgcctcgccctcaggaccaggcccgtggcggacgtgtgcctgcaggtcgcccgcgagtccggctggctctcgcgcctcgaggcggagggtgcggcaggcgtcgcgcgcgaggcaaacgtgctcgcggcggtggaccacatccgcgacctcacgcagtccatggggctcgggcccgcgcgcgccgcggcggagttcgacctctggctccaggtctccaaggtcgcgcccgcgtcgctttccggcggaccggacagctccgtccgcgtgatgacgatccacgcgtccaagggcctggagttcccagtcacggcagtggcggagtgctgggccacccgtcccgagggcggcaagctgcgccgactctccaccgggcgcggcagcgcgtgcgtcctcatgccgcagcagtcccttgcgagcgacctcaagcgcgtcgaggccacggacgacccgtccacgctcgcggagtgggcgcgctacatcaaggatgcaaacgacgaggccgcggcggccgagaagaccaggctcctctacgtggcgctcacccgcgcccgcgaggctctcatcgtgggctgcaacgtgtccacgagcaagggcgcggagacgaagcccgagctcgcagcgggcttcctgaacgccctggtgccctcgggcgtcggggcgccgggggagcgccgcctgcacctcgacgtgggcgacggcccggacgacccgctcgacgttgcgctgcgcgtgatcgacgtgagcaaggaggacggcacgttcacggtggactccgcgggctcgctcgagggcgtggacggcaccattgacgccgcggccgacgaccagcaggatgcgcccgacggccccggcgccgccgacgcgcccgcgacctacgacatctacgcgagcgagcccgacccctccacggcgcacgtcgagttctggaagccgcgcgagggcgtgtacagcttctcgagcgcgcatgagctcatgcgcgagcgctttgcggagggcgcccccatgggcgagaaggacgcggccccgtccgagggcgccaacctggggaggcccgtcgccgtgcgggtcccgacccgcgccgagcgcgacgcggagcaggagggtgcgcccgtgacggacgacgaggaccgtgccacgaactttggctcggccttccacgagctggcgcagtgcctggtggagctgggcaacggcctcgacgacccgctcgccgtgcgcctgcccgacgcccgcatcgaggcgacggcggacctctggcggctctcgcccaggaaccgcacccgcctgaggcaagcgctcgagcggtggagcggctcggctgtgcgtgcggaggcgctcgggcacagggtcgtccgcgccgaggtcccgttcttctcagccgcggactcggagttcggctcgtacgtggagggcgcgatcgaccttttggccacggaccccggctcgcgcgaggcgttcctcgtggactacaagacgggcgaccgcgggctcacggccgcgcagatccacgcgcgccacgagatgcaggccaacttctacgcgtccgtgctgatggcgcaggggttcgaggcggtggagtgccggttcgtgtgcgtggagcttgaggacgcggacgcccccggcgagccgttctgcgcgcgataccgcttcgacgcggggcgtcgccctcgcatatagctgcggcctggccgcctgcgacttgtggacggaatctggagcgacgccacattctgcgtgcccccgctgacctgcggatacgtaccgcggggcagcgggggtgcagctcagggggcgtgtccgaggatagaacacgtgttcttctcgcccgcgcgggcccgctgcgtggggtatgatggtgccctaaaacgaggacttgccaacggaggttgcacatggctttcgtccaccttcacaaccactcggacttctccatcctggacggcgcgacgcgcatcccggacatggtcaagcgcgccgtggacctggggatgcccgccgtctccataacggaccacggttacatgtttggcgtgccggagctcgacctggagtgccgcaagtacaacgacggccagaagaacatgaagcagtggcgccacgacgtcgagtgcttcaagaaggagtggaagctcgaggagccggacccggacgcggacgacgcggactacttcgaccgcgtgcacgaccagtgggcctcggatgtggacgtgtgggagaagagcgggcatgacctctcggcggtcgaggccaaccggccgcgcctcaagatcaagccgatctttggctgcgaggcgtacttcattcccggcgaccacgtggagcgcggccaccgcgagaagcgctaccacctcatcctgctggccaagaactcgaccggctaccacaacctgatcaagtgcatgtcggaggccgccggccacgagatgatgtactacggcaagccgcacacggtcttcagcatgctcgagcgctaccacgagggcatcatctgccagagcgcctgcgtgcagggcatcatccagcagtgcgtgctcgacgggcagttcgacgaggcgcgcgactggacgcgcaagttccacggcctgtttggcgacgacttctacatggagatccaggaccacgggctcacgttccgcaacggctgggacgaccgcaagctcgacgagtacctggtcaagctcgcgcacgaggagggcatcaaggtcgtctgcaccaacgacttccactacctcacgcgcgacgacgcgcccacgcaggacatcctctcgtgcatcggcaaggcgaccacgcttgatgaccccaatcgcatgcgcatggagggcaccgagttctacatgaagagcgaggaggagatgcgcgagctcttctcgtggtgccccgaggccgcggacacgacgctcgagatcgcggacaagtgcaacttcgagctcgattggtcgagcatgtacctgcccgagtaccctggcctccgtcccggcgagacggccgagcagcgcttccgcgaggagtgcgagaagggcctcgcgcgccgctacggcgaggactggcgcaacgtcaccatcggcgactggaacgtcaaggaccgcttcgagcacgagtacaagatcatcacggagaagggcttcgcgaactacttcctgatcgtccaggactacgtgcagtgggccaaggacaacggcatcggcgtcggcccgggccgtggctccgcggcgggcgccatcgtcgcgtacgccatgaacatcacgaacttcgacccgctcgagaacgggctcatgttcgagaggttcctctcgccccagcgtaccgagatgcccgatatcgacatggacttcgacgacgagcacctgcaggacgtcctgcagcacgtgcgcgacgtctacggcgaggaccacgtctgcaaggtcatcacgtactcgaccatcaaggcgaagcaggccatcaacgacgcgaaccgcgtgctgggcttcccggtcttcatgggtcagaagctctcgaagatgctgtcgaacgaccccaagctcacgctgcccaacgccctgcacaagaacgagaagaagcccgaccagtactccccggacttcgaggaggcctacaacaaggaccccgacgcgcaccgcatcatcgatgcggccatgtccatcgagggcttcatgcgcggcgagggcgtccacgcgtgcgcgacgctcatcgcgccgacacccgtcacggaccacgtgcccaccaagctcgacaccaagggcaacgtcaccatcacgcagtacgagggccactcggtcgcggacatgggcctgctcaagatggacttcctgggcctgcgcacgctgacggtcatcaacaaggcccttgccaacatcaagcgcaggtaccccacgaccgcggacatcgaccgcgtgccggagtcggtgcgccgctgcatcaaggacggggccacctgcgtcgacatcgacgtggacaagatcgacttctcggacccgaagatctacgagctcctgggctcgggccagacggccggcgtgttccaggtcgagtccggcggcatgaccgcgaccatcaagaacatgcagcccaaccagtacaagcagatcgtcgctctcatcgcgctctaccgcccgggcccgctcggcgccggcatggtcgacagctacatcaagcgcatgcacggcgaggagaagatctcgtactacgatgaccgcctcaagccgatcctggaggagacctacggcaccatggtctaccaggagcaggtcatgcagatctccatgaagatgtccggcttcacgcccggtgagtccgactcccgcatgcgcaagccggtcgccaagaagaagatcaagatgctgaccgaccagatcttccactgggagaagaccggcgcggacgagacgatctacgaccactggatgaacggcgccgtcgccaacggctacaagcgcgagatcgcgcaggagatctgggacaacgtcctcgagttcgcgtcctacgcgttcaacaagtcgcactccgccggctacgccatcctggtcatgcagacggcctggctgaaggcctacttccccaaggagtacatggcctccgtcctcacgtcctacatgggcaagacggacaagatcgtccactacgtcacggcgtgcaaccacgacggcaccaaggtcctcccgccagacatcaacgagtccggcaaggacttcacggccaccgacgagggcatccgcttcggcttcgccggcatccgcggcgtgggcgagggtcccgccgaggccatcatggcggagcgctccgcgaacggaccgttcaagagcctgcacgacttctgcgagcgcgtcgacacgacccaggcaaaccgccgcgtggtcgaggcgctcatcaaggcaggcgcgttcgactcgacgggctacccgcgcaagcagctcatggagttcgtggacaagaacaaccccgcgaacatcatcgacgccgccgcgaagaggcagaaggacaaggcctgcggacaggtctccatgttcgacatgttcgcggacgtccagggctccggctttgcggaggacatccccgcgccgaacccggacgacgaatgggaccgccacatcaagctgcagcaggagcacgacgtcctgggcctctacgtctcggaccacccgctcaggccgttcgagtacgccctctcaaaggcgagggactgcaccatcagcgaggccatggcctccgaggactacgtggaccccgtgacgggcgccacgtcccagcgcttcaaggtcgaggacggcaagaccatccgcctcgcgggcatggtgcccacgggcggcgtcgccaagaaggtcaccaagaagggcgaccagatggccatcgtgacgctcgaggacatggagggcgagatctcgctcgtggtcttcccgaagacctacaaggagtgcgccccggccctcgagggtgaggtcgaccccgacacgggcgagcgcatcggcgacgtcttcatccaggcgacgggcaagatcgagcacggcgaccgtggcgaccagctcatctgctcgcacatcgaggcgctcgagctgaacgagaagaccaaccgtcccaaggtcgtggaggtctacatcccctccaagatgctctcgatggacaggatggagaccctgcagtcgatcttcgaccgctacgacggcctcgaccgcatcgagctcatggtcgagagctcgtgcggcgacatgatgaggatggagctcccgacgaaggtcgatgccaagaacatggtccttctcgccgaggtgaaggacttcgtgggccgcgagggccacgtgcagatagcctagttacccaggcggccttgggcggcggccttgcgggacgctagattcccgcgaggtgcgtccgctcgaggtcgcgggcgatcagggggctcttggcggagtagtcggccacgagcgtctcgatgccacccacgaggtgcgcgaggtcgctcgggtcgaggaagcgcgcgaccatgccgacgaagcccacgtagtcgaccgcgtcgtcgattccgacacgggcgtcgtacaggcgctcgccgtgggcgcagaggttgcggacgtcgacgatcgcctcgaggtcgcgctcgagctcgcgcggcgtgagggtgcccttggggcccgcctgcgagatgcgggcgaggccgtcgcacacgcagagctgctcgtcccgcctgagcagcgcgaagaggtacttgaggttgccgaaggtgagctcgtccacgaggacccagaggggcacggtgtcgtgcttgtcctggaagtgggcgacgcggacgtcacggccggggccgcgtgggtcgcgctcgcgcgagcgcgcgtggtgctccagcgtgtcgatcatccacctgaggtcgccctcgtactcgtcctcgccgcggatgtagtcgcggcgctgcgtgaagttgttggggtcgaggtatgcctcgggcttggggtggcgcgagcagaacgcgtagctggtgagcgagcggagcgtggcctcgaccatcatgaggtggcgaaacgtgagggcgcgcaggccgcggtcgaagcggaagagcgcgtacacgtccgagaaggacgtgccctcgaggtagcggtcctctccctcgaaggaggtcgccgcgacgtcgaggaacggccgcttgtagccgttgacgacggcgtagtagccctcgcgcaggagcgtgagctcggtatcccggtcgcagcgcatgccgcgggactcgaggagcctgacctgctcgtcgatggtgaggaagcgcttctccatgttgcctccgggcggtggtgttgggactgcacgacgtgactctaccacgcggcgctgcccgcggctggcggatggccgggttctgccgtttgcggcgggaggggaatagagcgccgcgaggcgggaacaatagaccagaagggcgcccacgcgacgcccgaggcgtggtttgagaggacccacttacaaggaggaaagcgtatggcagagcttacgttctatcgttgcaacaagtgcgggaacctggtcatggtgcttgacaagggcgcatgcacgcctatgtgctgcggcgagcccatggagaagctcgaggccggttcgaccgacgccgccgccgagaagcacgtgcccgtggtcgagtttgacgacaagcacatgaccgtcaaggtcggcgaggtcgcgcaccccatgaccgaggagcactacatcgagtggatcgtcgtcgcggcagagggcaagacggtcatcaagcacctgaagccgggcgaggagccccagaggacgttctgcaagaagtttgcggagcacggcaccgtgtacgcctactgcaacctgcatggactctggaaggcagagttctagacccagtttgacggacgggttgccccgcggggcgacccgagggcatctccctccgtcgggcgtcgaccccatggtgggcgtgcccgacggagggatttctttcacatgaggataggcatcgcacagatcgacacgcgcgcgggcgacttcgaggccacggcggggaggatgatcgggctctccgcgcgggcggcgcgagagggggccgaccttctcgtcttcccgatgacgtcgctcacgggaccgacccccgttcgcgagagcgaggaggacgacttcctggtggacgccatggaggcgctggtcaggatgtccgaggaggtctcgtgtccctgcatcgtgcccgtggttggctcggtcgacggtgagccgacgcccgaggcggtgctcatgggcgagggcaagctcgtgccgctcaagatgcgggcgtacgccgactccgtgtcgcgtggcgtgaccgccgacgaggacggaccggcgcccgacctgccgaccgtggagatcgcaggcatgaggctgggcgtcgcctttacctccgacgacctggacgactacgacgacttcgacattcccgtggatgcggtggcctacatcgcgggctacggctacgccatggacgacccggactcggccctgggcgcgaacctcgcggagggacgctatgtgtctgacgcgcgcacgacgggcgcctggatcgtgggcgtgggttcgctcggcggctacgggacgtccgtgcacacagggtcgagctttgtgctatcgcccaagggcgacctcatgtgctcgcttccctcctttgaggaggacctgcaggtgtgcgagctggcggatgacgatgacgcggcgccgctcacgcccgaggtgtggaacggcccgctctacacctggcaggccctggtgctggggcttggcgactacctgcgcaagctcgacaagcggcaggcggtgctcgcgcttgacggcagcgtgggctccatggtggtcgcggcgctcgcgacggacgcgctcggcccgacaaacgtgcacgccatcgtggacgtgccgggcgacgtggcgcgcgaggcgtgctgccagcgcctggccagaaacctcaggatcgacgtgcgcgacgcacaggacatgcgtgcggcgcaggtggtgaccgacgcgcgcgacgcgacgctgcgccggggcatcgtgggcgcctacctggccgcctgggccgaggagctggacgccctggtgctttccggcgcggacaagacggcgctcgcgctgggcgagaggcgctttgtcccggaggcggacgccctgaagccagtgggcgacgtctaccgctccgacctgctggagctcatgcggatgaggaacaccatgagcccggtgttccctgcggtgcggctgtgggagcgcgaggtccccatggcgggggagcgcgacgagtccgttgcggaggagtcctggtgccagcaggtcgaccaggtgctggcggaccacatcgagtacgggcgcagcgtgacggaggtcgcggcagcggcgggcgacggcgacctcgcgcagcgcgtcctgcgacgcctggaccagagcgagccgtggcgcatcgggcgtgggctctacctcatggtctcgagcgtgacgctcttcgacgcgcggaggcccctcggcatggcgtgggagaaccgcgtccgcacggaggcggagctcgaccacagccgcgaggtggagcggctggcctcgcgcatggacaggacgctcggcatggcggcgctgcaggcacgcggcacgggggacggcgactcgtccctctcgcccgcggagcgcgccgcatccgccgaagggggcgagaagggcggcacgtctcggcagggtgacgaccgcaagatgcgggaggcgttgtccttcctgcgggacttctcgtactttggcgggttcaagcccaagggcgacgggacgtccgggagcgagggggccggaggcggccagggaggcttcgagggctccgacggtcgcaagtggccgagcccgttttccgagaactgacacacggcctgcggggcactgtgatactatagaacgaacgttctatagttcgacactgctttggggacgacgtgatcattcttggcattgacccgggactggcgcacaccgggtggggcatcgtggagacgcgcgggccggtctgccgcgcccgcgcctacggctgcgtcaccacgaaggcgtccgagcccatcgaccagcgcctgggaaggatcttcgacgacctgacggaggtcatcgcgcgctaccagccctcccagctctcgatcgagaagatcttctttggcgagaacacgcgctcggccattgcgacggcgcacgcgcgcggggccgccatcgtggcatgctccaacgcgggcctcgcggtgggcgagttcacgcccatgcagataaagcaggccgtcgtgggcacggggtcggcggacaagcgccaggtgatctacatggtgcgcaacatactggacctcgaccacgacccaaagcccgaccacgcggcggacgcccttgcggcggccgtgtgctacgcgaacctcaacaggaccaagagcatcacgcgcagggtcgcggccgagcaggtgcgcgagcaggaggccgcccagcgcgtggccgacgccgccgcggcgaggcaggttaccgccgccgcgaccgccgcgaacgtggcgcgcgcccacggcaggcaggaccagctcttctcgacacggacgagcagaaggagcagcaaatgatcgtacggcttacgggaacgctggtggaggcgctgcccacgcgtgtcgtgctcgacgtcggcggcgtgggctacgagctcggcgtgtccgccaacaccgccgcggcgctgcctgccgtgggcgaggcgggcgtcaccctgctcacgaggctcatcgtgcgcgaggacgccatggagctgtacggcttcagcagtcgtgaggagcgcgcactgttcgacaggctcgtcgcgatatcgggcgtgggtcccaagctcgcgctctccgtgctgtcgacgttcacgccgcaggcgctcgccaccgtcgtggcgacgcaggacgtgagtcgcatgagccaggtgccgggtgtgggcaagaagaaggcgcagcggctgctcgtggacttggagggcgtcttccagaaggacgcggagctcaggagcctcgtgggactgaccggccccacggacgggaccgtgtccgtaaaggctgccggcgtcgcccccgcagtttcggtcgaggccgaggcgacggatgcgctcctctccatgggattcacgtcgcaggaggtggagctcgcgctcgatggcttcgaggaggcgggcgccaacacgatccagaaggtgctgtcgtacgcgctcaagcgtctgggaagcggggcctagcctatgtgggaagctgacaaggacgacctctttggggatgcggcggaaggccgagcggctcacaccgcggggcctcgctcggtgacgggcgagctcacggccgacgacctcgaggtcgaccgcacgctccgccccaagactctggacgactactgcggccaggagcgcgtgcgcgagaacctgcgcgtgctcatccaggctgcgaaggagaggaacgagcccctcgaccacgtgatcttctcgggtcccccgggcctgggcaagacgacgctcgcgggcatcgtcgcgaacgagatgggggcgaagctccacaccacgtccggccctgccatcgagcgtacgggtgacctcgcggccatcctcacgaacctcgaggagggcgacgtcctctttgtggacgagatccaccgcctgaaccaccaggtggaggaggtgctctatccggcgatggaggacttcttcctcgacatcgtcatcggcaagggacccgccgccaggtcgatcaggctcgacgtgccgaggttcacgctcatcggcgcgaccacgaggacgggactcctcacggggccgctgcgcgaccgctttggcatcagctaccgactcgactactactcggtcgaggagctcgcgcgcatcgtgacacgctcggcgggcatcctgggcgtcgacatcgacgagcagggcgccctcgagatcgcgtcgcggtcgaggggcacgccgcgcctcgcgaaccgcctgctcaaacgcgtgcgcgactatgcccaggtcaaagccgagggaagcatcacctgggacgtcgcggccgaggcgctggggttcttcgagattgacgagatgggtctcgactggatggacgtcaagatcctgacggcgcttgcgaagacgttccgcgggcgcccggttggccttaccacgattgcgagcgccgtgggcgaggacccctcgaccctcgaggacgtgtacgagccctacctgctgcagaagggcctcatcatcaggacgccccagggcaggcaggcgacgccgcttgccttcgagcaccttggcatcgtcccgccgcctacgaagtgacgggggccaaggccgccgtacttctcccctggggagtatgcttctatcgtttgacggacacgcggcaggcgtgcccagagtgatgcccttgggcgggaggttctgatgcttcagcatgactatctgctagagatcatcggcaggttcgtggagtccgtgagcgacgcgctcacgtgcatgctccgggacggcgacatgagccgcgcgggcgaggtcgaggacgccatcggcgagctgctcgacctggacgcgcacacggcgatggcgctgtcgccgcagtcgctcgtgacgatgatgacgttgagcggcgtgggggagtccgtcgcggggtacgtgtcctacgcgctcgacaagctagcgagggcgtacgagaaggacggggacgagcgggtcgcagccgttaggaaggcccaggcccaggcgatagcccaggcgttccattctggcggagaggtgcctccggagttcgagaccctcgaggagacgctctcctagccgactttgggggagcctcccatcggaatcggctcggggactaattttgtccgcaagcggtttgttggacagacgcgttccccaatggggtaacatatccctcgtgacgcgcccgagggcaactcacgacttgtatcgcgcgaaagcgcagcgtttatgtccccaaccgggggcaagaaagaaaggcacgacatggctcagggtactgtgaagtggttcaacgccgacaagggctacggcttcatctctcgcgaggatggcgacgacctgttcgtccactactccgagattcagatggacggctacaagactcttgacgagggtcaggctgtcgagttcgacatcaccactggccagaacggcaagctccaggcttccaacgtccgcaagctctagttctagaatcgctcaggcgcaggcttctgcctgcaggtgattccgcggcccgtcgtgcagtgcacggtgggccgcggttttgtatgtccgagggccgtggctggcccaggcgcgcccgtgcgccacgggcggcgctacgtgtaccatgggatgcgataccgaactcagacgattgggggacccgtgtcagacgaggaactgaagcgcgaggcggacgcgtacgtggacgaggtgtgggaggacgtcgtggcggacatccgcaccctggtgaggattccgtccgtgagggaccgcgagggcgccaagccgggcatgccctggggcaaggcgagccacgacgcgctggtggcggcgctcggcatcgcgtcgcgcctggggctcgacgcgcacgagtgcgagggctacatcggctacgcggacctcaagggcgcgtcggacacccagatcgcgaccatcgcgcacacggacgtggtgcccgagggcctgggctggaccgtcgacccctttgacgtgacgcgtcgcgagggctacctcctcggccgcggcgtgctggacgacaagggcccgctcgtgctgtcgctctacgcggccaacttcttcaggcgcaaggtcgaggcgacgggcaagcccctgccgtacacgctgcgctgcctcgtgggcaacgaggaggagtgcgagatgggcgacctcaagtggtacctcaagcactatcccgagcctgccttctgcttcacgcccgacgccgacttcccgctcatctgcggcgagaagggcgtcttccacggccacttcacgaccggcaggctcgcggacgagccgggcgccaggatcgtgagcctggatgcgggcaccgtcgccaacgcgatccccggccaggcggaggccgtcgtgcgctcgggcgccggcgagctcaaaccgcgcgagggcgtcgaggtggaggagaagggcgacggcacgttcctggtgcgtgcccacggcatcggcggccacgcgtcgcttcccgcggggacgcgcaacgccatcggcatgctggccgactacctgctcgacaacggcgtctgcaacgagcccgagcgctcgttcctctcgctcgagcatctgctctgcgctgcgtcgacggacggctcgagcctgggcatcgcatccgcggacgagaagttcggccccctcacgtgcatcggcggcacggtgcgcaccgtggatggcggctttgtgcagacgatggacgcccgctatcccacgtccatcacggacgggcagatcgaggaggtgctctccagactcgcggccgagcacggctgcgcgttcgacgtggacggcgtgaaggtgccgttctacatcgacccgtcctccgcgcccatcaagatgctgctcgacacgtacgccgagtactccggccagcccgccgaggcccaggtcatcggcggcggcacgtacgcgcgcaacttcacgtgcgcctgcgcgtttggcgcgaacgaccccacggccaagctgcccagctgggtcggccccgagcacggccccgacgagggcattgcggaggacacgctcaagcaggcgctcaggatctacatcgtgtccattgcgaggctcatgcgcctcaagttctaatcgcgggaggggcccgggcggccgcgccagcgttgccggccgtcagcagccccgcctgtcacgacaggcggatgtcccgccagtcccacaggaggaggtccgccgcggcgcggacctccttcacgtcctgtgtgggatcgttcgacacgacgccgcaggtcagcatgcccgcaccggacgcgctgcggatgccggccaccaggtcctcgaacacgatgcactcccgcggcgccacgcccaccctgcgcgccgcctcgaggtagatgtccggcttggtcttgggcacgggcacgtccttcccgtgcacgcgcacgtcaaacaggctgtccatgtcgatcccgcgcatggagttcagcacgtcggggtcgttcgtggtcgcgagcgcgatgcgcacgccgcgatcgcgcagcgcctggacgtactcgcgcacgccgggaagcagcctcgcctcgtcgcggtacagcgcgcggcccatggcgttccactcgtcgcagatctcctgcacgctgtcgtgcaggccaaagcgctcgatcgtgtagcgcgctcccgcctcgaaccccagggtcgacatcttgcgcgcgtagtcctcgggcacggcgtggccgcgcgagcccaaaaaggcctcgtctacgcgctgccaaaggctcgccgtgtcggatatggtgccgtcgaagtcgaatatcgcggccttgaagcgcggcggccacagctccgcgggcgcctcgtgttccggaacgtaccctgccgtgccctgcaccatatccctcccgacgtcatgggtccccgcgcgggcgcgcgggcggccgtcgatatgctagtctaaccaacgcgcggcgcacagggcgccggccgagcagttcgggtcctaaatcctgctcgtaaaacctaaaaccaagggagaagaacacatgctcaagaagacgctcgaggactaccggctgctcttgcgaagcgtgcccagcaccaacgtcgcgctgttcacgctcagcgtcgtcctcatgaacctgctcgccaacaaggagctcgtatcgctcccgtacctcgcactcgactgcggcatcacgctgagctgggtgtcgttcctgtgcatggacatgatcaccaagcgctttggcgcgcgcgcctcgatcatggtatcggtcttcgcgctcgtcaccaacctcgccgtggccgtcctcctctggctcgtgagcctcgcgcccggccactggggtgcctactacacctcgggcctctcggccgtggaccagggcctcaacgccaccatcgcgggcagctggttcgtggtgtttggcagctcggtgtccatgctcttctcgtccgccacaaactccctgctcaaccagttcatcggccgcaggctcgccagcaacgagggctttggctcctttgccaagcgcgtgtacgcgtccacgctcgtggggcagctggtcgacaacctcacgttcgccatcatcgtgagccacacgttctttggctggacgtgggcgcaggtcgtcagctgctccatcacgggcgccctggtcgagctcctgtgcgaggtcgtgctgagccccgtgggctaccgcgcggtccgcgcgtgggagcgcgacggcgtgggtgccgcctggctcgccgcgcaccccacggagggcgacggcgcccagtccaggtccgcctcgacggtgggggaggcctagcatgagcgtgctggtcacgggcgcgtcgggcggcatcggccgcgccatcgcggatgtcttcctcgagcgcgggcacgaggtggacggcatcgacgtgcgcgaggccccgttcgagcgcgcgggctactgccaccacgtggcggacgtgcgcgatgccgcggcgctgccccagctccccgctcccgccgtcatcgtcaactgcgcgggcgtgcaggacaccgcggatgacatcgacgtcaacctcaaggggaccatcaacgtgtgcgagcgctacggcttcgcgagcatgtcgcagcccacgccggagctccgctccatcgtgaacgttggttcttcctccggccacaacggctcggagttcccgcagtacgcggccagcaagggcggcgtcatcgcgtacaccaagaacctggcgctccgcgtggcgccgcaggccatcgccaacagcgtcgaccccggcggcgtcctgaccgagctcaaccgtcccgtcatggaggacgaggccctctggtcgcgcatcatgtcgctcacgccgctgcgccgctgggccacgccgcaggagattgcggagtgggtctacttcgtgggcgtgaccaaccgcttcatgaccggccagagcctcctcatcgacgggggagaggcgggcaacgcggagttcgtctggcccgacgtcacggtcggcaccaagcacgcggagtagccacgggcgggcgcggctggtcgcccctgccgtcggtcgcgcacgcggccgccccgcataccgtatgcggaggcgttcgtgccaaatgttgccagaatgttacactacacaggtgttgcaatccaaccatacgtacgcatccggaggtcgccatgacagacgaggaactgaaggcccgcgcaaaggagttcgcggagaagaactgggacgccatcgtcgaggacatcgacacgctcgtgcaggtcaactcggtcgaggacctggaccacgccgagccgggcaagccctacggccccgccccctacgaggcgctctcccgcgcgctcggcatcgcgtcgcgcctcgggctcgacgcgcacgactgcgacggccacatcggctacgcggacgtgcccggcgcctcggccaagcagatcgcgaccatcggccacacggacgtcgtcccggccggcacgggctggcgctacgacccgttcaaggtgacgcgcaaggacggctacctcatcggccgcggcgtgctggatgacaagggcccgaccacgctctcgctctgggccgccaagttcttcgcggacctcgcgcgcgagaccggcgagcagctgccgtacaccctgcgctgcatcatcggcaacaacgaggagaccaacatggccgacgtcgagtggtacctcgaccactacgaccagcccgagttcctcttctcgcccgatgcggacttccccctcatctacggcgagaagggcggctggtccgcgacggtcatctcctcggacgtggcggacgccatcgtggacatccagggcggcaccgtgggcaacgccgtcgccggcgaggcgaccgcgctcgtgaggccgggcgcgcacaagctcgagcccgcggagcgcatcgacgtggagtacgcggaggacggcctggtcaggctcacggcccacggcatcggcgcgcacgcgtccacgccgcagggctcgatcaacgccatcggtcttcttgtcaactacctgctggacaacgacgtgtgccagggcgcggagcgcgagttcctggagttcgagcgcatcgtgtttgcctccacggacggctcgagcctgggcatcgcgtgccaggacgagtactttgaccccctgacctgcatcggcggcaccatcgccaaggtgggggagcacttcgagcagacgctcgacagccgctatcccacctgcatcaccggggacgagatcacgcgccgcgtgggcgagctcgcggccaagtacggctgcaccgtgcgcgtcgacctcgacatggtgccgttcctgaccgaccccaagacgcccgccatgcagacgctcgtgcggacgtacaacgagtacaccggccgcgacgcccagggcttctgcatcggcggcggcacgtacgcgcgccacttcaaggcgggcggctcgtttggtcccaacgacccggcgttccccatgccggactgggtgggcgcggagcactccgcggacgagggcttcagcgaggagcagttcaagcgcgcgctgcagatctacatcgtgtcgatcgcgcgcctgatgcggctcgacttctaaccacagacaactgcaagccgtcggcgtcgcgtgcgcaggcggtggacgagaagggcggcgcgccggcttgtggccggtacgccgcccctttgcatggcgatgggtcgtgaccccgctggcccgtggcccgcggtggccgcgtgcgcctactggtccggctcgcttcccagcgagtccatcacgtcgagcgtgacgtcgtcctggtcaaacgccgcgagcacgttcacgaagttgcgggccacggggaagacctccgcgtcgaccgaggcgcgcgtgcactccatgacggtctgggagacctgcggcgtgggcgcgacggggatgtcgtggtagccgagcgtggcctcgatctcctcctgcgagaggggctgcgtgagcggcctgatggcgccctgctgggccgggctgcccagcacctgcgcggactgcgcgtccgcgggggcctgcgcgtcgggggcgtcgtccttctcgcctgcgtcgcccgaggcgtcatcggcgggggattgggcgtcctgggcgtcctgggcgtccgtgccggcgacctgcgtgacctgcggctgctgcaagcccgcgacctccatcaccacgatgggcgtgatggagggcatgaagcttatggcgctctggtagcacgcctgcgcggccaggaggttgcccttgttccacatgaacgaggccatgcggtagtagccgaggccgatggactccgggtcgtgcgcgtcgcgcaggaagccggtcaggacctcctgggcctcgtccatgctgccgcactcctccaggcagcgcacgagttggagcaccgcgtggttgtcgagcggcgcgagctccacgagcctgcgcgcgtgcgtgagggcgcgctgcgggtggtgcaacatgacctgcgccacggacgcgtagaagagcgccgcaaagtaggagtcgggcgcgagcaggagggcgcggccgtcggacgcgtacttgcggttgtagagcgcgcggtccacgtagctgccaaagtagcgccacaccacgcccttgccgtccgcataggcgcccgtcctgtccaggtggtcgagcacgggctccagcacggcgacggcgcccgccgcgtcgcgcttggacaggaggtcgcgcccgcgctccgcggcgcggctcagggggtcgccaaacacgagctcgtggccgatggcctcggggtccgtggggctcgtgccgctcaccatggacttgaccaggcgctcgcccgcgtcgcggacggtggggtcggggtcgtcccgcgtgaagtcgagcacggtgcggacgttcctttgggtggcgtccttctcgcccgcgtccgcgaggtgcagcaggatgttgccagccacgatctggcggtcgctcgcctcctcgatccccaggccggacacgctctgcgtgccgagcgcggccgcggcctccttggggagcctgcgggaggaaagctcgacgggcatgaagcgccacgcggggctgaagcgggcctcgtccaggtccgcggtctgctccacagggcgcaggatgccgtcctcgacgcgcatgttggggacgaagggacgcatggcgcggcgcaggtcgtccacgtgggcgaggtcgagccgcgcaaagcgccagcggtcgaagtcgacgcagaggtagcagcggtgcgtggtcgcgttgtccacggtgcccacgacccacgcgtgcttgatgcggcgcgacgagcggaaggccgtcgcggcaagcaggatggcgaggcgctgcgcgtaggccgaggccaccttgcggcgcatctcgcgcgagctgtgcacgaggccgatgccgtcgacgtacatggacgaggggaagacctgctcgggcgtgagcgccacctggaatacgacgttgccgtccgccacgttggtcctgaagtgctgctcgagccggtagggaagctgcagggactcgatcgccgtggcgatggagcggcgcacggcccactcgccgtcgggaacctcgccggcctccaggtcgagcggctggtcgatgggggccgactgcgcgcagatggagttggccaggctctgcatgagccggtagcagtcctccaccgtggccgactgcgggtcctcgaagtacgcgcacgcgcgctgggccgccgcgagcgccgcctcgagcttgagcacgcgcaaccgcgcgaggtagctgagctgctcgtcctgcacgcgcagcctgagcgtgcccgtgcgcgacgagcgcgtcacggcgatgcgggggagcttgacgtccttctcgaacagacccgcctccacgagcacgcgcgcgaagaagcgctcgataccgctgggggaaagcgtcgcctgcgcctgcgagccggactcgccgtcgacctgcgccatgcgcgtgcggatgtcgcccaccacgagcttgagctcgtccatggggtccgcgctcgcctggaggcgctgcgccacggactcgaagtcgagctgcgactccgcgggcgcctggggcgaggactctgccgggacgacctccacggtctgggtggcaggctcggccacgtccgtggcgtcggcggcttcggttgcgtccgcattgtcatccgggtgagaagaacggggcgcctgggccgcgagcgcgtcgttggactgggcctccgccttggctgcggccgagggggtcgcgtccttctcgcctgcgggagcctggtccttgcgcgtggccgcggctgtctgcgccgccgtgacatccgttgcgcctgactgctcctcctgcgacccggcgccgagcgtcgccgcgaacacgcccaccagcgccgccgccacgcaggccgcgatcgccacgagcgcccacgcgacgctgccgagcgttagcgcgcggacgatgcccacgaccgcgacgaccgcgaggacgacgaccgacgatgtgagaacccgccttatgggcgaacggaactgagccatgcggaaccacctaggagccaaatcggtacgggcgacgcgcgcccgggacgtatcttccagtcttcttacccaatggcggcccgtttgacgcgggggtggccctagcagccctcaatctcctttatctcgacctcgtttccccgcagcaggtaggtctggtcgcttccgcagtaggggcagacgcggccgtactcgaccgtggggtacgtcctgccgcagtcgttgcagacggtcaccgcgtcgacgcgctcgatcttgagctcggagtcgcgcaggaggtcgttcttcttctgggcccagtgccagcagtccgcaaagtagtcctccaggatgcccgagacctcgcccaggcgcatcgtgacgctgctgatgcgcgtgagctcgttctccttcgctatgtcgtcaagcgtgtccatggccgcgaacacgactcccagctcatgcatctgcctgccccctcgcgcgacgccgcggcccgactaggccttccactcccggacggcctccctcagccagtccagccactcgtccatgccctcgcccgtcttggcggagaggtagatgatccgcgcgttggggttgcgcaggcgcacgttgcgctcgagcttctgcttgtcgaagtcaaagtaggacagggtgtcgatcttgctgatgagcacgaggtcgctcacctcgaacatgagcgggtacttgagcggcttgtcgtcgccctcggggacggagaggatcatgaccttcttgccggcgcccgtgtcgaactccgcggggcagatgaggttgcccacgttctcgatcacgacgaggtcctgtccctcgaacccgagctgcgcgagcccctgctccgtcatcgcggcgtccaggtggcacatgccgcccgtgtggagctggatcgccttggcgcccgcctcctgcacggtgtgggcgtccacgtcggaatcgacgtctgcctccatgatggcgatgttcatctcgtccgcgagcgcgcgcgtcgtggcggaaagcagcgtcgtcttgcctgcgccgggcgagctcatgaggttgatcatcatcgtgcctgcgtcgtgcatgcgctggcgcagcgcctccgcctcgcggtcgttgttgctgaagacgctttcctttacctcgataaccttgatcgggtcctgcatctggctcctcctttggcatggctttctcaaccatgatacaggagccgtcgctggctggcgcccgcgggtgaggcggcgtccttctcgcccgcctgcgcgcgcaggggccacggcggatcccaccgctcgccgatgccgccccattcgcataatagtttgatttaagagactgccgtgaggacgcggcatcgcgctatgtgacgcgatgaataaacggaatgcacgcacttctcacctgcagatttgttgggcaagaaacacgtggaaacatacttgaaacataaatttagagcgtgtataacgaagccgtaaggcacgctggcgcgtgcggtccaaccacatgtctggagggtctatgggagcgttctctgcgcagacggtactgttcatcacctacacgatgctcggcttcgtcgcggccttggccgcgctgatggcggtcgtgggcatcgtcaggtacgtggtgcgaaaggcacttggcaggaaggagcctgaccccaatgcgacgacgtatccgaccgaggtccctcgcatcgcataggcgacgcgaggcggcaatgccgaccgcggacgaggaagttacgtgacagcccccgcaacctgacgtggtagcgggggctgtccttgtgtggcgtgtcgtcgcgggcgctaggcgtcgcccagctccgttggccagacggttccctcgggcatcttggcgttgccggactggatggacgaggggatggtgctgtcggacgccatcagctcgtcgatggtcacgagggtgtagccgttcttctggagcgcctcgatgatcttgggcagcgcctggacgtcctggtcgcggttgccgccgccgtcgtgcatgaggatgatgtcgcccgacttaacgttcagcagggcattgctcacgatctggtccacgccggggagcttccagtccttggagtcctgcgtccacgtgatggaggccgacgcgatgccggcggacttgacccacgtggtctcgcggaagtcgccgtagggcggacggaagaccgtcgtctccacgcccgtggcggacgatatcgccttgaagccggagctcagctcggactggacctccgcggcgtcgagcgtcgtgagctgcttgtggtcctgcgtgtggttggcgatctgggagccctgcttgacgatggcctttgcgagctcggggtactgctgcacgttcttgcccaggcagaagaacgtcgccttggcgtggtacttgttgaggatgtccaggtactgctgggtgtacttgtcgctcgggccgtcgtcgaacgtgagcgccacgagctgcttgccgccctctggcaccggcgtcctgaggtagatctcggcgtcggtggccttcttggtcacgacctcggccgtctgcttggagcgcttgcctttgagcaccttggcgctgccggccttgccgtagtttctcacgtacgcgacggggccaaagccgcccttcatcacgagcttgggcgccacggacgtggtcgaggtcgtgtggggctccatgatgttcttgcccttggcgagcacgatggtgtcgccctggctcacacggtagcgctcgccctgcctgccggggaggcttttgccgttgacggtcgccgtgaacgcgtagccgccgccccgcttgagcacgtcgcccttcacgctcacgaggttgccgcgcctgaccttgagggagaggtcccgtgcggcgtccttgagcgtgctgtcgatcttgacctggtagctggagccgttgatggtcacgggcaccttgcggttgctccacaggtgccaggcgacccctcccagcaccaggatgagcgcgagcgccagcagcgcgggtaccttgctcctgctactgcgctcctccgtggaggccgccttctcgcgtccgccctcggcgccgctcacgcgctgcgtggtggggatgtagtacaccccggtcgcgttcttctcgtcctgttttgcctgcctctgccctgccttgtggcgtgccgggttcgagttctgctctgccatggtcactggtccgttccaagcttcgtttcgtgtgccgccgaactaggatagccgcctcagtgggcggtgcgtgcaatcacaaagtcttcagagtccgttaagcgttgggccgcaaaggtcctcttactatacgggcggcggccgcgatcctgaccaagaatttggaagtctttaaggttatttctgccacgttctggcatccgcgggcgagaagcgccgcgaccctggctggggccgcggcgtgcgttagcgcgctatggagttatcgccttcgtgctagcggatcttgcggatgaagagcccgctcctgagcttgggctcgaaccaggtcgacttgggcggcatcaggagcccggcgtcggacacggccatgagctcgtccacggaggtggggtacagcctgaaggccacgcccttctcgcccgcgtaggactccagcgcctcgggaccctctatgccgcccacaaagcggatgcgggggttcgtgcgcgggtcgtcgatgcccaggacaggcgcgagcacgcggtcctgcaggatggacacgtcgagcgtggccacggggtcgtccccgagcgctgccgcctcgggcgagagggacatggcgtgccagccgtcggcaaggtagaggccaaactcgtggcgggctgtgggggagaagggctcctcctgcgcgggaccgacctcgaagccggcgtggcggatcttctcgatgagctcgtccgcggaaaggccgttggtgtccgccacgacgcggttgtatgccatgaccttgagctggctcgcggggaagagaaccgcgaggaagccgttgtagggggcgtcctcggaggactcgccgcgctcggccgcctgcgcgcggagctcctggctcacgcgcacggcggatgcggcgcgatggtggccgtctgcgatgtaggcgtgctccacggtcgcgaacgtcgcctgcagcgcctccacggcggccggacgggccacgcgccacacgcactggcgcacgccgtactcgtccgtgaagtcgtagagcggctcggccgtggaggcgaggcccaccagggtgtcgatggcgaagttgtccctatacgtcaggaagatggggccggtctgggcgcccgtcgccctgatgtgctccacgcggtcctgctccttctcgggacgggtgttctcgtggcggcggatcgtgccgtcaaggtactcgtccacggagcaggcgcacaccacgcccgtctgggcgcgaccgtcctgctccaggcggtacacgtagtagcagggcgtgtcgtcgcgcaggagcgtgccgtcgctggcggccttgcggatgagctcggccgccttggcgtacacgtctggggcgtacatgtcgtggtcgggggagaaggacgtctccggccggtcgatggccagaaacgaccccgggtgggccttcacgtaggaggccgcctgcgcgcggtcgaacacgtcatagggaagcgacgcgaacgtggccgccttgtccggtgccggacggaagcagcgtatggggtctgcgcgcatggggtctccttaggttgtgaggttgcggcgagctacctggtgatcgcggggacgatctgcctgatgcggtacacgccggggatggcgcgcagcgcggccatggtctcggcgtccaccggctggtcggtatcgataagagtataggcgctgccgtcctgggcctcgttggacatgcgctggatgttggcgttggacttggcgagggcgcccgagatctggccgatcatgttggggacgttcgcgtgcagcgccgcgatacggccgcccgtgtggcacgggcccatgtcgcagtcggggtagttgacggagttcctgatggtgccctgctccaggtagtccttcatctccctcacggccatggtggcgcagttggcctcggcctcggctgtgcaggcgcccatgtgcggggtgatgatcgtgttgggcatcttggtggtcatgggcgtcgcgaagtcgcacacgaagcggcagagcttgccggagcgcagcgccgcgtccacggcgggctcgtccacgatgtcggcacgcgcgtagttgagcagcatcgcgccgtcggacatgagcgagatcatctcggtgcccatcatgtggcgcgtgtcgtccttggaggggacgtgcagcgtcacgtagtcggcgttgcggcagagctccgccatggagtcgacgcgcttgatgttgcggttgagctgccaggcgtgctcgacggacaggtacgggtcgtagccgtacacgtccaggcccagcgcctcgagggcattcgcgaccttcgagccgacggcgcccaggcccacgacgccgaccttgcgcccgatggcctcgcgtccgacgaaggccttcttgttcttctcggcatccttcacgatctgcgggtcatcggcgttcttctgcacccagttcataccgtcgagcgtgccgcgggagttcacgaggatcatgcccacgacgagctccttcacggcgttggagttgccgcccggcgtgttgaagaccacgatgccctgcttggcgcagcgctcgatggggatgttgttgtagcccgcgccggaacgcgagatgcagcgcacgttgggcccaaagtccacgtcgcggatgtcggaggccctcaccaggacggcgtccgccttctgcacgtcgtcggtcttctcgtagccatcgcccagctcggccacgccgtcgcgggtgatggtcttggcgatgttgtcataaatccttacgtaacgcatggtgtctccctctgcgtgtgttcgcttctctttggtttgtcttgcgcctggcgcgccggcgcggccggcccgcccttaggcgtccgtgcggcagtccgccctgtgggccgcctcgaaggactccatgtacgccagcagcgcctccacggcctccttggggaccgcgttgtagcagctcgcgcgcatgccgcccaggaccctgtgcccgccgacgttcaggatgttgtgctccgcggcgcccgccacgaactccttatccagctccttggaggggcagcggaacgtgacgttggcgatggagcgcgagtccctctttgcgatgggcgagaagagcctgctctggtccaggtagtcgtacaggaggttcaccttgtcccagttgcggcgctccatggcgtccaggccgcccgtgtcctccacccagtggaagatcttgccgcacatgtagatgccccaggtgttgggcgtgttgagcagcgagtccttgtccgcctggacgcggtagcccatgtaggtgggcacgacgtcgcccagagcggggccgtcgcccagcaggtcgtcgcggcagatcagcaccacgttgcccgcggggccggcgttcttctgcacgccggcgtagatcagcccgtagcgctccacgggcacggggcaggataggaacatgctcgacacgtccgccacgatgggcacgttgcccgtctgcgggagctcgcgcgtcatggtgccgtagaccgtctcgttctggcagaggtagacgtagtccaggtcctggtcgacgggaccctcgagcgtcgccgtgcggtcgaagcccgtcggctcgctcgtggccagcacgtcgaccgtgccgtacttctcggcctccttggccgccttcttggaccagttgccggacacgatgtagcccgcgtggcgcgtgcgcatgaggttcatgggcacgccggcaaactggagcgttgcgccgccctgcaggaacataacgcggtagttctcggggatgcccatcaggcgcctcagcgtggcctcggcgtcgtcgatgatcgactggaaggcactagatcgatggctcatctccattacggacattccggtgcccttgtagtcgagcatctcggcggcggcctccttcaggacgctctcgggaatcgccgagggccctgcggaaaagttgtacgcgcgtgccatccaaacctcccaatcatcaagctgtgggccttgccccgccgcacccccatggcgcggcatttcgcatcaggttaccctcttcgtgtttcaggtgtggaaactaattcccaccgcgtgtaagggatatgaccgacgcccacaatggttgccgacatccgtacattccatacagtattccaaacttttatcggtcccgcacgcgcgcgggaccgggaacgggggcaacgtgggcgagaaggacaactcccaggcgcgcggcgcggccgtggcgccgcaggcgctgcgcgaggcggacccgagcgtgcgcggcgtggtcgtgttcgacttcgacgggaccatcgcggacagcatgccgagcatcgtcgccacggcgacgcgcgtgctgacggactgggggcttccccgggagcgcatggccgacgtgcccaagctcgtgggcccgcccttcccgcaggcgttcagcatggtcttcggcatgtccgacgcggacgcgcgcgaggtgacgcggcgctaccgcgaggcgtacgagaagatcggcgcctccgcgtggccggcgttccccggcatggcggagctcctcgacaacctgcgcgccgccggcaggacgctcgccgtcgcaagctccaagcgcacgaggctcctcaggcgcggcctttccgaccaggggatcctcgaccgcttcgaggtggtgctcggcaaggagaccgacgccccgcagaccaaggcccagacgctcgcggaggtgctgcgccgccttggcgccagcccggacgacgccgtcatggtgggcgaccgcctctacgacgtgaacgcggccacggcctgcggcatgccctgcgtgggcgtcacgtacgggcacacggccccgcgctcggagctcgatgacgcaggcgcgtgcgccgtggccaaaagcgtcggggagcttggccgcgtccttctcggccgctagggtcgctcacgcagggcattcgcttgggacgcgcctgcaatgccgtttgtggagccgggcgtttagcgcctgctcgcttggggtaaagcaaggctataaccatgcgggtcccgcggggcccgcccatcgcgttgagaggggtcggcatgtctggttttgacgatttgggcgagggcgtccgcaagctcttcctgcttggcgtgggcaccgtcgcgaccggtgcggagaagtcgacggagatcgtgaacaagctggtcgagaagggcgagctcacggtcgcgcagggcaaggccgtgaacgaggagctcaagcacacgatccatgacgccgcggacggctcgtccgacgccgtgctgcgcgcgaagctcaagtccctcacgcccgagcagcgcgccgcctgggtcaagaacgcccagaagatcgccgaggacctggacgccgagcccgtcgaggtcgaggtagaggacggcgacgagaaggacgagcccaagaagtagggaagagccactcacttgtcaaacgacacgggccaggacccgcagcgcgcgtccgggggcttcgacatcaatgacatagacgacgtcgagtacctcggcaagtggtacgaggacgtctccaaggtgcacacccgggatgccggaaccatcggcatcctgggcgggcgcagtgcggacaccggaccgtaccgcatcacccgtgccaagaaggcggcccgcctgcacgagatcctgcgcatcgcgagccactacgacgttctgcacggactcacgccgaagacgctgcggagcctgctcgaggagcttggcccgacgttcgtgaaggcgggacagatcctctccatgaggtccgagatcctgcctcagagcttttgcgacgagctcacgaagctccggaccaacgtcgagccgatggaccgcgacctcgtcctggacacgctccggatggagtacgacacgccgatcgaggagatattcgacgcgatagacgacgtccccctcggctcggcctccgtggcgcaggtccacaaggcgcgcctcgtgacgggggagaccgtcgccatcaaagtgcagcgcccccacgtgcaggagatcatggcgcaggacatatccatcatgcgctcgctcgcgaagcacagctccgccgtgatgggcaacgagcaggtgctggacctccagtccgtggtggacgagctctggcagtcgttccgcgaggagacggacttcctggtggaggcccgcagcctcgaggagttcaggcgcaacaacgcggactgcaagttcgtggactgccccaagccatacccgaggctctgcacggagcacgtcgtggtgatggactacgtcgagggcatccccatcgacaacacgaaggcgctcaaggcggcgggctacgacctgtccgagatcggcgagaagctcgtcgacaactacaccacccagatgctggacgacgggttcttccacgcggacccgcatccgggcaacctcgtcatccacgacggcaagatcgtctacctcgacctgggcatcatggggcgcctctcgtcccacgaccgcaaggcactcacggacatggtgtccgccgtggccgcgcacgatgccgtcggcctcaagaacgggctcctgaggttctccgtgtccgagcccgagctcgtggatcatcccgggctcctggccgacctggacgcaatcctggacgagtacggcgaggccgacctgtctgacctggacatcggcgcgttcctgaatgcgctcatttcgatggcgagaaagaacgggatcgagctgcccggcaccgtcacgatgctcgcgcgctccctggtgacgctcgagggcgtggttgacgagtttctccccggcacctcgatgatcgatatcgtgagggcgcacatcaagtcgcacacggacccggtgcagcttacgaagaagcagctcaggcagctcgcgcgcgagtccgtgaccgcgacgcacggccttttggacgcggcgtcgcaggcgtcgaccgccatgaacatgctgacgcgcgggcagcttaggatgaacctcgggctcgacgggtaccaggaccccatcggcgacatgtcgagggccgcggaccgcctcaccatgggaatcatcatcgcgggactcttcatcgggtcgtccgtcgtgtactacgcacgcatcaagcccgtcgtctttggcatacccgtcatcgggttctttggctacatgctcgcgctggtgctggggctctgggtcgtgcgccaggttgtgcgcgaggggcgccgccgcaagtagcgtcgacgtcggaaacgacgagaattttgtgcggtttgcatgtgttaacttccgttggcgtctgctgaataaccgtccgccgaaagtggcaacattgttgttgcaggggaagcgcggatgcgcgtcagacggctagcgatggaggtcgcgtcacatggaccaggatcccaggtttcagatcgcatggagggtgccgggaggaggccagagaaccacctatgtgtcccggcaggttcccaccttcgggccggactgccgcgacctggacgtgagcgtcgagcgcgacggcgacgtctggcacgtgtgggtggacccggagtacgacctcaccgtcgagaacgcctccgcgaccgtgtctgtggacctcgagcatgcggacgcgctgtacctcaacgggtacgactccaagaccaactcgtgggagtgctcgccgcgcgtgggcatgcgcggcctgtggggcatccccggctttgtggcggaccactgggcgctggacgccgagggcgactaccgcatcgcgaggcaggacccgcggcccggcaggcagcatggctctggatacggctacgtgaggaacggccgcgccgtgacgctctttggcgagtgccggccggacacgggcctcacgtcggtatacgaggacctgtccacgggctcggtcacgctcacgaaggagggtcccgcgcggaggctcgcggcgggggagcgcgtcgagctcctcacgctcctggtcacgacgggcacgcttcaggaggcgttcgggcgcctcgcgtccctcatgggggtggagcgccgcccggcgctgccgctcgtgggcttcacgagctggttccgccatggtgacgatatagacgagccaacgctcgagagggacctcgtgggcgtggccgacgtacttctcgcccagccgctcgaggacgtgctgccggtgttcgcggtggactccggctacgcgcgcatgggcgactggctcgcgccggatgagaggcgcttcccgaggggcatgggttccctcgcgacgtccgtgcgggcggccggcctcgtgccggggctgtggctcgcgcccttcgtgtgcgagaggggctcgcgcacctatgccgagcaccccggctggctgctgcgcgacgcagacggacggccggtcaaggccggctcgcaggggggtggcgtgtacgccctcgacacgaggaacgacgaggtgagggagtacgtcaggagcgtcctgggcgtcgcgacccatgactggggctatgggctgctcaagctcgactggctctttgcggcggccatgctgccgcacgacgggatgaaccgcggacagctcatggccgacgcgctcgacctgctgcgctccgccgtgcccgagggcacgccgctcgacttctgcggggtgcccgtcgtgagcgcgatgggccgctgcgagtactgccgcatcagctgcgacgtgagcccggactgggacggcaagcccctcgagcgcatgctgggacgcgagcgcgtgagcacctggaacagcctgcgcgacacggagggacgctcgcacctgaacggcgtggcgttcctgaacgacccgggcgtctactacctgcgccgcgacgtggcgatcaccaactcccagcgcacgcgcctgctttccgcggacgcgctcctgggcggggcgctcgtcacgtccgacgacatgggcgcgtgggaccagcggcagtgctccatcttccggaacgcgctcgagacctttgtgcagcgcaacagggagcgtggcctgacggaggtcacggttcccggaagcgaggaggagccggccccgctggcgctcctggcgccagaggccgtggacgaggccgagggggaccagggcgagcccggggctgccgaggatgcgcccgcggccgaggccgagcgcgagcccgagaacgtcatgcagcttgcaaagagcgaggagacccaggtctgggacgactccaacgtcacgagcgtggtgccggttcccggcccggacgtgacggtggtcgaccggccgctgatggccgcgatcgaggctgccggcatcgaggtgccgaaggaggctgccaaggacgaggccgaggagccgggggagaaggacgcccccgaggccgagggcgatgccaagtccgaggaagagcctgccgaggacgcgaatgcccagggcgacgcggacgaggcgcccgacaaggacggtgcggatgacgaggacgagaagagcgaccgtcccgagggcgtggacgagcccacggtgctggcaccgccgctggctgccgaggtggccgacgccgcccagggggagaccgaggtgtacgtgatgacgccggaggacctcgcgccggacgacctgaggtccgcctgcgccgagaccgtggacgagggaccgacggagatctgacacctcgcgatgccacagcaaagggccgatacgacaatgcgcccgccccagtccgccaacgtggcgcgaccgaggcgggcgttcttctcgccctttgtgttacgggactgctagtcgaccatcttgatgctggtgatgacgggctggttgtccttcgcgacggtgccgttgctgtcttcgactggcgtgtcgtcgcagatggcgtccacgacctccatgcccgaggtgaccttgccgaaggcggcgtactggccgtcgaggttgctcgagtcctcctgcatgatgaagaactgcgagctggcggagtcgtagtcgttggagcgggccatgctgatgacgccgcgcttgtgctggatggcattggtgacgccgttggcgctgaactcgcccttgatgcgctggttggagccgccggtaccgtcgccgttggggtcgccgccctggatcatgaagcccttgatgacgcggtggaacgtgaggccgtcgtagaagccctcgttggcgaggcgcgcgaagttgctgaccgtgatgggcgtgttggtggcgttgagctcgagcgtgatcgtgcccctgcccttgacggtgatggtcgcgtggtggatgccggtggagtagccgttcttgagcggctttgtgaggaccgacgtgccgacggagctcgaggagtcgtcggtctttgaggacgagcccgaggacgatctgtctgtgcatgacgcgaggatgagggacgccgcggcggacgcgaaggtcgcgaggaagcagcggcgggtaatgtggtcgtggctcatgggttcctttccttgggggagggcggctggccgccacatgatctggttagcaagcccccaaaggtgcggctcgatgtgtcaacggagcccattttaccaattcttttaatagttttccaagcggctttgcgaacgggggagctggcgggccgtgcggcgccttgaatgtgcgaataatgtggccggaagggccgcattgccgcggcacgggaagggcgcgccggccttggtggaccgacgcgccctggcggtgcgtatgttggagaagggcgctactcgagctcgaaggcgcccgtgtagagctggtagtacgtgcccctctgggcgattagctcgtcgtgcgtgcccttctcgatgatgcgaccgtggtcgagcacgatgatcacgttcgagttgcgcacggtggagagcctgtgcgcgatcacgaaggtcgtgcgcccgtacatgagggcgtccatgcccttctggacgatctgctcggtgcgcgtgtcgatggaggaggtggcctcgtccaggatcatcgcaggcgggtcggccacggcggcgcgggcgatggagaggagctggcgctggccctgcgagagctgcgcggcgttgtcggtcagcatcgtgtcgtacccctcgggaaggcgcctgatgaagctgtcggcacccgcgagcttggccgcgccgatgcactcctcgtccgtggcatccaggcgcccgtagcggatgttgtccatgacggtgcccgtgaacaggttcacgtcctggagcacgatgccgagcgagcggcgcaggtcgcccttcctgatcttgttgatgttgatgccgtcgtagcggatcttgccgtccgcaatgtcgtagaagcggttgatgaggttcgtgatcgtggtcttgccggcgcccgtcgcgcccacgaaggcgaccttctggccgggcttcgcgaagagcgagatgtcgtgcaggaccatgtggtcgggggtgtagccaaagtcgacgtgcgagaggcggatgtccccggcgagcggggtgtacgtgacgctgccgtcgtggtgcgggtgcttccatgcccacatctcggtccgctcggagcactcctcgagctcgccgtcggcacccttgcggacgttcaccagggtgacgtagccgtcatcggactcgggctcctcgtcgatgagcgagaagatcctctccgcgccggcgaggcccatgaccacgaagttgatctgctgcgacacctggccgatggagccggcgaagcgcttcgtcatgttcaggaacgggacgacgacggcgatggagagcgccatgccgctgatggaggggttggggaaacccgtggtgagaaacgcgacccccgcgagcgcgacgatgacgtaggcgaggttgcccatgttcatgaggacgggcatgagcgtgttgccgtaggtgttggcggttcgggacgcctcgtacagggcgtcgttcacggcgtcgaactcctcgatggtcttggcctcgtgcgtgaagaccttgatgaccttctcgccgttcatggcctcctcggcaaagccctcggtgcgggcgagctgcacctgctggtccaggaagtagtgggcgctccttccgccgagcacgcgcgtggcgtagaccatgcacgcgaccatggcgaggaccacgagggagagggggatggagtaccaaagcatgatgacgagcaccgagaccatggcgaacagcatcgtgaggaggttggggagcgactggccgatcagctgacgcagcgtgtccacgtcgttggtgtagtggctcatgatgtcgccgtgcttgttggtgtcgaagtagcggatgggcaggctctccatgtggtcgaacatctggtcgcggaccttcatgagcgtgccctggcagacgatggcgccaagctgcgtgtaggcgatgttggcggcaagggcgatgacgtagcaggtgataagcccgagcgcgatgccggcgatcttggggccggcagaggcccagtcgcccgtggggaacgcgtgctgcaccacgtcgattgcctgctgcaggaagatcgacgggacggacgcgagcacggacgagacgatgatgcagatcaccatgaccgtcgtgtgcacggggtagtagtggaacaccatgcggagaatgcgcttgaacgtggcgccgggcctctgggagccgcggtgcccggagggagcgccctcgcgtcccgcctgcggcgtgggctcggtggtcgcgttcttctcggcggaagtgtcgttgctactcatggtctgcctccttcttctcttcctcgtccagctcgctcatcttggcgtcgtgggactgcttgttctgggtcgtgtaggtctcgcggtagatgtcgttggtgcgcaggagctcgtcgtgcgtgccgatagcgtcgatctgaccgtccttcatgaccacaatgcggtcgcagccctcgatggagctggtgcgctgtgcgatgatgatcttggtcgtgtcggggatgtagctgcggaagccctgctggatgagcttgtcggtcttggtgtcgaccgccgacgtggagtcgtccaggatgaggaccttgggcttcttgaggagggcgcgcgcgatgcacaggcgctgcttctggccgccggagacgttggtgccgccctgctcaatgtaggtgtcgtacttctgggggaggcgctggacgaactcgtccgcctgggcgagcctgcaggcctcgagcatctcgtcgtcggtggcctgctggttgccccagcgcaggttgtccttgatggtgccggagaagagcacgttgcgctgcagcaccacggccacctggttgcgcagggtgtcgaggtcgtagtcgcgcacgtcgcggccgcccacgcggaccgtgccctgcgtcgcgtcgtacaggcggctgatcagctggatgagcgtcgtcttggacgagcccgtgccaccgaggatgccgatcgtctctccgctcttgatgtgcaggtcgatgtccttgagggccatgcgctcggccttcttggagtactcgaagctcacgtggtcgaagtcgacggagccgtcggcaacggtcgtcacgggatcctcggggttcgtgatgtcgctcttctccatcagcacctcgcagatgcggcgtgcgccctcctcggccatcgtgaccatcacgaagaccatcgagagcatcatgaggctcatgagcatggagaagccgtacgtgatgagcgcggacatctggccgacgcccatggcctgggcgcggctgctcacgattgtcatggagccgaagtagacgacgaagaggtagatgacgtcgatcgagacggtcatgagcggcgtcatccatgcgaggatgcgctcgacgtggacaaagtcatggtagagctcgccggaggcgcggttgaacttctgcttctcgtactcctcgcggacgaacgacttgacgacgcggatgccgctcacgttctcctccacggagtcgttcaggcggtcgtacttcttgaagatgcgcttgaagatgggcatgaccacgagggagatcttgaagacggcatagcccagcagcacggacacgacgacgaacgccactgccatggggccgcccgtgacgaacgccatgatgatggagaacaggatcatgagcggggcgcgcacgacgaggcggagcagcatcatgtacgcctgctggacgttgttgacgtcggtcgtgagcctcgtgacgagcgagctcgtgctgaagcggtcgatgttgctgaacgagaagcgctggatctgcgcgaagatgtcgtggcgtaggttgcgcgcgaagccggtggacgcctttgcgcagcagacgcccgccatggtgccgcagaagagcgacacgagcgccatgagcacgagcgtcacggcgtagggcgcgatgtcctggaacccgccgccgagcgagatcttgtcgatcaggctcgcggtctggaacgggatgaggcactcgatgacgacctctcccaggacgaagaggggcgacgcgatcgagcttcccttgaactcgcggatgcttgccccgagcgtcttgaagatctggcggtacgttagcccctgttgctgttgcttcggcattcggtctcccttcccatgttctctctttcctcccagtgcgcgcggacgcgttcgagcagactctgcagctcgcgcttctcgtcctcggtcaggacggagagcgagtctgcctcgaagcgccgcttggtctcgagcatgtccctcgcgcacgcctctccctcctgcgtgagcaccacgtcgagctggcggcggtcctgtgcactgcgcgtgcgcgcgatgagcccctccgattcgagcttggcgagcacctctgacagcgcggccgatgtgatgtgggagcgctcgagcacctctctctgcggcagcctgccaccgttcaggagcaggagcacgaggatcgcgtgcttgccgccccgacccccggcatgccagtagaggtagtggccaaagaagccgaggtcgcgaaggacctggcgctccagcgtgacgggcgcgtccgaccagggaccgcccgttccaacgtctctttcagacaaaatgtgacctccaacgttttccggacgcaagaatactaggtacctagcgaattgcttgcaaggggaaatcgcatattgcaaggtaccttcatatttggtcccgaagggactgccgctggcatgccgctgccttcttgccctgccgttgtgacgtggcagcatggcgtcccagatgggcgagaaggacgagctccctcggcggcaacatcatccaagtgcggagtgggcgtttctcacctgcgactttacaaagcgatgaccaaatgtaagccaaacgtaagcaagcatcacgagcgggtaagtgcggccaaatcacgcggaaaggcaccttccagggccatagcatcctagtcgacacgagccgtaccgcggccagacggcggcgggcaggctcacagccaattggaaggaaagatatgtctaagagcatctctcgtcgtaacttcgtgacgctcgccggcgcctccgtggccgccttcgcgggcctgggcctcgccgcctgcggtggcagctccagctcctccgacagctccagctcttctagctcctccagctcctcttccagcaaggacgtctccggcaacatcaccgcagtcggctccaccgccctccagcccctcgtcgaggccgctgccgagcagttcatgaacgagaaccccggcgtccagatcaccgtccagggtggcggctccggccagggcatcacccagatcgcccagggcgccgtccagatcggcgactccgacgtcttcgccgagaccaagctcgacaacgccgacgacgccaagaagctcatcgacaacaaggtcgccgtcgtcggcatgggccctgtcgtcaactccaaggtcagcgtcgacaacctcacactcgaccagctcaagggcatcttcaccggcaagattaccaactggaaggactgcggcggcgacgacgccgacatcgtagtcatcaaccgtgcctccggctccggcacccgcgcgaccttcgaggacgccgtactcggcggcgacaaggtccccgaggacttcaagccgcaggagcaggactcctcgggcaccgtccagaagatgatcgccgagacccccaactccatcagctacctcgccttctcgtacttctccgatgacatcaagtccctcaaggtcgagggcgtcgagcccaaggacgccaacgtcgagaccaacaagtggaccatctgggcctacgagcacatgtacaccgccaagaagccggatgccgcgaccaaggcgttcatcaagtacatgctcggtgacgaggtccagggcacgctcgtcaagaagaccggctacatctcgatgaagggcatgaaggtcgagaaggacgcctccggcaaggtgaccaagctttaatgactgcaattggggagaagaccgtgtctaacaagtccgagtccacggccgaggtcgtgggcgtctcccccaagcgaggcatcgagcgcaggggccagatcatcactggcctctgcgttactcttgtcgtcgtcttggtggtgacacttatcttcatggtgtgctcgcgagggctcgccacgttcaccaaggacggaatccccctggggtccttctttggcggaactacctggaacccgcaccagaacggtgcagacggagtgcccctggtcggtgcgctgcccatgatcgtgggctcgttctccgtcacgctgctgtcctgcctgatcgcgctcccgtttgcgctcggcgcctcgatcttcgtggtcgagatcgcccccggcttcggcagcaagatcttccgtccgctcaccgaggtcctcgtcggcatcccgtccgtcgtgttcggcctcgtcggcctgggcatcatcgtcccgtggatgcgcggcctcgtcggcggcacgggctacggcatcctgtccgcgtccatcgtgctcgcgttcatgatcctgcccaccatcacgtcgctgtccaccgacgcgctcgccgcggttcccaacagctaccgcgacggctcgtacggcctgggctgcacccgctggcagaccatcgtcggcgtcgtgcttccctccgcgctgcccggcatcctcacggccatcatcatgggcatgagccgcgccttcggcgaggcgctggccgtccagatggtcatcggcaacgccgcacagatgccgcagggcctcttcacccccgcgtccacgctcacgtcggtcctgaccatgggcatgggcaacgaggcaatgggcacgctccccaacgacgtgctctgggcactggccatggtccttctcatcatgtcccttgtgttcatcctgatcgtccacctcatcggcaggaagggggccgcaaagaatgactagcgcacaggaaaccgctgtcgcgggcgagaagaacgcgcccaaccagtccatgcccaatgccgactacacggccaccgctcacaaggcccgcgtgcaggacaaggtcgccacgggcatcctcgccgccatcgtcggcgtcatcatcgtggccctcgtcgcgatcatcgtctacatcctggcgtccggcgcctccaagctcgtggacgtccacttcctgacggcaaagcccgagcagttcaaggcgggcggcggcatcggccccgagctcttcaactcgttctacctgctcgtgctcacgctgctcatctcggtccccatctcgcttggcgcggccatcttcctcacgcagtacgcgccgcagggcaggatcaccaacatcgccaagacggcaatcgagacactgtcgagccttccctccatcgtcgttggcctcttcggcatgctaaccttcgtcctcacgctgcactggggcttctccatcctctccggcgcccttgcgctcacgatgttcaacatccccatcctcgtccgcgtgatccagcaggcgctcgaggccgtcccgcgcgaccagcgcgacgccgccctggcgctcggcctcacccgctgggaggccaccatgcacgtgctcgtgccggcagccatgcccgccatcgtcacgggcgtcgtcctctctgcaggccgcgtcttcggcgaggcggcagcgctcatctacactgccggccagtccgcacccgtgctcagctggtccgctcccatctggagcctctccaacccgctgaacgtcttccgtccggccgagaccctggccgtgcacatctggaagataaactccgagggcgtcgtgcccgacctctcggcagtctccgccggcaccgcagccgtcctgatggtctgcatcctggcattcgacatcatcgcgcgtgtcgccggacgcgcgctcgagaggaagctgacggcagaatgacagacaccacgaagctcacctcgagcacggtacagaacccggtgctccacacgcacgacgtaacggtcgactactcgggcaagcgcgccctcaacgagacgagcctctcgttcgagagcggcaccgtgacggcactcatcggcccctccggctgcggcaagtccacgttcctgcgctgcatcaacctgatgaaccgcgagatcccgggctgcgtcgtcggtggcaagatcgtctaccacgacatcaacgtcaacaccaagggaatcgacaccctgtggctgcgcaagcgcgtcggcatggtgttccagcagcccaacccgttccgcaagtccatctacgagaacgtcgcgttcgccctcaagagccatggcatgaccaagaaggaagagctggacgagcgggtggagaagagcctgcgcgccgcggcgctgtgggacgaggtaaaggacaagctgcgcgactccgcctacgcgctctccggcggccagcagcagcgcctctgcatcgcccgcacgctcgcgctccagccggacgtcgtcctcatggacgagccctgctccgcgctcgaccccatcgcgaccttcgcgatcgaggagaccatctccagcatcgcgcgcaacggcatctgcgtcgtcatcgtcacgcacaacatggagcaggccacgcgcgtctccaacaagaccgcgttcttctaccttggccacatggtcgagttcggcgacaccgcgcagatcttcggcgcgccgaaggaccagcgcctcaacgactatctgaacgggaggttcggctaatggcagagagcatgtcggtcaaggacctcaacctctactacggcgaccaccaggcactcaaggacatcacgctcgacatgccggcgggaaaggtcaccgcgttcatcggtccctccggctgcggcaagtcgacgctcctgcgctgcctcaaccgcatgaacgaccgcatcgagggctgccgcgtcgagggcaccgtgaagctgggcgacacggacgtctacgagaactacgacgtctacgagctccgtcgccgcgtgggcatggtcttccagaagcccaacccgttcccgctgtccatctacgacaacgtggcgtacggtcccaggcaccacggcaagcccagcaaggcggagctcgaccagatcgtcgagaccaccctcacggacgtgggcctctgggacgaggtgaaggacaagctcgaccactcgggcctctccctctcgggcggccaggcgcagcgactctgcatcgcacgcgccctcgccgtgaacccgggcgtccttctcatggacgagcccacctccgcgctcgaccccatctcgacggggctcgttgaggagctcgccgtcaaggtcgccaaggagcacacggtcatcatcgtcacgcacaacatgcagcaggcgacgcgcatctccaccaagtgcgccttcttctacctgggagagctcgtggaggcggcgcccacggcgcagctcttctccacgccaaaggacaagaggaccgaggactacctcacgggaaggtttggataatgatcaagacgagaagtgcctacaccaagcagatcaagcaactcgacggacacgtctccgtcatcggccaggcggtcgtcgaggacatcgagaacaccgccaaggccatcggcgacggcaacaaggacgccgcgcaggagaccatcgacggccacgactccttcgagcgcctgcacaggaacgtcgaggacacctgcatgaccctcatgctcctgcagcagcccatggcgagcgacctccgcctcgtcaccgcatccttccgcgcgatcagcgacctcgcgcgcatcgacgagatggcgtacgagaccgccctcctcaccgaggagatcgacctcaccgtccccaaggagcttgccgatttgctcgtctccatggcggacaaggcagctacaatggtgaggcaggcagtggtctccttcggcaacggcgacgttgccgacgcagagaaggtcttcgaggaggacgatgccctcgacgcgctgtacgagcaggttcgcgtcaaggtgatcgagtacctcaagaacggcacggagtccgcgacggcggcgcctgagttcctttccgtcgcaaagtacttcgagcgcatgggcgaccacgcacagagcgtcgcggattggtccatcttccgcgcaaccggttcgtaccgcggccgcaccatgggggagaatgactgacgtggtctactacgtcgaggatgacacgaacatacgcgagctcacggtctacgcgctccgccaggcgggcatcgagtccgagggcttctcggacgacgccgagtttcgtgtcgcgtgcgcaaagcgcacccccgacgcagtacttctcgacatcatgctcccggacacggacgggctccagatactcaagcgtatcaggcgcacgccagggttggagaacgtcccggtcatgatgctcaccgcaaaggacacggagctcgacacggtccgcgccctcgacaacggtgccgacgactacctcgccaagcccttcggcatgatggagatggtgagtcgcgtgcgcgcgctcctgcgccgcgcgggccgctccaccacgggcgagaagaacgaggtgctctcgctggggccgctcacgctctggccaaagcgccgcgaggtgacgctcgagggagtcgagctcagcctcacccagcgcgagttcgacctgctcgagttcctcatgaggtctccgggcgaggtgttcagccgcgaggagctgctccagcgcgtctggggctgggacttcgacggtggctcccgcacggtcgacgtgcacgtccagcagctacgcgcaaagctgggcaagcactcggacctcatagagacggtccgtggcgtaggctacagggccaggggttagacaggacggggtcgcgcgcctcttggggtgcgcgacctctttcttcgccaggaatgtaaggactcaacatggcggttcccattacagaaggaaaggcaatcgcggggcaggcgccgggggagaagcgcagggcctctctcgcgaggcgaatctttgcggcggtggcgatcgtggccgtcgcgtcgtgcgtcctcgtctccgtcgcatccgccttcgtctaccagaagtccatcatcgaggatgcgcagaccggcctcggccatgagtgtgcccttgtctcgtcgatgctcaacgccaccggcaatggcagcgccggcgaggtggccgcgctcaaggagaccgagttcggcgacgtccgcgtcacgctcgccgcaaagagcggcaaggtcctctatgacagccaggtcgaggcctcgacccttcccaaccacgcctcgcgtccggagattgcccaggcgcttcgccatggcacgggcgagtccgagcgcgacagcaccaccgtcggctacctcagcgtgtaccacgccgagcgcctcgagtccggcaacgtgatcaggctctccgaggaccgcgacggcatcctgcgtgtcatcggaagcgcgctctggcccatggtcggtatcgtcgcgctcgtcgtggccgtggcgtggatcgtcgcgcagcgcttctccgacctgctcgtgaggccgattctcaagatcgacacctcctcgggcaacgcagagtcgccctaccaggagctcgacccgctcgtgtcccacctcaacgagcagcaggcggagctgcagaagcgcatgaacgacatcgtggacgcggacgccatgaggcaggagttcaccgcgaacgtgacgcacgagctcaagacccccatcgcggcgatctcgggtgcgtcggagctgctgcgcgacgggctcgtccgtcccgaggacgtccgggagttcgcgagcaggatctacggtgacgcgcagcgcctctcgagcctcgtgtcggacatcctcacactctcgaagctcgacgagtccgagcgcgtgggcgaccaggcgctctttggcgagccctcgcaggtcgacctctacaccgttgcgcaggacgtggcggaccgccttgaggagaaggccgccaaggccaacgtctcgctcagggtgcagggtgcctcggtcttcgtgaacggctacccgcgcctcctggacgagatgatccgcaacctttgcgacaacgccatccgctacaaccgcacgggcggctccgtccacgtgttcgtgctgcccgtcaacgggcatcccacggtacgcgtgagcgacaccggcgtcggcatctccaagcaggaccagtcaaaggtgttcgagcgcttctaccgcgtggacaagagcaggtcgcgcgagaccggaggcacgggcctgggactcgccatcgtcaagcacgcggcggccctccacaaggcgaccatcgacctcgagagcgagctcggccgcggcacggccatcacggtcacgttccccgccgagtcggagtagccgtcccgccgacacatcggtcgaatctgtcgtttttctcccatgcccccacgcggcgatgcgctaagagcgtgaagccgcgcgtccgatgctattcttctaaacaagaggaaaacgcgacgactgggagcgcatgcgcggggacatcgtatccatacgcgacgtgatcgcggcaaacaatatgcttgagcagcgggggagcggccttcgcgtccacatgcatgacgcgtgcggagggcagagcttctcgctgcgtggcgacgcgggcgagaagggcacggatgtcgacaggcaggcagtgctcgactgcatgcgctcgctcggccacacgatggagtttgccgaggacggcgtcaacttctgggtggctcgcgcatgagcgccggaggcgacgtgacgggcgagaagagcgagggcctcgtacagaaggtcaagggcatgctgagcgagcgcttcacgaagttcgtggggtcgtcgctcatcagcacgctcgtggaccaggtcatggccttcctgctctttgggtggctgcgccccgtctttg

SEQ ID NO: 243 - DNA, 1102 bp, Unknown
  Metagenome-assembled genome
gctaccgcactgaggggcgattagctcaggggtagagcacttccttcacacggaaggggtcgctggttcaaatccagcatcgcccaccataagagattgcaggccggacggtttccgttcggccttttttggcagtcggctgccatccggctttgggagcagaccgcgatccgcttacgactgaccctgcacacaagagttcgcccccgcgatcaaagtgaccgcgggggcgactggctttcgcgaactatgtgtgggcgatggggctgtccttctcgaccgacgaatgtaagcgaaagggctactttgcctcgaggatcgtttcaaccttcttggcgagcatgaagaccagaagcgccatgacgacgcaggcggagcccacgaagatctcggccagggacttctgcggggccaccaggatgtacgccgcgcagaagaacatcacgagcaccatgaccgaactgagccgcttgatgtggttcgcgttcgaggggacgttgatctggcgcgcgcagtggaagcccatgtaggtgcagagcacgccgtcgagcaggcccacgtaggcgcgggggttcatgtggttgaccacgatgagcgcaatcgagcaaacggtggccagaaggcccaccacgagggatacgatgcagacgatcttgagcttcttgcacgcgtcgttcattttgttctccgttcggttttggggtgtggcggcgtggtggcgccaggggagtaccacccgacttggtaggtgcacacttgttgggttcccatataggaagcagtgtagcggtttgtgaaggaatttcacaactgatgcgcggtggcggggaagtcaaaatttccgcttgaccgggatggtgactttggtaatatatccctcgcaccaacgaacggggaattagctcagttgggagagcgcatgactggcagtcatgaggtcaggggttcgaatcccctattctccaccatgtaattaagggggcggcggcttaggtcgccgcccttctcgttaggggcccatggcgcaacggttagcgcaggggactcataatccctgggttgggagttcgaatctctctgggcccaccaagcatccgggacc

SEQ ID NO: 244 - DNA, 3603 bp, Unknown
  Metagenome-assembled genome
agcagcacgacgcggtccggctgctcggcgtcgatggcgtccatgaggcgcgagcaccaggaggccgcgccgtggatgtcggatgcgatgaggagcttcatgatcttcttgccctccaaaagtttttgggccgggttggcccttgcacgtgcatgtgaccgatggtcgcacgagtgggacgggaaggtcaaatggcaccgtctacgtgcacaaacgcaaagatttctgtgggatttggcagggtgccccggggcgtgggcaaccctataatgcggatttcaaaaaatctaatgtatgaagacttagattatgtatagaatcgaagcgcatgggaacaatgagaaatgtacaacgcagaacataggaccctcggccccgaaagcgacctggggaagaacagaaaggaacaacaccatggcaaagattcttggcatcgaccttggtactacaaactctgcaatggccgtcctcgagggtggcaagcccaccatcatcgtgaactccgagggtgaccgcaccactccgtccgtcgtgggcttccgtcccgacggcgaccgtatcgttggcaaggccgcaaagaaccaggccgtcaccaacccgcagaacaccgtcttctccatcaagcgcttcatgggccgtcgctacgacgaggtcggctccgagctcaagaccgtcccgtacaaggtcaagagcggcaccggcaaccgcgccgtcgtcgagatcgatggccaggactacacgcccgagcagatttccgcaatgatcctctccaagatgaagcaggacgccgagaagtacctgggcgagaccgtgaccgacgcggtcatcaccgtcccggcctacttcaacgacgcccagcgccaggccaccaaggacgccggcaagatcgctggcctcaacgtcaagcgtatcgtgaacgagccgacggccgcggcactcgcctatggcctggacaagaagggcatcgaccagaaggtcctcgtgttcgacctgggcggcggcaccttcgacgtgtccctgcttgacctggccgacggcgtcgtcgaggtcctcgcgaccaacggcgacaaccacctgggcggcgacgactgggaccagaaggtcatcgactggatggccgacaagttccagcaggagaacggcatcgacctgcgcaaggacccgatggcgctgcagcgtctgaaggaggccgcggagaacgccaagaaggagctctcgagcgcgcagcaggccgacatcaacctgccgttcatcaccgcagacgcgaccggcccgaagcacctgaactacacgctgacccgtgcggagttcgagcgcatcacccgcgatcttctcgaccgctgcaaggcgcctgtgaccaaggcgctgcgcgacgccaacctgcagatctccgacgtgaacgaggtcatcctcgtcggcggctccagccgtatgcccgccgtgcaggagctcgtcaagcagatgaccggcaagcagccgaacatgtccgtgaacccggacgaggtcgtcgctgacggcgcggccgtccagggcggcgtgctcaccggcgacgtcgagggcatcctgctgctggacgtcaccccgctttcccttggcgtcgagaccatgggcggcgtgatgaccaagatgatcgaccgcaacacgaccatcccgacctccaagaccgagatctactccacggccgccgacaaccagacgtccgtcgagatcaacgtcctgcagggcgagcgtgagatggccgccgacaacaagagcctgggcaagttccagctcaccggcatccccgcggcgcgccgtggcgtgcctcagatcgaggtcacgttcgacatcgacgccaacggcatcgtcaaggtaaccgcaaaggacaaggccaccggcaagtcgcagcagatcacgatcagcggctccaccgcactgtccgacgccgaggtcgaccgcatggtgaaggacgcagagtcccacgccgaggaggacaagaagcacaaggacgagatcgagatccgcaaccagaccgactccctcgcctacagcaccgagcagacgctgaaggacctgggcgacaaggttcccgccgacatgaagaagcaggtcgaggacgccgttgccgaggccaggaaggcgcttgacggccaggacatcgacgcgatcaagtccgctggcgacaagctgcaggaggttggccacaagctggccgagattgtctacagcgacaccaacgcgcagaccgcgaccggcgcgggcgccggtgcggcgcagccgaccggtgacacggacgacgtggtcgacgccgactacgaggtcgtggacgacgacaagaaggacaacaagtaggcgctagcgagctagtacctgccaagcagaacgtacctgggggcggtcgagaggccgcccctcagagggataacgaatgagggtgacgtgaaggtgccagtcgaggacgcagaagagaagaacaaggccaccaaggccgaggacaagccggctaccgataaggcggaggagctcgaccccgaggaggaggccgctcgcgtcgaggcggcgaagcgcgctggcgaggccgctgcggacgaggacttcaaggcgagcgcggacaagatgcgcgagcagcgcgacgacctgcagaagcagctcgatgccgccaccgacgaggtggagaaggccaagaagcaggccgcggacgcatccgaccgtctcgtgcgccttcaggccgactgggacaactatcgcaggcgcaccgcacaggagcgcctcgacgagcgcgagcgcgccgccgagaagctcgtggtgaacctgctccccgtgctggacgacatggagcgcgcctcggagcacgcgagcaagaccgccggtgacgacgagaacctgaagcagttcgtggacggcgtcaacgcagtgcacgacaagatgctctcggtcctggccaaggacggtgtcgaggtcatcgaccccgtgggcgagccgttcgacccgctggtccaccaggcggtcggccgcgaggagaacaaggacgcctacgacgagaccgtggcccaggtgtaccagaagggctactccatgggcggcaaggtcatccgcaacgccatggtcacggtgacgtacggcggtcccaagcgccccgcccccaagcaggaggacgactccaagcccaaggacagcgcgaaggacgcgacggaccccggcaagagcggggacgcaaagtaggtttgacgacgcgcccgggccccttcggttcgggcgcgactatatggaaggaggcgttagcctcgcatgacggacaagaggaactactacgacatcctcggcgtgaagcgcgacgccaacgccgaggagatcaggaaggccttccgcaagcttgccgtgaagtaccatccggacgcgggcggcgacgcccagaagttcaaggagataagcgaggcgtacaccacgctgtctgacccccagaagcgcaaggagtacgaccagctgctgatgttcggcgggatccccggctccgactttggcgggtccggcgggaggaaccgcacctacacgtacaccacgagcggcaacggcgccgactggtccgagatattcgacaacatccggagcggcgacggcgcgttt

SEQ ID NO: 245 - DNA, 3240 bp, Unknown
  Metagenome-assembled genome
tacttctcgggaatcaaccagagggcggcatagggaagggcaagaacagctaagctgggaacaccatcaggcaagggctttcggtagaaaacgctaattcgtgtcgaacagactcagccagttcagtgtaatgcgccatcctgccccagcgcaaaagaggccgttctgaatccggaatccttgatgatgccctaatgtcgtctttctcccgtctgcatgccctagtgacatctcggaggggagaatgctgcagcattacactgaggtacaactaccacagcgtactaagattcatatttatttctgcgtcttccattagcgacctattgatttcaatggtatggtccgcaggaatttcatctggctcaatcgaggcaacgattatctgccagccctcaaattgattcttgagaaggtgcatgtacttggcgaagttttccctgttgagctctccgcttctgggagagtcgataataagtggcaaacggagatagcagtatttctctatcgcctttgcataggcaagccgaaaagcaaagaccaacccctggtaatacgagccactcttgttcttcaagttgttcgtaagcgggccatgcgtatctttggagtatgcctcatatattccaaggcgttctgtgaaatctctaatagtgtcggctatgaatctgtaaggttcacaaatggtgacctggcttgctatcgattttttaacggccttcttttgttttgcaagctccttctcacccttctcaagggtgcctgaatcgattttcagtccagcaattcttctatctattacatcgagatcacttcctggtgagaatagtctgccgtcattgtttagcgcaatttggatggcatcaatctggcgctccgtctctttgagattggatttgaggacggacacttgcgcctcaagatatttttcttggtcttcaaatcccactagattttcgcgatttactgggatttctcggcttccatctttaattcgcaacttgagatgctcgatatattccgcgaaccgcttattatccttttgtacggccttcattgcattgatgcgttttttgagatatgaggcgtgcataagaagctgctgctgtctcgagaaatcgcgattggaatcttctgatggtattggttgtgtctcattttcaaggacatctctttgatacccagccgctcctagtgcaaatttatatcgcttggtctcctgctcaattttctttatctctgctctttcgttagctaagtccagcccagcaagaccactgacaaaatcctcgatattaaaactgatatttgcaatagcttttcccctgttgagcaaggtccagcctttatcttgatcgatatagcatgcgccaagcaggttgtctgaaacgagtcgattcgagatgccccaaattttagacttcgcttcgtaaagctctagaggcaaaacataactaaccacatctctgctgtctccatctcgcaacctaagggtatttgcagttcttagcagtttgacctgtgagctatcgctgtggaggtcgaggtaaaactctttctttgcgctctgaaaatcgaaagattgcgttccgggaacattctcgcccatagcaaagagaagggcgcgaatgagagtcgtcttgccgacctgattcgctccattgctggtaatcaagttaaatccattgctgaatacgaaagttttcgtagacattccatcgcggattgtcagcttgtcaattatcaagattgaccttctccttaatctctgcaattactccccgattcgcgataattttctttacaacaagagctgtaatgcagttagcttcatctgtatccaactcatctgctccaattagagatcggtactggtcgatatttttcgcagtaaagtcttctcgcagctgtttagaaacaccgtgatggtcatgcttatattgatcaaagtcacttaatacctgcgagataatatcgtaccgttcagtagtctcgccaattatctgtccataacgctctatgacatcctgtactacttcatcgtcgtatgtatcaaagaacttgtcgtttggatttacttctgtcagcaggacgatgagtggccaaatcaactctgacttgcttactgcaacatctgttttcagtgtggcggcgttactggtgaggacatctgtccatagtgagtaaagctttgctgagtacttgctaactgactgcgggtctattgcagctaagaaattttcgatagcgcgtattgtggctttcgtcctagttgaggcatctttgccgtagaaccacatgacatagatggcaaggtgattctccaaagtggctattagagaatcggcatcactttcaccgttgagtagttcatgaagtttggcggtgatgtatttttgctggtcgggtgacagctcactgaatgtcagaaaactatcatagtcaaacttaatgtcattgtgtgatttcccgagagggaatacgtcattagtgacatagatggcattcagacagttcttctgttgagcatcttttgcaagtgtgtgaagagcgtctttgaaacgctgtggagagccctttcctggttcattggtcgtgcgtgcttttgcttgggcgtaatcaacatgcttatcggtgtagtagatttcgatgtcgtcggttgctccctccacccttatcgagtctatgtctttgatgtcgcgaagcattagaacgagtgcggcatgagtttggaactgccagccaaaggctgaactcgaagcatttgtatttgatgggatacccatgtcgctctccgcagccttgctgcattgtcacgaaagctgaagttagcaacggatgatattcattgcttaccacacaatcaattgcccaatgcagatagttatatcgagtagtgaagcgccttccgtgcaggcaaatacctgcccgaagctcattgcattcttacagtgcacaatccagtgctaaggagtgttcctccggagatacctccctctcttggttgaatcttatctcgcagtgaactggctgagtctgttcgacacgaattagcgttttctaccgaaagcccttgcctgatggtgttcccagcttagctgttcttgccctttcctatgccgccctctggttgattcccgagaagtaccagctcgccggggtctcgtatcccagcgactggtggatgcggcggttgttgtagtagcccacgaactccgagaccagccgctcgagctccct

SEQ ID NO: 246 - DNA, 1011 bp, Unknown
  Metagenome-assembled genome
cctattggtcgagggggaacttgctcccccgcacctgtccaacgttctgaattctacccagaacgaaattcttataccacacaagagaaaaaatcttcctacagacacttagattttctcgcacaagtcaacgcatggtagccggtagtcgcgccccggcatccccacgcgggcgagaagaacctcccccggccccagaccgggaccaggggaggccagccaaagccagttgtgacggggcaagacgtgcccgcgggcgccccggaacctacaaccccccgagctccctcagccagagcgcggagcaggcgtcggagggcatgcgcaggtcgccgcggggcgacacggccgccgagcccaccttgggcccgtccggcaggcagctgcgcttgaactgctgcgagaagaagcgccggtagaacgtgcgcagccacttgacgatcgtggcgtcgtcgtaggagtcgcccagcgcgtggcgcgccagccgcagcaccttgcgcggggcaaagccgcggcgcagcacctggtacaggaagaagtcgtgcaactcgtaggggcccaccaggtcctccgtgcgctgcgcgatggtgccgtcctcctccgccggcagcagctccggggacacgggcgtgtccagcacgtccagaagcacctcggaaagcgcgtcggagtccgtcgtgtcggccacgtagcgcaccaggtgccgcacgagcgtcttgggcacggaggcgttcacgccgtacatgctcatgtggtccgcgttgtacgtggcccagcccagcgccagctcggacaggtcgcccgtgcccaccacgaggccgccctcctggttggcgacgtccatcaggatctgcgtgcgctcgcgggcctgggcgttctcgtaggtgacggagtggtccttctcgtcatgccctatgtccgcgaagtgctggcgcacggccttggtgatgctcacctcgcgcagggtggcgcccagcgcatcggccagcacctcggagttgccgtgcgtgc

SEQ ID NO: 247 - DNA, 1143 bp, Unknown
  Metagenome-assembled genome
tgaaaacgtgataaagtagatgtacccaaagtaatcactccctatattggttggaattagctactaccattgtaagtgattgctttgggctttttaatttctgttcggattaattatagaatttgccgaataaaatttatttccgtaaaaattatcctgtcacctaccatagtgggcgcaggcgctggttggattggcactcttattttaaagttactacttggataagggactctaagcagtttcttcaccacgttacaaccggtcttgatgagtatcctaataacttgtatgtttgctgtgctaattattacaccgatttccaccgtggccatcggcatggcaattcaattgaacggtgtctttgttgatactgccgccataggtgtggctgtgattaccattgtgttgacaattcattctttgaaaaccgataaatctggtgtcactattgctgtggcgttgggttccatgaaattgatgattcctaatcccttctgtcacccaatcattctactactgactttgactactggtattacttattctgttccagtcgccttgttctacgttatcggcatttcagcctccaccggctttgggctagtcggattggtaaggtatttagcttcgattaacgcgagctagagtccagcgactgtcttaatggtgtggttcatcgttccgattattgtcggatagatctcatcgttggtgtatgagaaaaagctgcatctttatgatgaaaggaagtttttgcttacttaagcgactaatcctctttcggaaaaagtgctagattgcaatctagggttgatcatgcatcaactgtatcttaggccgcttgactaaggtaatattagttacgatgcttgtccttctttttaaatgtcatgttatgcaaacacccttttaacaagaaaggacaggcttttttgtcttgagggtggtaacattaaatatgtaatctcgtctgtaataattagaattggaatgcttagaaaaagggagtggcaatgatgaaaaagaactggcaactaatgatggtgcttgctgtaagtgccattgcgctagtctttgctttcgttttaaagcaaccactgatcgcgcaagggctgatcacggtgatggggtcaatcattg

SEQ ID NO: 248 - DNA, 17914 bp, Unknown
  Metagenome-assembled genome
gccttgagcttgtcgtcaatcaccacgcgaccctcgacctcgtggtcgtacagcgcgtccacgacctcgcgcatgttcacgatggaggccacggggaagccgtacttctcctggatctcctgctgtgcggttacctttccgcccttgccgacctccatgcggttgagcgagaccatcagccccacaacgttcacgtccgcggctgccttgagcttgggatacgtctcgtcgatggacttgccggacgtggtcacgtcctccacgatcaccacgcggtcgccgtcgtgaaggtccgcgcccagaagctggcccttgtctgcgccgtggtccttgacctccttgcggtcgctgcagtagcggacctccttgccgtacagctcgtggtaggcaatcgccgtcacgacggaaagggggatgcccttgtacgcgggcccaaacacgatgtcaaagtcgtcgccaaagttatcgtggatggcctgcgcgtagaacttgcccaggcggctcagctgctcgccggtcacgtacgcgcccgcgttcatgaagaacggagacttgcgcccgctcttgagcgtgaagtcgccaaacttcagcacgtcgctctgaaccatgaactcgatgaactcctgcttgtaggcctccatggccctccttccgtcgtcaggtcgcgtcccatggtagcgcagcgaggccccgcgggcacgccaagccacgcgcaaggttcgaccaaaaggcgcccggccaataagaccgcttgggcgagaagaacggcccaaccaaaagggtcccggccgcttgtgcggtcgggacccagcttcaagccatgcgatgtggcggggaagcgagcgctgcctgctactcgtccttgccaaggagcaccttggtcatgtccgcggcggccttcttgccggcgcccatggccaggatgacggtagcggcaccggtcacgatgtcgccgccggcccagatcttggggttggaggtgcggccggtctcctcgtcagccacgatgtagccccacttgttcagctccatgccgccgatctttttggcgaaggggttggcgttggtgccgatggcggaaatcgcgacatcgcaggggatctcctcgacggcgccctcgatgggcacggggcgacggcggccggaggcgtccggctcgccgagcttcatgtcctggaccttgacggcgcacacggcaccgtcctcgcccgcgatgaactcgagcggcgagaccagctcgtgaatcttgacgccctctgccttggcgtgcaggacctctgcgcgacgtgcgggcatctcggcctcggtgcggcggtagcagagggtgacctcgtcggcgccaaggcgcagcgcggtgcggacggagtccattgccacgttgccgccgccaaagaccacgacgtgctttccgtgcttggtgggggtgtcgtactgcgggaacttgttggccttcatgaggttcacgcgcgtgaggtactcgttcgcgaagaacacgttggggaggttctcgcccgggatgttgagcagcttggggaggccggcgccagttgccacgtagatggcgtcgaagcccttctcgcccagaagctcctcggagttggcgaggttgcccatgacggagttgaactggaacttgacgcccagctccttgaggccgtcgatctcgcgcttgacgaccgtcttgggcagacggaactcggggatgccgtacacgagcacgccgccgccggtgaagaacgcctcgaacacggtgacgtcaaagccgttgcgcgcgagctcaccggcgcaggtgatgccggacgggccggagccgatgacggcgaccttcttgccgttcttgggggcgagcttgggcttgctcgcgagctcgggctggtcgcccaggaagcgctcgagctggccgatggcgaccggctggctcttgacgccacggatgcacttgccctcgcactgggtctcctgcgggcagacgcggccgcagatggcgggcagcatggactgctcgtggatgatgtcgaggccctcgccaaacttgtgctcgtagatcttctcgatgaacgcggggatgttgatgttgacggggcagccctgcacgcacagcggcttcttgcacctcatgcagcgcgcggcctcggccacggccatctcctccgtgaagcccttgtcgacgggacggaagtcatgggcgcgctcggcggcgggctcctcgttgtccggagtgcgcggagccttcatgtccgcgatccagcgaccgtttacctctggcatgcgcagttcgcctcctcataggccttgagggcctggccctcctcggtacggtatgcagcctgacgtgcgcgaaggtcgttccagtcgaccttggtcgcgtcaaagtccgggccgtcgacgcaggcgaacttggtctctccgccaacctcgacgcggcagcagccgcacatgcccgtgccgtcgaccatgatggggttgagcgacgcggtgatgggggtaccgtacttctcggccgtgagggacgagaacttcatcatcggcacggggccgacgcagaagacctggtcgacggcctttgcctggagcaggcgctccagcggggcagtgaccacgcccttctcgccataggagccgtcgtccgtggtgatgtggatgtggtcctccggcagcaggctgcggaactgctcctcgagcagcagcaggtccttggtgcgggcgcccatgatggcgtgcacctcgtggccggtcgcgacgagctggcgcgcgacggggtacgcgatggcgaggcccacgccgccgccgatgacgcaccaggcgcccttgccgctcatgtccgtcggctggcccaggggaccggtgaggtcctcgatctcgtcgccggcctcgtacttagagagcatctccgtggtcttgccgaccaccatgaagatgaactcgacccagccctcctcggcgttccagtccgcgaaggtgaacggcacgcgctcgccggtctcgttggcgcgaaccatgaggaactggcccgcatgcgcatgcttggccatctcgggcgcctctacgcgaaactcgaacaccttctcggagaactgcgtcttttcgaggatcttgtacattaacgaactcctctcctgaagccccatcctcgggcgcgccccgcagacgcggacgcgccggcataacgaacaaagtatacagcgatgaaattgggcgagaagggcaatgccatccggctgttcccaagtttgggtgtgcgcccatgtgcggcccctagccgttggctgcggcctgcaccccgcgctcgacgacgcgctccgcaagcgatgccgcatcctgcgcctcgagctcgaactcctgcaggtagttgcccttgagcgtgcgcagcacgtagtcggccacctgcatctttcccggcgggcggccaatgccaaagcgcagccgggcaaagtcacgcgtgcccagtttgttggcgatggagcgcaggccgttgtgcgcgttgaggccgccgccaaacttgacgtcgacggccccggcggggcggtccacctcgtcgtggatgacgagcacctcctgcggcgtggccttttcttggcgcaggagcttggaaagcgggccgccgctcgtgttcatgaagtcctgcggtttggccaggatgacctcgcgcgtcccttcgggcgcgcgcatccgcacgcgggcaaccatgcagcccgcctcgctcttccagtagcgggcgccgtggcgctccgcgagcgtgtccacggtggcgaagcccgcgttgtgccgcgtggcggcgtagtccgcccccggatttcccagcccgcagatgatgcggacgtcctttggtcgtgcctgctgggccatggtccctccgtctagccttggatcttcctaaggtggtcagccagatacggtaccgcaaagcgcacgtacccgcgtccggcggcctcgatgacccccgccgtctaatttgggtttgggtgccgcccctacgcctgcggccccacgtacctggacgagccaaagcccagcacgagcgtggccacgttgggaaagaacagcagcacgagcgccatgcctatgccgtgcccaaatgcgagcgacgtcttgtacagcatcacgagccccaccaccgcgatggcgcagtacaggagcgccaccagcacgccgagcatggggtagtcgaccggggcgctggtgccggcaaacgccccagcaaacgccgccatcacaatgagcgcccagaacggcgccgtgccccagcaaatcttgaacgagatgtaggtggagtacacggggatgatcgacttccacccggcttccccggccttctgaaacatcctccaccgcgcaatcaccagcagcgcccatacgatgatcccaaggaacgcgatcgtggttgcgtagagcgaaaacagcgcgatgagtccggccaaggcgaccccacccttcgtggttcggcgagaagaccgtgcgcccgtggacggacgcacgctcctagcataaggcccgcgcggagccgagggggctgccgcgcgggccgggggttcttctcgccccgtggacggggcttgcgtgttgcgccgcgagcgccggggcttcgcgggcgtgggactacatctcggagttgccgcccgcgaggccgctcacggagtagttggcgtacaccgcgaagatcgcgtcggccatctccttggccacggagatctgcttgatcttggagccctcggtgttggcgatggcgcacgggatggagtccgtcacgacgcactcctcgatcggcgcgtcctcgagcagctggatggcctgcttgctgaagatgccgtgcgtggcgctgatgtagatgtcgcccgcgcccatctccttgagcttgcggatggagcccacgagggtgccgcccgtgtcgatcatgtcgtcgttcacgatgcaggtcttgcccttgatgttgccgatgatgcccatgacctcggccgcgttgtgcttcgggcggctcttgtgggcgatggcgacctcgcagcccaggtagtcggacagcttcttggccaccttggcgcggcccatgtcggggctgacgactacggtgttgttgaggtcgaagttcttggccttgaagtagtcgccaaactggtacagcgcggtgaggtgcgtgaccgggatgtcgaagaagccctggatctggttggagtgcaggtcgagcgtgatcacgcggtcgacgccggcggcctcgagcaggttggcgaccaggcgcgcggtgatcggctcgcgcgaggcggccttgcggtcctggcgagcgtaggcgtagtgggggatgacggccgtgaagctcgccgcggaggcgcgcgtggcggcgtcggccacgatcagggtctccatcaggaggtcgttcacgttctggccggcgatggactgcacgaagaacacctcgcagccgcgcacggtctcctcgaagcgggcgtagatctcgccgttggcgaacttggtgatcttgagtccggagagctcgaggtgcagcacgttcgcgatgcgctgggccagcgccgggttgccggtgcccgtgtaaaggcggatgttcttctcgacgttaaggggcttgctaaggtcctcgtacattgtgagctagtcctctctttccagacggtcccagtaccggtctgcccaaccctcgatcacggtctgcttggaacgctccagcgcgagggcacccgcgggaacgtccttggtgatgcacgagctcgcgcccacgagcgcgttgtcgcctatggtgacgggagccaccatcatggtgtcggagcccacgaagacgtggtcgccgatctcggtgtggctcttgtgcttgccgtcgtagttgcaggtgatggacccgccgccaatgttgacgcccttgcccaggcgcgcgtcgccaatgtagctcaggtgcgggaccttggagccctcgccgacctccgagcccttgatctcgacgtgcgtgccggccttggagcccttgtggaagtgcgcgccgccgcgcaggtacgcgcgcggcccgcagttgacgtcgtcgtcgatggtggagtccacgatcacggtctcgtccaccgtgcagccattgcccacggtcgcgttgaccaggcggctgttggggccgacggtgcaggcctcgcccaccgtggtcgtgccccagacgatggtttgggggagaaggacggtgtccatcccgatcgtggcctccggcccgacccacacctgctccgggtcgagcatggacacgccggagcgcatgagcccctcgttgatgcggcgctgcatgatcttggtgacctgtgccagctggacgcggtcgttcacgcccaggagctcccggtagtcgtcgcagtggacggccgtcacgggctcgcccatgcccacgtagaggcccaccatgtccgtgaggtagtactcgccctgcacgttgtcgttggtgagcttgtcgatgttcgccgtcaggcgcttgccgcagaagcagtacgcgccggcgttgcactccagcagcgtcttgcgctgctcgggcgtgcagtccttgtgctcgatgatggccttgacttggcccgactcgtccatctggacgcggccgtagcccgtggcgtccggcggcgtcatggtgagcacggtgcaggcgtcgtggttctcgcgcgtgcgcgccacgagcgcgctcacggtctccgggcgcacgagcggcaggtcgccgttgagcacgacgacggggccgtcaaagccgcccagggcgtcgcgaaccacgcgcacggcgtgaccggtgccaaggcgctcgcgctgctccacgaactccacgtccttctcgcccgcaaagtacgcgcggacctcatcggagccgtttcccaccacgacgacgatgcgctccacctcggccttgcgcgccgcgttgacaacccaccacacgagcggcttgtctagcaccttgtgcatcaccttggggtggtgcgacttcatgcgcgttccctcgccggcggcgaggacgatcgcggttaccggcatgtgttgcctccagcgtttgggtccagcaggcggcacccagcgacggcacgcactctagctggactgttacacgaccctcacatgatagcgcgcgccgcgcggccgtgggcgccgctggcgtttggggacgagaaacacaagatgcggcgcggaaagcggctcgggtcgcgcgcggcggccggccgcggcacaaaaagagccggaggccccgtgcgggacccccggcgatgtcgcgttggctggggtagtaggattcgaacccacattccaggcaccaaaaacccgtgtcctaacccttggacgataccccaatgcagtcgctgcgttgggcgtcgcggcacgtcgccgcgggtgcgccagcctcgcgcccacaaagtgtaccagatgggcggccgcgtccgcgcggcgtggccctcctgggacgattgctacaggttgaacgcggagcagatggcatcgagcagcatgaccgcgaacgtctgcgcgtcgctcgtggtgaacgtgccgtcgtaggccaggccgtgcggcagctccaggcgcacgacgggcggcctcacgccgttggcgtgcgcgctctccaccgtggtgcgcaggcgcagcggcaggctctcgatctcctcggtggagaggttcgcgagcttgctgccttcgggcaggtccgtcgtgccgagcacgatgaccacgtcgtcgtccgggcgcgaggcgtccacgctctccacgatgcccaggccgctcttgtccgtggtggccgtggccaggttccagatgcggcccgcgacgttgcggctgatggggtcctcggccgtgagcgagatctgcgtgtgctccagcacgccggccgcgcgcgcgaagcccatgccgcccatggggtgggggccgtccgcgggcttgcccgcccacacgtggtgcaggcgctcgatggcgtcaaacgtgtccgggaaggccatgccgtctgccagcatgccctggctctcctggaactccttcacggcggcctcggtgtagacgccgtagcagccgtcgggcttgccgcacgagaagcccaggatgttcaggcacttctgcagctcgagcacgtcgttgccgtgcaggttgggaaggcgcaggtacagcgtgcggtcgcccatcttgtagccggcgtccaccagcgcggaccacgtggcgctgtcgacctcggtgcccagggggatgtcctggtccatcctgaagcgcccgacggcgtttgcggtcgtggggccaaagctcttctcgcccagctcgtgctcgtcgatcttgtagcccagggacgtcagacgctcctggatgtcctcaacagcggcgcccgaagcgccctctcggattggttccatgtgctctcccgttttcgcggcgcctaacccaggcgctcaacaaagaagtctgccatagagaggagcgttctgcccgcttctggcaaaaagtccgcagacgcgaggtgagacttcgcctcgtcggcaagccggcgcgcgtaggcgcgggtgtggtcgatggcgccggactcgcccatgagctcgacggcgcgtgccagcgtggcctcgtccgtcgcgttggacgagaggatcgtgcgcagctcggccgcgggcccctcctcaaggtgcgtgagcgcccagaccgcgaggagcgtgcgcttgccctccgtgatgtcgctccggaagtccttgccctggcgggccgggtcgcccacgaggttgagcaggtcgtcctggagctggaaggcgaggcccgcgctcatgccaaacgagcgcagggcctccacctgggcgtccgagccgccgccgcagatggcgcccgcggccagcggcacggccgcgctgtagtaggccgtcttgtggctggccatgtacaggtagtcgtccacggagatgtcccagcggccgtcgcgcgcccagccaaggtcgagcgcctggccctcgagcgtgcgctcctccatggccgtgacctcgcgcagcacgcggagcttggtggcgtccgcgagcgaggcgtcgtccaggatctggcgcgtgaccgtggtgagcgcgaggtcgcccacgttgatggccacgcccacgccctccgtcacgtgcacgcagggctcgccgcggcgcagttcgctcctgtccgcgatgtcgtcgtgcacgagggccgcggactggaagttctcgatggccgtggccacgctgagcgcgtcggtcgcgctgccgcccacggcctcggcgcccagcaggcagagcgccgggcgtgtgcgcttgccgcccgacgccgtgaagtgctccagcggcccgtacaggtagcggtcgagctcggcgcgcatctgcggggccgtctggggcagggcgcgcgggctcttctcgcccagtgcgtcctctatgagttggtgacgtgaggcaaggtagtccgcgaagaggctccccgcggacctaccgttgggcgacgtggtcgccatggctagtcctcgaagccgttggggttcttggactgccagttccaggagtcgcggcacatgtcgtcgatggtgtacttggcctcccagcccatctcgcgcttggccttggagcagtcggcgtagttggcgtcgacgtcgcccgggcggcgcgggtcgatctggtaggggatcttcttgccgcaggccttgccaaaggcctcgatgatctgcaggacgctcgtgcccttgccggtgcccaggttgaagatctcgacgccggtgcggccgttcatccacttgagtgccgccgcgtggccggtgcccaggtcgcacacgtggatgtagtcgcgcacgcccgtgccgtcgggcgtgttgtagtcgttgccaaagacgtgcacgcactcgcgcttgccgatggccacctgcgccacgtagggcagcaggttgttggggatgcccttggggtcctcgcccatgagtccggaggggtgcgcgccgatggggttgaagtagcggagaaggacgacgttccactccgggtcggcggtgtggaggtcggtcaggatctgctcgatcatccacttggtccagccgtacgggttggtcgcgggcttcttgggcgactcctccgtgagcggcaggctgtcgggcgcgccgtagaccgtggcggagctggagaagatgatgtccttgcagccgtggttgcgcatcacgtccacgagcgtgagcgtgttgcccaggttgttggagtagtactcgatgggcttgctgacggactcgcccacggctttgaagccggcgaagtggatgacgcggtcgatgtcgttctggtcgaagatggcctccatggcctcgcggtcgttcacgtccgccttgtagaacgtgaggttctgggccgcctcctcgcccacgatctggtcgatgcggtccacgaccttctcgctcgcgttggacaggtcgtccacgatgacgacctggtagccgtcctgcagaagctcgaccacggtgtggctgccgatgaagcccgcgccgccggtgacgagcacgcaggtgtccttcgggtccttcttctggctcatgtgagtctccttgcctgatgttggttgcaggtgccgcgcgcggccggggccgctggcggcgacgtacatacgccacaaagtatagcgcccgagcgtgtgcgggctgtggccaggtgcgggccggcggtcgcctgcgctatcatgtgcgcgattccacaggcagggcgccgcgtggccggcgccgcgatcgggcgggaggcgcacccatgagcaagccgagggccggcgtggaggaggactccctctggcagaggtggctgtcgtgggcctccgcctggtcggacgcccccttgccgcggcgcgtgcccgcggaggcggccgtgctcgcggccagcctcgcgctcgcgacgctcgtcggcgtcgcgctcgaccgcctgggcctcggcgcggacgcgatcgtgatcgtgtacgtgctgtccgtgcagctcgtctcgctcgtcacggtgagtcacgtgacctgcggcgtcgccacggccgcctcggtcgcgctcttctgctacttcttcacggagccgcgctaccacctcgtggcgcggggcagccagtaccccgggacgttcgcggtcatgtgcgtggttgcggtcgcgtcgagcctgatcgcgatgcgcctgcgccagaacgcgcgcgacagccgcgcggcaagccacatgatgcacgtgctcctgcagaccaaccacgcgctgcagcgctgcgactccgtccaggccgtcgtgggcgaggccggccgacagctcgcgcgcctggtcagcggcaccgtcgtgctgtacctgcctaatgccgccggcatgctcgagcccggcgcgctcttcctgcgcgacgggagcgacgccccggtgcccgatgcgggcgcgctcgacggcacgggcgtgatcgccggcccgcgcgcgacacgccagcccaacgtccccatcgaggccgcggtcgccatgcgcgcgtatgagaacgacgcgccagccggcagcggcaccgcgctcttctcgtcctcggcggggctctacctcccggtgggtgagaaggacaagccccttggcgtgttcgcggtgctgggccagggtgggccgctctccgcgggggagcgcgacatggcccgcgccgtggcgggcgagacgagcctcgccctcggccgcgagctcgccgcccagaggcgcgagcaggccatggtcctcgccaagaacgagcagctgcgcgccaacctgctgaggtccatctcgcacgacctgcgcacgccgctgacctcgatctccggcgcggcggagatgctgctcgaggcggacgccccggtcccaaccgcgagcccggccccgcagcccggctctaacccagcggcccccgcccccgcgcccctcgcgccggagcgccgccgcgagctcgagcgctccatccgcgacgacgcgcgttggcttaacgccacggtcgagaacctgctcgcgatcacgcgcctcacgagccagggagtccacctggaccgcacgcccgagctgatggacgacgtggtcgaggaggccctgcgccacgtggaccccaaagcgtccgagcacgtcgtcgcgacggagccctcgcgcggcctctgcctcgtgagcgtggacgcgcgcctcatggtccaggtgctggtcaacctcgtgaacaacgccgtcaagtacacgccgaccggaagccacatcacgattcgcgtcgagcgccacgccgcgccggccgcggacgacgcgggcgagaaggacgttgtcaccacgagcgtgaccgacgacgggcccggcatcgcccccgaggaccgcgggcgcgtgttcgacacgttctatactgtgggccacgggctcgcggacggccgacgcagctttgggctggggctatcgctctgcaagtccatcgtcgaggcgcatggtggtaccatccgcctcgagccaaacgagggcgacggccacggctgcgtgttcagcttcgacctgcccgcatgcgacctgccgggaggggacggaccagatgagtgacgacgcggcacaggccggcgcggtgcaaaccggcgcggcgcaagccggcgcggcaccagtgcccgccccgaacatcctcgtggtggaggacgaccccgaggtccgcggcatcatcctggccgcgctcgacgcgcacggctacgccagcaaggtcgcgaccacgggaaagcaggccatcgcgctcgcggccgcggagtcgccggacatcgtcctccttgacctcggccttcccgacatcgacggggtcgaggtcgtgcgcgccatccgcgcgtggtccgagatgcccatcatcgtggtgagcgcacggagcgaggatgcggacaagatcggcgcgctcgacgctggtgcggacgactacgtatgcaagccgttctccgtgggggagctgctcgcgcgaatccgcgcgacggagcgccaccttgcggtcgcggcggcggccaagccgacggcgcccggggcagcagccgcgccggcggcccaggcatccgcgcccgcgacctttaccgacggcggcctcgccatcgactacgtcgcgggcgtcgtcacgctcgacggcgaggagctgcacctcacgcccatcgagtaccggctgctctgcctgctctcgcgcaacgtgggcaaggtgcttacgcacggatacatcctggacgaggtctggggccgccaggggcagaagggcgacctcgccacgctgcgtgtgtacatggggtcgctgcgcaagaagatcgagcgcgacacggcgcacccgcgctacatacagacgcacgtgggcgtcggctaccgcatgatgagcgtgtagaccttctgcgtgtagaccttctcgcccgtgtgggcgctcgggcggcaccgtgttcttctcgcccgcgtttatgccatctgcctgcggcttttatgccgcatttataccagccttaacgttatcttatgctgctggcgtggcgtttcgttcccaaggtgcggcgtcgggtcgcgccggcgccgcaatggatatcctcccctctggtcgacgcgagccgaccgtggttccccggcgggtgccggggtcgcatcaagaggaagggagggccttcgtggaggattccaaggacggtgccaccatacaggtggcccaggttccccggcttacgagtgacaaggtcttcttggccatgggcacgtctgccgcggggctcagcgcccaggaggtggaggccaggcagaggcagtacggcaagaacgtcatccagtccggcaagaagaagtcggtcgtgctggtgttcctgtccaacttcacgcacatgatggccatactgctctgggtcgctggcatcatcgcctttgcggcgggcatgccggagctgggcatcgccgtgtggctggtcaacgtgatcaacggctgcttcagcttctggcaggagagcaaggccgacaaggcgaccgaggcgctcaagaagatgcttccggcctacgtcaacgtgatccgcgacgggcaggagcagaaggtcctggcggaggacctcgtgcccggcgacgtgatgatgctcgaggagggcgacaaggtctcggccgacggccgcgtggtgcgtgccagcgacctgcagatcgaccagtcgacgctgaccggcgagtccaaccccgtgcgcaagacgtccgacgccgtgcttgaggagaacctcaccaacgccgagatgcctaacctcgtgttcgagggcacgagcgtggccgagggcaacggccgcgtcgtcgtgacgcagaccggcatggccacggagtttggcaagatcgcgagcctcacgcagaacatggagcagaaggagagcccgctgcagaagcagctcgaccacctgaccaagcagatcacggtgtttgcgctgtgcatgggcgtcgtgttcttcctgctggacgtgctgtttgtgcacaacgggcttgccgcctcgttcatcttcgcgctcggcatggtcgtcgcgttcatcccggaggggctgctccccaccgtgacgctgtccctggccatggccgtgcagcgcatgagcaagcgcaacgccctcgtgaagtcgctgtcctccgtggaggcgctgggctccacgagcgtcatctgcacggacaagaccggcaccctcacgcagaacgagatgacggtcaaccacctctggaccccggcgcgcgagtacgaggtcacgggcgttggctacgcgcccaagggcgaggtgcgggcggagggcaagtccttctccgccgctgacgacgaggagctggagctgctgctcgagggcggcgccctgtgctccaacgcgcgactgatcccgcccgagaaggacggcggccgctacacggtgctgggcgacccgacggaggcgtgcctcctggtgagcgcgcagaaggccggcctcgacctcaaggacgtggagcgccgcatgccgcgcgtgcgcgagctgccgttcgagagccgccgcaagcgcatgtccaccatccaccagctggaggagccgctcgacggcgccacgcgcgtggcctttaccaagggcgcgcccaacgaggtcgtgcgcctctccaccaaggtccgcataaacggcgaggtcgtacccatgaccgactcgctgcgcagcaagatcatgaacgcgaacgactcctacgcggccgacggcctgcgcgtgctcgccgtggcgtaccgtcccatccacagggacgagcccgacgtgcccgcctccgtgagccagtacacccccgatatcatcgagaaggacctgaccttcgtgggtctggaggtcatgcaggacccgccgcgtcccgaggtcgcggccgcagtggccgagtgccgccgcgccggcatccgcgtcatcatgatcaccggcgactacggcctgaccgcggtctccatcgcgcgcaagatcggcatcgtaaagggtgcgcaccccaaggtgttctcgggcctggagcttgagaagacctccgacgaggagctgcgccgcgccctcaagggcgaggtcgtgttcgcgcgcatggcgccggagcagaagctccgcgtggtggagaacctgcaggccatgggcgaggtcgtggcggtcacgggcgacggcgtgaacgactcgccggcgctcaagaaggccgacatcggcgtggccatgggcatcacgggcacggacgtcgccaaggaggcggcggacatgatcctgaccgacgacaactttgcctccatcgtgcacgcggtggaggagggccgtgcggtctacgcgaacatccgcaagttcatgctctacatcctcaactccaacgtgcccgaggccgtgccctccgccgtgtacctgctgtccggcggcgccgtgccgctgcccctgaccacgatgcagattctgaccatcgacctgggcacggacatgctgcctgcccttggcctgggttccgagccgcccgagaaggacgtcatgagcaagccgccgcgcgacccgcacgagcacctgctcaacgcgcaggtcatgcgcaaggccttcctgtggtacggcctgctgggcgccgtcgcctcgcttggcgcgttcatgttcgcgcaggtgcaggccggctggcacatgggcgccacgatgttcggcgtcggcaatgagctggaccccacgtacgtccgcgccacgaccatggcgcttgcggccatcgtgttctcgcagattggcgaggtcatgaactgccgcacggagcttgcctcggtcttctcggtcgggctgttctccaacaagcaggtcaacaagggcatactctttgaggtggcgctcatcgtgttcctgacgctgttcccgccgttccagagcgtgttccacacctgcccgctcgggcccgcggactacgcgttcctcgttcttctccccccgatcgttctgctgctggaagagggcaggaaggccatcgtgcgcaggcacctgggcatcgaccgcgacggcgtccgcatcgcgcaggaaagtgaaaggtaggacatcatgaacgtgattgtcgttggacttgggcgcatgggcctggggctcgcgcgcaagcttgaccgccagggccacaacgtgtgcgccgtggaccaggacgcggagcgcctggagcttctgggcgacgactttgccggccgcagggtctgcggcgtgggcatcgaccgcgacgtgctggccaaggccggcatcgagcgcgcgtccgcggtcgtgtcgtgcacgacgtcggacgagacgaacatcgtgatcgcccgcatcgcccgcgactcgtaccgcgtgccgcgcgtgatcgcccgcatgtacgacgtgagcaaggccgagacgtaccgccgcctgggcatccagaccatatcgaccacggactggggcgtgcgccgcgcctgcgagctgctgacgtaccaccagcaggacagcgtgctttccatcggcaccggcgaggtgcagatcgtccgcgcggacgtgccgacgctcctggaggggcgcacggtgcgcgagatcaccgcgatcggcgaggtcaaggtggtggccgtctcgcacaacaaccagacgtccatccccaccgagggcacggtgctcgggcacggcgacgtgatctacgcggccgtcgcgtcgagcgcgcaggagaagtttgcccacatgcttggcaagacggagtaggaggcagccatgaacatcatcatcgtaggcggcggcaagaccggtcgctacctggcgcccatactcacggacggcggatcttccgtcgtggtgatcgacaacaggcgcgagaccgtgcgcaagttccaggaggagctgccgggacagaaggtcgtgctcggcagcggcacgagccccgaggtgctggagaagtgcggcgtcatgaacgcggacgtgctcatcgcggcgacgggatctgacgaggtcaacctggtcgcgtcgaccctcgcgaagatggagtaccaggtgccgcgcgtggtggcgcgcgtcaacaaccccaagaactcgtggatgttcaacgagtcgatgggcgtggacgtgggcatcaaccaggccgacctgctggcccgctccgtgcaggaggggctcgacatggaggacgtcttcacgatcatgcgcctgggcaaggacgagcacgccctggtgcagctggaggtgcgccccgactccaaggccgtggggaggaagatttccgacctggggctgcccgacgaggccgtcgtgatcgcgatcgaccgcgcgggcgacatcatcgtccccaagggcgacacgggcctcatcgcgggcgacaacgtgctggcgtttaccagtgcggcggccaagcgcgagctcaagcgggcgtttgcgtagcggcacgggggcgggcgcgggttgggcccgcggggcctgaccgcgaaaagcggaccgacaggggcccgactcacaaagcgtgctttgtgagtcgggccctttttgcgtttgggctggtaaataggttaaggcgggcttgcgcccacactcgcaaagcatgctttgcgagtgtgggcg

SEQ ID NO: 249 - DNA, 1201 bp, Unknown
  Metagenome-assembled genome
tttcagagaacgatagctcgtcagttaacgcgtcaaaatgttcatgatttcttatcttttcgtcaagattatgatatttagcttgagcgtttctttgcgcgctaacttgttgattaaatgcttttcgttcgtgtcgtttgctattgattccctcatgctgagttggggtatcatctattccttgattgacaaaagatttctcactaatccgatccggaatatttttttgtgctaaagactgattgacactcaacgcccaattttttcgccactcattaattttttcttttttatcccaatcaaccaaccaaatttttctttgttttggaaacccacttttggttaaaagttgcttgccattttcatctttaatgtactgcgtctttgcttttaatccccaagtaccatcaagattaaatgggcgattagtcaacatcacatgtgcgtgcggattgtccgggtgatcgcaatgaatagctacatcagctaccatgccttgatcaacaaagttttcttgcacgtatttagttaataattctttctgttcatctgcgcttaactcaactggtaaagccacgttaaactctttggcataccgtgagtttgatttacgatcgttcttttcaacttcattccataattgttctcgatcactggcccattctggtgcatttttgggggttaaaataaagctttctggcataaccgatcgggcataaaaatagtggcggccttcttgatcatcaaataatttttcaccacttcgataagccgcactggcaatcgcacttcgtccttttccagcactaatattactaaaactcatatgaaatattgccatgctagtcacctctttactttgattctatgggcttgactttgttgtcgccatcggcgacttctaatacaggattttggggttagtacaacatagaattcattctatgtgtaagtgcgcattaacctcgtttcactcggcctgctgattcccctaaatttacttctagtgtatgccttccgcttcgctatttcaacttctatcctttgacttaacgttctctgtatgatatagtttcggtgattatttttaatacgattggagggatcattatgtctcaaagtaacttagaaaaacaagaagccaaattaaaacagcttaatcaaaagattaaagctgaaaaaaataaaattgaacaaaatc

SEQ ID NO: 250 - DNA, 19858 bp, Unknown
  Metagenome-assembled genome
aggccccggcgacatacccccgtcacgggcggccgccggccgcctggcccctcgtgccggaaaacaacgttccatatccggttgtcaaggtgctggaaaggccgaagttggcctggctaacctgttgacaaatccatagctggctccctggattgcgtccagaaccgtcgagacgattgtatgacgggcattaacggttgacgtcacacttgctgcgagcgcaatacgtgcggcaacgagaggttgatgttggcgatgcgtatgcttactgcatatgctcgcgagacttcagtaccttaatgaactcgtcaaaatccgttgcagcaatgatgcgctgttggtttcgacggctgcttgtgacatcgatgagaagatcgtacagactctcgatgttcgtcctgtcgcccagcttggctgcaaggaggaagactatgcgggcttcgggggagttctcgtcccaatagattgggctcggcagtattgcaaccgcaaccattgttctgcgactgactggcttcatcgagtgaggaatgacgaatgaggggctcattcccgtactcgaaagttcttctctcttcatcacgagtggaaggaagctctcgtctacgtcgccggttgactctaggagccccgcgagttggttaaggacctcattcttgtcgagtggtttgctgggtcgcaagaaaagtctggaatcaaagaagccctcgatgtcggactctcgagactcgtcgagcatgccgagtgcacggtcgaccttctcggtatcagagggtccaagcgtgaagtctacgagcacgctcggaacggggaatccctccagtggcacagtagaaatgatgagatctatctcgtttaaggcgtcttcgggaaggtcattgagctcatggtaggagagcatgctcatgacgcgcactctgtccccaaacagcgattcgaccctgctctttagcatctgcgagatggaccttccggaaccgcagaccacaaggattcggtactggcccttaggctcctcgcccctgcgctcgatggacgctccaagatggagcgcgacgtatccaacctcgtcctccgtaagcttgtagggatcggtgtcgaagaccttgctcgtactcgtgagcgcaatctcgaatgcgagcgggaagttcgtcttgattgtgttgagcatggggtttcgcttgatgatcttgaagtccctcgcgccaaatgtgagggagaggtgctgaagcaggttctttctcagcactgtgtcatcacgcaggtcaaacccatagttttcccagatgatctggagcatcttggtgatgtctgcctggaagagcctgtcatccgcgtcagatgcggcgagctcggtgttcgcgagcaggtggaggtgcagatagctcctctcggcatcgttgatgcgaatcttgaattcggattccagccgattgcaaagctcgtcaacgaggagcgcagttcgcccagccgagtcaagttcgcctgtcgactcgacaacgtgaccgctcttgattctgccgaccatgagcgctacatggatgaggaagttcttgaacccatagtcggtggttatcacgtccgcctgggacaggtactcggagacgaccttctcgatacggtccaagtcgaggttagggaagagacgcctttcgtcgtcagtgaatcccttgacgtaggtctttgaattcctgatgactaccttgtcgacgtagcaacggcgcttgtcgcactccatgccaatcaccttggcgccaagacctggcttgttaacgagcacaaggtcatacggtgagagcagatcccgcagttggcgcacgtagccctgaagtgtgttttccccgacgaacaccatgccagccaggtcgtcatagggtatgtaggtcgaactctcaagtagctccctaagcaagtagcgaatcctgtcgtccacatcagagaggtcaggctgctccctgttcgagtgaagaccttgggagagaaaggcctcgtacgaggcatgatcttcgatcacaaggtgatagccacgctcacgcttcatgacgatgctcgcgccatggtcgcctaggatttggttgattttcgagatatctgagcgtaccgtgcgctctgttacatcagaggtctttgcaagcagttcggctggggtgtaatcggagcgcctgattgtatcgaaggtcttatccaagcgcttgttaccgaacatcgtgacctcctccatccatcgcaggtgtctcgacggcacgagaactattgccgaatcgttactcacgacaaatatagagggccattctcatcctccaaacattccgaacttccacttgcaaccggaaaacgacaacgctgatgcgtttccaacttccggcgcaagtggaagtccggaagcttgagtaggcctgtaggcaggcacatcatttggaagcgaagagaaggacttccgccttggagaggaggtttgatgagtgagagcaaggagcttttcacgccagaccacgtgtttctgggacttgacgcgaagagcaagcgcgacgtcttcgactgcgtctcgaagatggcagagaaggtcggcgtgactacttccgcttccggcctgagcgacgcgatcgcagagcgcgagggcgagggcatgacgggcctgatggatggattcgcaattccgcatgccaagacgaacgtcgtaacgcgaccttccatgttctacgtgagggccaagcacccgctgaagtgggaaacgcttgatgacgaggacgtctcgagtttcttcgcgctggtctcgcctgatagcgacagtggcagctcgcacttgaagatgctttccgcattggctacgtgcctactggaagatgacttcaaggaaacggtcaaaaagcttggaacagcggatgagctcgtctcatacgtcaacggttacatcgcaaaggagagtgacgagggatgaaggtcgtaggagtgtctgcttgcccggctggccttgcgcatacgccaatggccgcgaaggcactcatgaaggcaggcgagaagctcggttgggatgtaaagatcgagcagcagggcgccatggggttcatcaacaaggttacccgcgaggaggcaagtgcagctgacttcgtggtgattgcctctgaccagaagatcagggagatggatcgcttcgagggcaagccgacgatgcgcgttgacatcaacgtctgcatcaaggccccagaggccgtgctgaagaagtgcgcaagtgctgctaaggcacacgaaggcaagtaatcccttcggcaagttattgtgcgggctccggtccgcaagacgaaaggtgacagatatgaagcagttctttaaagaggcgaaaggccacctgatgaccggcattggctacatgctgccaatgatcatcggttcgtcgctggtcgtcgcgattccccagctgattgcactcgcgatgggcatcccttcccttactgacagcctcaagggcttccctgggttcctctatcagctccagcaggtcggatggacgggcattggcctcgttaacactgtccttgcggccttcgttgcgtactcgattgcggacaaacctggccttgctgccggtctggtcggtggcgcaatggccacctccacgaaggcaggcttcatcggcgccatcatctacgccttcatcggcggttacatggtgcgctgggcaatcaagcacatccatgtgaaggaaaagtacatggcggtcatgcccaacgtcgtgctcccgttcctcgccacgttcgtagtcgcgctcattgccgtcatcctcgcaaccccgcttgccgcaatcaacaacggcatcgttgcctggctcgaggctatgtgcaagagtggcaccagcaagctcatcatggctatcgtgctcggcgccatgattggtttcgatatgggcggccccgtcaacaaggctgcttggatggccggcaatgcgcttctcgccgagggtatctacaccccgaacgtgttcatcaactgcgcaatcaccatcccgcctctgggctatgcaatcgctgcagtcatccgcaaggcccgcttctccacctccctgcgtgactccgcctctggcaactgggtcatgagcttcatcggcatcaccgagggcgccattccgttcacgctggtcaagccttctcgcctgattccgattaacgtcatcggttctgcactcggcgccgctgtctgcgcgcttcttggtaccgatgcaaagattccgccccttggtggttggtacggtgcaatcacgatgcagaacccctggggttacctcatcggcatcgcagttggtggcctgttcatcgctcttgccgccacggcactggtcgacttcaacgtcgatcccgacgccgaggaggagagcgtcagcgaggacgacatcgagatttcattcgagtagcgcaaccgagtttctcggaagccgattgtaaggcggcgcggcttcgcggtctgcatgaccggaggtcgcgccgcttttgccaaccgcagcgacaaaatgtgagatggagtgagtatgagaaggactatccacgtcgtaccccattcgcactgggaccgcgagtggtacttcacgacctcgaggtcgaaggtctacctcatgaaggacctcgcagacgtacttgataccttggagaagaaccccgacttcaagacctggatgctcgatggccaggcttccctcctggatgactaccttgcctggagaccgcaggacgagagtcgcatcaggactctggtgtgtgacggccgtctcgtaatcgggccttggtacacccagaccgacgagatgctggcaagtggcgagagcatcgtccgaaatctctactacggcatgaggaggtgcgaggagctcggaccctacatgcacgtaggatacatgccggactcgtttggacagtcgggtaatatgccacagatctatcggcaggcaggtttcaaggacaccctcttctggcgtggagtttccaacgatatggtcgacaagttgaacttcacgtggcgtggagacgacggctccgtcgtttttgcgacccagatgccaaacggttactacatcggcggaaacgtcccagaggattccgaccagaatgacgcgtggtggcacgagcagtgcctggacaagctggcgtcacggtatgccaccgagcacgtctacttcccctgtggtttcgaccaggctcctgtccgtcggaaccttcccgagctcgtcgcagagcgcgcgaagcgcgatcctgacaacacgtacaagatgagcagcattcccgagtaccttgcggaccttcatgaggctattgatcgcgagggcgtgaagctcgaggaggtccagggcgagctgctgaatgccaagcacatgcgtatccatcgctcgatttggtcctcgcgctcggacctgaagcgactgaataccaaggcacagttttacgtgacaaacgtgctggagccgaccctctccctctcggcaagcctcggtaacgagtacccgaagaaggcggttgagcacatctggaagctcctgctggagaacgccgcgcacgactcgatgggctcttgcatcgctgacttcgtcaacgccgacgtcggacttcgctacaagcaggcgatggacgtcgccacgagcctcgttgagcttcacagccgcatgatcgccacgagcatcgactcgggagatgccccgatgaccattacggtcttcaacgctgatgcccatccgcgtagtggtgtggtagtcgagcacatgtatcttcccggcgaggacttcaagattctggacgagaagggcagtaccgttgcctataccattctgtgcagtagggacctgacggattacgtgctttcccagaccatcaagctcgatccaagcaggaaggcatacgtcccgagcaaggttctcgacgctatggttgcaatcgatgcgcacgaggttcccgcaatgggctatgcgcagtatcacctggtgctgaatgagagctcctctcatccgatggagaatcttgacagggataccgtgcttgagaacgagtactaccggatctctgtcaatgtcgacggcaccctcagggtggaagatcgttcgaatggatacgtctacgaccatcaggccgtactggtcgagaacggcgacgatggcgactccttcaactactctccgccaaggcaggaccttgtggtccgttcggacgaggggaaacccgaagttgcaatcgagggttctgacatctatcagcgggccacgattgacttttctatgaatgttcccaaggacctggatgagagggcgaagggcatccgctccacgagccttcccgttcggcttaccgttgcgctcaggcgcggctctcgtgtcattgaccttgacgtacacgtcgacaacaacgttctttcgcatcgactctgcatcctctttgacgcgcaaatggcgacgaagttcaactttgccgacgagcagtttgggtctatcaagcgtgagaacgtgcacgcgcgcgagatggcactctataacgcgtccctcgacaaggagaacgatgatgcgaccgaagatgactccatgcttcccgccaattggcgacagaatgcggagacctggcaggagatgcctgtagcgatcgagcccacgcagagctacgtggcgcttggtgatgggacgagaggtgtcgcagtgctacccaggggcgttcgcgagtacgagatcgttggggatgagaagaacgagatctgcctcaccctgttcaggacctatgggtttatgggcaaagaggacctgctttatcgtcccgggcgagcttcgggtgagaggacgatggagacgccagacgcccaactgctgggcccgctcgacttcgacctcggtctgcttccgtttgcgggtagcatcgatgaagcacgtattgcggaggaggcgcgctcctacgacggcgaacttcgtgcctatgagtacgcggagttcctcaatggcagactgatcttctcggagccggaggtcgagggatggcgttcgcagaccgggtctctcttcgaacttgatggcgacgcgatcgtttcggcggtaaagacctctgagaactatgggaccgatgggctcatcgtccgactgttcaacggctttgctgacaaggacgcgactgctaacttgaagttcgcgcgccctgtccaagaggcatacctgtgcgacctgcgagagcatcgcagcggagacgttaccttcgaaggtaacgtggtcactctgccggcccttggacactgcaagttccagacgctgttcgtgaagttggcttctgcatagcttgaacccaaatggcaaagttgtggggcacggcatcaacgatgtcgtgccccctttccgcatcggtatcacttctgtgttatgcctttgagtatccaatgtgctcttggctatcgaccaaaccgaacgctttccttcgcaaaatgctatcccgagctgggtcgatgcccttctcagcattcctataatccatagcaacgtactaggaaaatggaatgccaggagagaagagcctggcaggcgggggtggtggcatggccaagggtgagtttccagatgcggtgctgggcgtgagtggttatcgcaggagcctggaagacccgcggggcatcctcaacccgggcggcgtggcgcggccgctgagcacgggcgtggcggcgtcgcggctggtgccggacgtgttcaggccgctcgcgaccgacgaccttttggacgccgccaagcagacggcggcatggatccgttcgcacgaggtgccgacggagcatggcaagctttgggatgtctttcccaaggggcagccgggctttgggccggacgtgatgatctttgggccgcggtgccactactccggcgcggcgggcatcggcacgttcttcctgcgcatgtgggaggccacgggtgacgagtcctacctggcagacgcccgtgccgccgcggacgagctcatcgccacggcatccggcccggagtggtacgaccgcgtgctcgcgtccgacgtgggtggcgtcatccccgtacccggctgggccatcggctactccaacggacccgcgggcgaggggctgtttgtcatttccctttacgaggccacgggggaggagcgctacctggcctacgcgcgcaaggtcgcggacgacctgattgccgcggcaaagccggacccacacggcatccgctggagcgaccaggaggacgtggtggccgacggcggcttcgtgttctaccttgtgctggtgtggcgcaagacgggcgactcccgctacctggacgcggctcgacgcgcgggcgaccgcatcgcggcggacgcgctccaatcaccccacggcgggctgtactggaagctcctggacctgcggctgatcggcttccccaaggacacgacgtttcccaacttctcgcacgggacggcgggcacggcctggatgtttgcgcttctctttgaggcgacgggcgagaagcgctacctcgagctcgcgcgcggcggcgtggagtacctcaaggccatcgccgtgggggacgagaccggcatgctcgtgccgtaccaggtccaccccgtgacggggctcaccaccaaccggttctacctcagcagctgccacggccccgtggggacggtgctgcccttccgcaagctgtacgagctcacgggcgaggcggagtaccgcgactggtgcgtgtggctgtcgcgcgggatcatccgcgccggggcgcccgagcactactcgtggggctactggaacagcaactgccagtgctgcggcacgcccgggatcctggagcactttgtggatatgtacgagttcaccggcgagccggagtttcttgactatgcctggcgcacggcgcgggtgctgctggcggattccaccacctgggacgacaggcccggccagcgcacctggtacggcgcgtggacgcgcaccatccccagccgcgtggtcagctacctggggctttacagcggggcggcgggctgcgcgtcctcgctggtgcggctgtacgcggaccgtcgcgacgtgcggctgacgcagctcttcgagtacgagttctttggcgagcggctgggccgcaaccgcgacggggacgccgcaaggtaggcaacagggccggggcgggcgtccttctcgcccgcggaacgtggcgcatgtggcgcaaggcagatgcaagggagaagatcatggcggaaaacagggcgtattcgtccatcgcggagctcgttggcaacacgccgttggtggagctcaccaactacgagcgcgagcatgggctcagggcgcgcgtgcttgcgaagctggagtacttcaacccgtcgggctcggtaaaggaccgcatcgcgctgggcatgatcgaggcggcggagcgcgaggggcgcatccaccccggcgacacgcttatagactttaccagcggaaacacgggcatcgggcttgcggccgtcgccaacgccaagggctaccgctttgtggccgtgatccagccgggggtatccgtggagcgcacgcagatcctcaaggcgtacggtgccgggttgctgcagttttccgacattcccggcgtggaccagatgatgcgcgagcgcggcatggtgctgagcgagctgtacggctacattggcgcgtacgcggacgcgcacggctactactacatcaaccagggcctcaaccggcagaacccgctcacacactaccgcaccacgggacccgagctgtgggaggccacgggcggcaacgttgactacctggtggctctggtgggcacggccggaaccctggtgggcacgggcaagtatctgcgagagaagaaccccgacgtgcggatcgtgggcgcgcagccggcggcagacagccgcaaggacccagcgcatccggagcgcaaaaccatcgacggcgtgctggccttccacgacgtgccggccgaccgcgtgccggacttctttgagcagtttggcgagcgtccggacgaggtgctggacctggatgcggacgaggcctacgccatgggtcgcgaggtcgtacgcacggacggcatctttttggggcagtccgcggcggcggctctgctcgccgcgaccaaggtggcccagcgcgcggaggccgagggcaagaccatcgtggcgatctgcgcggacaacgcgttcaagtacctctcgaccaacatctaccgataagccctggtgcaggttgccctcagcctttctgccaagataaaagccgcgggcgagaaggacgcgtccttctcgcccgcgggcttgccctgggacggcgacgctacaccagtcgcagccgccgtgcctcgcttgcggcctgggagcggcggcgcacgcccagctttgcgaggatgtggctcacgtgcgtcttgaccgtgggaagcttgatgcccagtacctggccgatctccgtgttgctcttgtcctggcagatcaggcgcagcacctggcgctccgcctcggtcaggtgctcggacgggccggtcggctgcgtcaggaagtccgggtagcgcgacgcctgcgcgcgggcacccttgactagccgcgcgagctgctctgcaagttcgccgtcgctgttgccattgctgttgccgccgccggccgcggaggggccctgcgcctgcgtctggagcagcagcggcagcacggcggccccgtactgcgtgatggtgcgcacgtagccaaagcgccgcgcggtggcgagcgcctgccccagcggccgttcccagtcgcccgcgccggtgcgccagcgcgcgatggccgtcaggacgccgtagttgatgatctctatgtggcggtcgcgcgactccacgtactcgctcagggtggacatgaggtgcgtcgcctccgcgtagcgtgactccgctaggtacgcctggcagcaggtcaggtacacgtagcggtcaaggtaccagagtctgtccaggtcagcgggggcgttttcctcaagccaggcatgcgtgcgggcggaatttcccagccgcagcaggcagcggcagtgcatggcgtccaggttgcgcacgatgcgccggctctgggggtcgtcctcccacgccagggggcggcggtagcggtccagcagctctatggcctgcggagcgtcgcccaggtcaacaaggttgcggacttgcatgcccacggccgcaaactccacggagcggtcgccgccgcgccgcaccttgggcagcaccgcgctcacgcgcgcgacgtcggccgcgacgtcctcgcccttctcgaacctgctttcgcacagggccacatccaggcagcccacgctcatccggcccagcgccctgccagcgattttgcccagcgcacggcaggtgcgctcgtcgtccgggacccaggggctcaggtcgcgcccaccgtcgatgatgctgggcatgccgctcgtgagcgacagcgtgaggtcggggtcgcgccccgcctgcatgcgcgccagggcggacaccgcacccgtcaggctgtccagccgacggtggggaagcgccaggtccaggtaggccaggtacgagcgggcgcgccggcgttcctccgggctgcgcgcggggtccgccgcgtagcgctccagctccgcgtaccagcgctcggaacccatggtgtccattgacatggaatcgagcaggctcatgatgcgcatgaggcggggagaagatcgtacgattccatctggcagcgcatggtagtagcgctcaagctcaaagtagctgccgttgcctgggtgcaggcgggcgtgctcctccaggagctcgagcgcacgctcgcggttgccgctcttggagcagacctccagcgcgctggggtagttgccccgctccacgtagtagtcgatggcgcggctgacgatggcctgcgcggcgccgctgtcgtgccggcgctcgcgctcccacgtaaagaacgtcaggatgtcgggccgcacggtccaaccgtgcccctcgcgcgtgatgaagcacgtgtcgtggtggatggtctccaggaaggtccgcccgtccttctcgcccaggacgtttgtgacaaagtcgtcatccacgcggtcgaacagcggtgccaacaggagcatggactgggtccgcgcgtcaaagcgcttttcgaactcgacctcgaagtagcgcatgacctcgccgtatatgacctgctcccaggtggcgtcgccgcgcaggatgtggctcacggcgagcgcgacgcccagcgggtagcgcagggtggcatccgctatgtgccgcacgagggccgggtcgggctccacgtcgttggcggcgagcaggtgcgcgatgtccgcgttggaaaacgcgaggtcctcgctcgtgacgatgaggagctcgccccgggcaaaggcgggcgtgagccacccgggcatgggcgcgcgcgacgcaaagacgaagcgggtgtccgggcagcgctccgccaccgcggcgagggccgacccctgtgcggctgacaccgcgtcgtggatgttgtcgaccagcacggcgtcgtgtgcgcgggccgcggcctccgtcacgacggccgcggcgtcctcgcgctccgcgtcgacctccagcacgtccagcccccgcagcatgcgccgcgcgaacgtggtctttccaaagccgagcgggcccgagaccagcgcgatgcgcgtgcgctcccactgcgggcgcaggtactcgtcaaactcgagcgggaccatcgtcagcatgtgcgcacccttccgccgtggcttcccgttgtcttgctcgggcgagaagaacgcccgccgtgcccgacatcatactttggtatgaggtctgggcgcaaatgggtcactaatatcgttcaccaagacacgatagccacgtcacttcgaggggaaagacgccatggaagctgcctacgagctgtacgaagaggacgggatgaggttcgaccttgcagatttcttctgtcgcgagtacgacgagctcgtgggcgacggggacgcgcttgcctgctcctactttgccaaacgtcttgagggtgaccagacaaaggtccgcgcggcggtcaggcgctttgggatcgagggcgaggacgcggacgaggtcagctttgtgctcgacaccaccgtgtttggcacctgcaagaaggggcttgccgtcactccctctggcatctatctggtggacgaggccgggaagcgggcgtttctggactgggacgactttgccgcgtgcaaggtgagccgcgtgaacgacacgctgaccatcgccgggcacccgttcatcatgagccgggacgaggcccgtctggtcgcccgcgtgatgcgcgacctgaggaagtgacggattggccgcgctgccacaacaatgggcatatttacctgctcgttttctgattgtggtacggttcgcttaccgattgtggtaagacgcacttactgattatggtaagtgacacttttcgattatggtaaactctacttaccgattatggtagttcgagtgggaggtggccatgatcgagcgcgacatcgctccatgggtgcagaagaatgcgacgtggtttcccgtgctgtcgattactggcccgcgacagagcggaaagtcgacgttggtgcgtgcgctcttctcggattatcagtatgtgaaccttgaggatcctggcacgctggccatggcattggatgaccctgttggattcattcgtaacaagccctcgcgcttggtgattgacgaggcgcagctggctcccgagctcttcaacatgattcaggtggtatcggacgaggtagggactccgggtcagtacgttctgtcggggtcgcagaacttcctgctgcttaagcaggttacgcagtcgcttgccggcagggtggcgctgctgaagctgttgcccttctcatataaggaattaaaccaggcaaaccagcgcgtcgagcttcatgacttcatatgtcgtggtggatatccacgcctttatgacgttgggattcccccggaggtctattacgagaactacttggagacctacatcacgagggacgcatcgggatatgtcgacccgaggaacctgggactgttccgcagcttcattgttgcgtgcgccacgaattgctcgaaccttttgaacttgacgggactcgcaaacgatgttggtgtgagtgtgcccacggcaaggtcctggctctccatgctcgaggcgagctacgtggtctttctgctgcagccttaccatgccaaccttaggaagcgactgacgaagacgccaaagctctacttttatgacacggggctgctctgccacctcttgggaattcatactgcggaccagatgatggcgtccaaacagaggggcgcgatctttgaggacctggttatcgaggagaccgtcaagcgtcatttgaacgcgggtaggcagccacagctgttcttctatcgtgatgacagcaagattgaggtcgacctggtcgacatgactgatgcgtcggctccggagcttgtggagataaagtcctcagccacttatcgcccggccttcgcgcggcacctctcgcacgtgggggagcttttaggcgtggatacttccggtcagtccatcgtaatggatgcgtcggagacaaccgtggtgaatggccggaaggtatggtcgatgactgactggcttctgcgttcgtagcggcaacgtcgtatgcctgcagttaccgcgtcagtcgcatgtggagcagcgggaacggctcgcccgcgtcatcggtctcgctgcggccaaacgtaacgaagcccatgtgctcgtaaaagcccacggcctgcgggttctgctcgttcacggtgagctcgctcacgccccagtcgccaatcgcgtggcgcagcagcgcggaccccacgcccgtgccgcgctcgcccgcgttcacaaacagcatctcgagcatggtgccattggcgcccgcaaagccgagggcgcgcccgtcatccgcgcgggcgactgccagcctgccgacgcccccgatcgcctgcggcacatagccgcggatgcgcgtgacgtcctcctccgtcaggaagtcgtgcgtggcgcgcacggagcgctcccatacgcccagcagcgcctcgacaagctctggcgtcctgtcccggatgtccgtgatgtccatgcgtctgtccttctcccctgcggctgcctgccgtcgcgttgatggtcgcctaaggttaccccgtcctaaggaactcgtcgaggaagacgtcgagaaggtcgttcttcctggtgggaagccatgcggcgaccacgtgcatctggtgctccataccctcgatgggcagggcgacgaccttgccacggcggggcagcgtcgccgtgaggtatcccgggagcagggcataacccaggcccgaggccacacagaggaggcttgtctccacatcctcggaaacgtatgagaccctaacggtggaaccgacctcctcaagtgccgcagcgatggtctcccgctcgccgtatccgcccttgccacggtggatgtctacaagggggaatccagagaggtccttcatgcgtatgcggcccctgtgcgccaacgggtggttggcaggcaccaccgcgagcaacgggtaatcccgcatctccgtccactgcaggtcgcgcatcctgtcgggcgagtagagcaggttgattgcgacgtcgatcttttccgccctgagcgcgtcgtacagctccgcgacgttctcgcggaggaaggacagtcgcacgttagggtagtgcatgtggaagtcgtacagcatgtcgcccaggtcggtccgctcgaagcccttgatgtagcccacgcgaagctctcccatggggccctggtcggccgctcgcgcccggcgcaccgcgtcgtccgcgcgcgagatgatcgcgagcgcgtccaccaaaaaggacgatcccgcgggcgtgagctcgactcggtggttgtcgcgatagagcagcttgcagccaacttcccgctcgagcgacttgagctgcgtcgacacgctcgactcggacacgaagagtcgctttgccgccttggtgaatgagagctcctccgcgacggcgacaaagtactcgagctgctttggtgtcatgtgcatcactcgcttgcgataggtaaacgcgattacgcgataggaaacgcagagggaagtcgtacaaaaccccttcttacaattcgattatcaaagcgcaaaccatagtttgcaaggacgtttggagcggagggacagacatgtcagacagaaggaagatcaagctcgtgcaggccctggtgggctccatcgcgctcaccctgctcatgcaggtaatgggattgtttgggtactcccagtacatctggatgtgcttcctcccactcctgatgttctttgcgcttggggcagacttcaagaacataccctccatgatcatgagctacgcggtaggcgagctgtggtgcatggtcaacggtctcgtcgcgggtgcgttctccgccgcgttcggcagcggcaacatggtgatgtccaacatcgtccccacgatcctagtcatcttcctcatcctcaccacccacgagaacctgctcgagggcaagccgtactccaacatcccctgcatcttcatggggcttgcgacctcgttctttgtcgagttcctgcagcaacccatcggctacctgcacctgctcgggttctggtgctacggcgtcgtcctcgccgtcgcgctcgtgctttcgggcatgtgggtctgcagcgcgatctttggccgcgaccgcacaatggcggcgcttgcgcccgcaccacgtcccgcggatggttccaaggatcaaaaggccaggtaggtaaagccaaacgtcttgtccggaaaggggcaaagagatggaagccaaagtcaagggcgagaaggacgtggataacgtcgagaagagcacggacgcaacgcccgtggcacggtccgtggaggaggcccgcaaacagtacgagggcaagccaggcgcgcagaggtatccccacgtgttcgacccaatcgagatccgtggcagggtcttccgcaaccggctcatcgcggcaccgacgatgttcttccacgcggcctacttcatcccccagattcgcgagaacatctaccgcatggtcgaggtccgcgccaagggtggctttggctgcgtggccacgggcgagctgccgctcaacttcgaggagggccgtggtgcgttcatggaccgcgccatcgacgtgaggcacttctacgggagcgacttcgactccgccaaggagtacgcggaccgcatccactccggcggtgcgctcgcctacatggagatatcgcacgaggggctcgaggcggacgacgcggccgagccctggggcccctgcgacatcgtgcgcgaggacggccgccacgtcttcggcatggaccgccagatgatggataaggtctgcaacgacttcttccaggtgggccgcttcgcacatgccgccgggttcgacggtgtgctcctgcacggaggccacgggtttctcatccagcagttcgtgtcgccgctcttcaaccaccgtacggacgagtttggcggctccatccagaatcgctcccgctttcccaagatggtgctccgcgccctgcgcgccggcatgggggaggacatggtactcgagctgcgtatgagcgcggaggatggcgagaagggcggcatgaccctggtcgactcctgcggctttgcggaggagatcgacggcctcgtggatatcttccacgtgtcgaacggcatcaagaagctcggcaacggcggcgatacgttcagtgacatcttcgacccgcacggcgtgaacctggagcgcgcggccgcgatcaagcctcacctgcacaagagcctcgtcgccgtggtcggcggcttcaacagcgtggcccaggccgaggacgccatcgcggcgggcaaggtcgactttgtggagtacgcgcgccagtgctttgcggacccggacttcatcaacaagacgctcgacggccacgaggacatggtgcaccgctgcgtccgctgcttccactgctacccgggcttctgcgagcacccgaccgacattcccctgtggtaccagctcccgcccgaggagttcatgaaggtctacagccccgcggtgatgggggactgctccataaacccggactccggcctgggctactaccccgaccgtctgcccaagccaacggcaagtcgcagggtcctcgtggtgggcggcggcgtcggcggcatgcaggctgccatcacggcggcgcgccgcggccacaaggtgacgctggcagagaagggcgaccgcctgggcggcgtgctcctgtttgcggaacacgaccatgacaagcgcgagtggatggacttcgagcacgtcctcgagcgcgagctgcgcgacctgaacgtcgacgtgcaactgggcacgagcgtggacggggactacctccgcaagacgaaccccgagtacgtgatcctggccgttggcgcccacgaccgcgcgtgcccgctgccgggtgccgagcttgccatgagcgcgacggacacctacttccacatggacgagatcggccacaccgtcgtgatcgcgggtggcgggctcacggcctgcgagacggccctcaaccttgccgccgccggacacgaagtcaccgtcgtggcgcgcaagcccaggctcacgccatccacgtttggctactaccgcaacgccctcctggacgagatggacaagcgcggcatccaccagctcctctccacgtgccccatggagttcaccaaggggggcctcgtgtgccagaaggccgtcgacgacaagggaacccccggcggcgagcacgtggtggtacctgcggacacctacgtctactcctttggcatggatgccaacacggacgaggcggagcgcctgaccaaggccgctgaggcgctgggagccaaggtgttcaacatcggcaactcgaaggagccaggcaccgtccatgatgccgtgcacggtggcgaccaggctgccatggcagtgctttaggatcaaagacgttgcgccctgaccatgggcgtgatggttaaagattggatgagaagaacgggcgtcgctcgcagttgcgggcggcgcccagtttgtcgaggcggtggaggacgcgcggccgattggttacaggttctggtatatgggcaggtgggggctatcgtttccgttggcgaagtaggttcgaggtcgatgggggcgacatgaaggcggggtacctggagtgcgagaggcgttggacgttctggctgctgatctttgttgcggggtggtacggcgcctacacgtttgccctgcgtggcggcgtcttctgcaacgcccagaccgccaacgtggtgctgcttgccatggccctgggccggcggcagtggctctctgccgcgtatctgctgctgcccattagcgcgtacctgtttgggtccttcctctccgagtggatgggcaaggggatcaagcgcctcgacctcgtgcgatgggacaccctgctcgtggcgctcgagatggcgatggtcgtttttctcgccctgatgcccgcgagctggcccgaccagatctgccaggtgacgcttaactttacgtgcgcgatgcagttcaacacgtaccgccagatggagggcgtgcccgccgccaccacctttgtgaccaaccacatccgccagattggcgcgaacctggccaagctcacgcgccacccggaggaccgcgcgctgcgccgcagggtcaaggcgcacacgtcgctgctgctgtgctttaccgcgggcgccgtcatctccacggtggcgtgcggcgcgttctcatacgtgtcgctgctgggtgcgctgattccgcttgcagccgtgctgaccaggctcatccacgcggacctctttggcgagcgcggccagctggacctggtgccgggcgggcactaggggc

SEQ ID NO: 251 - DNA, 17801 bp, Unknown
  Metagenome-assembled genome
tctaccaggagacgggcgagcgcaactccgagcactcctgctggcagtacttcgcggtcctgcccgacatcaagtccgtcggcgtcatgggcgacgagcgcacctaccagcgcccgatcatcgtgcgtgccgtggagtcctccgacgccatgaccgccgactgggccaagcttccctacgacgtgatcggcaagatctcgagccgcatcgtggacgaggtcgacggcgttaaccgcgtggtgtacgacgtcacgcccaagcctcctgcgacgatcgagtgggaataattttcggtcttttacggtctgtcacaccttgctacaaaaagcaacgtttttgcaggtcagatgggttgagaagagttttgagaagcgacgcttcgcaacgctccagaacgcttgactccggattattagtggcagaattagtggcagggctggattggacggcccaatacacctccgccacagagtgacattgagatggtggcgcggccttccggagggggtcgcgccactttctatttttatgtacagagaatggaactctccatcgcggggggtccgcacaggattagggggtgctgcacaccccctcgcgcgcaaagggcgcgcgctcacccccttgctgccccttcggtgggtgtgcggtgaaggggcacaccgcacacccaccgaaggggtcgatagggagctggcgctcaacgccattcggcaaggagccacagcaggagcgccatcggagccacggcaatgcacagggcggcggccgcgagcgtggccaccgcccagaagaggtcctcgcgggtcacgacaggagctcgttcacgcgccgctgcacggcggcgtagttcgccccgaggcgccgcttgcgctcctcgccgttcccgtagtcgccccgaatcacggcgcgcgccagggcgtctacgtcaacggcccgggtgcgcggcttcgacccggtacccaggatctcgttcacgcgcgcctggacgcggtcgtagttcgcgccgagggccctgcgccggtcgtcgccgttgccgtacttgccggcgattacctcgcgggcgagggagtcgatgtcggaggatggcgcggtgggggcggggctcgcggaggctgcgccgccggcgcccatgcggtcgtaccacagctgcgcgcgcgagatgtaggcgtccttctgcgagccgtagatctgccccgggcagctcgtgctcgcgaagtggcagtgcgggaacacgttcacgttccactgggggcgcccgagcccgtagagcctgcagagcgcggccacgaggtgcgcgccgttgtcgaggcaggcctccgagatcgtgccgtcccttcggttcgcgtgctcgatgccgatggacctcaggttctccgaccagaggccggcgtgccaggcggtgtcgcggtcccacaccagctggccgacgcgcccggagctctcgacctggtagtgggcggacgccttccgcgtctgccaccagttccacacgtcttcgaccgagccgtcggcgtcgttgtagtggacgacgatgtgctggatcctcgcgccgccgcggccacgggtgaagtgcctgttcatgagcctcacgacgtcggcctcgcagcgtgcccagtccctcatctctcgtcaccccgctcgatccggggcgcgtccgcgtcgacgcgcttgccgagctccgccatcaccggcgagagcacggccatcacgagggcgaccacgagcgccctccactccgtcgggagcgcggtcgcgcccaccagcatgtccaggttcgccacgacgacgcccaggacgccctggaccaccgtgcgcgcgagacgccagtaccactcgtttccgcctaggaactcagccatccctgtccgccttcctctcgaggccgtcgacgtcgttcttgaggatcgccacgtcgcgctcgagcaggtacgtgcgctccacgaggcagttgtgcttctccaccctgcgcgtgagctcgtcgatcttctgctccatcaccgcgcgtgacttcgagttgctggcgatgaccccggcgagcgtcacgccgccggatatgatcgccacgattaccgactccaagccatctcccctcgacgacgtcccttcgggaccatggtcccagggggtcacaaggggggaggtggttgccgttgcctatcccgcggtcaggtagccgggctgcccggcgcggtcgatcacggccatgttcgcgcccgtcttggacgaggagaacttcgtgccgttcccgcccacgaggaggttgtcgccgtagaaggcgctcgcgctcgacgccagggaggacggaagcgcccagccctcggaaacgaggatcgtcgtgagcgagctcatccccgcgaaggcgtaggtccacctcctgatcgtggacgggtcgagcccccgaaggtcgaggctctggaggctcaccgagccgttgaacatgaactccatgctcacgggatgcaggttcggccagccggagaagccgagatggctcgacttggtgttgtagaaccagtagtccgtgcagaggccctcgaccgaggacagcccgctgccgaagacgacgtacgccagcatgtcgcggtggtcgtgccacggcatggacccgagcgcgttgtagcgcgcgttcacgcagatggggccggatgccaagacgtccggcgtcgtgccgcttccccagcccgtgttgatctcgagcttcccgctcgtgtagaggcgggcgtacgcccacaagcgggcgtcgtctccgtcgtaggcgaggagtccgttcgcgccggtcgtgaacgccgaggcgccggaggtgtcccttgccacggtgaggtggccgccgacgagcttccggcagccgtagaacgggatgctcgcgctcgtgatggacgagctgtacgcggcgtcgcacgagatcgacctcaggtcggagtcgccggagaacgtctgcgacgccttcgtcgccccggagatgtggtcgaagcccgtcacgttcgtgagcgccgtcatcccttggaaccagtgggagatatcggggaagctcacggtcgcgagggaggggtcgacgcgcacgaacgcgatctgctcgcggtagtcgtgccagggcacgtcggtgtcgctggcgtacccggtgggagagagctcccacgaccgctcgacggcgtcgtcgtagtaggtctggggtccgtcgaggtagttgagctcgaggttcttcccgccgttgtagaggacggcgcgcggcttgaggcccgtgtcccaggagaggtcgcggatcgcctgggccatctccccgggcctgtacttcgtggcgagcccgttctggctacgtatcgccccggcgatcgccgagaagaccgagtcggacacgaccccgctgccgcctcccagggcgcgcgccgcgcccttgccagacttcgttccgttaagctccgctatcgcggcggccatttcagccggcctgtaggtagcgctgccgccgttctgctcgcggatcgcgttcgcgatgtcgccgagcacggactctgcgatgatgcccatgcccatcagtagctcacccccgagaggtccgggaactgcgaggagacccactccttcgtggcgtacgcggagaggtcgggggtcgctccgtcgacgcccctcgcgcccgtggcgccggtagcccccgtcgcgccgcgctcgcccttgagcccggtgaacgagaacgagagcgtcctggcggaaggggtcccgccgagcgtgacggagaccgcgggcgtgcccgacgaggcgtccacggtggcggcgacgtcggcgatcgtcgcgtccgcgccgtctttgccggcgggtcccgtaggtccggtcgcgccaacgtcgcccttggccccctgtggtcccgtgtcgccggtcgcgccccaaggccccgtctcgccccgttcgccctttgggcccacgagcgccgcgagctgcgcctgcgtgaagtcgtcgtaggtgaacgggtcgcccttcggtcccgccgcgcccgccggtccctcagggccggtcgcgcccgcgtcgcccttgggtccgcgcaggtccgccgagctcgtgccgctcgcggaggtcaccgtgaggacgctgccctcccacgagtgcgtgcagcccacgccgtccctgccggccggtcccgcgtcgcccctgggtcccgcggggcccggcgcgccgctcagctcgccggcgtcgcgcgccgccttcagttcggccgcgacggccagggcgtcggcggccgcgtcctcgtagcgcttgatggcctcgacgaacagcgtgaagccgtcgcgcaccgcgagcgtccccacgagggaggtgcccacctccacgtcgaaggcgggcgtcgcgagcgtcctgtcgctccagctcaggaccacctcgcactccaccgatccctcggcggcgcacatcgccgccggccagaacacgcggaaggcaccagaggcggcgtctgccgcctccatcggctcgcatccgcgcgcgtgcgtctggcggtgtcgccacagcaggtagagccgggtgccgtcgccggagaggtccagcggctcgcccccgcgcgtcacccgcagcagcatccctcgcccgcgcgcgtcctgcggcgaggccgcgaggcgcccggcaatcgggccgtcgcacgcgtcccacgtgacctccgccaggccgtccgagtccagcgtctcagtcgtcgttgccatgtcagtactccttgcccgagaggtcctcgaacgacgagaccgcgtccgaggccttcgccgccgtctcctcgaccgccgacacgcgccgcacgatctcggcgctcgcctcccacgtcgcgcgctcgacgctgcccagggtcacgtgcacgcgggcgcggcctgcgccgaacgtgcgcaccctgcgcacgcagcgcgccgtgagccgccactccggcgagcgcgagcggtccacgaccgccacgtcgtcgccgaggcccaccgggacgccactgtcgagcatggccacgtcgcactcgtacgagacgcgcgggtggcatcgcctggcgagctccgccctggtcagcgccagcagctcggcggggtcatcgcagtccgggaacacgacgtccccaaaggcgtgcgtgcgttcgccccgcgtggcgtcccagcggccccagcgcaggcgagcctcgtcgtccccgacccacttgaccgagccgttcacggactcgaacgagatccggcgggtgtagccaccggtcgcgttgccctgctcgtcctcgatggggaggcccttgccccagccgtagagcgcggtgcacacctcgtcctcgagcacggtccgcgtgcagcccgcgaggttcacgccgtacgcgaagcgcgcccccctccagccgccctggcgggggagaagggcgacggcccgcctcgcgaccctgccgcccgcgacctcgcacgagcactcgagctcgccgccccacaccgactcgacgcgccggagagccgcgagcgcgttcgtgtggtacaggagcgccccgcgcctggcgtcgcccacgccgacctcgccgggcgaccagcgcgtgtgtgagagcaccgccgccatcgcctgcgcggcggtcctgctcaccagctgctcctcctccacgtagtcgcgcaggagctcgcagagcgacgactccgcgtacacgcggcacgagccgccctcggcctcgtcggtgcgcacgacctcgtgctcgcgccaggcgccggtctcggggtcgcgccacacgatccggtcgcccttgccgggcgccttcgcgcaggccagctccagcgtgtcctcgccgcccagctcctcggcgtgcgtcaccgagcccagggtggcgagcacgcccaggcgctcgtcccaacggtcgaacaggtacagggtcggaaccgccatcacgcccacctctcccgccaagagaccaggtgagaagagcagccctcgaacgccagcgcggcgcgtcccggcgcgaggcggaagaagtcgctccccagggtcacgtcggccgtcgcgtcggcgccgttcaccgttaccgtctgcgcgccgcagtcgatgtggaccaggtcgcccgccgcgagcgcgcgtgccagctcgacgcgctcccccgtccccgtgcacgcgacggaggcgcccgagcccgccgtggccgtcagctccatcaccggccgcgtcggccaggtcccgcccacgtcgaacgcgtcgcccgccgacgagcgctcggcgccgtaggccatggggtccaggcacaggaacgtcacggtcgcggaggcgtccgcgagcggccccgtccagcccgtggatcccgcgcatacgacgtcgcgccactcgagccccggctcgcccggcaccacgagcgtcccgccgccgtcggcgaggagccatgcccggatcgtgcgccggaccccggcgcgctccgcggccgtgagcgcctccggggcgtccaggtgcaggcgcacccgcagctccagcggctccacgtccgacgagacgagcgcgagccccggccttccgggcacccgcgccgtctccgccgcaagcgagtgcgccgctggccactccagctccgcgctcacgtagggcgagagcggacggccgcagaacgtaagcgagctcacagctggccccgagccctggcgtacgccgtcgccctgcgctgctgctcgcgcccgaggcggtccgcctcggcgggggcgccgcgccggtcggcctcgcggatgcccttccggagcgtcttcgccaccacgtcgcggtcgtccacgccgcgtcctccgcgcaccttgtcagccatcctggaccaccaccgtcatcgtcatcccaacgtcccagacccagcgccccgatcggtcgcgcccgtaaaggcgcggcagacccacgtcgcaggcaacgatgcgcatgcgcggcggggcggcggcgtgcgcccagtcgatgcccctcaggccgcgcgacacctcccgcgccgtcacgcgggcgtccgtcctgtcgtcgcagcacacgtgggcgagaagggcgcgccgcccgcgctccgagccgtcgtcctgcctgcactcgcgctcccagtcgcccatggagacgacgatcggctccgtgcagagccggggcgctacgggcgcgtcgtaggcgttcgcgtagcccagcgagcgcagcgcgtcgcgcacgacgcgcgcctcgtcgggaactcccgtcgtccaggccatcacccgacctccagctcccagtggtgcacctgtccgcgcaccacgcagcaccgcctgcacctcagcacgcgcatgccggggagcgaccccacgaccacgcggctgcctgcgggcacctcgaaggcgtcccggctgttcacggcgtccacgaacacgcggcccgagcgcgccgagtccctgtgcgggtcgtccgcgacgtcgtctgcgagctccaggcgcacgtggcgcaccatgcgggcgtccccgtagccgccctgcccgtcggaggggagcacgagcatgtcgtcgggcaggagccgcctcgggatgggcctcaggtacctcatgggcagcccgcccccgagaaggcgagccccgtgcccgcgagctcggagagcgcggccgcgcgcgccacctccaggccggtggtgcccttctccatgtagttcgtcaccctgaagtcgcctatcgcgtagccgcccacgcgcccctcgccgaactcggcgaacgcctcggcggcggcgcagcaggcgcgcgcccaggcctcgaggtcggcggtctccaggccgtcgtccgcggccccgccgcacagctcgcgcacacacctcagagcggcgggcatggcgtccgagaaggacgccgcgtcgagggagccgccgtacgagtctcggtagaaggcgaaggaggggccggccgcggcggccccgcccgcgacgcccgatgcctgcgggaaccccatggcgctacgccgccggcgccgcgctcacggccacgcccgcgagcttgttgtccatgagctccacgatgccgtacttgcggtacttcatcatgtagctatccaggttctccagctcgtccggcgagaagacgcgcgaggcgacgtgcttgtcgaacttgatgaccgcactcttctccacgaccatgaagttgatggcccgtccgtccgtcgccttcgcgtagccgaacttctccgagtcgccggagttgagggcgatcttcgtgtagaagcgcgcctgcggcacctccacgacgcggcagaagcgcgtgaggacgcggctgctcatgttcgggttcgcgagcgagtagtcgtcgagcacgcccttgagcgtcggcgtgatgaacaggtagcgcgagcccggcgtcacctgggcctcgtccatcgcgttcgtgacggagcggagggccgccagcacgtccgtcgccttggccttcgagaggtcggcctcggtcaccgagacgccctcgtgcgaggcgatggtcgcgtaggtgaaggcgtcggcctccggcgccacctgcgtgcgctgcagctcggcgcccgcctgcacgaagcagtcaaggacgcccgcctcctcgacgtccatcacgtcggcgaggagcttgataccgcggtcgtagttgaaggccttggtctcgtaggcgaagtcgatcgagcccgtcttgtagcccacgttgcgcgtgtagtcgccgagccccgtcacggatatcctcgggatcatgatctccttcgcgttgcgccccgcgcgtgccatgcgtgcgggcgagttcaggtacgagctcgtcgcctcccgctggtagacgcggtccaggatggtcgtgtagttcttgattgctgcgatgctgttggccatgccctagccctccttgccctcgtcggtgaggcctgcgattctctcccagcgcttcatgtactggtcgtcagagccaccggatgcgcccgccggctccagaccggtggcgccgccttggcccgggtctccggcgtcgaagagccacggctcggccttcgcgagcgcggcgacgtctccgtcgtgctctgccaggagcgccttcgcggcggtgacggagcgggcgcccgcgcttctgagcgcgaactccgtgcgctcgtcggcgaggcgggccttcaggtcggcgatctccttgccgagcgcctcggtggcttctgccgtcttggcggcctcggcaaccttcgcctggagcgcctcgatctcggcgtccttggccttgagctgtgcgacgtagtcggtgccgtcgtccccgttcaccgcgtccttctggggcgcctgctggccctgcttcgactgcgcgccgacgccctgctcctgcccgccctggtgctggttctcgccctgcccgacctggtcctgcgcctgctgcacgccactgggctcatcctccattgcgaccgcctttccgcgtcgtgcgggcaaagaaaaatgcccgcaccttctaggtacgggcattgtcctggggtgtcacaagggggtcctaggatgcgaggattaagggcgctacttcaacaatccttggcttttgcgccactcatacgtctcccagtaatactcaacgagagtcaggcagctcccaacggcgagctttgcgtggcgaacgggaaggggctgaaactgtgcggtgtgcccatggccgtccccataggcattgcgaaattcaatgacgccggtcgcaagaccctgaaggctaccgaggatttgcttaacgatcttaccttcgggaccattcgtatctacatcgccgacggcgactttgagcagcttcgcagcctctttagataacctcggggcatcccagtcgtctggtatgccaatgccttggttggcaagaatcgtcttgcagcagctctcgagaacttcttttgatttgccaatggcatcagtcggatgctcggtgcgcatcttcataagaaggtcgatctgctcgttcatggactcgcttgagaattctttcttgatgaagtctgccgattgcttgtacggcgatgcgatagatttctcgcgctcaacgaacttcttgcattgacggtatcggggaccgtagttcctgtccgcatactggggatgcgggtagtcatcccagctctcaaactcgcactggtatcgagtctcgtagtattcgaagaggtcgaaaagaaggtgctgtgagtcgacgaggctggcttcgttgatataggcaacaagggacttcccctttgagagtcgatagtgctcgcacagggggattcccactgagcccagggtaaaggtgtcgaactcattcgtgctgaagtcgagaacccagccgcccctgttaaagaggtcgcagagaaggcccatttcgttcttgctaagcatatggggcgtcctaactcagaaactttcctagggcccccatagccaaaggaagtagcaccttggccaggtcagagctgctctttgccaggcttgccagcttctcgagcttttccgagaaggtcatttggtcacgggtgctggaagcggcatcaagatccttggccgccttgagagcctgctccttcaaaccgctgtcaacgccatctatgtctatgattgccttcagcgttgtagtaagggagacgtccttgacgtttacactggagtcggaggaagactcagcgtgcgaggcggcatcgatgttaatcgtgggagtgaacttgttgatgattttggtgccgctttccgagcccatctgatctaggaaccatccttccgcatagcttcggccattgtcggtcacgatggccgacgtgagcgtgtcgtccgctgctagtccgtctatgagcccgtgtcgcttcaatgtccagtaatcgacgatgcggtcttcgtccacagtgacgaactgcatttcgcctgctttcttgagggccttatcctcggctgccagctcaagagcgagctcgtctgcctcatcgtcgaaggctatgaaggcgcggcgctgtgccctggctgtatcatagtgcgatgcgccagagctggtcaggttctgaaagtagacatggccgctaaaatcggcctcagcctttatgagtccccgctctctgagtgtcatcgccccgcgggagtgcttcttgcataccggctggccgaaagggccatcctggtgcaggtacaggtaggcgagggccgcctcctgctcaacagtcaaaccgttcaaataaaactcctagtcatccaaataccgctaaggcgatgtatggggttgaaagcaccgccagggtgttttaccttgctagatgtaatggaggaggcaagcccgccagaacccgcctcctcacgcagtgcatagggcctcgaggggagagtacctttggggccctacttctttctcacgcgaacgtgaacgtgccgggtgacggtgccggtcttcacgatgcgaccgctcttagtaacccggaacttgggaattcgtaccttaaccgtagccatagaacaccacctttcagcgctatcgaaatcgttccgttccgtctggggccgtggtttgccggtcacctcctcgcgaattgggacacagctcgggcgtctatggggaagatagcaggaagtcatgtgatttacaatccttgtcccaaaacaagtttactttgtcctatactgtctttgtcaggaactaggatagggacagccatgaagaagcgcaacgtcatcaacctcatcaggtatcacgaggaacgcaacgagtccgccttccgcagcgaggcggccgagatagcgcgtgacttcgacgccagcggggactatcagctcgccgaatacatcatggcgctcgtctcggacgcgaatgccttcgtgccgcaatccgatgacgagggcggattcttccgcaagctcgaaccctcctcttcgccgctgccgctgcccgaggccatttcggcggacgtgacaggcatctgcaacgccatcgcgcacaacgccggcgtcaacaagttcctcttccagggccctccggggacgggtaagactgagacggcgcgacagatttcccgcatcgtcggccgggagctcttcgcggtcgacttcaacgtggtcatagacagcaagctcggccagacggccaagaacatcggaagcctcttcgagcagatcaactccctacgcttccccgagcgcgcaatcatcctcttcgacgagatcgatgccctcgcactcgaccgcatcgatacgcatgacgtgagggagatgggacgggcgacctcggcgctgctgcgggagctcgacgctatgagcgaccaggtggtgctcatcgcgacgacgaacctctacggctccctggacaaggcgctttcgaggcgcttcgacgcgatcatcgacttcgggcgatacacgcgcgaggacctgctcgatatcgcggacgtgctcctcagcgggctcctccagaggttcaggggggcgggccgcgacatgcgcctgttcaggaagatcatgtcgcagatggaggagattccctatcccggtgagctcaagaacatgctcaggagcgctctggcgttcagcagccccgatgacccctacgactacctgcgcaggctctatgcccaggcctgccccggatcgcctgtgagcgatctcgcgcgcctgcgggagcaggggttcacgatgagggagatcgagaagctgtcgggcgtcccgaggagcacggtgtcacgcgagctgaaggggggctccgatgaatgacctcctcgagctcaagggccagttccagcacagcaaagcccagcagcccggcgccccggagctgccgaggggccagaaggtaacctcggataagttgcgctcgctcgccagcgacttgtcccgcatccgggactacttcgaggaacaaggcgtatcgttcggccccctcgtgagcgcccactacaggacggtcgtggcaaaaagcaaccggattcgcagaatcctggggagcgacggcaacgcgagcaggcacatcgtcggggcgaggttcgagggcgagggtgctgacacgcaccatgtcatcacctactgcgtcggcgcagacgtgctcgacgagagcatcgacgttctggcggcgtgcgccaacgtcgtagacgagcgctttgctggggcgattgacgacgagggcctgaggagggtcaacgcggggggactgagggaagacgcgggcatcaagaagtcggcattcgcccagataatacgcgacgctcactacgtgacgcggttcgacgtgcagaccaccacgagggacatcgacgaaccggcagtcgtgagcatatacgacgtcggatatcgtgacgtgcgagccttcctcgcggacctcggcctcgccctcacacccgacagggtgctgggcaactcgttaaggctcaatgccgacgagtacgcgaggctcgcttcccgctatccctacctggtgtcgatggccgtatcggacatttcgctcctcacacaggacgatttcgatatagagcggccagaggtcgcaagcattcccgaacccggcgacgagccgatcatcggcgtcatcgacacccctttcgatgaccgggtctacttcgctgactgggtggaggaccacaacctcattccggaggagatcggaacagagtatagcgacatggtccacgggacggctgtgacgtccatcatcgtcgacgggccgaacatcgaacccgacctcaatgatggctgcgggcgcttccgtgtcaggcacttcggggtcgccaagggagagcgttcgagttcgtttggcttcatgaggcgggtcaaggaaatcgttgagcagaaccgcgatatcaaggtgtggaacatctcgcaggggtcgatgctagagatagagcgcaactccgtgtcgccagaaggcgccatcctcgatgacctgcaggcaaggttcgatgacatcgtgttcgtggtggcggggacgaatcagacgatcaatgggaaccaggtcaagattggtgcaccggctgactcgataaactccctcgtcgtgaatgcgacggacttcttaggtcggacggcgagctattcgcgtaggggcccggtcctcgacttcttcaagaagccggacgtgtgtgcggtcggtggcgacagggaccggcccatgcacctttgcgtgggcactggcgagaccttcaagtctggcacgtcctttgcggccccctgggttgcgcgcaagatggcctacctcatgcaggtgatggggctgccccgcgaggttgcgaaggcgcttatcatcgattcggcggctggctgggactacagggccgacaggtatcgaggctatggccaggtcccgataaggattgaggacgtggtggaggcccagaacgacgagataaggttcttcctcgctgggtcggctgacgagtttctcacctacaactacggcatccccgtgccaatagtaaaggaaaagtatccctacgtggccagggcaacactctgctacttcccgaagtgcgacaggcgccagggcgcggactacaccagcacggagatggacctccacttcgggcgaatagacaacagggggaaattgaaggcgctcgataacaaccgccagggcgaggagggctacacgaccaccgaggaggttgcgcgaaagaactaccgcaagtgggacaacgtcaagcacatcggcgaagcgttcgggggcaacgttcgcgagcgcaaggcctacgacacggggatgtggggaatcaagatacgtacgacggagcgcggagatgagaagcttggccgtggcatgagattcggtgcggtagtcacgttgaaggaaatcaacggggttaaccgtatagatgacttcatccaacggtgcgccctcagaggttggattgtcaaccgggttgacgtccagaaccgcattgatatatacaacgccgccgaagtagttctacattttgatgaatgaccattctggggtaattgcgatagtggtaggaaaaagagaagaaaagagcgacatgaacgataacgcaggagaagaatatacggcaataatgccttttgacagcctatatcaggcttcaagaaaagaggcaagtaggaaaaagccagtctttttcatacataaatacttcgctcgaagaataactgctaatttcagaatggccttgttaggttttatggcaagtcgaaatgacgacgtcttaaaacaattctatgagccttcacctaatcgggaagatattactgttttagacccgtttatgggcggtggtacgacaatccttgaggccctcagatttggatgcaaagtaataggcaatgacttacagccactgtctttattcgtgacgagagctctcgtagagccaatggatacaaaagccgttgatgcagcggtaagatacctcgggagaacagtcggcaaagagatacaaaactattacaagacaaagtgcccttgctgcggtgaaacagcagatgtcatgtatacctttcatgtcaaaaaggtaaaaacagggggacaatgcaaagagcatagatttttttcaacttttattttggcatataaaaagggcgaatttactgtcgtatgtccagaatgcgggagagtatccaagacaacgttcaaggacggtcctttccactgtgagtgtggatgggaactgaaggatcctcatagttcatatgtcaagaacggtgtatttacatgtccgaagtgtggcgagtcgagggttctatccgaatacagtaatgaccctgactctgggtatccttttgcaacagatatcgttgctctagagtattactgcccaaattgtggcgcccatgattacaagcagccagactacgaagacaaagctctctatgaaaaagcaaaggctgattactgcaagtatgctgaatcacttccgataccccagcaggtgattccagcgggctataacacaaaccagataattaaccatggatatcgaaagttcaaggagctttttaatgaacggcagctgctttgcttaggtctacttttagatgcgattaacggaatagatgacaagcagacccaactctggttacaactcgcattctccggaatgctagaaatgaatacgatgttttgccgataccaacagaatgcgtataagatatgcaacattttctttaatcatgcctatgttcctatcactatgccagtcgagaattgtgtttggggaacaaagctgggaaccggaacctttatcaaaacaatcaagaaaattgagcgtggaaaaaagttcaatagcaatatgtatgatatttcagttgtgaagaataatgaaggtagatatgattcggtgaagaacttcaacggggatcaggtagctgctacaccagttacagtattcgataaagttgacggacaacacccacttttaagatgctcggattcccgagatctttcttttattccggacgcttcagtagatttggtactgactgaccctccttatggggcaaatgtcatgtattcagaactaatagacttttttcatgtttggaattataaaagcacgctggccgacgacttgggctttacggaaccgctttctcctaaatcaaaagagattgttgttaatccggtcgccggaaaagacattcagtattacgaagagggtctcacgaaggtacttgaaagatgccatgataaggtacgggatagtgggtatttagtcttctcgtttcacgataagcatctggaaagttggctggcggttctggaaagtgtctgcaaaggcggtttcaagttggtgaaatgctacccggtgcagtctgaaacaagaactggcgcgcatacatcaaacaagaattcaataggaattgatttaatgcttgtttgcaagaagatttcgttaaacgatgcgggtggcaccgtgccagggatagatgtaaaagacgccagtttacaaacgatgaagtatctttgcaaaacactcgataggctagaatccgtagaggcggagataacgttgcctgatatgcaaaacattgctatcgcgtactactattccgtactgcctacagcttgccttactgacgaaaactggcgacgcgttgcagttaaagaacttaagcaaaccctgagaaatgtagaggggttgtcaaaagactacacaatcgctgataaaaggactggctggtggtctgagctctataaaaagaaatgggatgtatgattgtttgggattcattagctagttagttagtcaaaccgattggcgattattccgttggagatagataacgggaccatacaaggtatggtcccgttatctatgggcgttttacctcccgtaaagcagctttagcttgtgattccaggcatcattgtcaagagtcgaattctgaccagtggcagcaacctgagctttccaatcattgtgatcaagccacccaaattttattctctttattgaaggagttgggttcgagacttcgtatttttcaaagttgattgctaggtaatacccgtatttctgtttaccagaattatggatactattcttttgtccatagctacggttgccgaagatcttgttttgagatgacgttttaatctcaatcgaataactatcatctggaatataaacaacatccttgtcgcttttatcttgttctgctttccactcagcaggatggctaatggctaaaagtgctgcgataagcatgtggaggtagtttccagttatttgcggactcggaaatacatctttgcctatttggaggagtccaccaatcttcgtatccctgatgcgctcccaagcatcaatcgtgacattgactatttcctttctctctgttagaccaagattgacctaagcaagccgataagcgtccggggccccgactacgattcgtgtcgccaaacaccagaatcgaaggggagggccccggacatgcttgacatgatactgcaaga

SEQ ID NO: 252 - DNA, 2523 bp, Unknown
  Metagenome-assembled genome
ggtcgcggcggtcgcgctcatgaaccgcttctgccgccgctacgtgtacgaccgcatcaccggccccatcgggcagctggagcgaggcgtcgagcacgtggccgcgggcgacctctcgtaccgggtcgactaccgcggcgacgacgagtttgcccccatcgcgcggtcgttcgaccagatggcgcagggcctgcaggacgcggccgcgcgcgaggagcacgagcagcgcgcccgccaggagctgatcgcctacatctcgcacgacctgcgctcgccgctcacgtccatccgcggctacgcggagggcctgctcgacggcatcgtcaccacgccggagcgccagcggcgctacgcctcacgcatcgtggccaagacggagcagatgagcgagctcgtttcgcagctcttcctcttctccaagctcgacctgggcgactttccgcaccaggagcgccgctgcgaccttgcggacctcgcgcgcaggctggtggagaagagcggggacgactacgcccagcgcggcatccgcctgcggcttggcacgtgcgagcccgcccccgccatggtcgacgcgtcgcttctggagcgcgccgcgggcaacgtgctcgaaaacgccgtgcgctatgcccccggctgcaccgtcacgcttgccgtgagcagcggcgcggacgggtcgcggctcacgctcgcggacgacggccccggcgtgcctcaggacgcgctgccgcacctgtttgagctcttctatcgcgacgaccccgcgcgcagcgcccagaagggcggaagcgggctgggccttgccatcgtgcagcgggccatggccgcgatgggcggcacggcgctcgcgagccgcacgccgggcggcgggcttaccatcgagctgagcttcccgcccgtcgacgcacagcctgcaggcgagccgcccgccagcggccagcccgcagacgagcagccaaccaacaagaagggggaggtgtccgcgcgatgaccgcataccaggtgcaggctcccgcaaggatcctcgtgattgaggacgaccaggacatcgcggagctcgagcgcgactaccttgaggcatcgggctacgtggtgaccctggcggccgatggccccaagggtctggcgctgggcctttccggcggcttcgacctcgcgatactggacgtgatgctgccgggcatggacgggctctccgtctgccgccagctccgcgagcgcaccagcatgcccgtcatcatggtgacggcccgtggcgaggatgtcgacgtgatccgcggcctgggcgtcggcgccgacgactacgtgaccaagcccttctcgcccagcgtgttggtcgctcgcgtgagggcccgactcgcggaggtgcagcgcctcaggggagaagagcgcacggccggtcaggagccgctgcggatggggcacgtcgtgttgaacccggcgtcgcacgaggtgagcacccacggcaggcccgtcacgctgaccaaccgcgagtacgagctgctggccttcctcatgcgccatcccaacgtggtgttcagccggcaggcgctgtacgagcgcgtctggcgcgaggacgccgtgggcgacggcgctacggtgacggtccacgtgaaccgcctgcgcgagaagctggaggacgacccctcacatcccgagctgctgcagacggtgcgcggcgccggctacgtcctgcgcgcgcccgagcgcgggtagcgctcgcgacttgggtataaacccggacatggcaacgccgtcgatggaggccgcgcgatgaaggaatccgagtgcccgccggaatacaagaaccccaggaacccatacttcaggagcctcgtcaagcagggcaggctctgcccctcgtgcggccatcccatgtggttcagggtgtccaggggctccgccgactttggctggtggcggtgtgacagttgcgggcgcctcgatcgcgagattgcgcccgagggcatgcgcgtcggcggcacgcagtgcgaggagcccgatgacgacttggatgctgacattgagcagcccgacggctgggatgacgcgcggtctgacaacgagcagcctggcgtacggaccgacgccggcggcgccaaggtgctgcagttccgcccgaggggtgggcgcggcaggcgctaggtccctgccgcggctactcgatcttctcgaacaccatggtcgcctggatgcggtcgccgccgcccaggcccttgctcccgccgtttgcggtcgagatggtgtgcagccggtagcccttggccgcctggcggttgatcacgtcctccagctccgtgaggttgcccgagcccgtgccaaagaacttctccttgagcgttacctgcagcaccacgtagtggtagctgtttccggacgcggtggagaaggacgactccttcttcatgtcatcgatgaatcccatgtgggtcccttcgttgtcggcgattgttgcgagtcgagatgatactcgcctgagcgttttgcgcccacttggcccaaggagtacgtcggattccacgttta

SEQ ID NO: 253 - DNA, 12933 bp, Unknown
  Metagenome-assembled genome
gcgggggagaaggacgcgcggcaggctgctcgcggccatcgcgtggctggtgctgggtgtcgcgttcgagatcctggcctccatcccgatacagctcctcaagctggactggaacctctccatcgagctcgccgtggccgtcttcatggcggtgggcgtgtgcgtgctgggcgcgcggcgctacctacggccgtccgcggcagccttccgcgaggtatggcacctgggctggcccatcatcttcacgagcgtggccctcacgatgctgcaactggtgggctacatccaggacggcacgcgcatatcttccaactggctgcccatgaccctgtactacgtggcgttctgcctgagcatcggcgtgcacgaggagtgctgcgtgcgcggcgtgctgcagatgggcctgctctcgcgcctgggcggcagccgacgcggcatggcggttgccatcacgctcgcggccgtcttcttcggctgcctgcacatcgactggacctcgctcgactaccacagcgcgctccaggtggcgcaggccgtgctcaaggtggggcagacgggcgtgtacggcgcggtcctttccgtcgcggtgctgcgcagccagaacctcaccggtgcgatcctgttccacgcgctggacgacttcagcgtgatggtggtgccgtacgcgctctatggcgaggcactcaccaccaactacgtgtcctccggccgcgcggacgcgatctactccatcgtgatgtacgcgacgctcatcgtgctgtacctgccctcgctcgtgcgctccatccgcgaggcgaggcggcttcccatgccgcaacgtggcggtttcgtgagggagaaggacgaccgtcccagtggcgagcctcccgcgcctgcgggcctggacgcacccgcgaccatggtcaccccgcagcacgccgcatggatgcagtctgacgaaacagcagatagcggcaccaatgacccgtggggcggtctgtagagcgcccgcgacgcatgggccgtgcgcggcaacgggcccacgttcttctcgccccggcatgcctaaaaacacgcccctgccacgccttttgtaaggggagttttagcttagctgcagcgatggagcgttacgttctgctaacatggcgcttgcaatttggtttcgcccgcaggtgcgaggcttgcaggactgcgtggcgtcgtgaaaggctacccaaacatgagtcgtgtgtcacgcaaggaagacgcgttcttcctcatgttccaggagttcagcaagatgacctccgaggccgcggagctgttcctggacattgtgcagaactatgacaagctgtcgtaccgcatccccgagctcaaggagtacgagacgaggggtgacgagcaggtcagcaagatcatgaccacgctcaacaactcgttcatcacgccgttcgaccgcgaggacatcagctcgctggcgctcaagatggacgacatcctcgatgggctcgagaacgtgtccgcccgcttcaagctgtacgacatcgaccacatgcgccccgaggccatcgagatggccaagctcatcctggaggcgacgctcgacctggaccacgccttcgcgaagttcccggacttcaagaaggacgagtcgctcctgaaggagaccaaggccgccaacgacgccgaggacaggggagacgtggtctaccgcgacgggctcgccaccatcttccgctccgacatccacacggtggacatcctcaagtggaagagcctgctggacaagatggagaacacgctggacgcgtgcaagaacgtggccaacgagatccagaatgtcatcgtgaaaaatggttagcgtccttctgatctgcgtgctcgcggcggcactcatattcgagttcatcaacggcttccacgacacggccaacgccatcgcgacgacggtctacaccaaggcgcttccgctgcgcgtggccatcctcatgtccgccaccatgaacttcatcggcgcgttcacgagcgagaaggtcgccatgaccatcgccgcgggcatcgtgaacatcaacctccagctctacgtgatccttgcggcgctcgtgggcgccatcctgtgggacctcttcacctggtggaggtccatccccagctcgtcctcgcacgcgctcatcggcagcctcatcggcgcgaccatcgtcttcacgcactccacggcccacatcaagtgggagggcgtgctcgacaaggtcgtgatcccgctcttcacgtccccgctcatcggcatggcgctgggctacctgttcatgaagctcgtgttcgagctcttcgcaaactggcaccccatgaaggccaactcgctgttccaccgcatgcagatcctctccgccgcgttcatggcgtacagccacggcaacaacgacgcccagaagaccatgggcatcatcacgctggccctggtgacggccggcctggcggacccggcggcgggcatccccatctgggtcaagatcatgtgcgcctgcaccatggcgctgggcacctccatcggcggcggccgcatcatgcgcaccgtgggcgacggcgtgaccaagctcaaccccgtcatcggctttgtggccgagacctcctccgccatcgcgatcgagaccatgactgcgctcggcgcgccggtatcgaccacgcaggtcatcaccacgtccatcatgggcgccggctccgcgcgccgtcgcagctccgtgcgctggggcgtcgcgcgaaagatcatgagcgcctggttcgtgacgctgccggtcaccatcgtgctgggcggctgctgcgcggcgctcatcggcctcgtgctggggtagggtgcgcttggcgtgagccgccagcccgaaccgaattaacttctagcccgtgggccgtgtgcccgcgggcatttttgtgccgcacgccgtctgaaaccacacggtaacgggcattgcgtaacatgcttatctacttgttgttcttatatagacgcatgcgatctggaagggttgctgatgagcagacaggcagacgttctgaccatgccgcgcgagaagatcgagcaggtccagctggaggggcttcgcaagaccgcggtccactgctacgaggacatcccgttctaccacaagagctttgacgaggcggggtttgacccgtactccatcaagagcctggacgacgtgcgccgagcgccctttgtgaccaagcaggacctgcgcgacaactacccctacggcctggtgggcgtggaccgcaaggacgtgcgcgaggtccacatgtcgtcgggcaccacgggcgtggccacggtggccgcgtacacggagcacgacctcaaggcgtggtcggagtgcttcgagcgcgccttcgagtttgctggcgccggtcccgaggacgtgtgccagatctgctacggctacggcctctttacgggcggcctgggcgcgcactacggctcgctccagtccggcgcgaccgtcatccccataagcgccggcaacacggagcgccagatccgcgtgctgcgcgagatgggctccaccgtgctggaatgcacgcccagctacgccatgcacatcgcggacacggcgcttgccatgggggtcgaccccgccaaggagttccacctcaaggtgggcatccacggcgcggaggcctttagcgacaacttccgccgcgagctggagcgcaagctcaactacaaggtgctcgacatctacggcctgacgcagacgggcggccccggcctcgccgtggagtgcctggagcagaacggcctgcacatcgcggaggaccacttcctgtgcgaggtgatcgaccccgccacgggcgaggtcctgcccgacggcgagtggggcgagctcgtggtgaccacgctggaccgccaggccagccccgtggtgcgctaccgcacgcgcgacatcacgcgcatcctgccgggggagtgcgcctgcggctgcacgcaccggcgcatcgaccgcctgcagggccgcacggacgacatgctcatcatccgcggcgtcaacgtgttcccgagccagatcgagaacgtgatgaagacgttcgacgaggtgtcctcctggtaccagatcgagctcaccaccaagaactacctggacgtggccacgctcaaggtggaggccaacccggacttcgacatcgactccacgggcgccatcgaggagctgcagcgtcgcatccaggccgcgctcaagaccgcgctttccgttggcatccgcgtgcgtctggtggagcccatgtccatccagcgctccgagggcaaggccaagcgcatcgtcgacctcaggggggagaacctcaaatgatcgatcagctcaccgtctttttggagaactccgagggccggcttgcaaagctctgccgcgcgctggccgacgcggacatcaacatgaaggccctcacgatcgcggacacgactgagtacggcgtggtgcgcatcatctgcgacgacgcggagcgcgcccgcgactacctggaccagaagggctaccgcgccatggtcaccaaggtgacggccatcgaggtccccaacaggccgggcggcctggcggacctgctgggcgtgctggacgacctggacatccccgtggagtacggctactgcttcagcaccgccggcgaccgcgcggtggacatccttaagatccgcatcgcgtccgaggcctccaaggccgtgttcaagctggaggagtccggcttcagggtgctgacgcagaaggacctgtaagcaaagacctgtaagtaaaggtggtgcgtccttctccccatggcacgtaaggcacgggcgagaaggacgcggcgtgccggccgcgcggccggcggaaggcggcggcgtgtgggttgcgcgcccgccgctagttgtgcacgtagaccgtgtcgcccacgcgcacgaggttgtagagctccgcggcgcgtgccggcggcaggttgacgcagccgtggctgcccgcgtacgcgtagatgctgccgccaaagctgccgcgccagctggcgtcgtgcaggcccacggagttgccgatgaacggcatccagtagttgacgtggctgatgtagtccggctcgccgtcgtggtcctcgtccgcgccgacgagcttctcgtccgtgcgctttgcgtttaccttgaacgtgccggtgggcgtgccgttgccctcgctcgtgttgccgctcacgatgtaggagcgccagatcacggtgccgtccttgtcgtacatgcgcgcgtactgcgtcttgaggttcacgtcgatgtgacggccgcggctctcgtgccccgcggactcgggcgggcgcgtgcccaccacgctgagcggcacttccacggcgtcggagctgcccgcctcgagcctgcttgagattgtctttgcgagcccggcggagtcgatggcgtagtcgtgctcctcgtcggacttggcgacctgcttggcgagcgcgccttttgcccacgtggcgatggccccctggtccacggtgacggagaggtcgtccccgactctgacccagccggccgcggtcttgggctccacggtggccagcgccttgccgtcgcgcgtgagtggaacggcatgcgcgaccagcgcgtttgccttggctgcggcctcggtcacggccttgctggtgctggggagcgttggctgcgacagcgcggcgttgtcgatcgtggtggaggtgtgcagggtggaggcgctcttctcgaccgccttggcgacggccgtggcgtcaagagccgtcccgacggactccttcttcaccacgaacttgcctgcgtccttgtcgtaggcgacggtcgcgttctgcgggtgcgtggccgactggttgtgggcgtccacagcttcctttaccttggctgcgagcttgtcggcgtcgtagaagaccgtcgtggcgacctcgaggtgcctgggcgaggcgaggtcgagcgcctagcgggctgggtccgtctgggccttggccttgcgggcgtaggcggcggggctcacgtcgaggtcgacgtcagccgccctgatcgtgacgtcgagcccctggccgcttacgtgcgtggaccaggcgtcggaacccttgcggacccgggccgcgagctgcgacgtcgtgaggttggacacgtccgcgccgttgacggtggtgccggggacaaagtggtccgtgtagtactgggcgcccgcgaactccgcgcaggcgagcgcgaccgccgcggcgcccagcgcgatggcgacgtgcctgccgcggtgcgggtgggccttggcgttgcgttttgggctggcgtccgtcgcgttcgcggacggcgccatgtgggttgcgtgcctgggtgcggtgctccccgtggttgccccgctgctaacgtttgcgtccctgtgccccgtcacgtccgggctcccttcgcccctgtgccccccgcgtgtgctgcgtatcgagagattgtagctgaaggcaaggtaaaggttaggctccgtgtgggacgctggcacaaaaagcgcccctctcgcatgggcgagaagggcgcggggcgtggcggttgccgccggtgcggcgtggcgcctacgagatggaggcgaaggcgtcccgaaggaccttgcaggaggagcgcatcgccttcttctcctcctcagaaagctcgagggtcagaatctccttgatgccgttacggccgaggatgcaggggacgccgacggagacgccctcctcgccgtactcgccctccaggtggacggagagcggggtaacgaggcgctcgttgtggaggatggacgcgatgagcatggccacgaccgcgccgatgccaaactccgtggaacccttgcccgccacgatcgtgccgcccgccttgtggacggtctccgtgaggtactcgtggttgagcttgctctggagctcggggtggctgcgcttgtactcctcgagcgagatgccgccgatggtgacgtgcgtgcgcgggatgaacgacgagtcgccgtgctcgcccatcacgaaggcgtctacctggtcgcggtcgacgtccacgatgctcgcgatgtggcggcgcaggcggacggtgtcgagcgacgtgcccgtgctgaagacgtgcgtgcgcggcaggtcgaggttgcggtagaagtactccgccacgacgtccgcggggttggacacgcagatgaggaacccgctgaagccggacttggcgatggggtccacgatgccgcccaggatcttgaacgtgctctggagcatctggaggcgcgactcgccggggcgcctgctgcggcccgccgtcatcacgatgaagctcgcgtccttgcagtcgtcgtaggtgcccacgcggatcttgacgtggcggtgcgtggccgtgagcatgtccttaaggtcctcgacctgggcgtttgcggcagcctcgttgatgtccaggaatacgatctcctcggcgtactggccgaccatgaggttgagggccacgtgactgccgacgttgccggctccgatgatgactaccttgcgcgtaaagtccatcgttcttctcgctttctccctaaagcccttgctcgggcatatctgtcgaccccattttcgggttttgtgaatgctggtgtggtgaaaatgagaaattcgccgcttgcgggcaggttcatacaactcgcggttgtggggttgacgaggacgaactccttgttaggagggccttccgtcgctctggggcatggccgtactctgtcgcttgtggccatttccgcaggcgcaagcccagacggacggctttggggcattataagtacgacaaggtttactaaaggaaggctcaagatggcttctaacgcgtcccaaccagagaagacgctcgcggatatagagatcggccagaccgtcaccatcacgaccgtgggaggggagggcgccctcaggcagcacttcctggacatgggcgtcatcccgggggcggacatcacgctggagaagtacgcccccatgggcgacccaatggagttccgcgtgcacggctaccagctcacgctgcgcgtggctgatgcccagaagataggcgtctgcaagcagcgccgcgcggaggcggggcagcgcccgagcgccgccaggcacccggagcgccacccgggcctgggtgaggacggcctgcccagcaaggtggacgtccgcacgagcgaccactcgcaccccgtgcccgagggcgaggtgctgcgctttgcgctcgccggcaaccagaactgcggcaagacaacgctcttcaaccagctcacgggtgcaaaccagcacgtgggcaacttccccggcgtcacggtggaccgcaagagcggtgccatcaaggggcaccccaacacggacgtgacggacctgccgggcatctactcgctgtcgccgtacagtcccgaggagctcgtgagccgcgagtacatcctgaacgagaaccccaacggcatcatcaacatcgtcgacgcgaccaacatcgagcgcaacctttacctcaccatgcagctcatggaactcgacaagcccatggtgctcgcgctcaacatgatggacgaggttcagggcaacggcggcaccatcgacgtcaacctcatggaggacatgctggggatccctgtcgtgcccatctccgccgtcaagggcgagggcgtggacgagctcgtgcgccacgccatccacgtggcgcgctaccaggagctcccgggccggcaggacttctgcgaccctacggaccacggcggcgccgtgcaccgctgcctgcacgcgatcatgcacctcatcgaggaccacgcccagcgcgcgcacatccccgtgcgctttgccgcgtccaagctggtcgagggcgacagccacgtgatagagtccctcgggctcgagcagaacgagctcgacgccgtggagcacatcgtgcgccagatggaggaggagcgtggcctggaccgcgccgccgccatggccgacatgcgtttctcgtttatagagaagatcgtgtccgccgcggtcgtgaagccgcacgagtcgcgcgagcgcagccagaggatagaccgcgtcctcacgggccgctggaccgccatccccatgttcgtgctcatcatggcggccgtgttcttcctcacgttcaacgtgatcggcctcttcctgcagaaccttgtgcaggcgggcgtggacgcgctcacgcacgcgacggacgtggcgctcacctccgcgggcgtgaaccccgtcatacactcgctggtcatcggcggcgtcttcaacgccgtgggcaccgtgctccccatcgcgcccatcatcgttaccatgttcttcttcctgtcgctcttggaggacacgggctacatggcgcgcgtcgcgttcttcatggacaagctgctgcgcaagatcggactctccggccgctccatcgtccccatgctcgtgggctttggctgcaccgttcccgccgtcatgtccgcgcgcacgctgccgtccgagcgcgaccgcaagctcaccatcgcgctcacgccgttcatgagctgctccaccaagctcacgatctacggctactttgcggccgccttcttcccgggcaggggaggcatcgtggtgctctgcctgtacctgctgggcatcctggtgggcgtgctcatcgcgctcatcacgcacaagaccatcgacaaggccgaggccgtgccctttgtgatggagctccccaactaccgcctgcccagcgcgcgttccgtcctcatgctcatgtgggagaagaccaaggacttcctgcgccgcgcgttcaccgtggtcttcgcggcggccgtcgtcgtctggttcctccagagcttcagccccgccctcacgctcgtcaagagcgagcaggactccatgctggcggcgatcggcgcctggatcgccccgatcttctcgcccctgggctttggcgactggcgcatcgcgacgtcgctcatcgcgggcttcatggcaaaggagatcgtggtggccacgctctccgtgctgtttggctccacggcccagctgctggccgcgctgacgccgctttccgtggtgtcgctcctggtgttctgcctgctgtacacgccgtgcgtggcggccatcgcagccatccgccgcgagctgggcggcaagtgggcactgggcatcgtcgtgttccagtgcgccgtggcctacctggccgccttcctggtgcacgccattggcctgctcctgggcttcgcgtaggggagaagaccgtggcatccaggcttgcgccgtgttagaatgttggaaagtaataatttccgacttttgacggaggccaggatgctcacgacgctcaaggacaagggccaggtcacgattcccaagaaggtcgtcaacgagttgggcctcgtgtctggcgatacgttcgacgtctacgtcgaggacggcgagatccgctttgtcccagtggtcatccgccccaaacgggaggtggaacgcctggagcgccttgccagcgaggccgaggcccagctggtccacggcgagcttcccgtatacgatgatgcggaaagcgccgttaaagacctgcacagggcgggctaacggcaatcaatctacgtgtcgcgatcaagcgggtgagaagaacatggtgagcctggcagacatgctgtcccaacagaccgaggaccagctgattctggtggaccttctggacaggcccacgggtagcatgggcaagcttgcgtgccaccaacagggcaggctgcaccgtgcgttttcgctcttcctgtaccgcaggcggggcggcacgaccgaactgctcatccagcgccgagcggagggcaagtaccattcgggagggctcctggcaaactccgtttgctcgcatccgcgggtgggggagtcgcttgcgcaggccgtgccgcgtcggctcacgcaggagctgggcgttcccacggacgtcgcgcagggtcttgactatcgtgaggtcggctcctttgtctatcgcaccaagttcgcgaacggcctaacggagttcgagtacgaccacgtcttcgcggcggagtttgacggcacaacagaggatggcacgcttgccccggatctcgacgaggtggccgccgtcgcatgggtcgatgcaagcgagcttcttgaggacctgcaggcgcacccgtcccgctacgcgagctggttccttacggcggcgccgctggccatgcgtcaaatcctgggataggggcgccgacgcctagccaatcgcgctcggctgacccagctcgatccgcgctacctccgtgtacgtgagcgcgccgcccgccgggtggtggctccacatgagcgacatcgcccccaccggcatcgcctgcggtcccgcctcgccacgttccccatcaagctcgcaactaacgcgggcgagaaggtcgtccatgccgcccgtcgcctcctcgggacgcgggcggcatcctcgtgcgagcgtgaggtgcggcgtgtaggcatccgcctcgagctcgatgccgtttgtcgcgagcgctgcggcgaggtccgactgcagcgccaacagctggcgccgtcccttccgctcggcctccggcacgccggcaacgccctgccacacgatgccgccgcgccgcttgccaaagcagcccaggtcccccagccagatcctgaacggggcgccgcccccgtccgcaaacgtacgtgccgcgtcgcgcatcgccgcgagcgcgcgggcctcgtgctccgcgtcgagctcgcccaggaaggcgagcgtcaggtgcaggtttgcggcggcggtgggcttccccttggcaaggtgggggagcagcacctcctgcgcgcgcaggagctccgcccgcgcggcctcgtcgggaagcaccgcaacaaagagccgcctccgtgccgagggggtaccgttcgccgacgccgcgtccttctcgccccgtgccgccttcttgtccatgggaggcctccgtccatacgcagatgttgctacaggtattcatgaatcaatatagcggcttgctggtatttggtttcacataccatgatgcacgaatttgagtcgctggtatttgctttcccatacaagtcgggacacaaagctggtgcaatgattgcaacctgtgcttaacatatggaaagcgaatccgcaaccttaaaaattcaatattacgtttgcagagaaaaacgaatcacccgcatgagaaatcgttatcattcggtacgtagaggacaaggcgacgcttgcgatgcgtcgcttgtggcaagggagccgacgcatgccggcgatcgcgccggaaggtaggcgaagcaggatggcacaaccagacatcgtctttgcaaggatcgacaaccggctcgtccacggtcaggtgggtgccgcctgggtgggctccatacccacctgcaatctcatcgtcgtcgcgaacgacgccgccgctgccgaccccgtccagcagtccctcatgaagctcacggcggacgccgcgggcgtgggcatcaggttcttcaccatccagaagaccatcaacgtcattggtaaggccagcgcccgccagcacatcttcatcgtgaccaagactcccgcggacatgcgtaagctcgtcgagggcggcgtccccatcaaggaggtcaacatcggcaacatgcacgcctccggtgacaagcgcgtcttccacgaccagcacgtctacgtggacgaccaggacctcgcggacctcaaggccatccaggactacggcaccaaggtctacatccagctcaacccgaccggccgcaagatcgaggacctggggctctagctactgatcggcgcccgcgtggggcaccgcaagcatccggacaacttcatagcacgcactgacatccatcgcttattggggtcctgcttccatggggggagaaggacttgggatagggaggaagcatgcaacttacacttgtgcaagggcttctgctgttcatagttggcgccatatgccaattcgaccagcagaccgaggccttctattggttcaggccaatggtcgcctcgttcttcacggg

SEQ ID NO: 254 - DNA, 54891 bp, Unknown
  Metagenome-assembled genome
aaaatattcgattctggcttgcgcgggcggcaatgtctgttatagttcctaacgcactaagaaattccccggtggcgcagtggtagcgcagctgactgttaatcagcgtgtcgcaggttcgaaccctgcccggggagccatattccccggtggcgcagtggtagcgcagctgactgttaatcagcgtgtcgcaggttcgaaccctgcccggggagccaggactttcgaggccgggggagaagatcctccggcctctgcttttctcgcccgccaagggcaactccaacactcgcgggtgctctttcgctctttatatggcgaggccatgccccgtgctagcatttccatgtcatgtgacccgatgcttcggaggcaaattgaacgccgaaaagaacgccgcgacgatctccgcaaaggacgcgtggtatccgcctgccaagagggaccgattcatcctcaagcagctcgtttccaaggacttcaagctcaagtaccgcaggagcgcgcttggcgtcgtgtggagcgtcctgaacccgcttctgatgatgctcgtcatggcggccgtcttcggatcgttcatgaggtacaacgacccgtcgctcggcaactacgccgtctacctgatcctgggcaacacggccttccagctcatgagcgacgcgaccagccagggcatgaactccatcatctgggcgtcctcgctgctcaagaaggtcaagatcaaccgctacgtcttcccggtgcagaaggtgctcttcgccgtcgtcaactacggcttctcgctcatcgccatcgcgctcgtcatggtcgtggagcgcgtcccgctcacgtggaccgcgatcctcatgccgtacgccctggcgaccctcatggtgttctgcatcggcctgtcgctcctgctctccgccgccgcggtcttcttccgcgacgtcatccacctctggagcgtcgtgctcaccgcgtggacgtacgcgaccccgctcttctatcccttcaagatcctcccgcactggatgcaggtcgcggagcacttcaaccccatgtacatctacatcacctacatccgcgacgtggtcctctaccacacggttccgtccgtgaacatgcacatcgcctgcctgggctttgccgtcgtcgcgctcgcgattggctatgcggtcttccataggcacgagcacaagttcatcctctacatctaacgcgattgggataggttcagccatggcaaacatcctcaagcgtcccccgattccgcccgaggacgccgagaccgtcatcgacgtcgatgacgtctccatgatcttcaacatcgcctccgagcagttcaactcgctcaaggagtacttcatcgccgcgatgcgccacgagctcaagttcaaggagttccgcgcgctcaaccacatcagcttcaaggtcaagcgcggcgaggcgtttggcctcgtgggcaccaacggatccggcaagtcaaccatgctcaagatcatcgcgggcgtgctcgaggcctccgagggcacctgcacggtgcgtggcaccatcgcccccctcatcgagctgggcgccggcttcgacatggagctcacggccaaggagaacatctacctcaacggcgcgctcctgggctaccgcaaggagttcatcgacgagcacttccaggacatcgtggacttcgcggagctccagaacttcatggagatgccgctcaagaactactcgtccggcatggtggcccgcatcgccttcgccatcgccacgatcacggagccggacatcctcatcgtcgacgagacgctctcggtcggcgacttcctcttccagcagaagtgcgagcgccgcatcaaggagctcgtcgactccgacgacgtcaccgttcttctcgtcagccacaacatcgaccaggtggagcgcctgtgcgaccgcgtgtgctggatcgagaagggccaggagcgcatggtcggcccgaccgacgaggtctgcgccgcatacaagaatctggggaagtaatggctcaggaccaggacatcgacgtcagcgtgatcgtcccgtgctacaacacggaggcgttcctcgaccaggcgcttacaacgtgcgagaagaacgacagctgcaggctcgagatcatcgccgtgaacgacggctccacggacggctcgctcgccatcatgcgcgagcacgaggcccgcgacccgcgcgtgcgcgtgatcgacaaggagaactcgggctacggcgccaacatgaaccgcggcatccgcgaggcgcgcggcacctacatcggcatcctcgagcccgacgactacctgcgcccccacatgttcgacacgctgttcgaggctgccgagcgccacggcatgcccgacatggtcaagtcgccctacatccgcgtctggatgcccacgaccccgcaggagcggctctacaactgcgcctactaccaccgcatcaagcccgtggacgagcccttcacgctcaaggactgcccgcgcctgatccgccaccacccctcgatctggtcagccatctaccgcaagggcttcctgcaggataacgacatcaccttcatggaagtccccggcgccggctgggtcgacaacccgttcctcatccagacctgtgtcctcgccaagtcgatcgtctacatcgacgagccgttctactgctaccgcgaggaccttcccggctcctcctccgtgctgcgcaaggcgggcctcgcgttcgagcgctggggcaacatggccgacctggtggagaagtacggcgtcacggaccgcggcatcctcgagtcgctctacatcatcggcttcaggtacgcgggcggcgcaatcggtgacttcggcctggacgagccccagatccacgagtgggtcacgcagatgttccgccgcatggaccccaacatcgtggcgggcatcgccgcgctgtctggctcgttcaagcacacgtacttcgagctcacgggctaccccgcggtcaagttcagcgacctgccctacatcggcaacctggtgaacgagttcttctacagctggcgcatcaacgggccgggcttcgcgttctcgcgcctcgggctcttcgcgaggcgccgtgctgcggagaagggtctcgccaagcccacgagcacccactcggcctcgatctaaggccggccggcagggcccgagcgacccaatctcaatcggaatttggaacatggccaccaccacgacgcagagtcgggtggtggcccttttcgtgcgcttggcaggtgcccgtgcgggggagggtgcgtccttctcgcccgcgtgttccgttcctgaaaggcggcgctccgtccccggtgcgagtttggtgtttgggcaaattggtgattgcttccggcgggaaagtgcgtatattgaataacgacctttaactcggtgcgagacgccggcaaggaacatacacgccctgcggggcttgggactgccttcctgacgtctgtgtgccgtggtaacgggacattggcgtcttttgttttggaaggagtgccatggctgagaacaagccgaaagcggtcatcatggatggccaggcgatggagcgcgcggtgacccgcatcgcgcacgagatcgtcgagcacaacgaaggtgcggatgacatcgccctcgtcggcatcatccgtcgcggcgagacgctcgcgacgaagctcgctgatgccatcgagtcgatcgagggcaagcgcccgcccgtgggctcgctcgacatcagcttctaccgcgacgacttcatgcgcaacgtggcgcccgtgctgcacggcaccaacatccccttcaacatcgacaacgcgaacatcgtgctggttgacgacgtcctgtacacgggccgcaccgtgcgcgcggcgctcaacgccctcacggactacggccgccccaagacggtccagcttgccgtgatggtcgaccgcggccaccgcgagctgcccattcgcgccgattacgttggcaagaacgtgccctcgtcccacgaggaggacgtgcgcgtctgcatagagcccctcgacgaccgcaacagcgtcgagatctgggacatcaatgtcgaaaagaaagccggaggtgcgaactagatgctttccgtcaagaacctcatcgacacgtacagcctgaccgccgatgacatcacgcagatcctcgacacggcggcggcgttcgagtcggtcaacaacgggcgcgtgatcaagaaggtgcccgccctgcgcggccgcacgatcgtgaacctgttcctcgagccgtccacccgcacgaagagctccttcgagctggccgagaagcgcctgtccgcggactcgctctccatgggcggcagcacctcctccgtcgtcaagggcgagagccttgccgacaccatccagaccatcgacgccatgaacgtcgacatgttcgtctgccgcgcccgcctcgccggcacgccgcagaagatcaccgagaacaccgacgccgtcgtgatcaacgccggcgacggcaagcaccagcaccccacgcaggccatgctcgacctgtacaccatccgcaagcacttcggccacctcgacggcctcaaggtcgccatcgtgggcgacctcgcgcactcccgcgtgtgcggctcgctggcccccgcgctcaagaccatgggcgccgacgtcacgctcgtcggccccccgaccttccaggtcgacgaccccgactggttcggctgcccgcagacctcgagcctcgacgaggtcatcgaggacatggacgtcgtctacatgctgcgcgtccagcttgagcgcatggagggtgcgaccatcccgtcccgccgcgagtacaaccgcctgtacggcctcgacatgaagcgcgtcaaccgcatgaaggacaacgcgatcatctgccacccgggccccatgaaccgcggcatggagatcaacgccgacgtagccgactgcgcgcgctctaggattctgaaccaggtcaacgctggtgtcctcacccgcatggccgagatgtacctgcttctgggaggagagaacaatggcatttctgcttaagggagctcacgccgtcgacccgcaggtgggcctcgacgaggtcgtggacgtccttctcgacggcgactccatcgccgaggtgggacaggacctcgaggcgcccgagggcgccgaggtgatcgacgctgccggcaagtacctggttcccggcctcgtcgacatgcacgtgcacttccgcgaccccggcttcgagtacaaggagaccatcgagaccggctcgcgcgccgcgacgcacggcggcttcacggacgtcgccacgatgcccaacaccgaccccgtgaccgacacgggcaccggcatccgctaccagatcgaccgcggccgcgccgccggcctgtgccacatccgcccgatcggcgcgctgacgaggggcgagaagggcgaggccctcgcggagatcggcgacatggtgctcgagggcgcctgcgccttcagcgacgacggccacggcgtgcagagcgccggcatgatgcgcacctgcatgggctacgtgtcgcagttcgaccgcgtcgccatcgcgcactgcgaggacgagtcgctcaccgtccacggcgtcgtgaacgagggcaaggcctccacgcgcctcggcatgttcggctggcctgcgctcggcgaggagctcgagatctaccgcgacatcgagatctgccgcctcacgggctgcccgctgcacatcgcccacatctccacggagaagggcctcgacctcgtgagggccgcaaaggccgatggcctgcccgtcacctgcgaggtcacgccgcaccacctcttcctcaacgaggacgacatcgacaacacctacaacaccaacctcaagatgaacccgccgctgcgcctcgagagcgacatgatggcgctgcgcaagggcatcgtcgacggttcgatcgactgcctcgtgaccgaccacgcgccgcacgccaagcacgagaaggactgcgagtgggagatcgcgttctttggtacgatcggcctcgagacctcgcttcccctcatgctcaccaacatggtgcgcacgggcgagatgggctgggacaggctcgtcgaggtcatggccgtcaaccctcgcaaggtcctcaggctcaagccggtcaagatcgaggcgggctccaaggccgacctcaccctgatcgaccctgaccgcgagatcaaggtgaccgaggactacttcgagagcaagtccaagaactccgccttcctcggcgagacgctcatgggcgtcgccaccgacgtcttcgtcgacggcaagcacaccctggacaactgcgtcgtcgcctagcggacgacacccgtactatcatggtggcgtgggcgctcgtgcgtccgcgccaccattcttgaaaagggggttcacgtgcagccaagctcaaaggtgcacctgtacgacttcgaagtggcgtcaaacgacgcggtgggcgagaaggtctaccgcctcgtgatgaggtcccccgagcttgcgagcgagctcaggcccgggcagttcatgaacgtggccgttcccggggatgcctcccacatcgtgaggctgcccttctcgtttgcctcgaccgatcccgaggccggcacggtcgagctgatatacgccgtggtcggggagggaacccgcaggctgagcgagatgcccgcgggctccacgtcgaccgtcgtgggcccctgcggcaacggctgggacgtcaagcccggcggccgcgcgctcgcggtagccggcggcgtcggcgcgccccccgtgatcgccgcggcccgcgcgcttgcggaggccgggcgcgaggtggacgtggtgctgggtgcccagaccaagtcgaggctctggggggaggacgatgcgcgcgccctgggcgccggcgaggtggtcgtgacgaccgacgacggcagctacggcatgcgcggcttcaccacccaggcgatggaggcgcttctcgcccgccacgagtacgacctcgtggtgacgtgcggcccggccgtgatgatggccggcgtggcaaggctcgcggagggtgccggcgtcgcctgccaggcgtcgctcgagcggatgatgacctgcggctttggcgcgtgcagcacctgcaacgtggccatgcgcgccggcggatacaagtcgtgctgcatggacgggcccgtgttcgacgcaagcgaggtggcatggtgagcgacgtgagcatggccgtcgacctcggcggcatcaagatgaagaaccccatcaacaccgcctcgggcaccttcggcaacggatggcagttcgaggggttctacgacgtggggcagctgggcgccatcacgaccaagggctgcgcggcggagccttgggacggcaaccccgcgcccaggatgtgcgagctgccctcgggcatcatgaactccgtgggcctgcagaatcccggcgtgagggagttcgtgaggagctacggcgactacctgcagggcctggaggagcggggctgccgcgtgatctgccaggtcgcggggcactcgatagaggagtacgtgcgcgcgctcgagctcttcgaggagctggcacccttcgcctcggggttcgagatcaacatctcgtgccccaacgtgagccgcgggggagcggccatgggcgcgacgccggaggccgcggccgaggtcatggccgccgtccgcccgcgcaccaagcgaccgattgtggtcaagatggccccgcacgacgtggcggagatcgcccgcgcgctcgaggccgagggcgcggacgcgctctcgctcatcaacacgatcccgggcatggcgatcgacgtgcgcacgcgcaggagcaagctctcgcgccccacggcgggcgtgtccggccccgccatacacgccatcgcggtccgcatggtgtgggaggcccacaaggccgtctccataccgctctgcggcatcggcggcgtgacctcgggcgaggacgcggcggagttcatactcgcgggcgccacggcggtgtccgtgggcacgcagaacctggtcgaccccacggcggcgccgaggatcctgggcgagcttacggactgggcggcctcgcagggcgtaagcgacatcaacgagctgattggagccttcgaatgctaactgaggaacaggcaagggattctgtcatcgtcgcgctcgactgcgaccacgcgacggcgctcgacctcgcggagaggctcgagggcagggcccgctgggtcaaggtgggcatgacgctcttctacgcggaggggcccgccgtcgtgcgggagatgcgcgagcacggcctcaaggtgtttctcgacctgaagctccacgacatcccgttccaggtcaagggcgccgcacgctcggcgtcgctcaccggcgccgacctgctgtccatacacggcctcggctcgtcggccatggtgcgccaggcgcgcgagggcgtcgaggaggcggccgaggagcgcggcggcgaccgcacgaggctcgtggcgatctccgtgctcacgagcatggaccaggcggccctctccgaggtgggcatcgacgtgcccgtggagcaggaggtcgctcgcctcgccaagatggccgtgggcgccggttccgacggcatcgtctgctcgcccatggaggcccgccagatgcgcgagctccttggccccgatgcgctcatcgtgacgccgggcgtgaggcccgctggctccgacgtgggcgaccagaagagaatagcgaccccctcgcgcgcaatcgaggccggggcgtcgaagctcgtcataggccgcccgatcacgcaggccaaggaccccgtgtcgagcctcgagtccatcgtggaggagctctgcgaggcgtagacaggcaatacaggccctctacgtggagaaatggccccgaattgtgtatttcggcccctgatggagggcatttgcgctacaaacccttgtaaaatgggtatccaattggcaaactacgtacttgcgattgacggctcgcccatattcacatgggccgcaaccttgaaataacaattgtttggaggaaccatggcactacctcagcttaccgacgagcagcgcaaggccgcactggagaaggcggctcaggctcgtcacgagcgcgctgagcttcgcgagaagatcaagaagggcgagatttccctcgaggacgttctcgactccgaggatcccatcgcgagccgcatgaaggtctctgccctcatcgagtctcttccgggatatggcaaggccaaggccaccaagatcatggacgagctcggaatctctgcaacccgtcgcgtcaagggcctgggcgcccgccagcgcgagcagcttctcgaggtgctttccaagtaagtgagtaggaaaccgcgtttattcgtcatttccggaccgtcaggcgcagggaaggggacgctcgtctcggcaattcgagaggagcgtcccgacctgggcctgacggtttctgcgacgacgcgcccgccgaggccgcatgacgtgccgggcgtgacctatcacttcctgagcgacgaggagttcgaccggcgcgtggcgaacggtgacttcctcgagtgggccgacgtgcacggccacaagtacgggacgcttcgcagcgaggtggaccgcctgatcgacgccggcaagtcggtcatcctggagattgacgtccagggcgccttcaacgtgaggcgcatctatcccgacgcggtgctgatcttcatcgagccgccctcgctcgaggtgctcgagagccgcctgcgcggcaggggcaccgaggacgaggcgtccatcgagctcaggatgagaaacgcccgccacgagatggaactcgccgaccgctacgacgagcgcgtcgtgaacgacgacctcgcgaaggccgtgagcgacctcggcgatgtacttgaaagatacgagacggatggaggcaactcctcatggcagtaaccaagcccgagatcgacgatcttctcgccaagaccgagcacaacccgttcctgctctgcaccatcgcgagcaagcgtgcatgcgacatcaacaacatgatccgtggccagcacctgcgcgtgacggccatccaggacttcgatgacatcacgaccgtcgtgtccggcgaggacaccgtctccgtcgcgatgaacgagatcgaggacggcacgttgggctttgacaaggacgcgttcgacgaggagatcaagggttcgaacgcgctcgtcgaccacaacctgtaagccatgactgacagggtttgcctcgtccactaccacgagatcggcctcaagggcaagaaccgctcgaccttcgagaaccagctcgtgacgaacctccacaggtcgctgcgggacttcgaggtggaggacatcaggcgcataagcggccacgtgctcgtgaccgccaaggacggcatggccaccgacgagatggcgcatgccatatcgcgcgtgccgggcgtggcgcgcgtgagcgtcgcgtacctgtgcgggctcgatgaggacgagtactgcgccgcagccgtgcgcgcgctgggcgaggcgggggacttcgactcgttcaaggtgcacgcgcgcaggtcgtccaccaactacccgctccacacgctggacatgaaccgcctggtgggaggcgtcctgtgcgagaagttccccaccaagaaggtcgagatgcaccatcccgacgtcacggtcatcgtgatggtcgtgaaccagagcgtgtacgtgtacacggacacgggcgccggcgtgggcgggcttcccgtgggtacggccggcaaggtcgtgacgctgctctcgagcgggttcgactctcccgtcgccacgtggatggtgggaaggcgcggcgccgtgtgcgtgcccgtgcacttctcgggccgtcccatgaccgcggacacgagcgagtacctgtgccaggacatcatcaacgcgatggcgccctccggcatggtcggcaggctgtacgtggtcccgtttgggcagaagcagcgcgagatttcgctctgcgtgccccagagcctgcgcatcatcacgtaccgcagggtcatgttcgcggtggcggagcgcatcgctcagatcgagggcgccaaggcgctcgtgacgggcgagtcgctgggccaggtggcctcgcagacgctcgagaacatctccgtggttaacgagatggtgcacatgcccgtcctgaggccgctcatcggctccgacaagcaggagatcatgcgccgcgccgaggagatcggcacgtacgacatctccgcgcaggacgcggccgactgctgcacgctcttcatgccgcgccgccccgagacgcacgcgaagcccgacatggtgcacgaggcgtgggactccttcgaccacgacgccatgatcgacgagctggtgcgcaacgttgagtacgtggactttgaccagtgcccctcctacaagccgcccaagcagctgagggcccgtcacagggagctggcgcccgccgagttcgagggaagccgctagaggcgctttcttgcggctggctttgcgtgaccccgtcagagacgcgcaaggcaactgtcataccaaataactttaccgtgcgattttgccacccccggtcccaacatgggattgggggtggttgcgtatggcgcagacgggggcgagaaggacggggcgttccggcggcgggggcctgccgcgcaggtacgggctcgagggcaggaggggcgtcgtgattgcggccgtcgtgctggtggcggcgctgtgcgcggtgggggccattgccctgccgcgcgtgggggacggcggctcgttcgaggtcgagcgcgcggatgggacggcgtctggggggaaggcctcctccggcaaggccgcgggggagaagggcgactcgggggactccggtgactcgggggactcctccgccgggaagtccgctgctacgtcgacgtcccgcgcgaccacggtcaggagcgtggtcgtcgtgcacgtggacggtgccgtgcgggcgccgggcgtgtacgagctgcgctcgaccacgccgcgggtggacgacgccgtgcgcgccgcgggagggcttgccgaggacgcggacacgacctcgatcaacctggcctccatcgtgagcgacgggcagaagatccacgtgccggcagagggcgaggaggtgacggctcaggagcaggatgccgggaccgcgggcgcggttgccacggacggtgcgacgggaacgacgggcgcgactggcacccaggcgcaggatgcgggcaaggtgaacatcaacacggccgacgtgacgcagctccagcagctgccgggcgtgggcgaggcgacggccaaggcgatcgtggaggaccgccagaacaacggggcgttctcgaccccggaggacctgatgcgcgtgtccggcataggcgagaagaagttcgagcgcatgaggtcgatggtctgtgtctgacggagggtgggttcccaacaggccgcacattcccttctcgctctacctgctgtgcgccgggttcgcgacgtgccaggccgtgctttcgctgggcacgaggattggcgcgacgtggcaggtgctgctggttggcgtggcacttctcgccccctgcgcccttgcgctgcggcgcgaccgcggtggggtggcgctgcgcgggtgcgcggtcgcgtcagtctgcctgctctgcgcgtgcgcggcgtccgggctcgtggggacgatggacgcgacggccgcggtcctgggtcgggtcgccgtgtcgtcgtgcgagctcagggtcgagtcggacccctcgctcgggaagcgtggctaccgggcccgtgccggcgtgtggcgcggcggcgagcgcctgggggacgtgtgggtcacgtccgagcggcgatttggcacgggctggcggctcagggccgtggggcggttctcgcgcgggaagggggagtggcgcgcctttgcgcggcggcagggcgtctgcggaaccgtgaacgtggtgcacgtgatcgaggcgcggccgcccacgggactacgtgccgccatcgagggcgtcaggtcacacgtgctcaaggggatggcaccgcggagctcgcccgcgagggcgatactcgcggggagcgtctgtggcgacagggacgccctgcaggagcttgggctggacgacgttttcgcgatttgcggggtggcgcacctcgtcgcggtgtccggcgggcacatcgccatcgcctccgccatcgtcgggcggctgctcggcaagagccgcctcgtgccggcgtggcgcatcgcgatactcgtggcggtgacgggactgttcgtggtcttctgcggcgcgccggtctccgccgtgaggtcgtggctcatgtgcggggtggcgtttgggtcgaggctcgccgggcggagggcgcactcgctctcggccgtgtgcgtggtcgcgctgggaatgctgacgctcgacccgggcgtcacggggcagctcggcttcacgctctccgtcgtgtccgtcgtcgggctctgcatcctctctccctacatgggctacgtgctgagggtggccttcccgacgccgcggctgccgcggggcctgcccgcgcgggtgcgctcgagggtggagtcgacctacggctcctcgcgagacgtcgtggcggcgtgcctcgtggcgcagctggtcacggggcccatcacgtgctccacgttcggcacgctctcgctcgtggcgccactggcgaacctccttctggcaccgctcttctccctgctcgtgggggcgggcatggcctactcctgcctgggtggggtgcgcccgctcgcgtccccgttcctgctggcgtgcgacgtcgcgggcggcctggtggcgcggctcctggggtggatggcggggctgccgctcgcctccgtagccgtgagcctcgacctcgccccggcctgtgcggtcacggtcgcgctcgtggcggcgctgctcgtcgcgtggccacgtccccggcggggccccatgctcgcggccctgggggccgccgtgctcctggcagggtgcctgctgctgaggtggcggttcctctcgcccgcgcgcgtctgcgtgctcgacgttggacagggggacgccatcctcgtgcaggacggagccgccgcggtgctcgtggacacgggtcccgacgacagctgcgccaaggagctcgggaggctgcacgtgacgcatctggacgccgtcgtgatcacgcacctgcacgacgaccactacggcgggcttgcgtcgctgcgcgggaacgtgtcgtgcgaccgggtcgtctttgcggacggcgtcacgggagggatgcccactgaggtccgcaaggcggcgcgcgacctggccggcagtcgcgtgggcgaggtgggcctgggcgacacggtgcgcgtgggcaggttcgccctcagggtggtgtggcccgaggggcccgtcgacggtatggacaacgaggactccatcgagctcgcgctcgcgttcgacagcgggggaaggaggatgagcgggctcctcacgggcgacgcggaggaggaccagacgggggaggccctcaggcacggccgcgtgggcgacgtggacttcctcaaggtggggcaccacggctcgcgcgtatcgatcgacgccgcggaggcccggcgcctcgacccggaggtctccgtcgcgagcgcgggccgcggcaacaagtacgggcatccctcgccggactgcgtgagggtgctgcgcaagagcggttccacgttcctctgcaccatggacgtgggcaccgtcaccctcgagccgggcgagaagggcgtccgcgtgagcgtggagcgcggccgcggcagcaccgcgtcctttgtggcatgataggaggccgagcgatgggagggacatggctaaggcagcgcttctgcccgcgtacctggcggtcggcgcggacgaactcaagagccgcgaggtccagacgaggctcaagggccgcctggagaagggcctcgaggcgttcaacctcgacgagagggtcgccggcccggacatggtgccgggagacctcatcgcgtcgctcaacacgattcccatgggctccgggttcaggctcgtgctcgtgacgagggcggagaagctccccaagcccgtgtccgaggccatcatcacatacctcaagaaccccaacccggggtgcacgctcctgctggtcgcgacgtcgctcgccaagtcgacccggctctacaaggccgtcaaggccgtggggccgcacgcggtaatcgactgcgcgcccgtgaagcgctggcagctcgcgccgagggtggtgcgcatggcggcgcactacggcctcgcgatggacgagcgcgccgccgccgagctcgtgagcagggtgggcgagtccaccacgatgatcgacgcgcagctgaggtcgctcgccgcgcagtgccgcgagagcggccaggcgaccgtcgcggacgtggagcgcatcgtcgcgaggaccgccgaggtcaagccgtgggacttcctggacgccgtgtgcgaccgcgacgccgcaaaggcgctcgggctctatcacctgatgcagaacccgtcgcagatcgcgctcacgtcgctcctgtgcgggaggctgcgagagctcgtgtgcgcgaggtcgctcgcggcgcgcggccagggcggcatgctcgcgcaggagctcggcaagcagcagtggcaggtcaagaaccacctgcgctgggcgctgaggttcgcggacggcgagcttgaggcgtgccttgggcgtgcggccgcgtgcgagcgcggtctgaagtccggcgacgacccggagaccacgttcctctcgctcgtgctcttcgtgtgcggaaagggagtcgcggcctagcccgccccaaccgcatgcgtacacggcagcgggcctatcgaccaggctcgcagtggtctatcggcacaaaaaagaccccgtcctgtcgggcggggtcgaaggctttgccttgtgcgtcgtgcgcatgactacctgatggagttcacgagcttctggacgccggacttgcggttggaagcctggttcttgtggatgatgcccttggaggcagccttgtccagaaggcggttggccttgttggcggcagcctgtgcggcctcgacgtccttggcgtcgacggcagcgcggacgcccttgacggcggtcttcagctcggagcggactgccttgttgcgcatgcgcgccttctcggcggtgatgatgcgcttcttctgagacttgatgttagccacgtgcggttcctttcggttctgatccttgaggcctctatattctgaggtgaaggacgtggggttatccgacacctgacacggcgaggtcgactcacggagtatagcagaaggaacgcccgcatgtgcaggaactttgcggctcgcccagcgcctcgcgcgcaaattcacatactcttccaaacgaggaagcgcggcttggcaggaagcggccgtgggttatgatggttcgcatggaaaagacagacatctctcacatccgcaacttctcgatcgttgcgcacatagaccacggcaagtccaccatctcggacaggatcctcgagctcacccacacggtgcaggagcgggacctcgagtcgcagatgctggactccatggacatcgagcgggagcgcggcatcaccatcaagagcaacgccgtccgcgtcatgtacgacgccgacgacggcgaccgctacatgttcaacctgatcgacaccccggggcacgtcgacttcacctacgaggtctcgcgctcgcttgcggcctgcgagggcgccgtgctcgtcgtggacgccacgcagggcgtcgaggcccagaccgtctcaaacgcgaacctcgcgatgaacgcaaacctggacatcgtgccctgcatcaacaagatcgacctcccctcggcccacccggacgaggtgaaggaggagatcgaggaggacctcgccatccccgccgaggacgccgtgtgcgtctccggtaagacgggcgagggcatccacgacctgctcgaggccatcgtctacctcgtgtcgccgcccaagggcgacgcgaaggccccgctcaaggcgctcatactcgactcgtacttcgacgagtaccgcggtgtcgtcgcgacggtccgcgtgttcgacggccgcatccgcaagggcgaccacctgcgcatgatggcgctgggcgacaccttcctctgcgacggcgtgggctgcaagcgcccgctcgagacctccctggacgagctcggcgtgggtgaggtcggctacgtggtgacgggcctcaaggaccccgcgctcgtcaagaccggcgacaccatcacgtacgaggacaacccctgcgcggagccctgccccggctaccacgaggcaaagcccatggtcttcacgggtctcttccccatagacaacaagcagtacgagaacctgcgcgacgcgctcgagaagctcaaggtcaacgacccgtcgctcacctggacacccgagacgtccgtcgcgcttggcttcggcttccgcgtgggattcctcggccttctccacatggaggtcgtgaaggagcgcctggagcgcgagttcgggctcgacctcatcgcgacgaccccctccgtcaactaccacgtgtacaagacggacggcaccatgatcgagatcacgagcccgcaggacctgcccgacgtcacgcgcatcgagcggatcgaggagccgtacctcaaggccaaggtcatcgtccctccggacttcatgggcgccgtcatgcagctcgtgatcgaccaccgcggcgagaccagggacatggtctacctgtccgagaagtcggtcgagatgcacttcgacatcccgctggccgagctcatcctggacttcttcgaccagctcaagagccgcaccaagggctacgcctcgctcgactacgagatgggcgactaccgcccgagcgacctcgtgaagctcgacatcctgctcgcgggcgaagtcgtggacgcgctcagcttcatcgtgcaccgcgacaaggcctacgacatggcccgcgccctgtgcgacaagctgaaggagatcatcccgcgccagcagttcgaggtgcccatccagggcgccatcggcaacaagatcatcagccgctccaccgtcaaggcgcaccgcaaggacgtcctggccaagtgctacggcggcgacgtcagccgcaagcgcaagctgctcgagaagcagaaggagggcaagaagcgcatgaagtccatcggctcggtggaggtgccgcaggaggccttcctggccgtgctcaaggtggacgacgaatgagcgccgccacgcttcccgaggacgcaacgcctacgcagatcctcgacgccctcgcccccgcggcgggcctgggcgagaaggtcgacccctttccccgcgagggcgacctcgcgtcgcggctggcttccgcccgctacctgctcgcgccgatggccggcgtgacggactcggcataccgcctgatggcgcgccgtggcggggcgggcctcgcctacacggagatggtctccgtcgccggcatccactttggcggacgcggcggcggccagaagacctgggagctcgtcatccccgcggatgaggagccggacatcgcggtgcagctcttcggcagcaagccggagcagttccgcgaggcggccgcccgcgtgcaggagcgcctgggcagcaagctcgccctgatcgacatcaacatggcatgccccgtgcccaaggtcacgcgcaagggcgagggctcggccctgctggacagcccggagctcgcggccgagctcgtgcgcgcgtgcgtggaggagtcgacggtgcccgtgacctgcaagatccgccgcagccgcacgccggggcccgagcaggctccggacttcgcgcgcgccatggagcaggcgggcgcctcggccgtcgcggtccacggccgcacggcgagccagctctaccgcggcaaggcggactggggctgcgtacgccacgtcgcggacgccgtgtccatccccgtcatcggctccggcgacgtgctcgacgcgcacgccgcggcggacatgcgcgcccggacgggcgcgacggccgtcatggtggcacgcggctcctacggaaacccgtggctcttctcggccgcgcgggccgtcgacgggggagaggagccacccaccccctcgtacgcccagcgcctggccgcgttcgagtgccacgtgcgcctgctcgcggcgacgcacgcccacctggcgagggcgcggagcctcgcgggatggtacttcaaggggatgccgtacgcggccgagtggcgcaaccgcgccatggcgtgcgtcacgctcgaagactacctggggctcgtgcgcgagctcgagggccggctcgacgcctgggcggagtagcccgtgggcgccgagagctgggaggggcgcttgcacgcggccggcgcgcaggcgctctacgtgcacgtccccttctgcaggagcaagtgcgcgtactgcgacttctcgtcgtgggccacgcgtgcggacgacccgctggtcgcggcgtacgcggcctcggtcgggcgcatgctcgcgcaggcggaggccgcggggctcctcgagggctgccggaccggctacctgggcggcggcacgcccacgctcatggggtccgcggtcggcggcctcctcgcgcgcatggcgccgcactgcccgcgagagctctcctgcgaggccaacccggactcgctcgacgatgccacgctcgcggccatcgcgtccagcggcgcaacgcgcgtctccgtgggggtgcagagcacctcggacgcggagctcgcggcgctggggcgcatccacacgtcggcgcaggcgacgtccgccctcaggcgcgcggtggcggccgggctcgacgtctcgtgcgacctcatgtgcgccatcccaaggcagggcgagaagagctggcgccggagcctcgacgacgtgctggccgcgggcgtgggccacgtgagcgtctacccgctgcagatcgaggagggcaccgccttcggccgccgctacgcggtcggggacccggcgttcaactccgaggacgtgcaggccgcgcgcatggcgcaggccgagcacgcgctcgcggcggcgggcctccatcgctacgaggtggcgagctacgcgcggccgggcaagtcctgcgcgcacaaccgcgcatactggacgggcgtgccgtacctgggcctgggcaccggggcctccggcatgctcgcggccgagggctacgctcatctgcgcgccgtggcgccgcaactgccgcccgcacccgaggacgcggcccgcgtgcggctcaccgtcacgagcggcaggcgccaggtcgcggcggcatcgggccttgcggggctcgacttcgacctcgagttcctgacggaaccccaggccgcggccgaggacctgatgctggggatgcgcctcaccgagggcgtggcggagggccttctcgcccatgcgcggagcgtactcggggcgggccgcgtggacggcgccctggcggaggccgcggcggagggcctcgcgcacgcgacgcccgcaggcggccttgcgcccacggagcgggggtggctcctgggcaacgagctcttcggcctcatgtggggcctcgcgcccggcacggtcgcgagcgcgagcgcgcgggccacgggcgcctgacctgcgcctgcgcggtggtgatttgctgcgccggcgccgcgcgtgaataagcggcgccgccaatggatagaatcgttgaacgaacgtgcccgattctgtcgggacgtgcgccggtcggcgctttggtaggacacgacacgctgggggatccctcatggcaggaatggacgagaaggactactacgcgatcctgggggtctcccctgacgcctcgacggacgagatccgcaaggccttccagcagaaggcccgcaagctccaccccgacgtcaacaaggcgccggacgcggaggagaagttcaaggaggtctcggaggcctacgccgtcctctcggacgagcagaagcgcaagcgctacgacgccatgcgctcgggctcgccgtttgcgcaggagggctacggcaccccctcgtacggcggctccgggcaggacccgtttggcgggtacccctttggctggggcttcccgtttggcgggacgggctaccgcagggccacgaccacgcgctcgcgcgcgtacaaccccaaggcgggcgcggacgtcgtcatgcagctcgacctggacgacgagacggcccgcaagggcgtgaggcgcggcttcacgtaccagcgctacgtcgcgtgcgacgtgtgccacggcaccggctccgtgcgcagcgagcacgcggagacctgccccacctgcggcggaacggggcgcatcagcctcgacctcacgggactcttcggcttcggcatgatggagatggagtgcccggagtgcgagggcgtgggcaaggtcgtggcggacccctgcgaggcctgcggcggctccggccgcgtgctctccgcgagcgaggtcgtggtcgaggtcccggccggcagccatgacggggacgaggtccgcgtcaagggcatgggcaacgccggcaccaatggcgagtcctcgggcgacttcgtgtgccgcgtgggcgtcgcttcggagcgcgtcaaccagcgccaggccatgggcatgcagacgctcggcttcctgatcccgttcgtggtcctgggtgccatcacgggcacgctctcggccatgctgccgttcattctcatcatggccgcggtctgcgcgtactcgctctatcgcggcggtgggctcggcaagagcaagacgtggtggaagcacgccggaacgtcggtcgccaacggagcggtctcggggctcctgctcgcattcctcatggtgctcatgttcagctgcggcagcgccaactacggctactacggctacggaccgggcgcaagagggtagaacataccctgaaatgaccttctgccgccccgcgtgggcggctcttcgtgttcgtgtacaaaccaggtgggggaatcgcaagtggcaacaaaggactactacgaggtgctcggcgtcgagcgtgacgcggatgccaagaccatcaagcgcgcgtttctgaagaaggcgcgcaagctgcacccggacgtcaacaaggcgccggacgccgaggccaagttcaaggaggtgaacgaggcctactccgtgctgtcggacgagcgcaagcgcgccaactacgaccgctacggcacggcggagggcccgggcggcttcggctcggactacgtggacatgtcggacatcttcggcggcggcttcggcatcgacgacatcttcgactccttcttcggcggcggcagacagggcggcgcctcgggtgccgcggcgcgcacgcgcggacgcgacatgggcatcacgctcaagatcacgctcgcggaggccgcggcgggctgcatcaagaccatcgcctacgaccgcctcgcgccgtgcgacgactgcaacggcacgggcgtggccgagggcggccacgtcaagacgtgcgagaagtgccacggcacgggccgcgtcgttcaggtccagcgcaccatcttcggccagatgcagacccagacgacctgccccgactgcggcggcaccggcaaggtggtcgacaagccgtgcgagacctgcgagggccagggccgcaccccctcgcgcgagaccgtcgacgtcgaggtgccggcgggcgtgcactccggccagagcctcagggtcaagggcaagggcgaggccggcgtccgcggcgacgcgtccggcgacctggtcgtccgcatcgaggtcgcggaggacaagacgttccagcgccagggcgacgacctcttctgccgcgtgagcgtcgactcgctcgaggccatcgtgggcgcgaccgtccacatggacggcatcctcgagggcgacgacgtcgtggtcgaggtccccgcgggctgccgctacggcgagcagatccgcatcgagcgcatgggcatgccccgcatgggcaccacggcgcgcggcagcctgatcgccgtcgtggaggtcgtgccgcccaagggcctcacccccgacgagctcgaggacatccgcgacatcgtctcctcgcgccgcgacgccagcgcgtccgagcaggagggcgagaaggacgaggccccgcacgcggaggccggtgccaacgccgagcccagaaagcccaagttcaagcaccgcggccgccgcagcaggtccaagtgagcggggccaacggcgcgcgcgtcgcgatcgtcaacctcggctgcagggtcaacagggtcgaggccgacgtcatagcggccgagctcgagcggcacggctgcaggctcgtgggcgaggacgaggcggatgccatcgtcgtcaacacctgcgccgtcacgggcgaagccgaggctaagaccaggaagaccgtccgccacgcggccctgcgtccgcagcggccggtcgtcgtggcgacgggctgcgtcgcgaacctcttcgcggacgagctcaggcagctggcggaaaacgtcgtcgtgcagggcaacaaggccgcggtcgcggccacggtgctcgagcgcctcggcatcgcgggggacgcgtcgtgcgcggattccgtcgtgagcgtcacgcccacgcccaccggccgcatgcgccccggcatcaagatccaggacgggtgcgacaaccgctgcacgtactgcatcgtgtggaaggcgcgcggcaggtcgcgctccatggatgcggcggaggtcgtctcgcgcgtgcgccagagcgtttcacgcggcgcgcgcgaggtcgtgctcacgggcatcaacctcgggcgcttctccgccgtgggggaggacggcggcagggtctcgctaccggggctcctcgaccttctcctcagcaagacggacgtggagcgcatcaggctctcgtccatcgagccgcccgacgtgacggacgagctgctccgcaccatggcggccggcggcgagcgcgtggcgccgttcctgcacgtgtgcctgcagtccggctgcgacgcgacgcttcgccgcatggggcgcgtgtacgacacggcgttcttctcgggcgtggtcgaccgcgcgcgggagctcgtgccgggcatcgcgctggggacggacctcatcgtgggcttccccggcgagacggacgcggacttcggggagtcgctcgcgttctgcgagcgcatggccttcgccaagatgcacgtcttccgctactccaggcgtcccggcacgcccgccgcgacggcgcccgggcaggtcgacccccacgtcatcgcggagcgcggccgccgcatgcgcgacctcgccgcacggatgcgccacgaccaggcgggcgcccacgtgggcgccgacgagctcgtcgtcgtgcagtacccgggccgcggcgtcacgggcgggctcttcgacgcgctggtcgaccccgcctacccgctcgactcgctcgtgcgcgtgcgggcccgcgccgtcctgcccgacggcacgctggactgcaccacgcagcccgcgtaacggcggctgggacggccgccccgtctggggcggtccgaacgggcgagaaaagcggctatcatgggtgcgaggacacccgcgcttggaggaacatggaacctacccacatcaggctcaccataccggacaccgtcgacccgacgctgctcatgggccccgccgacacgcaccttcgccggatagaggacgcgttcgacgccatggtcaccgtgcgcggcaaccaggtgagcgtgatcgggcccacgcaggaggccgacgccgtggtcgcggtgttcacgcggctcatccgcgacatcgaggccggcggcgcgcccacgtccgaggacgtggacctcgtcatcgggcaggtctcgcacggggccaggcagggcgacgcgcccgcgggcgacgtccttctcacctatcgcggccgcgcgatccgccccaagacggagggccaggcgcgctatatcgaggccatccgcgacaacacgatcacctttggcctcggccccgccggcacgggcaagacgtacctcgccatggcgatggcggttgcggcgctcaggcgccgcgaggtcgggcgcatcgtgctcacgcggcccgtggtcgaggcgggggagtcgctcggctacctgccgggcacgctggaggagaagctcgatccctacgtgcggccgctctacgacgcgctgttcgacatgacggacgccgagcgggcaaactccctggtcgagcagggtgtgatagagatcgcgccgctcgcgttcatgcgcgggcgcaccctcaacggcgcgttcgtgatcctggacgaggcccagaacaccacgcccgaccagatgaagatgttcctcacgaggcttggctttgggtccaagttcgtggtgacgggcgacgtcacccagcgcgacctgccgggaaggagcgggctcgactccgcgcgcgccgtgctcgcgggcgtggacgacatcgccttcgtggagctgggcaggaacgacatcgtgaggcactcgctggtcgcgcgcatcgtcgacgcgtatgatagggccgagcgcaccgagcgccagcgtcccccaaggagggcggttcatgatggagaatagctacgacgtcgtgctcgaggagggcgtgtccagccccgtgagcgagcaggagatccgcgaggacatcgacctcgtgctcgcaagcgagggcgtggagcgaccctgcatggtgtcggtctcgatcgtctcggacgagcgcatgcacgagctcaacctccagtggcgcgggatggaccggcccacggacgtgctctcgctcgagtgcgagcgcccggacgacccggacctcgcaccgggggagccctgcgagctgggcgacatcgtgctcgcgccggactacatcgcgcgccaggccaagggcttcggcaccacgccggcggacgagtgccggctgctgctcgtgcacggcacgctgcacctcttgggctacgaccacctcaaggacgaggaggccgaggtcatggaggcccgcgaggacgagctcctcgccaagatcaagaccgaccacgcgatcgaccacgtgacgctcacgcgccacagggacggtgagtagccatgattcccggacggacgccaagccatccgtcttttaggaggagcttcctcttcgcgctgcagggcttccgcacggcggtgcgccaggagcgcaacatcaaggtcatgctcggcggagcggcctttgccatcgtgatgggcatcgtgttgcgcatcggccccacggactgggccgtcgtggccgtgtgctgcggcatggtgctcgcggccgagctcatcaacaccgcgatcgagaccgtggtcgacctcgtctcgccggagttccatccgctcgccggacgcgccaaggacatcgcggcggcggcctcgtggctcctcagcatcgcggcggccatcgccgggctctgcgtctacggccacgcactgctcgaacttctcgcccactaggcgggccggacggcgcggccgcgccagcacaacgtgacacaccagacccacaagggggttgcaatggaagacatccagggcaccggtgcccagtcgggcgagaaggacgaggcgccgttcaggagcggcttcgtcgcgctcgtgggcaggccttccgtcggcaagtcgacgctcctgaacgcggccgtgggcggcaaggtcgccatcacgagccccgtcgcccagacaacgcgccgccgcatgcgcgcagtcgtcaacaggccaaacgcgcagatcgtgatcgtggacacgccgggcctgcacaagcccaaggacgccctgggcaaggagctcaacaaggtggcgctcggcgagctcgcggacgtggacgtggcggcgttcctcgtggacgcgaccaagcccgtgggcaggggggacgagtgggtcgccaggcacgtggacgcctccgacgccccgtacaagctgctcgtcatcaccaaggcggacctcgccaagcccgagcaggtcacggcccagctcgaggcggcctcggccctggctcgctttgacgacacgatcgtcgtgagcgcgcgcgagggcttcaacgtggacgccttcgtgtccatggtggccgagcacctgcccgagggcccgcgctggtttcccgaggacatggactgcgacgccacggacgaggagctcgtggcggagttcgtccgcgagaaggtcctgctcaacctgcgccaggaggtgccgcactccgtgggcgtcatctgcgacgacatcgactgggccaaggacggtcacgcctcgatccgcgccacgatcatcgtggagcgcgagagccagaagggcatcgtgatcggccgcggcggctccatggtcaagcgcatcggcacgcaggcgcgcaaggacatcgagcgcctcttcgacgcgagggtcttcctcgacatccaggtccgcgtgcagccgcagtggcgccgcgaccagaacgagatccgccgcctcggctacgactacgaggagtagccgcgacccatggcaggcaggcggaccacacggaccaaggcgatcgtcctcgaccacagggcccagctgggcgagaaggacctcatcctcacgcttttgaccgaggacggggagcgcgtggacgccgtggcgaagggcgccctcaagcccggcggcaggctcgccgctagggtggagctcttctgcgagacggacttcctcctggcgcagggcaggagcctctccatcgtgacggaggcctccgtcgtgaacccgcacgcgggcctgcgcggcgacctctcgcgcgtgagcgccgcgtcgtgcgtgtgcgaggtggcgcgcctcacctgcttcgaggacgtgggcgacccgtacctgtacgccatctgctcgcgcgcgctcacggcctgcgagcaggcgcccgaccaggagcgcctcgacctcgtggtggcggcgtacgcgttcaaggtcacggcccacgggggctggaggccggagctccggcgttgcacgctctgtggcgacgaggacgtctcgttcttctcgcccaaggccggcggcatgctgtgctcgagctgcgcaaaggacgtggccggggccgtgcgcatgggcccctcggggcgcgaccggctccagtcgctcatcaagtccacgttcgaccagatcctggcgatggaggccgacgtgggcaccacgacggagctcgtgagcctcgcgcacgtatggtgcgccacgcacctggacgcgcgcctcaggaccttcgagttcatgctcagcctgtaggccgccgcgcctgccgtgcggacgtgcgcaaaatgtgtgcgcggtctggtgattggcccccacgtgcggattttgcggccgagaagtgcgcggcggccgtcgacgtggtaacctatgcgagtccgtaccccctacttggtggcccgcccaatgccagacggccaacccagttcggggcgtatctatgtgaaaggggttttcatggcagtcaccaaggagcgcaaggccgagctcatcaagcagtacggcaagaacgagaaggactccggctccgccgccgtccaggtcgccctgctgaccgagcgcatcaagggcctcaccgagcacgtcaagttccacaagcacgaccaccacacccgtcgtggcctgctgatgctcgtcggccagcgtcgtcgcctcctgtcctacatcaagaagcaggacatcgaggagtaccgcagcctcatcaagagcctcggcattcgcgacaacatccagtaacacaaggtgttaagaggagggcgccggcatggcgctctctttgtatgacggcccgcctgcaaaggggcaggcggagataagaggaaaaaggaaaatggcaaaggttacgcacgagttcgacctctacggaaagcactacaagctggagacgggcgagctcgcaaagcaggccacgggcgagtgcctggtgtcctgcggcgactccaccgtcaacgtgacggtcgtcgtctcgaaggagcgcaagaactacgacttcttccccctgacggtggactacatcgagaagatgtacgccgtcggccgcatcccgggcggctacctcaagcgcgaggctcgtccgagcgagaaggccaccctcacggcccgcatgatcgaccgtcccatccgcccgtccttccccgacggcttcaggaacgaggtccagatcgtcgcgatgccgctcgtcgcggaccaggtcaactccgtcgacacgatctgcatcatgggcgcctccgcggcgctgaccgtgggcggcgtgccgttcgagggcccgctcgccggcgtgcgcatcggccgtgacgtcgagaccggcgagttcctcgtgaacccgacgtacgaggagcgcgacaactccgacctcgacctcgagctcggcggctccgccacgttcatcagcatgctcgaggcgggcgccaaggagatctccgaggaggacatgctcgcggccatggcctttggccaggaggccatcgcggcgttctgcaaggaggaggagaagttcttccagaagtgcatcgaggtcaacggcccgttcccgaagcgcgagtacgtgctcgacgagcccatccccgaggtgcacgagcgcgtgttcgcccacttcgacgagatgtccgccgccctcaaggacgccgacaagctctcccgcatggacaaggtcgaggccctcaaggagtccatcaaggccgagttcaccgaggaggagcaggaggagtgggaccgcgccatccccgtcgagctcaagagcctcgagaagcacgccatgcgcaagatggtcgtcgagaccggcgagcgcgttgacggccgcaccgcgaccgaggtccgcccgctcatggtcaagccgaactacctgccgcgcgtgcacggctccggcctcttccagcgcggccagacccaggtgctttccgtctgcaccctcggcatgctgaacgagtggcagcgcctcgacaccatcgagccggtcgacggcaagcgctacatccaccactacaacttcccgccgttctgcaccggcgagaccggccgcatgggctcgcccaagcgccgcgagatcggccacggcaacctggccgagcgtgcccttctccccgttatcccctcggaggaggagttcccctacaccatccgcgtcgtgtccgaggtcatggagtccaacggctccagctcgatggcgtcgacctgcggctccacgctcgcgctaatggacgccggcgtgcccatcaagcgccccgtctccggcgtcgccatgggcctcatccaggaggagggcaagaccgtcgtcctgaccgatatccagggcctcgaggacttcctgggcgacatggacttcaaggtcaccggcaccaccaagggcatcacggccatgcagatggacaacaaggccaccggcctcacgcccgagatcctgaagcaggcgctcaagcaggcgcacgagggccgcatgttcatcctcgacgcgatgctcgacaagatccccgcgccgcgcgagcacgtcaaggcgaccgcgccgcagatcatcagcctcaacatccccacggacaagatccgcgacgtcatcggctctggcggcaaggtcatccgtggcatccaggacgacacgggcgccacgatcgatatccaggaggacggctccgtcttcatcgcgggcaccaacggcgccggcgaggaggccgcggagcgcatcaaggccatcgtgaaggttcccgaggtgggcgaggagtacaccggccgcgtcgtgaacatccagccgttcggcgcgttcgtcgagctgctgcccggcaaggacggcctgctacacatcagccgcgtcgccaagggtcgcgtggagaaggtcgaggacgtcctcaacgtgggcgacgaggtcagggtcaaggtcatcgaggtggacgagaagggcaagatcagcctcgaccgccttgacaagcccgaggccccggctggctccgagcgtaggggcgagcacaagagcgagaggcacgagggcgagcaccgtcgccgtcgccacgttggcgacaagggcggcaacgccggcaacggcgagcagcgccagcccaggcgccaccacgagggctagtcacagcctggcataggccaaactgacacgagcggggagcctccaacccggggctccccgctcttctcgtatgcggaacataaattcttctacggctggcgtcaccgttgatagacggcgtcagccccggaggtacttgacgagtgccgcacagagaaggacgagcgcgaccggctcggcgaagtccttgaccgtggtgaacacggaaagcagcgtggcgaacactacctctggcgtcatgggttgctcctaacctcgggatacccggccgtcttggtgggcatatacaggacggccactcgaggtggagtatgcgacgtggaatgctgtatggaagctgaaatccgtcgctcttctcccaaaggtagtttttggcgagcgcgctccttggggtcgcgcgccggaggggcttggccctgtacgggcgaaaaccacacccgcatcactaaacaaagaccccggcacactacaataggtgtttgcgaaatgtccgacagcacgaggctgccgagaagatatggatcgtgacacctgtcgaaaggataattggacaatggcaaaaaagcagacgccgctgaggatcattcccttaggcggcctggacggtattggcaagaacatgaccgccttcgagtacgggagcgacatggttctcgtcgatgcgggcctcatgttcccggatgacgagcagcccggcatcgacctggtgctgcccgactactcctacgtgctcgaaaacgaggacaagctccgcggcatcatcatcacgcacggccacgaggaccacaccggcgccctgccgtacctcctgatggacctgggcaagaaggtccccatctactcctccaagctgacgctcggcatgatcgaggccaagctgcaggagttcaagatcaactcgcccaagttccgcgaggtcaagaacggcacccacatcaacctgggcgtcttcagcatcgacttcttcagcatgacgcactccatcccggcggcgctcggcgtgtacatgaggacgccagcggggtccgtgctccacacgggcgacttcaagctcgaccagacgccgatcgacggcgtcacgcccaactaccaggcgatctgccgctttggcacgctcggcatcgacctgctcatgtccgactccaccaacgcgacgcgccccggcttcaccccgtccgaggcggccgtgggcccgcagctgcgccacatcatcaagaacgcgaccggcagggtcttcgtggcgtcgttctcgagccacatccacaggctccaacaggtgtgcgacgccgccaccgccgttggccgcaaggtcgtggtgacgggccgctccatggtcaacaacaccaagatcgcccgcgagctcggctacctcaagatctcgcaggaggacataatcgacgcgtacgacgtgaaggacatccctgacgacaagatcgtcgtgctctgcacgggcagccagggagagcccctgagcgcgctcggccgcatggcggcgggggagcacaagtccttcaccatcacggcagatgacacagtcatcatcagcgcgacgccggtccccggcaacgagaagagcgtgcagtccataatcaacgcgctctccaagatcggctgcaccgtgtacgacaggtccaacacgctcgtgcacgtttccggccacgcgagccaggaggagctcaagctcatgctcgccatgaccaagccgaggaacttcatgcccgtccacggcgaggccgtgcacctgcgtgcgcacgccaagctgggccagcagatgggcatccgccccgaccacatcttcgtggcggacaacggcgacacgctcgagatgcgaaacggcgaggtcaagtggggcaagcccgtggagtccggcgtcgtgtacgtcgacggcctctcgatcacggacgccgacccgatcgtcttccgcgaccgccagaagctcgcgagcgacggcatcgtgacctgcgtcgtcaccgtcgcgaagcgcgaccgcaaggtgggcgacgtcgacatcgcctgcaggggcgtctcgttcaacaacaacgatcagctcatctcggaggcgcaggccgtcgtgagggaccacgtctccgcaaccgcaagcaaggagggctcgagcgtggacatgctcaggaagaacgcacgcaacagcctctccaacttcctctggagcaagacgcacacgcggccgatggtcatcccggtcgtgatggaggtttagccacatggcgtcaaaccgcagctcaaacgcacaacagaagagaaggaagggcacgtcttccaaggcgtcccgcgcacgcggcaggcgccagccggtggcgcccgcccgtgggtccgcggcaaacgacatcctgggcgtggcactggtcgtcgtggccgtcgtcatgttcctctcgctcgtggtgcccaccagcgccccggtgacgagggcgctcggggaggcgctcacgctgctgtttggcgtgggggcgttcctgtgcccgctcgcgctcatcgtgttctccaccacgttcttcgtggagcacgaggagcccgtcagcaagcgcgtggccgtgggcctcgcgctcgtggtcgtggcgattctgggcatcctgagcatcaacatgcccaacgcggaggctaacccgggtctggtcatcgcgatggagtccgtgggctcgcgcggcggctacgtgggcggtgccgtcgcgtggtgcctgctcaagagcgtgggcgccaccgtgggcaacgtcgtgctcgtgggcgtgatcgccgcgggctgcatcgtctgcgggttctcgctctccggcgccgtgcagaagctgcgagagcgcatgcaggggctctccgagtcccgcgaggccgcgcgccaggaccgccttgcccgcaggaacctggggtttgacggccaggccgccatgatggacgagaccgccgacatgtacgacggcgacgccgtggagccgctgggccgccgcaagacgacgctgctcaggcgcaaccgcgtcgaggccgccgccgacgctgagtccgagggggccgtgcccgaggaggaccagcccacgacgcttctctccaacgcaaagacgacgctcctcaggcgccgcaagaagcacccgcccctggacgaggacgaggccgtgcccgcaggtaccgcgggcgagagggacgcggacgacgccgcggaggacagcacccggaatgcgggcgcgacccaggcggcggcccccgcggccgcagcagcggctaccaagcccgccgagcccgcggtgccggacttcctgaagcaggccaagggctcgggcatcggccggggagggtcctcggacagcgcgcgtgccacgaccaaggcggcgcgtccttctcgcccgagtgcgacgcctgccgtgcagaccgccatcccgcaggtcgcggccgcggcgtcgacggcggcgcgcagggccgccgcgcccaaggacgtcaagcgcccgggcgacgggtcggaggactacgagctgccgccgttctcgatgctgagctccaaccccaacagcgccaactccgcctcgagcaaggaggagctggacgagaccaaggagcgcctgcaggggacgctgcgcgagtttggcctcacgagccgcgtcgtggactacgtgagcggcccgctcgtcaccacgttccgcatcgagatgggcgagggggagcgcgtcagcaagatcaagaaccttgaggacgacatcgccctcacgctcgccgccgagaaggtgcgcatcttcgcaccaatccgcggcacgtcgtacgtgggcatcgagattcccaacagcaagcgcgcaaacgtgcacctgggcgacgtcctgccgcacgcgacgggcggcccgctcgaggtggcaatcgggcgcgactccgcgggcaagcccgtcgtggcggacatcgccaagatgccgcacatgctcgtcgcgggcaccaccggctccggcaagtccgttctcatcaactccatggtgatgtcgctcctcatgcgcaccacgcccaagcaggtgcgactcatcatgatcgaccccaagcgcgtcgagttcacctgctacaacgggctcccgcacctgtacgtgccggtcgtgaccgaccctcgccaggctgcgagcgccctgcagtgggccgtgtccgagatggagcgccgcctcaaggtgttcgagcgcgccggcgccaggaacatcaaggtctacaaccagatgtgcacgacgggcaagctgtccgagatggacaaccctcccgagcccatgccctacatcgttgtggtgatcgacgagctgtccgacctcatgatgacggcgggaaaggacgtggaggcctccatcgtccgcatcgcgcagctcgcgcgtgcggcgggcatccacctggtcatcgcgacgcagcgaccctcggcaaacgtcgtgaccggcctcatcaagtcgaacatcgacagccgcgtcgccctcaaggtgtcctcgggcatcgacagccgcgtcatcctggacgagacgggcgcggagcggctcctgggcaacggcgacatgctcttcaaggaccggggcctcgctcccaagcgcgtgctcggctgctacacgtccgacgacgagatcgaggccgtcgtgggcttcatccgcgaccaggccgagcccgactaccacaacgagattctctcgcaggtggtgcctgggcagcccggcggcggccacgcggacgtgggcgaggacgacgacccgctcgtgtgggaggccgcgcagattgttgtggactctcagctcggttcgacctccgggctgcagcggcggctcaaggtgggctacgctagggcaggtaggatcatggacatgctcgagtccaagggcgtggtgggccccccggaggggtcgaagccacgcgaggtacttttggacaaggacggccttgaggagctcaggaccgccgaggcacagtttcgggaggtgtagcacatggcgcgtcctcgcttcagcgagatgctcgtggacaggaggcggcagctgggcctttccgtcaagcaggcctcggacgtgctgcgactcaaggaggacgtcctcatcgccttcgaggagggcgacttcgacgccatgccaaagagcggctatgcgcagggcatgctgtcgagctacgcccgctaccttggtatcaactcccgcgagctcataaaccagttcacgcgcgacctgcacgactgggagcgccagagcgccgcggcgcgctcgcgcgcaaggaggtcccgcaggggagaagagcccgtgtacgagctcccgggcgaccaggagtcgaggcgcgccggctaccgcggcagccccggtcttctccccacctcgggcggcttcgcgggcgacctgtcgacgtactcgaccgtgtcctcgccgcgctcgaggaactcccgctccacgcagctcgtgaactaccgccagcgccaggccaaccgcgccgcgggggacaccccgcgccagcgcgccggctatggcaacggctaccgcgacggcggcggctcgtaccggcaggacggctggggctaccagtcctacgagggccctgcgactgaggtgggctaccgcggacccgcgatcgaggacgcgtacgaggcgaggcgccaggtgccccgcggctcctacgacaccgagcgtcgctacacgtcccgtgacgtggcgccgcgcggcgagaggcgcaggggctcccagggccagggccgctacctgcggcaggcagacgagtacggaaactacgcccgctacacgggagacgagggccgtgccgagcgctcggcccgcgacagcgtcgtgtaccaggacgtgccgggccagtacgtggacgacctcaggtacgagggcgcgcgtccctacgaggccgcctcgacgcggtcgggacgccagtcctcgcgcaacatcgcgaacccgcagcgccccaacgtgcgcaggcgccagtcctcgaggcgtggccgcgaccagcggcagcgctccgagcgcgaccgtcgcaggcgcccgcagcatggcggcctgcttgggctcgtggaggcgttcttctcggacggaaggcgcgccatcgccttcgccgtgttcgccgcggccatcatcatcacggtggtcatcatctcgtcggtgagctcgtgcgtgggcaaccagaacgccacccccagcaagagcgtgtcggtctcgacctccagcacgaagagctcgagcagcaaggacgactcgtcgagcagctcgagcacctccaagaaggcagcggaggcggccgcggcagcagccacggccaagaagaccgcccaggaggagaaggacgccaacacggtcacgaaggtgaccgtctcggtcgccgacggagaggtctcgtgggtcgagatcaccctcgatggcaagagcgtcgtggcggagcagatcaccggctcgtggaagaagacctacacggtgacggactccatctcgatccaggtgagcaacccgacggccgtcacggtgaagaagaacggcaagatccagaagttcgactccaagacggccggcgtgggctccatcacgatccagggcacgaaggtgacgagcaccgacacgagcgactcgagctcctccgacacgagctcgacctcgagcacgaacggaaccacgtccacgacctctgacaccacatccggcacgtcaggcaccacgagcggtaccactacgggcacgaccacgacaagcgggacgtccacaaccggcaacacgacctcgggcaccagcacgacctctggcaccggcacgaactccggcaccaccaccacgacaacgagcaactaggcatgacgggccagcgcaaggcgccacggcggcgccgcgctggccgagtcgtgccacatgggcacatggcagacgagaggagaccacatggctaaggagtcgagcttcgacatcgtttccaccgtcgacctccaggaggtcgacaacgcctaccagcaggccgcgcgcgagctcacgcagcgctacgacctcaagcagagcaacgcgagcatcgagttctcgaggaaggacgaggcgttcaccgtgtccgccccgtccgagttcgtgctcgggcaggttcaggacgtgctgaacggcaagctcacgaagcgcggcatcgagctgagcgccctgtcctggggcgacgtcgagcctgcgacgggggcgacggtcaggcgccgcgcacgcctggtgcagggaatcgacaaggacgtcgcaaagacgatctcgaaggacatccgcgacctcaagctcaagtgcaaggcgacgatcgagggcgacaagctccgtgtgagctccccgtccaaggacgtcctgcagagcgtgatcgcggcactaaaggaaagggattatggacagcctctccagttcacaaactaccgatagcgcctccacgggcgagaagaacgggcagaactgcctgttcgtcaccctggggtgcgccaagaacgaggtcgacaccgaccgcatgcgcgcccttctcctcgatgccggatacggcgaggcggaggacgtcgacggctgcgacgtcgtgatcatcaacacgtgctccttcctggcctcggccacctcggagtcgatcgacaccacgctcgacctcgccgacgaggtcaagtccggcgtgaggagcaagcccatcatcatgtgcggctgcgtcccctcgcgctacggcgacgacctgggcgagcagctccccgaggtgtcggcgttcgtgaaggccgacgaggaggacggcatcgtctccgtcgtcgacggcgtcctgggcgtctccgggcgagaagagcaggacgagtcgggcgcgatgctccgcaccatcgagggaacgagtgccttcgtcaagatcagcgagggctgcgaccggttctgcgcgttctgcgcgattccctacatccgcggccgctaccactcgcgcccggaggaggagatcctctccgaggtgcgttcgctcatggagggtggcgtgcgcgaggtcgtcctcatcgggcaggacacgggaatctggggcagcgaccttggagacggccgcacgcttgcctacctcctcaggcgcgttgccgaggtcgtgcgcccgtaccacggctggatccgcgtcctctacctccagcccgaggggatgaccgaggatctcatcgcgaccatccgcgacgtggacgaggtccttccctacatcgacatccccatccagcactgcaacgagcgcgtgctcaagagcatgggcaggagcggctcgacgcagcagctgagggagctcttcgcgaggcttcgcgagcagatccccggcatggtgctcaggacgaccggcctcgtgggcttccctggcgagaccgaggaggagttcgaggagcttctggacttcttcaaggaggaggagttcgactacatgtccgtcttcccgtactcgcgcgaggacgggaccaaggccgccacgatggacggccaggtggacgaggacgttaagatggagcgtgcgcagcgcctgcttgacgttgcggaggagctgggcttctctgcgaccgcgaagcacgtgggcgagcgcgtgaaggtgataatcgacggcgtcgatgagacggacgacggcgtcgagctcatagggcacacgtggttccaggcgccggactgcgacggcgccgtgcacatcgagtcgggtgaggcagcggtcggagacgtcgtgacggtggacctcgtggactcgttctgctatgagctggttggcgagatcgtggatggagaatagcaatatgtctgacaagaagaaaagcatctggaccccggcgaacgttgtcaccacgatcagggtggtcttcgtacccatctggctcgcggcggcggagctctgcggcgccagcgacggcaagtcgctctcgggcacggcgcttttcgcggcgctgttctacatcgtcctctcgctcacggacaagctcgacggctacctggcgcgaagcaggaacgaggtcacgaccttcggcaagttcctcgatccaatcgcggacaagctcgtggtcatcgtgtccctctgcttcctcctcgagcagggcgaggtctccgcgtgggtgctgctgatcatcgtggcccgcgagttcctcgtatcgggcctgcgcatggttgtcgcatccgagggaacggtcatcgccgcgagcaacctcggcaagtggaagacggccacgacgatggtctcgatttccggcctcctgctctgccgtgcgcttcctgcaggcgctttccacacggggctgcttggcctctccaacgtactgctcctcatcgcggtcgtgctcaccgcttggtcgggaatcgactacttcgtgaagtcctggaagttcatcgcggacgcagactagccaaagatgctgtcgaagcgggggtcggggacagcctgacccccgctttttgtaaaggtagcgcggacgggaagattcgcgctagacataggaaatgtaactgtcaggccgccgtcctatcatctatacaagtcgttgacttagaacgggtgttcgtatagtatgcgaggaaaggcgggagaggagcatgatggcaaagtctaagggcacggtccgcgaggttcacgagaagacctatggagaagaacgcgacaagatgatcgaggcaaccacgtctgagatcatcaagaagtttggcaagggctcgatcatgaggtatggcgacgatggtcccgacctcgagatcgaggcgattccgaccgggtcattggcccttgacgccgcgttgggcatcggtggcgtgccgcgaggcaggatcatcgagatctacggtcccgagtcatcgggcaagacgaccctgtcactcgagattctggccgaggctcaggcaatgggcggcgtcgtggcgttcattgacgcggagcacgcgctagatcccggatatgcggcacgcattggcgtggacatcgacgaggtgctcatctcgcagccggacaccggcgaacaggccctggagatctgcgacatgcttgtccgctccggtgcgattgacgtcgtggtcgtggactcggtcgcggcgctcgttccccgtgccgagatcgagggcgagatcggtgacacgacggttggactccaggcgcgccttatgagccaggccctcaggaagcttgccggctcgctggccaagtcaaagacgacctgcatcttcatcaaccagcttcgtgagaagattggcgtcatgttcggcaaccccgagaccacgcctggtggccgtgccctcaagttcttctcttcggtgcgcatggacattcgccgcattgactcgataaagaagaacggcgaggtcatcggcaaccgcgtgagggtcaaggttgtcaagaacaaggtcgctcctccctttaagcaggccgagttcgacatcatgtatggcacgggcatctccaaggagggctcgatcctggacatggccgtagactatggcgtcgtggacaagagcggctcctggttcacttacgagaccgagcgacttggacagggcagggaggccgccaaggagttcctcgccgagaatcccgacctcagggacgagatcgaccacaaggttagggtggcatgcggactcgagctcggtgacgagcgagttggcgagcccgtggacaagtccgatgacggggcgaaagaggagtagtgcccgtgaaggattgggagattcggctccccgagaacaagagggcgaggctcggcatggggagacccactgccgagctcgtgctcaggcagtccggaggcgattcgagacgaagaatccctttagccgtggcacgacgcatcctgaagcgtaacgaggacgacagcctctatcccctgacggcggaagaactaatggcccttgagacgaaggtcgaaagggtgtgctgctctcagagggcggaggatctactcaacaggaggggatactcctcagaggagatgcgtgacaagcttcgtcaggatgggtactcaaaagagctagtcgacgagtatgtgcggcgagccgttgaggtagggctcctggacgatagcaggtatgccgaatcgttcgcgcgttccaaggtcgctgccggatggggagagcgaaagatcgccttggccctcaggggaaagggcatcgacatcaaggagcttgaggactggcccgatgacatgttcagtcacgaggacgagtttgaaagggcgctcgaacttgcgagcagaaagaggttctcggagaagaacaggttccagaaagtaatgcggttcgtgtgcggaagaggcttcgacacgggtgtcgcatatgaggttgcgcgccgcgtctgcgatgaggggacatgacgataggtcgaccccaaaagctctcttcagagattgaaaatgattcccgacacggtatgcggtttaaccactttgccgtgtcgggatgcttctctctttcggaggtcgaacttacggtcacggtatctatttggcgaacggtacattagtttgacagtttgaacggatatacataggattaataatgccgtttgagtatttcctcgactgctgccattgcagttgatatttatatttgcacgttgatttactgacaaaggcttccaggcttggattttcctctgatggcgggttctgccagaaatggcagtctcctgaacgaccattgctaaagcattcatcaaggagtccacatggaagtgattattggcattgtctgcctagcgataggcgccgtcgtcgcatatctcgtagtgtccggcggtaacaactctaaggtacaggaagccaacaggtcggtcgaagaggccaaacagcaggctgagaggattgcctccgacgcgcgtcatgacgcggagaccgcaaagaaggcagccatcgtcgaggcccgcgaggagattctccagctcaagcagaagtccgaggccgacgagaagaagcgtaagcaggagattcagaagctcgagaacaggatcatgcagcgcgaggagtccctcgacaggaggaacgacgcgctcgaccgcaaggagcaccagctttcgagcctgcagggtcagattgacaaacgcaagagcgatgtcgacaagcttttcgccaagcagacgtccgagctcgagcgcatcgcggacctcacgagggaagacgcccacaaggagcttctcgacagggtgcgtgccgagtccgttcgagacgaggcgcagattctccgcgagtccgagcagcgtgtcagggcacaggcggacaagacggctcgcgagatcgtgtcgacggcaatccagcgttgtgctgccgaccaggccggtgagatcacggttacgtccgtgcacattccctccgacgacctcaagggccgcatcatcggccgagagggccgtaacatcaggaccttcgagcaggtgaccggcgtctccctcgtcattgacgacacgccggagaccgtcgttctgtcgagcttcaaccctgttcgccgcgagacggcaagggtcacgctcgagaacctcatcgcggacggcaggattcatcccgcacgcatcgaggagatgtacaagaaggcggagaagctcgtcaacgagcgcgtgcaggaggctggcgagcaggctgcgttcgacgccggcattcacgaccttcaccccgagctgatcaagacgctcggcgcgctgcgataccgcacctcgttcggccagaacgtactgcagcactccatccaggtaagcgagctgtgtggaatcatggcgtccgagctcggccttgaccccgctcccgccaagagggccggccttctccacgacctcggcaaggcgatagaccacgaggtcgaggggccgcatgccgtcatcggtgccgacctgtgccgcaggtacggagagaagcccgagatcgtgcatgccatcgaagcgcaccatgctgacatcgagcccaacaccgtcctcgatgttctcgttcaggcggcagacgctatttccgccgcacgacctggcgctcgccgcgagtccgcggagaactacatcaagaggctcgagaagctcgaggagatctcgaacgcacatgagggcgtcgagcgcacctacgctatgcaggcaggtcgcgagcttcacgtcatggtggagcccgagaaggtctccgactccgaggcgaccgtcctcgcccacgacatcgcaaagcagatcgaggacgagatggagtacccgggccaggttcgcgtggtcgtgatccgcgaatcccgtgcggtcgacatcgcgaagtaggaacatgcctggggattcaaaagacctcgtagacttcgtcgctgctatgggaggcgagcgttccctcaaggtggaggagaactacggagacggattcgtccgtctccgtgtcgccgaggccgagcgcaggcaggccaagcatgacatccgctgtgtggaggacgtcgtaatcgagatgctgcgcaactcgagggacgccggcgcccagaacatcttcgtggcgactacgcgcgaaggcaacgttcgaacgaccacgattctcgatgacgggtgcggcatccccgacgacatgcacgagaggatattcgaggcgcgcgtcacctcaaaactcgagtctgttcacatggacaggtggggtatccacggcaggggcatggcgctgtactccgtccgcgagaacgccgagtcggctgaggtcgtgagctccgagcctggcaaaggctcggcgattcgtgttgtgacaaatgccaagagccttggcgagcgcaaggaccagtcgacctggccctccctggggaaggacgaggacggaaagcagaccatagcgacaggtccgcacaacataatcaggacgtgttgcgagtttgccttagaggagaggggtcgctgcgccgtatacatcggctcgcctgccgagatcgtttcgaccattcgcaggagggtgacgccctcgcttgacggttccgcgcttctctttgtggacgacctgtcggagcttcccgttctcgaaaggattcccgctgcggcagacgcaggcgagctcattcaggtcgcgaggtcgctcgggcttgagatgagcgagcggacggcgcatcgcataattgcgggtcagatcaagccacagcgaaacgtcctctcgaagatgacgcacaagagcgacaagtccatccaaagggccgttgacctcatgcgcgacaggcgtggcatgaagatctccaagtcagacgtggaggagttctctcgtgcggtcgagaaggactttcgaatactagccgacaggtattacctgagccttgcagacgatccccacatcagggtgtctaaggggaagattgtcatcacgtttgacgttgatgaggctgattagatttcctgtattgaaattatctcaggaaatggtagctttatctgaatacgcagtttaagcgcactagttcgcatcgtaatgggagtcacgcaagatggagtttctcaaggtctccagcaagtcatccccggcttcggttgccggggcgattgcgggaatggtaaaggacggcgtgcccgtcaacatgcaggccgtcggtgccggtgccgtcaaccaggcgattaaggcgattgccattgccagggggttcctcatcccgacgggcgtggacatctcctgcgcccccacgtttgcggacatccagatcaatggggacagccgcacggccataaggattgccgtatacgtgcataggctgggccccacctcgaacacggagacatccccgcaggacgacgcaacggagttggtatagcttgtcaagagtgcaagagctcgtcggaaagacctaccacgtcaggacgttcggctgccagatgaatctgcacgattccgagcgcgtggcaggtctgctcgatgattgcggctgcatacaggtcgaggactcggcagaggctgacatcgtcgtcttcatgacgtgctccgtcagggagaaggcggacacgcacttgtatggcgaggcatcaaacctcgtacggctccccgatgccccagacggtcgccgcgtggtcgcgattggcggctgcatcgcccagcgtgacggcgaggccctcaagaagaagattccaaacgtggacgtcgtgttcggaacgagcgcccttgcctcccttccaggccttctcgtcaaggcatttgacgagaaggacggcaagtccgtgttcgtggacaccgtcgaagaggggagggggttctcgaccgagctccccagccatcgcgagcagcagttccacgcctgggtacccatcatgacgggctgcaacaacttctgcacctattgcatagtcccctatgtgcgcggccgcgagaagagccgcgtgttcgagaggatcgtcgacgagtgcgaccgcctcgtgtccgatggcgtccgtgagatcacgcttctcgggcagaacgtaaactcatatggccgtgacctgtatggcgagcttcgctttgcggaacttctccgtgccgtcggcaagactggggttgagcggatcaggttcacttcctcgaacccgaaggacctctcgccggagatcattgctgccatggccgagacccctaacgtgatgccacaccttcaccttgccgtgcagagtggctccacacgcgtcctcaaggccatgaaccgcagctatacgagggagaagtacatcgacctggcaaagcggattaagtccgtcatcccaggcatcgcgctctcgacggacattatcgtgggcttcccaggcgagaccgaggaggatttccagcagacgctgtcgctcgtctccgaggtcggcttttcatctgcctacacgttcatctattcgaagcgccctggtacgccagctgcgaagatcgaggacgatactccgagggaggttgtccaggatcgtttcgaccgcctcgcaaagctggtcgaggaccttgcgcatgaggcaaaccaggttgacttggacacgactgtgacgtcccttgtcgagggtacctccaagaaggacggctccgtgctcgtgggtcacagccccaagaaccagacggtgctgtttgacctacccgtaggcgctgccgcgagcgactacatcggaaagatgtgcgacgtccacgttgacgtcgcgaagacatggtatctgcgtggaaagctcgttggcgacccgcgatgagcacgaggggccgcgtcatagccatcgtcgggccgacggcatctggcaagagccagcttgccgatgaggtcgcggcaagacttggcactgcagtcatatcggttgactcgatgcaagtctatcgaggcatggacatcggtacggctaagacgcctcctgaggagcgcaaggtaccactggagatggttgatgttgccgatgtcggcactgacttctccgtgcagatgttccaagacatggcgcggggctgcgcggacgacctcatctcacgaggcctagtgccggtcctgtgcggcggaacgggtctgtaccttgatgcggtgattgacgagatggaatttccaaaggggcagacaaacggcaaggtgcgtcagcactacgaggagattgcgaagacccagggaggggagaagctcttctcgattttgatggaacgcgacccggaaagcgcgcggctcatccatcccaacaacgttagacgtgtagcgcgtgcccttgagatgctggacgatggaacgtcgtatgcagtgcagcatcagggactcaagtcacacaggccgcactatgacgccctcatcttcggaatagaccgccctcgcgagcagctgtacgatcgcattgaccggagagttgaccaaatggtaagtgatggcctcgtacaggaggtcagagcgctgcttgcaagggggcttagggagtcgacgacggcgagccaggcaatagggtacaaggaagttatcgcgtatctcgacggccaatgcgatatgggcgagtgcgttacgaccatcaaaaccaggtccaggcgatatgccaagcggcagctatcgtggctgagacgcgacggcagaacccggtggatcgacatgaacgaggtctcgcttgacgatgctgctgaacgcattgtcagcgagtatcaaggattgggagacaattagtgggaaggttcgagcctcgatctacagctctggttccagaaagagcaattctcgttggagtcgacaacagcaagtccgagtggccaatcgaggagtcgatggacgagcttgagaggttggctcacactgatggggccgaggtcgtctataggctcacgcagcgtctcgacaccccagtcccaaagacctttattggaagcggtaaggtcgaggaactcgttacgctcgtacacaatctggatgcggacgtcgtgatcttcgatgacgagctcagtccgtcgcagcagtcgaatcttgaacgtgcagtgggccgaaacgtcaaggtgatcgacaggaccgcgctcatcctggatatctttggagagcatgcaaaaacgaacgagggcaggctgcaggtgcaacttgcccaactccagtatgtgtatccgaggcttcgcggaatgtggagccatttggtgggggagcagacaaggggcggaataggcagcaggtttggacagggtgagagccagctcgaggttgaccgacgtcttgtgagaaagaggatatcctggctgaagcgtgagcttgagaagctggaaactaggctgggagtacgaagcaaggcccgctgggattctggcgtgtacagggtcgcactcgttggatacacgaatgcggggaagtcaacgctcctaaacaggctcacaaatgctggcgtttacgtgcaagacgaactgttcgcgactctggaccccacgacccgctcattggagctggaagagggccggaagattaccgtaacagatacagtcggattcattcagaagcttccgacgatgctggtggagtcatttaagtcgactctcgccgaagtaactgccgccgatttgataatcaaggttgttgacgcgtcagacaggaataacgagaaggaaattgacgcggtggattcgatcctaagcgaaatcggggccgatgaaatagattcgatcatcgtgttcaacaaagttgatttgatagacgactccaggagagcttcaatacttgcggcgcatccaaattgtgagttcatatcggccaaggatgggtttggcatccgtggcctgctgtacagaatcgcaaacgaggcttccaagggagacgagctgctgaccgcagtcgttccctatgagaaggggcttctcgttaagatggtgcacgaacgatgccaagtagtccgtgaagagtaccaacaagatggtctctttgtgaccgtaaaagcaccgaagcggatggcggaggtgcttaagccatatgaatgcgatagcgagtagatgagactcccagtttcagagcgaatggctactgaatgaacagcatcgtcagaagcaaaagaactggctggtggaatacatatatcgcgagggcgtgtctacctacgaactccagtggactacagtgaagcttctcaaaccacgtggcatatccagcattgtggtgacacgcagaaaaggcagctccagagagataaaggaagacgaagggaattaacggataataatcgcccgaactgaaggtcggactgggaaatccggcccaggagagccatccacagtcatagagctgatgaggaagccgaagagcaagaccgaagtttccgaaataccctgacggaacatgcagacagagcaagaagcatatcgccatgattatcgatatgagatttcccttaacatgaactccgactctgtcaagaacaaagcaggtcaacgtgcatgcacccatgcagaagatgattccgaagtttataggaatatccactctggcaagggttgtgaccacgaaaatgagaagagcgaccgccaggtatttcaaggaccttttgaaattgttgcgtgagtaggagaacatgcacccagcaataaaaacgaaggtccacgagattgttgcacgccaaacgtcgatgaatggtgaggcgaagaatccgagacgtaagccggcgatgaatttcaggtcatagcaaaaatggaacagcaccatggatatgacggagaagcctctgatcacatcaaaggcgtgaattcgacccttttggccggactctactgattccatcggccgttctcctaagagatcgatctgaacagtcccgtaaccttaccaaggataacagggttcttcacgtaaatcggctccatggagtcgttctctggctggagacgaatgcgattgctctcccgatagaacgtcttgaccgttgccgagtcattgattagtgccacaacaatctcgccgtcatgggcatcatgctgttccttgaccacgatgtaatcaccgtccagaatcccggcgttgatcatcgagtgtccgcgaacacgaagaacgaacgagcttgagtcccccactatgctcgtaggcaactggatggtttcctcaacgttctgctccgcgagaatcggaattcctgctgcgaccctacctacgagaggcaagcttatcgtgcctttgtcgaggtcttgacttatatgagcatacccagagtccgagcgagatgccccgccgtttggtgatgcagagtcttgctgcgcattggtaacgacctcgatggtacgcggcttcttggagtcacgctttatatagccacgttcttggaggacctttaggtgcatgtgcactgtggagggagaagctagcccgaccgcgcgaccaatctcacgcaccgatgggggatacccatgctcgttcgtgtattcgcagatgaaattgtaaatgtctgcctgacgcttgctgatgtggtcctttgacatggctcctcctttgttatggaacagtttacgacagtaagctcgaattcgcaaacaaatgttcgcattgtattgactcaaacacatgttcttctataatcgtacctatgttctacgcacaaatgttccgtaaatgaaattaatgtcctcgggacttgatacaacacaaccaagatcacgaggagaagagagaagaacatgaacgaaagcaacgacaagtactctgcagcgtttgagacatatggttctttggcacttgagcccagcatgaaccggttgattcttattgatggcgaacgtgattctggacgtaatcttagcggtgaaggtactttggctgatgatgccagagatcacgttaagaaccagaggattgctggtaggagcatcctcgctatggcggttgtcgttgtggcgtttgtcctggttactggtgttgcaggcgcaattctgaaggcaaatgtcgtaaagtcgtcgctcgacaatgcaaagctgacgaccgtcacggttgattcggggtccacggtttggggatacgcttccaagtgcaatgttaagggggcctccaccggcgagatcgcgcagtggattgaagacgcgaatgggatcaagcaggggaagctcgttgctggcgaaagtcttcagctcccaaactttgaggaacaataagtttctgatctccgtgcaaagtatttcgtgaaaagaagcaatttgcccctaagcggtcatatttatgagatttgtgttaatctcattctgtgatttgatggaggtggcaaggtgcggtgtccgaagtgcggttgcagcgaatcgaaggttgtcgattcgaggccatctgagaataacgatgcaatcaggcgtaggcgagagtgcgttaagtgcggtacgcgctttacaacgtatgagcgacgcgaagagatgcccctcatcgtcatcaagaaggatgggtccaaagagactttcgacaggcagaagatcatgcggggtctcgttgcggcgacagtaaagcgcgacgtgccactctccaagctcaatgcccttatcgatgacatcgagtcttacctgagggataacggtaagactgaggtggagtcgcaagagatcgggaagctcgtactccagaggctcatcgatatcgacaaagtcgcatacgtgcgctttgcttcggtgtatagggacttcaaggacgtggacgagttcaacgcggagcttaggagccttgccaatgagcagaccagagattgagctgcgcgtacggaggctttctggagacgttgagcttccgaaatatgcgtatagtggcgacgcgggactcgatttgagggcgaatgagagtctgtctcttaggcccttcgaaaggcgtttgattagcacgggtattgccattgcaattcctgaaggatatgcggggtttgtccaacctcgaagcggactggctctgagacttggactgtccttcccaaatacgccgggactgatcgactcccactatcgcggcgagcttaaggtctgcgcggtcaatcttgatcctgagaaaacaatttcaatcgagaagggcgagcgtatcgcccagcttgtcatacaagaggtgccaatggtgaatctcgtcgaagtcgacgagttggaccagacggatcgcggcaccggtggatttggttcaagtggcgtctgacgccattgaataggcctttgggtctagttgtatccgtattttgttttgggggggaattttggacaagctatttcacatgagcgagagggggacgtcgatgggcgacgagctccgcgctggccttacgacgttcctcgcgatggcttacatcatcgcggttaaccctgccgtgctgagcggggctgttattggcgctgatgggaagcccatgactggtgctctcgtcaccgcgacttgtgttggcgccggcatcatgaccattatcatgggccttgctgcaaacaggccccttgcttgcgcatctggccttggcgtcaacgcaatgattgctgccgtgacccccaccatgtgtggcggcgactggcatgaggcaatgggaatcgtcttcgtcgagggcgtcgcaatcctcatcctcgttctctgtggtctcagagagaagatcatggaggcaattcccgtgagtctgaggcacgccatatccgtaggccttggcttgttcatcgccatgatcggccttgttgacgccggtattgtcgttgctggcaagggcacgatcgtgaccctcggcaacgtctactctccgacattcatcgtcggcatgctctccatcgtgattactctgattctttccgcgctccacgtgaacggcgccatcctcttcggcatcatcatctcggtcatcatcggcattccccttggcgtgactaccgcgcccaagggtatcgttgacgccctcgatttctcgaccgttggcgctcccttcatgaccacgaagggcgtcatgggccttgcgaaggtgtttgcgaaccccaacgccctcatcttcgcgttctctctcatgatgtcggacttcttcgacacgatgggaactgcggtcgccgtggcgaagaatggtgagttcctgaccaaggacggtaacgtcgagaacatccgcgagattctcgttgtcgactccgccgccgctgcagtcggtggcttcatgggcgtctcctccatcacgacgttcgtcgagtccgcttctggcgctgctgacggtggtcgcactggtctcacctccgttacgactggcgtcctgttcatcatcgcagccttctttgctcctgtgatttccgtcgtgagcacggctgcgacgtgtggtgcgcttgtgtacgtcggattcctcatgatgtccgaggtccaggagatcgagtggactgacctgctccagggcttccccgcattcctcacgaccgctggcatcgctatgacctattccatttccgctggcatcggccttggcttcattgcctatggcgtcaccgcagtcgttaccggcaaggtgaaggaaatcaagccgctcatgtgggtggcaatcgtcgccttcatcatctacttcctcatgtcataggggattcgatcctacggggctcggctcgtccgagcccctttctttatgcgtaaattcgtggggaaaggagaacgatggcaagaaacaagagacagattattggagtcgacgaccgcgtgtccgtcggtcgagcgattccgcttggtatccagcatatgatgagcatgttcggctcgacggtgctcgttcccgtgctcaccgggctgaatcccaacgtggccatcatgtgctctggaatcggcacaatatgctacctgctcgttaccaggaacaagatccccagctaccttggaagctcattcgccttcatcagcccgattcttgccgccacagctgcaacgggcagcatccatacggcgctatctggcgtagtggtggcgggattcgtctttctagccgttgccggcatcatcaagctggtgggtaccggatggcttgacagaattcttccgcccgtgcttgtggcgtcggtaatggtcgttatcggcgtcggcctttctgcgacggccgtgaagatggcgctgaactcgtcgactgacaagttcgttgcgacgggtgcgattgtggccgcaatcacgcttgctgctgcagtcgtgttctctagtatgggtggcctcattggtacgctcccaatccttcttgcaataatcgtcggctacgtcatctcgggcttcctcggcctcgttaacttcaagcccgtcgtctctgcgccctggattggccttccacctgttcagaccccgcacttcgaccccggtgccgttgcgctcatagccccagttgcgctcgtggtcgtaatcgagcacatcggccacctgcttgccgtgggagagatcgttggtaaggactatcgtcccatgcttcctcgttcgcttgcgggcgatggcatctccacggtcatctccggcttcctcggtggtcctcctaccaccacgtatgccgagaacatcggcgttatgagcgtcacgagggtgtactcgacccaggtcttctggtacgcggcgggattcgcgctcctggttggagggttctgcccaaagcttgcggcgtttatcgactccattcccgtccccgtcatgggtggcgtctccctgctgctgtttggccttatcgcgtccaacggccttaggatgctcgttaccaacaaagtggactttgacgagaaccgcaacctcatgattgcgtccgtggtgat

SEQ ID NO: 255 - DNA, 12011 bp, Unknown
  Metagenome-assembled genome
tccgcgtccgacgcgacgaggagaaatggcccaaaacggcaagggtcatgcgccatttgcttatgaccgatgcgcattaccgcagctcaaggtaggtataggacccgcacgattcgctactctcggaaagtgcgaaagaaactgtacgtcatcgagcttggagcttgccgacgagctggaggcggcataggataggcaactgatctcaggtccaggacggcgtccgcccctcagagcaatgaggccgttacaccaacattcccgacactaccggctccgctcactcgatgtgaatataagggcatatggtagcagtccgactaggacaggcaatgagccatgttgagttgaaactagctatcttctggcaacgcgcttcacacctgcgatgaggtgcgaggccttgtcccggaagatccagaggaacacgaggtatgcgcaacagtagattccgaaggcagcgaccgcaggcagcatcagcgcgcttacgataaagatcagggtcagcagcagctcaccaagcgttagcgcgcgggaactcggtacctcaagctcgttggtcagcgtagcctcggaccatacacttcggccgattatcgccacaacagcgccgccgattactacgaaaatcgatccaaaggcaaagactcccagcagcgtgaaagcagcactcactatgcatgtccagatattgacccagagtagcctcccctcttcgcgcagcactttgaagaacgtggtgcagcagatattcatcttggagtcgaacacacagatgggaatgaggaagacgaagtagatgaagctgtttgcatacttgggcaaccatagcgagagcaaccacaccattgggtagtagagcagataaatgacgggaaagaaaaccgacatcgtgtctcgcgcattgcgaaagaagctctttacttcacttgtgtctacttgcctaagcgcagggaaaagcaccattgaggcttggctcacaaaggccaggaaaaagttcaccattgagagagcaaacgacagttctccgaaggtatcgattccccatgcagcatcgattgcgaaacgcgccacaccaagaatcaaggagctgacaatattcgccatcatgagtttgaagcctactcggatagagctccaggtctccctcgcagcctggcgaaatggctccaaaccgactgcaaaaaaatctcggcaaagccaagcacagtaacagagctgtgccacgctggaaaggatatatgaaattacaaaaggttggtacgaatgataacgaatcactagcagcacaataagcggaatcaagaaagtcagccgctcaacgattgtcgagtatgaagacctacgcgtctcattcattgcctgaagcaaatatgagaagtaatttgctgcgttctgtatggtcagatagattcccgtacaaacaatgacgaactctcgatctggtccaaacccacccctgatagcaaccagtactattgccaaagcaatgacgagctggaaacatatgccaactatgaactgggagaaaacagaccgcttgtcaatagcttcacgagactgcccgcctttgacaaggtaaacgccatcgttgaggccaaggtgggcgaagcctacgtagcctgtgtaaaaaataaagagctgccaatagccatactgcgtcgtccccaacagtttcggtaccagcagagtctgtatgatgctcagcatcatagctatgccttgtgcaaggaaggcggtcccggcgttttttgctagcgatcggtagttcatcgcacattgtcaccttcagttctaattcgagaattccattcactaatggcctcaaactaacgcacgaggaaactccgactcgatagctttcgtggtaagccaataaactagataaaaaaggagagccataatcaacgaattcaggcagaaatacatcgagagcgtctcttcctgcacaaaactcttcacaacggggacgtaaaaataggcaaagtagaggaggcgaacatcactaggatgttctccaagccgtcgcttcgtcgccagataccaccaactgaatacaagtcccaaaatatattcaatgatcaacatgcccgggaggccaaagtcatggagatactttttaaagcacgtatacacattgcccactagaatgcccgttgcagaaaacctaaattcctcatgcaccgaaccctcagctattccaaggtcattttccagcgcataaaatgactcctcgccaaaggaattggctacagaatcaatgccctcatccctcacatataaatctaggagctcaatagagccacccgtataagttgagatgtaagtcataggatccgtatcattaagacggccgactgcgaatcgcattccactaaagacaagcagaaaggcagccacactcgcaataagccacttgatgagctttctgctcgccccgccctgaaatccgtgaatccttccataggtaagaaatagaagggtaaatgtaactacgagcagcgttatcagttctgttcgcgatgccccgaatatcgacatgacaataaggagggctgcaggtactaaaaataagacgttcttacgaaatttcttagtgtaaacaacgttgttaataaagaagaacaggtatacataggcaattgccttgaacaccttgaccatctggttaacgtagtaaggttgaagttgcgtcccgtcatagccttttgtccgataggcgttcgttacgttggctaacgtggaaaacgaccccgagacagcaataacgtttctaataaacaacagtgctgtcacagcggaaaagatgatgcagaaaatagtaattagaccatttggccaatattctttgcacgacaatcgatagtcagcaacgttgttgtctttcctattaacaaagagggcaagcccgctccccaaggaaaaggctgatacgcctagaacaataacgatgaaggttgtccaagtgaggttgactccgaaatagtcaatcaggtacgtacagaatacagttgcgacaagaaaccccaaagtaaatatgttctgtggagcccagaaatctccgtcagtcgcaaaatagttgataataaagactactaccagcgcaaatatgagccaataaatgaccacgttgattgcgttccttccaaaaccttagccgatacccatcaaatatccatctcgcaagccccgactccattgacaaagctttgcaaacttatcgtcctcataaaatagatagacgaatattcgtgtccaggcagttctgacatatcgatggtaacgtgcctcgcccaaactcaaacgatgcttccgagcaaaatacacctgatttcgcgtaatgtaataaaccctaaaggcggaatggttgaacacaacaaaatgctttcccaaaaagctgtgctcacttgtacctgtacctacctcatgtaggattcctaccgatgcaatgctcaggatttttttgccatccaacctaagtcggtagcaatagtcagtatcgactcggtctatgaagaggcgctcgtcaaaacctcccagtcttttccattcggctagatcgatatagttaccagaagtgatgcaggaatccacgtacttcttatctggctctttataggcaaaacttctgtcggtaattcgacaggtcatagaagcaacatccgactcaccaacatggctctcatattccgcgacaagcccctcgccgcaaacagaatcttgatcaagcgttagcaaccaatttgcaccacactcagttgccttagaagcaatctgattcaaagcggttgcaataccgcgattctcctcgttgtgaattacctcggtagggaatttgtcacagaggccagtgatagctggataatttttagacccattgtctacaataacgacacggtcaacctgcgaagatgctgccgacaggttctcccctagcctctcaatatcagggttgtatgtcactatccctgctaccagcaagattctctctcctcattcaatacgataattcaacaaagtagggaccttcatcaatcactaacatccagctggcacaagcgtccaactgtccatatacagccctattttcctgccatcaacgaaccacttgtcaggagcaataacaattttattgtcgtttttcgaaagaaattgggcccaccagctgaaggtgctgttcgagataatgaagttgttgcacatcgtcatcattcgaattttctcttcgaccgtgtcacaacctctttcgtaaagaaattcgtattgtggataggcatcttcaaactttaggtgttccttcacccacttcacgtcgtcggtaaagacaatgaacttagggtgatttagcatctgggatattcgctcgatgctgtcgtggaagtactgaggattacatacatatagaagcttcttgaccgtgggattaaagtaatttccgcagcggatagatatacagacggattccttgtcacgcgcaacgtcgtagacatatttgttttccatgaggggtctcgttattggaacgatctcatcggagagctctttctgtacatcctgtagatagcgaatgtcttgccaccaaccagaagcaaatatccgctctgcatccagcacgggaatcggcatatagtcagaccgttgccacatcaaatagccgcgctttgccatagactcaaagtactttcttggcatcaccttttttacgggttttattacgagattagagaagtccgcataccaggggaacgccttatcttcgcggataacgttagcgtcgagcttgaatccacccattgcataggagaacttttcgtcagccactttagacatgcgatgttccagctcgtacacatcacagtaaatttgcccaccatattgtttctgcaggtttcgagcaaatgcatattgaaagagttggttgcccaacctacccgtcagcaatgtgtgtatttctttcatggataacatccttcaaatgtagtcagctgatgcgtggaatgaatagcggcctattgcattaagcccgctttgcggcacgcccggcaaaacaaagtgaatggaccgatgcccagaaaagcaaacgctgcagccagtcgctcccttgctctagcgcatccatcaaaaagaacagtttgccggtgctgggtaatgactgcccaaagatctgcgcggcaacgtttattttccgaatcgctagtatcggtaggcacctgagcgaagaccgtcctgcagattgaaaaacacctagatgcagccgcactcgtaagatcaggccaaatccgcgagatgtcgttatatagctgacgtgaaacccttattgccgaatctgcctttgacggattgaaatcctggcgcactaggctctctctacgctgacgatacgcgtagagttcccggtctggtactagcacaagctttcctgctctacgcacaaacttgtatgtggaggcgaggtcctcgccaatcacgatgccagtcggaaaaggattgctacccaaaatatcacgacggtaaagtcgccattgaacgcccgtcgtagcttgctggtagagcatcattcgtagaaagtcaacgtccttatagacgacagaagaaaggtcagctttatcgggcgtagccaaagtgcatgagtcaccatcgcgaaaatcatgtcccccaggaacacaagcaagagcgcagccgtgaccagtagctgcttggaacaacatctctatataagtcgaagcaacataatcatcggaatcaatgaaagaaatccattccccgcgagcttgctccaacccattatttctggcaacagacactcccccgttaggctcatggagaacgtgtacggtctggtacttctcgctaagtcgattacacaattcggaagatccatcagacgagccatcatccacaaggatgatttctatgtttggataagtctgtgccaaaaggctctgcacacactgctccaaatacttttctacgttgtagaccggtacgattactgagaccagaggataatcagtagtcaacctacttcaccttatccctgattgcccacagtgcctgcttagctcttgtataagtacccgtgtgctccaagagctcgcgaccgttgcgctttgcgcaggtgacaacatcctgcgggaaccacttcttcatgaacgccatagcatctatatgccgcaggtcatcgaacatctgacgcctacgcggatttggactaattgaataggtgagctcgtgagccctaccggcagcctcatcggggtcaatttcctttgcccgcagcatgtccagcgaggcgtccagcatggtttgaccccactcggagtgcaccagaatgcgcgttgctcccctattgtcatcgaagccatcgccatatcgccatgcatcgaagcaatcccacagagtgagatccgtcgtgcggtagcgcttcttgaaatggcactggtaacaactggttctatcggagaggtcatcaaagaacgccctcagatacgggtcagactccactcccgccgagtaggtaggctgaatctggtactcgctggtagcaggcttatagggctccgtttcgtcgaaggcgcggatgttggagtactcatacccccaacgacccttgtcacggaacagtacgcaatccgcctcgtgcccggtactatgctgtagccactctaggtatgccgagaacacggcacggcacggcacggcacggcagacgacgtctgccatgccgaggccgcgggggagcttgccgccaaagtagtggtacagcccctcgcactggcaaggcgtaccagagaagagcacgagcctcccctgtttcaggtactcggcaacctcctggtatgcattccccatctcgctctgcacgtacttgctgttgcggaagaatctcaggtcctcgaccttgtctaccgcaaagcagcgcacggccaaggggctgtcatatgcagctttcccatcccggtcgtagccggagccgaagacgactccacccatctgaatcaccgttgtagcaagtgcagtgaatgcaccacctgaggtggactgtcgcagaactgcgtcgtctttgttttgcacaaggaaggcccgctgcttgaaatccttgcggggtttgtcaggagttacgttgatgatggggcaagcacgtacgcatttgccgcatccgatgcacttagtgtcgtcaatctgcggatattcgcagccctcagcatcgaaggccattgtgatgcactgcacaggacagacgttggcgcaagccgcacaaccacagcagtcttccgcatgatggatgtctacgtgaggcgatgccttgcgccccccaaaatgaagggcgttatcgaaccatgaggaagactccgcacggtaggactctagcctggcctctgacttctgaaaatcgatggactgagaagctatggtgtcgaacgcatcgtcggactcacagattctgcctggcagattcagtacacgaagcagcgtgtcgattcgggaattcgtagactgcccactctttgcagcatgacgcctaaacgacacgaagggcacctggaagagattgctaaagaccgacccatggaaggaatcggtgcacacaaagctggcatgctcgaacagagcaagccactgtgctggaccggcatcccacggatacacgtccgcgtaatcgttgtcggaagagatgtaaacgtcgttgtgggcaatcgcaacaaccttgagcccgtgcgtccgagcatatcgaacagcacactgacgctgccatggattatcccccatgaagtagcagagaacgtaaggctcgctgggaatgcccttatacgattcgtcagcgacattgcgccattgctcagcagttagcagcatggtcggatcgcaggtaaccgtcgggcgattccccgtggccttctgcaccaatgcggctgcagagtcctcgcgcactgacacggcagagtaatccgcaaggaaattgcgcatgcgacccaggtagtaatcgtccagatgggaaagaccaatggaagtagcataggagaccttacgcacagatttgtccacccattcaagcgtaaagtaaccgccacctatattcacaggtagccaaagctggtcagacccaactaccaccgcatcgtactcacggctaagattgcgcagttcatcgaaggaaaaggtctttcgagtgaggtggaagcgcgcacgagcaaatgcatcgaaagcacggcgacgcatacccatctgttggctaaattccttccgagccttttggcgcagtagcttgccaacaaagggggccttctcgcgatacatctgcacgtccagtgcattgcgacggtagtagtccatgcggcccagctcgattgccttgccaagcccagtcttgtcgattgtgcgcacgtcaaagccttgcgcctcaagatacgcctgagtcgcatacgcctgcagcatgctcccaaagtttcgcttgtcatggcaagttgcaagggcaactcggacgccgttggatttcattatgttattcaacagaaagcccagcttcctttgctagctcgaggtacctattggtcagccactggccctggcgcacgatgtcgtagtttgcgaagtcatcgtggttgatgttggtacgttccgcattcgaacgaagacagatatggcagaatgcatcggcccatacgtctgcgtcatcaatcggcagaaagtcacaggtactggttacgtccacctcgcgagtaatggtatccgctaggatgcagggcaggcctgccgcttgggcctcaatgcccacgaggcacaaaccttcatagaggcttggcagcacgaatgcgtcgaacgcctggtagagctcgttcacgtcgtctctctggcccaggaacttcaccttgtcagatagaccaagctcgacaactttgctctctgcgcttgccatgccatctccagagccaacgcatagcagtatgaggtcatcgcgcttctggcacgcctttgcaaaggcatctatgaggaagccgtggttcttctgcggcatgaaacggcccacatggccaatgacaacctggctgtcggcaattcccaactccgcccggactttcgtgcgagcggactcggagaaccaaaagcgctgcaaatctatggcgttatacataagctcgaatggtacgcccttgccaaagagccattcgcccgccagcttcgagcaggcgaagcggtgcgtcggatagcgattggcctgggtgcgtaggaccgacttcatgacattcttgaccgtctcgcccttgccagcggtactgtggctatgcgagatgcgcaccgggaccccagctcgcacggcctctttcagtggaaacacgttcatcgcgttggcatgcgaatgtacgatctgccattcgtgatgctcacgaaaaagatcatagcaagtaccaaggaactggggcaggtgcgtgtaagcgggtaccatgaacacacgtccgccaagagactccatctgttcccttggaacaatggtcgagttctcggtaacgatgaaatcgaactggaccttcgaccggtctacgtggcggtagtagttcataactaccgcctcgactccaccgccgttcatgtttcccacaaattggcagacacgaatcattcgacaatccccactacgacgctcaaagaactcctagatgggaattcagtcagttcccctgtgcggtcaagaccacaccgaccgtctggatgatcaacttgaaatctacccaggcactacagcacttgatatatagaaggtcgagagcaacccactcgtcaaagctgatgtcatcgcggttgcggcgcgtctgccaatagcaggtgattcccggcttaatgagcagacgctgtgtctggtacggcgtgtactggcagacctcacgcgggagcgccggtcgcggaccgacaacggacatgttcccgagcaggacgttgaggaactgcggaagctcgtccaagctggtcttgcggatgaagcgaccaacgcgggtgatgcggggatcatccttgatcttgaagacgggtccgtccttctcgtttaaatcactcagactctcgagacggtcctcggcatcgacgtacatggagcggaacttgtacatcttgaagtgccgaccgtccttgccgacgcgctcctgattgaagaggacgggaccagggctatcgagcttgattgcgatggcgacaacgatatacagccaccagagtagggcgaataccagcagactgaacgcaatgtcgaatgcgcgcttgaacgcgacatagccgatacgggtcctgagcctctccgcggcacgagtcgcttcaggatcgggagcttcgtaggagtctgtgtcctttaccagatggtaccttgaggcgacatgaccctctgcagtctggtgagccttgacgatgacggcatgcgatttgcgcgcattgtcggtacttgtaccctgctgggcaacggcaaacgcgtcttgcatcgagtaatacccccccccgagcggattgcccggacgacgtatccatttcgacgccagcgctgcctgatgcgatatgcggctctacaccaacggccctggatatgccatgaaaccgaatttgctatcaaatgccacgttgtgacacgaattacatggtaccgtagatttaagcttgtgataaggccgttttgtgatttcctaaactagtcttaataacgtctatttaggaacgaataacggtgctaatgcatgtgcgatggcttgacaccatagccttgacatgccttcttcaagagctcatagtgctcaaccctgtgggcgtcgcttgcgatgaagcgataaaggcccatctggaagagcctcttggcggtcttgccgctgttgccgagacggccaccttgtataaaatcggccgaagcctgcaagtcacagtcaagctcgacaagacgcctcgcaagctccggatcccgtctgattgcgtcgtagcgctccgggtgcgcgatgacgacgcgccagcccatgccctgcagctggtagatagtgcgttcgtactctggcatagcgttcgccgtacaatgcgtgtcgagctcgagcagaaactggcccatgcggcggcagccgagacgcgggccccactcccccacaccgagctgcatcagcttggcgtggttgacctcgaaacccattgccattgggaagcctgacgcggcggacctgaacgcatcgaacgcggcgaccatgcggtcgtagtcgaagtaggggtcgcggcaatggggggtgcacaccatgctcgtgacgcccgccgccttagcggctgcgagcatcgcgaggctgtgcgccatgtctggcgaaccgtcgtccaccccaggcagtatgtggcagtggatgtccctcatgcccgtgccgtggtgctattagagcggatcatgacgtgccggggcattgtctagccctgccttggggtgtagcctgccttcttgaggaaggccgacgtctggtcgaggttgttgctgccggtcgcagacgttgcaggcgggacgactggcttaacgcgggcggccacaccgccggccggagccgacacctggcggacgccacgagagcgcggtgcagcggagatgggggcctgggcctgcgaggcggcaggggccacggggacggaagatacgggcgcgaagtcatttgcggatggcggcggagtgacgacatcgtaggaatcgttcttctcctccccgtactccttgtagtagccgtagtagtggcccgaggaggcggcgtcgcaacagttgaggaccgtgccgatgacgttggcgcccgcctggacgagctgctcgtacgcggcggagacgtcctcacgatgcgcgtagtcctggcggacgacgaggaccgtggcgtccgtcacggagcccgccacggcagcgtccacgaaggcggtcactggcggcgtgtcgatgatgacgaagtcgaactgggccctaagctgcgtgaggaacgagtggaagcgcttggactgcaggacgtccgcggggttggggatgccgggct

SEQ ID NO: 256 - DNA, 38075 bp, Unknown
  Metagenome-assembled genome
ctctgcttcatggcgtcgagcgtcttgaggtacgtggcgtgcaggtagtcgagcttgggctggcagcggccgatggagccctcgctgcggagccagatcgtcacgtcgtacccgctgtacgcgctctggaacgcgatctggctgcccagcacgccgccgcctgctacggttaccttcttgatatccatatgggttcctttccgtgggacctcgcgttgcttgcattggtcctctggtacccaatgccgggtatggaatgacgttcgccgcccaaaaacttcggtggacggtagaaggcgagaaggacggcggcgcgggctgccggcggtgcgggatgcggctactgggccagcaggtccgcggccttgtcgcttgcgggctcgagcgcgccgagcgagcggtagagccactcgacctgggcgggctcgggcgcggcggcggtgttggcggccgagaggtcgagcacgcgctgggcgagctggcgctgcgtgtcgtcaagcgcgtcgacgtccgcgggctcgtgcgcggcgacgccgcggtgctcgctcacgtggcccgcaaaggccacgatgttgggcgtgacctgctcggccgcggcatcgtccgcgtcggtgtacgtggagatggcgtccaggatgacctgcgcgggggttccgcaggggacaaagcccggcacgtcgtccatggcgtcggtgatggtggcgcccagcgcgatgacggcgccggcgagctgcttcttctggtcggacatgggtgttcctctctgtcgctggtctaaagcgggcctagcgtatcccaggcgggtgcgcgcgtgcgttgcagatgcaacatcacgagataaacgcgagcgcgaccgtggcatttgcgtgtgggcgcgcgatgccgtgacggcgggcgagaagggctaccccagctcgcggatgatgtactccgagaagcgccgcgcggccagcggcagcgtcttgctggagcgccagcccagcgtgatcgtgcgcttgggctcctcgcgtatgggccgcacggccacgccggactcgaaccccatgagcatcatctcgtacaggaccgtgacgccgagcccctgcctgaccatggcgagtatggagtagtcgtccgtcacctcgtagcagacgtgcggctcgacgcccgcctgctcaaaggcgtgcagcgtgacggactcgcgcccctcgtccaggaggattagcggttggtccgcgaggtccagcaggctgagctcgtccttctcggccagggggttgtccggcgggaccacggccatcatgcggtccgggccaaaggggtgggtctcgagccccgcggcctgggcgtccgtcaggttggtgaagcccaggtcgcaggcgccggtgcgcacccactgcgcgatggaagtgtactcgctctggcgcagcacgaagcggacgttggggtagcgctggcgaaagtgaagcatggggccgggcaggaggttgcggctcacgctcgtgaacgtgccgatggtgatcgtggcgcggccgaggccctgcacctcgcggcgcttctcgtccagtgcggcctcgtcccgcgcgagcgcctgcaggtagggcatgaactgccgtccgtccttggtgagcgtgacgccgtccttgccgcgctcaacgagcgtgacgcccagctcgcgctcgagcgccttgaccgtctggctgacggcgctctgcgtgtatccaatttccttggcgaccttggtaaagctgcgctggcgtaccacctcaagaaagatggagtaccttgtgagccgtacctgcgcgtttgcgatgcttggtcccgattgtgcagccatgagccctcctgtgcgcgatactgcattagcaaagctattgaatcaataagaaacattcgttttacttatgttacacaccgttgcttaatgtgcgtaggcagaaatcggaaaggcggggggcatccatggcaacggcggaactcggaatgggggagcggcttccccaggcgcgcgtggcgtgcacggcatcgcgcgggggcctgctcgcacgtcatggcgtggccctcaaggagggcgttcgcgacggcgtgcccatagccatcggctacctggtcgtgtccttctcgctcgggatcgccgcgcacaaggcgggactcaacgccgtggagggcttcttcgcgagcttgctcaacaacgcgtccgcgggcgagttcgcgggtttctccgtcatcggcgcgggcggctcgctggtcgagatggccgcggtcatgcttgtcgcaaacgcccgctacctgctgatgagctgctccatggcgcagcgcttcgagccggggacgccgctcgtgcaccgcgtgctcgtgggctacgacctcacggacgagctctttggcatcgcgatcgcacgccccggctatgccgacccgtactactcctacggcgcgatggccgtggcgctgcccggctgggccgtcggcggcgcgctgggcgtcgtggcgggcgacgtccttccgcagatcgtggtgagcgcgctctccgtcgcgctgtatggcatgttccttgcgatcatcatcccgccggcgcgccagaaccgcgtggttgcggcgctcgtgctggcaagctttgcggccagatggtcgttcacgttgctgccgctggtgtccgcgctttccgacggcacgcgcaccatcatcctgacggtggcgctctccgcgctggccgcggcgctcttcccggttgacgagcgcgacggcgtgcaggagcccgcgggcgagaaggacgagggcgcctcccccgcggcgggctcccgggcgcagggcacgccggccgattgcggggtgagcctcgatgcggcctaacgtcgtggcgtacctcgccgtcatgtccgcggtgaccctgggcacgcgcatcctcccgctcacgctcatcaggaagccgatagagaaccgctttttgaggtcgttcctctactacgttccctacgtgacgctcgcggtcatgacgttcccggcgatccttcaggcaacggatacgcccgtggccggggcggcggcgctcgtggtgggcgtggccgcggcgtggctgggtgcgagcctgccccaggtcgcggctggctgctgcgtcgtcacgttcgtgctcgagctgctggtgtagcgcctacctcgtcgcggtcacgccgccgaagctgacggaggccacgttggcagggtcgatcagcccgtcgaagaacgagccgacggtgcagacggtcttgccgtccttctcctgtgagcttgccgcaccagagggcacgctcacggtgctgccgtccctcatggtgacggtgatcgtgcccaggtcaaggtagtcgctcgaccacttgccgcttgcgggtgccttctggaggccgtcgaccgtgtagctcacggtcacgcccaccggcgacacgctcacgccccggacgctgcccggcgtgcccgcgaccttgaggctacctgccggcttgagcgacacggagtcgctctggtagttgagcttgaacttgaggtcccagctgcccgtggccatggtgcccgcctcgtggtaggtcgtggggtcgagcaggctcagccccctgaagctcgcgtgcgtggtcgcaccgatgacgctcgcgttggtggtgtacttgaccaccatctggatggcgttgtcgctcgggtccgcgtcgtagaagtacgactcgccgccctgggcgctcgcggcgtccatgctctggtcaaagtccgcgctcgggtacttgccgtcgatcgtgagggtgccgctcgcgtccttcccgatggtgccaaacgccttgccgtccgcgcgactgatgctgtagaccacggcgtagttgtgctcgtcgcccacgatcgcgtccgcgctgatggtgacgccgtcgctcgtggccgtcgcgtccacggggcgcccgaccttgttgcgcacctcggtgggcgccgtcgacccaaagaacacgtcgtcgatggcgctggccacgctcaccagctggccgctcgcgtaggcgtagccgccggcccccaccacgagggcgatgcccgccgccacggcagccatcgcaaacctcgggcgcgtgcgcctggccgccgcctgcccgcgacccgcctttgcgggcgagaaggacgtggcctcccgcccggcgccggccctgggctcagtctgccccaacgccgacgcagcgactgccgcggccatccggtccctcgccgcgggcgaaagagaaacgcgattcatctcgtcccggtacgcttccattatcacgtccatcgtccttctcctccaagctcttgcgcagctccctgcgggcgcggctcagccgctttgtgaccgcggccaccgtggctcccacggcgcgcgcgatctgcgcgatgctcattccctcgtagtagtgcaggtacacggcctcgcggtagggcggggcgagcctcatgacggcggtcgtgaccctgcccggcagctcgtccttctcgacctggtcctctacctggggcgcgggatctcgaacctcccccgcggcggcgagcggtacgttccggctgcgcgcggcgcttcgcaggatgtccttgcaggcgttcgcggtgcagcgtatgacccaggccctctcgtgctccgggccgttgaacgcccccggtctgcagatcatcttgcacagcacgtcctggctcacgtcctcggcgtcctgccgggagcctaggtacgtgtaggcaagccgcagggacaggtcgccgtacgattccacgagcctgcgggcctcccgctccacctccttggtgcgtgtcgttcgatccaagtgaaaaacctcctcgatttcctgagcgctcacacacaacacgtttggctggaggaaagctgacagcgcttcgccaacattgtggcgcaaccgcgccatggcgcgcgaacgttgcccaacatggcgcgcggggcggcgttgggctatagtttctgcgctggtagaggtgcatggcaggcggcaagcgggagctttgatgaaggaaaaggtcgtgagcggcaggcgctacgagggcgtggagcttgacgggcagatcgtggcgcacgtgcgcatgtccggctgcgagtttgtggattgcgtgctggacggctgctcgcttggcggctgcaccatagaggggtgcaccttcaggggctgccgcatcgcgagcccgcgctcgcagaatagctacctgcgagactgcgactttgtggactgcgagctcgtgggcgtggactggtcgctcctgtggccggacgaccgcaacggctccgccatcggccggcttgaatcctgccgcctgcgcgagtgtcgctttgacggcctgggcatgcgcgggctcgggtttggcggcagctccgcgcaagactgcgcctttgcggcgtgcgacctgcgcgactgcgacctccacggctgcaacctggccggcacgcgctttgaggactgccgcatgcagcgcgccaacctcacgggtgccaccggctaccgcctgagcctgctgcgcaaccgcgtgcagggcgcacgcttcacctacccggattgtctcgcgctcctggagggcacgggtgccatcgtggagaaggacgagccctcggcctagtgccggcgcccgtggtcctgattgtcctggctgacagtgtcgaacgcgttcttccactcgcgctcggactggcggttcctttcctcctggtaccagggctggtcctccagctcgcggctgcggccgtctgcggtgcggcgcggcgctcccgtctggccgcgcctgcgctcctgcttggagacgcgcgccacgtggatgatgaagccgatgatcagcaggatgagaaggacgaacagcgcgatgcagagcgtcgccgtgtccatcgcagcgtccttggggcccagggccatgtccttctcctccgtcttgttcttgcaaatcgatcgaaaagggcgcggccccgccgccctaaggctgtgcggggccgcgcgccgcgttgctactgcgtcagctcgaggtagaggtcgcggtactgctttgcggacttctcccagctcacgtccttgttcatgtcgcgcttgaccatctcgtcccagcaccagcggttggtgaagtacagcgtcttggcgcggttgatggcgtcgtacagcaggccggcgtcgtagcggtcaaaggtgaagccgttgccctcgttgctgtacttgttgtagggctcgaccgtgtccttgaggccgccggtctcgcgcacgatggggatagtgccgtagcgcatcgcgatgagctgcgtcaggccgcacggctcgaagcgcgagggcaccatgagtgcgtccgcgccggcgtagatctggtgcgagcgcgcctcgtcgtacatgatgttggagcagaccgtgcccttgtacgtgttctcatagtagcggaacgagtcctcgtactgagcatcgcccgtgcccaggagcacgacctgggtgttgccatccaccatgccggggatgacggcgttcacgaggtcgaggcccttctggtccgtcaggcgcgatatgaggccgatcaccatcttggcgtcgtccacctcgaggccaagctcctcctgcagggcgcgcttgtcctccttcttgttgtcgatcacgttcttggcgtcgtacggcttctggatgaacgtgtcccgcgcggggtcccagatgtccacgtcgatgccgttgacgatgccgcgcagcttccaggagtggtagcgcaggtgcgcgtcgagcccctcgccgtactccgggctctggatctcctgcgcataggtgccgctcacggtggtgatcatgtccgcgtaggcgaggccgcccttgaggatgttggcctcggtccagtcctgctggagcgcgccctcgttgaagacgtagtcgggcaggttggtccagtacttgatggtggggatgttgtacttgccctggaagcgcaggttgtggatcgtgagcacgaccttggagcggccgagcggcgtgttctggaacatagtcttgaggaacagcggcaccaggcccgcctgccagtcgtggcagtggatcacgtcgggcgtccagtcaaggtagttgagcgccgcgagcgccgccttgctgaagtagcagtagcgcgggatgtcgtccaccaggttggtgtaggggttgccgtagctgaagaagtcctggttgtcgatgaagtcgtacacgacgccggaatccgccacgtactccatgatgcccacgtagaagctgcggccgtccgcgcacaggtccatgtcaaacgatccgcggtagaccatcttctcctgccactgctccttgatgcaggcgtagcgcggcaggatcaccttgacgtcgcagttctgcgcgacgagcgccttgggcagtgcgtacatgacgtcgcccaggccgccggtcttgacaaaggggtagcactcggacccgatgaagcagatgctgcggcgcggctgggggagaggagcgggctccgccttgggtgcgggctccgccttgggctccggctttgccttggctgcagccttgggctccggctttgccgcgggctccgccttgggcgcgggggctgccttggccgccggctttgcggcgggcttgggctccggtttggcggcaggcttggtcgcggtcgcaggcttcggctcgggcttgggctcaggctttgccgcgggcttggcctcgggcttcggctcggccttggcggcaggcttgggtgcggccttgggctcgggcttgggcgctgctgccggctttgccgcgggctccgccttgggggcgggggctgccttcgcggcgggcttctccgctggggccgaaggcttggcctctggcttggcgggtgcgctcttctcgtctgcctttacctgcggcttcgctgcagccttgggagccggggcggcctttgcgggtgccggctctgccttcggcgcagttgcggtcttgggctcagccttgggtacggctgcggccttgggctcggccttcggcgtggctgcgggcttgggctcggacgctgctaccggcttgctcgtcacgggagtggccgccttgggctccggcttgcttgcggttggcttggctgctgtcggctttgctaccgtggccttggcggtcgacgccgcggacttggtggcgggctttgccgtggtccgcttcctggccgccggctttgaggttgactttgctcttgagctggtcctttttctggtggccatgtgcactctcctcgacgttcaccaaacggcccgccgcagctgcgaacgtgcggcaggcatgccttttgcatgcccatccattgtaactttgcgggcgggcgttcgcgggtcgttgcgggcagtgtggtcgtctgggcgtctggcggttgcggacgcccgttcgcgctaaggtaggtgcatggacgcgatactttttgacatggatgacacgctgtacgaccaggcccagccgctcgcgtgcgcggtgcgcaaggtggtgggggagctgcccggcgtcaccgcggacgcgctctacaaggcgagccgccgccactccggcgaggtgtttgccgcgtacgccgcgggcggtcgccccacggacgccatctacgtgcgccgcatgcgccagaccatggcggactttggcgtaaaggtatctgacgacgtggcccttaggcttcagcgcgcctacaccgcacgcaatcccgaggccatgcggctcagtcccgcgatggtccgcacgctcgacctgtgccgtgcccacgcgcgccgtggccttggcatcgtgaccaacggcacgctcgaccgtcagatggacaagtggcgcgagcttgggctttcccgctggattccgcgggagcgggtctttgtttcagacgagctgggcacggcaaagccagaccctgccatcttcctgcacgcgctgcgcgccatgggcgcaagcgcggacgcgtcgctctttgtgggggacgcgtaccagatagacgtggtgggcgcgcacgcggctggcatgcgcgtggcatggctcgaccgccgacgcaacggcatgcccaagggcacgaacagcccgcgggcggactggaccgtccacacggacgagcagctcgcatcgctcatggcgcggcttctggggcaggaggactgacgctcgctggccatgacggcccgtggggctgcggctaggatagtgcctcgctcacgtggcgctgcaggtcggggatgacgtccttctcgaaccacgggttcttcttcatccagatctggttcctgggcgaggggtgtaccagcgggaagtactccggcaggtagctctggtagttgcggacgacgtccgtgagcttgtccttgctcttgagtcccaggtagcgcctggtggcgtacgacccgatcagcacggtgaagcgcacgttgggcatgagcgccagcagctgcgggtgccacttctgcgcgaagcccttgcgcgggggcaggtcgccgcccttgccgtggccggggaagtagaagtccatgggcatgatggagacgaggtccgggttgtagaacgtgtcgcggtccatgccgagccactcgcgcaggcggtcgccgctcttgtcgttccaggggatgcgcgtgtcctgcgccacctgcccgggcgcctgcccgatgatcacgatgcgcgcgcccgccgccgcggtgtagagcgggtcgatccccgccgccgtgtaggacgcgttctgctcgtccgccctgatcgcctcgaagatctggtcaaagtccatgcccatgcctgcctcccagcaaactgcggcgcggcccccggtccctttcgcggtcgcggctcgcgccgccctctcccgcacgcgggggtccacgccaccctggactctagacctcccgcggccggtggtgcgttgccatcgcaacattttacgcctgccgagaagtgcgcaagttagcgaacgcggccccctcgcacgcgcgcaccatgtatgggggcgcggcatctggatagaatcccctgtgacgtgggcgcccgcgcttcggcgcccgttgcgtggagggaagcggcatggcaggcacgggtacgacggagggaaagcgaaaggccagcgggcgcgggggcaaccccgtgtcgcgggcgctctcgagcgtgttcaacgtgcgctcggggcgcgcgagctacgcggagatccgccggcgctttgtgggcggctccaagctcaacgggacgcacctctgcatcctgatcgtggcgatgctcatcgcgtccatcggcctcaacaccaactcgacggagtgcgtggtgggcgccatgctcatctgcccgctcatgggctccgtgctcgcgatttcctactccgtggccacggcggacctcaggctccttcgcgacgccgtggtcggtcttctcgtccagatcgccatctgcctggccacgtccacgctctactttgtgctgtcgcccatctccacggagacgagcgagctcgtcagcaactccacgcccacggtgtgggacatcctggtggccgcggccggcggctttgcgggcgggctgggcaactcgcgccggcaggagccgtcgaccctcatcgcgggcgtggccgtggcgacggcgctcatgccgccgctgtgcgctgcgggctgcggcatcgccacgcgcgacccggcgcgctttgcgagcgcgttctacgagttctggctcaacgtcgtgttcatcgcgcttgcggccgagatcgtgctgctgatcctgcgcgtgccgctgcaccgcgaggtgggcccggacggcgtggtgaccctcgaggaggaggcggccgagaagcgcctctcgcgcaacatgaagcgcttcatcgccgtggcgaccgtcatcttcatgatcccgtgcgtgattgcgacggcgggcatggtgcgcgcgagcgcgtccggctccggcacgagcgccgccgcggaccgctacgaggtgtcgctcacgacccgcgagctcgaggccgtgtgcccaggcttcgaggagtaccgcgtgggcacggagtacgtggggacctccgcgggcgacggcacgtccacgcgcgtggtggccacggtcaggacgcgccgaccgctcacgaaggaccagcgctcgagcgtgcgcgcgctgatagccgtgcacgtgaaggggcttgacgacgtgcgctttgtgacggcgtcgtgagcgcggcgccagcggtggcggcgcggggcgagcgcggctgctgccgctagcgaagcaggtccgcgttgttgcggtccttgaggaagcccacgaacgtggcggccacggcggtgaggccctcgggctcgagcgtcgcgatgccgatggtgcggtagctcgcgggcgagaggggcctgacctcgacgtcgaaggccgagttactgagaatgagccgcggcatgaccgatacgccaaagccgtgctccaccatggccatggccgagaagtcgtcgttgagtgcgtagcgcaccttgagctggccgtgcgcgtccgcgagcgcggcgcggatgtcctgctccgagccgcgcagcggcatgacgaggtcctcccgggcgacctcctgcaccgtgacctcgtccttctccgccagcggatggcccttggggagcacgaccatcatctggtcgcgcttgagcgggctgaacgtgaggctgtcgtcgcacgcgatcgaggggaggaagccgcagtccacctggccacgcgcgatgcgctgggcgatctcgccatagccgccggcgaagatctggaacgtgacctgcgggtagagcttctggaagcgcgagatcatgctggggagccactgcgtggagaccgaggtgaacgtgccgacgcgcagcgttcccgcgacgacgtggttgacctgctggatggcctgctcgagcgcgcgcttctggttgacgagggcctggatgcgcggcagcagcagctggccgttctgcgtgagggagacgcccgtcttgccgcgagagagcagaggcgtgccgcactcctgctcgagcgagcggaccgcgtggctgacgccggactgcgtgtagctgagctcctccgcggcccgggtgatgttgccgagctccgcgaccttgaggaatatctcgtagcggtccatgcctgcggccatggcggcctccctatttgcgtgcgtgtctgacagtacaaaacgtacttgatatgagtataaagatgaagttaacaaatgcctcgcggctcggtacaacagtggaggaaaagttaacgcggtggcatcaatcgggggcgctaatgcagggcacgcaggtagaggcaggcaaggtgggctggtcgcagcggcaggcggacctcatgatcgcgctcatcgcgatcgcatggggcagctcgtacctgatgatgcaggtggggctctcgtccatcccgccgtttggcatggtcgcgctgcgctttggcatcgcgttcgtggcagtggcgctcatcttccgcaagaggctgcgcgacctcaccagggacatcgtctggcgcggcgccgtgctcggctttttgctgtgcgtgttcttcgggctgctgatgtacggcctcaagacgacgcccgcctcaaccgccggcttcctgaccagcgcaaaggtcgtgatcgtgcccgtgatcgtgtccgtgtggacgcgccgcgcgcccagccgcgccacgcttttgggaatcgtggtctgcaccgtggggctcgctcttctcaccctgaacgggcccatgtcgatgggcgcgggcgccgcgctctgcctggcgggctcggccgtgtacgcgctgcagatcgtgatgacggacgcgttctcgcgccgtgaggatgcgctgcttttgggcatctgccagcttggctttgcggcggtctttggcgccgcgttcaaccttgccttcgaggggccggcgctgccgcagtccccggcggagtggggcgccgtcctggggctcgccctcgtgtgcagcgcctttggctttgcgatgcagcccgtggcgcagagccgcacgaccgccacgcacgcgagcctgctcttctcgctcgagagcgtttcgtccgcggtgctctccttcgtgttcctgggcgaggtcatggcgccgcagtgctacctgggctgcctgctgatcctggcgtccgtgctgctggcgtcgctggcggacggcaagcccgaggaggccgccgagcagcccaagggcgtcgcggcgtactccgccgccagccacgcgggactcggacgtgggctttcggccacgcgcgccagggccaagcggatgctcgactaggcttcccgtgcgcctataattcgcgtgggcgccgcgacggtcagcggcgcggcagactggcgggcacgcgtgatgggagcatggcatggatgcaggcgttcgcagggtaatgggcctcataagcgagatcaacgttcgctttgtggtgccggtctaccagcggccctactcctggggagaagagcagtgcctccagctgtgggacgacatcctccactgcggccgatcccgggaggagacgcacttcacgggctccatcgtcaccatgcaggacggctccgcctcgccggctggcgtcgccgcgctcgcgctgatcgacggccagcagcgcatcaccaccatcgcgctgctgctcgtggcgcttgcgcgctacgcgtccgcgcacccggacgagcaactcccgtactcgcgcgacgaggtcatgctcggcggctacctcacgaacccgttccgctcgggggaggaccactacaagctcacgctctccaagggcgaccgcgccacgttccgctcgatcgtggacaacctggaggacccgtcgcgtcccgtcgaccccacgtccaagcgcatcctgcagaacctctcgctcttcgagcagcgcctcgacgccctgtccaacgtcgcgagcgtgtgggtgggcctgcgccgcctcgaggtcgtcgcggtgtcgctcacgcaggggcgcgaccgcgcgcagctcatcttcgagtccatgaactccaccggcaaggacctgggcgccgcggacctcatcaggaacttcgtcctcatgaagtaccccctcgaccgccaggcggaggcgtaccgcacctactggaagccgcttgaggacgcccttctccccctgggcgaggacgacgctctcgacgacttcgtgcgctgcttcatgcagatggcctacgcgccggagcccctcggccaggcggacctgtaccagacgttcaagcgctacgtcgcggagggcggcttcgaccgcaacgaccgcatgggcttcctttgcctgcggctcaaggactttgcgcagtactacgtcgcgacggtcacgggcgagctcgcgcagccgctcgtggaggcctccgccgcagacgccccggcgtttcgcgaggtcacggcgcgcctcgccggcatcgcggagctcggcgtcccgcaggcgcgcccgctcgagctcgagctcctgcgcagctgccaccgccgcgagtgcacgctcacgcagctcgcgacgatgctcggcacgctcgagtcctacctgctgcgccgcgccgtgtgcgactgcgagggcagcgcccagacgcagttcctgctgcggctcgtggccaagctccaggccgttcgcaacgcgggcgagaagtactacgacgcctacctcgcgctcttcctcgtggaggagggcacgccgcgccgcctgcccacggacgacgagttctcgcgcgcactccaaagccgcgactgctttggcttctcgcgctcgttctacctgctcacgcgcctgaacggccaccgcgccgccgcgtccgcacaggcgggggagaaggacgccgttcccacgggtgacgtccccacccgcgagggctggtcggtcgagcacgtcatgcccgtgggcgcgctcgccgacgacgcttggcgcgcggcgctcggccccaacccggagctcgcctacgagcggctcgagaacacgctcggcaacctggtgcttacgccctacgcctacgacctgcaggactgcggctttgaccagaagctcgagcgcctgcgccaggacgcggacggcgtgccggagcgcatcgcgctctcctcggacgtgctcgaccagcaagcctggggcccggagcagatcgaggcccgcggcgcccgcctcgcgcgagaggccctcgccatctggcccatgcccacggtggacgcggccacgctcgagtcctaccgccccacggcccgcgcggcgagcctcaggcagaccacctggcaggacctcttcgactccggcgtggtccagatggacgacacgctcgtgagcgcgagccccatgtacccgggccgcgccaccgtcacgtccacgggcaagatcatgctcgccaacggccagatgttcacggaccccacggacgcctacgagcgcttcctcggcaccatcggcgcgaaccccaccggcctcaacggctggacgcactggcgcctgggcgacggcggaccgctcctggacgacctccgctagcggcggcgttgctgccaaggcgctgcgttcttctcgcccgcgtgcaacgtatgcgactttttttgttacctgcgcgttcgcatatgctgggcgcgccgcacatacgttaagctgtctgttggtttgtgacgttggctcgtgggcgccgctgggcgccggcagaaggggagctttcacatgggttacgacgagcgctttggccagcagccgcgtgtgggggaggatgactcgctccacgacgagtgcggcgtgtttggcgtgtgggcccccaacagggacgtggcgaggatcacgtactttggcctgcatgcgctacagcaccgcgggcaggagtccgcgggcatcgccgtcggcaacggcgagacggtgcgcgtgcgcaaggaccgcggcctcgtgagccaggtcttcacggacgccgacctcacggccatggcaggcaagtgcgccatcggccacgtgcgctacggcacggcggggggacgcgggttcgatgccgcgcagccgcacttctcgctcatcgacgacgtcacgatcgcccttgcgcacaacggcacgctcgtcaacacggacggcgtccgcagcgagctcgaggagctgggcgtgcccttccgctccaacacggactccgaggtcgcgtgcgagctcatcggctacttcaccaagaagtccggccacctgcgcgtgggcatccgtcacgccatgcagatggtcgagggcggctacgccatggtgctcctgcgcgagaacgccctgtacgcgttccgcgaccccaacggcatccgcccgctcgtgatcggtgcgctgggcacggagggctgggtcgtcgcgagcgagacctgcgccctggacatcgtgggcgccacgtacgtgcgcgacgtccgccccggcgagatcgtgcgcatctccgacggcggcatcctctccgagcagggcatcgcgccgcagcccgaggcccagtgcatcttcgaggacgtgtacttctcgcgcccagacaccgtgatccgcgggcgctccatctactccatgcgctacgagatgggccgccagctcgcgcgcgaggcaccggtcgacgcggacctcgtgatcggcgtgcccgactccggcatgccgcccgcggagggctacgccgcgcagaccggcatcccgtttggcgagggcctcatcaagaaccgttacgtcgcgcgcacgttcatccagcccacgcaggagatgcgcgagatgggcgtccgcatgaagctcaacgcgctttccgacaacgtggccggccgccgcatcgtgatggtggacgactccatcgtgcgcggcaccacgtccaagcagatcgtgcgcatgctcaaggaggccggcgccaccgaggtccacgtgcgcatcaactgccccgaggtcaggtggccgtgcttctatggcatcgacaccgacgtgcagaagcagctcatcagcgccaacaagtccgccgaggaggtctgcgagtacatcggcgcggacagcctggccttcctctcgctcgaggggctgcgccgctgcgtgccggagtgcggctactgcgacgcctgctacacgggccgctaccccgtcacgatccccgagcgcttctccgcgggcaagttcctggacggcttcaccccggagttcccctacgacgacggctcccgtccgggcgagaaggacgccatcgccaacatggagctcgacgcgcccgcggactaggcggccacgctgccgcgcggtgatgcgcggggagtctggattgcaaggcgagaacgggagattgcgctcctggatgagacggttcccatgcgtgatgcgtgggaaccgtctttttgcgatgcaaggattccgtttcccatgcgtttgggccgacggtttcctcgcgtggcgcatgggaaccgcggctgcgctgcctgcggacggctccgaatgcccgcacgctgcggcccgagggcgcgcgttcttctcgcccgtaacatcgtgacaaatcacatagccattctacctgcggttgtttcgatttcgctacgtctgggaaacccaacggtatccagccgatgaggatttgcgcacgcgggccgcgcgggcgcgtttcggacataaaatccgtttggtatgttgccacctgaggcaaaagcgagaggagacccgatggcaggtcaggattccctgagggagttccaggcggcgcgagagcggcgcttcaacggagaggggcatgccccgcaggggctgtacagccccgagtacgagcacgacgcatgcggcatcggcgcgctggcgagccttcgcggcgagcgctcgcacgcgatgctggacgatgcgcttgcggttctgatgaacctcgagcaccgcggaggcaagggcctcgagaagaacacgggcgacggcgccggcgtgctgctgcaggttccgcaccgcctgttccgccgcgaggcgcagcgcgagggccacatccttcccgaggagggggagtacggcgtcgccatgctcttcttcccgcaggaccccgagggctaccgcgacgcccgtcgcgtcttcgaggacggctgcgcccaggagggcgtgcccctgctgttctggcgcgaggtgcccgtcgacccgcatgacctgggcgacacggccaaccgctgccgcccgcacatcgtgcaggccttcctgggcaggcccgagtccacgcccgccggcgaggagttcgagcgtcgcctgtacgtgacgcgccgcgtgatcgagaagctcgcggagcacgagccggcgctctccggcaagacgttctacgtgtgctccatgagcgcccgcaccatcgtctacaagggcatgctcgtcgcgacgcagctgcgctcgttctaccgcgacctcggcgacgcctacgccgagaccgcgatcgccctggtgcactcgcgctactccaccaacaccacgccgagctgggagcgcgcgcaccccaaccgctacatcatccacaacggcgagatcaatacgctgcgcggcaacgtcatcggcgtccgcgcgcgcgagccggagctctactccccggtcatgggcgccgagctcaagaaggtcatgcccgtcatcaggagcgccggctccgactcggccgtcctcgacaacgtgctcgagttcctcgtcatgaacggcaggtcgctcccgcgcgccgtgtcgctgctcctgcccgagccgtgggacaagaacccccagctctccgaggagcgccgcgcgttcggcgcctaccagtccatgctgtccgaggcctgggacggccccgcggccatcgcgtacacggacggccactatatgggcgccgcgctcgaccgcaacggcctgcgcccggcccgctactacgtcacccgagacgaccgcctgatcctctcgtccgaggcgggcgcctgcaacgtcgagcccgaggacatcgtccagagcggctcgctcggccccggccagatgctcctcgtcgaccccgacaagggccgcgtcatctgggacgacgagctcaaggacaagctcgcgcgcgagaagccctatcgcgactgggtcgcgcaggagacgctgggcgtgagcgacctcgcgcccgcgaccgagggcgacgccgagggcgaggccgccgacgcggaggccccgctgtcgctcaggctcgcacgccacggctaccacttcgacgacgtcgaggaggccatcaccccgatggccaccacgggcaagaagcccggcgcctccatgggcgcggacatgccgctcgcggtgctctccaggcgctcccgctcgttcttcgactacttcaacgagctcttcgcgcaggtaaccaacccgcccatcgacgcgctgcgcgaggacttcgtgacgtcctcgatcctgtacctgggcaaccacggcaacctgctggaggaccagcgcagcagctgccgcctcatcaggctcgagaccccgatcctcacgcgcgaggacttcgaccgcatcctgcacgtggacatggtgggcttctccacccgccgcttcacggcgagcttcggccgcaacgccggcccgcacgccctgtccaaggcgctcgacagcctcaacgccgaggtcgagaaggccgtccgcgagggcgtgaacatcatcgtgctgtccgaccgcgtgggcgagggccaggtgcccgtgccgtcgctcctctcgctcggctccgtgtcccaccacctcatcgagtgcggccttcgcatgagggccgacatcgtggtcgagaccggcgacgccatgaccccgcacgactacgcgtgcctggtgggctacggcgcctcggccatctatccctacctcgcgcaccagctcatccgccagctcgcggacgacggccacatcaaggtggacggcgagaagggcgtggctaactacaacaaggccctcacggcgggcatcgtctccatcatgtcgaagatgggcatctcgacgatgcagggctatcactccgcgcagatcttcgaggtcgtgggccttgccaaggacgtcgtggaccgctgcttcaccggcacgcccagccccgtcgcaggcctcgacatggacgacgtccagcgcgagtgcgagggccgctacgacgagggcgaggcccagcgcaggagcccggctcccgaccagctggcgagctccggcatcacgaagtggcgcccgctcggcggcgagcagcacatgctgacccccgaggtcatctacctgctgcagcgcgccgtgcgcgagggcagctacgacacgttcaagcgctacagcgccgcgctgcacaggcccggccgctccatcgttctgtccgaccttctctccttcgtgcccctgccgacgggccccgtgcccctggacgaggtcgagtccgtcgacagcatcgtcaagcgcttcgaggcggcggccatgagctacggcgccatcagcgaggaggcgcacgagacgatcgccatcgcgatgaaccgcctgggcgccaagtcgaacaccggcgagggcggcgagaaccccgtccgcgagacgacgctccccaacggcgactccaggaactccgccatcaagcaggtggcctccgcgcgctttggcgtgacgagccgctacctgcgcagcgccaaggagatccagatcaagatggcccagggcgccaagcccggcgagggcggcaacctgcccggcaagaaggtctggccgtgggtcgcggaggtcaggaactccacgcccggcgtcggcctgatctcgcccccgccccaccacgacatctactcgatcgaggacctggcggagctcatcttcgacctcaagaacgccaaccccgacgcgatcgtctccgtcaagctcgtgagcgaggccggcgtgggcaccatcgcgaccggcgtcgccaagggcggtgccgacaagatcctgatctcgggcgccaacggcggcacgggctccgcaccgcgcgactccatctatcacgcgggcctgccgctcgagctcggcctggccgagacccagcagacgctgctcctgaacggcctgcgctcgcgcgtggtgctcgaggctgactccaagctcatggacggccgcgacgtcgccatcgcgtgcctgctcggcgccgaggagtttggcttcggcacgccggtgctgctgtcgctcggctgcctcatgcagcgcgactgccagcaggacacctgccccgtgggcatctgcacgcagaacgcctgcctgaggaagcgcttcgacggcaagccggagtacgtgatcaacttcatgaggtacgtggcggaggagctgcgcgaggaaatggccaagctcggcttccgcaccgtcgaggacatggtcggccacgtggagtgcctgcgccagaccggcgtggaggacaactggaaggccgagaagatcgacctctccgacatgctgaagaaggtcggcaacgacctcggcaagtccttcccgggcgcggaggtgccgcacttcgtcgagagcatgggcccggacgtgggcctcgaccagacgctcgacgcgaccctgctcatcccgtacaccaaggagtgccgcgagtccatgggccgcatgcacttctcggtcgacatcgcaaacgtcaaccgctgcaccggcaccatgctgggctccgtcatcaccaaggagcaccccaacggcctacccgacggctcgatcgagatcgagtgcgtgggctccgccggccagagctttggcgcgttcatgcccgcgggcgtcacgatgaacgtccacggcgacgcgaacgactactttggcaagggcctctccggcggcatcctgaccgtcgcccccgccgacagcgccacgtacaagttcgacgagaacgtggccgtgggcaacgtcgcgttctacggcgcgacggccggcaagggcttcatcaacggcctggcgggccagcgctttggcgtgcgcaactccggcgcgaccatcgtgtgcgagggcgtgggcaaccacggctgcgagtacatgacgggcggcgtcgcgctgatcctgggccaggtgggcgtcaacttcgccgctggcatgagcggcggcgtcgcgtacgtctacgacgagcgccacgtgctcgactccagggtcaaccacgacatggtcctcatggagaagcccacggccgacgagctggagctcatccactccctggtgcaggagcacgcggagcgcaccaacagcccgcgcggcatcaagatgctctacaggttcgacgacatcaaagacgacttcgtgaaggtcatcccgcgcgagtacaagcgcgtcctcgagctcacggccgaggccaaggccgacggccttgacgacgaggccgccgaggagcgtgccttccaggtcatgaggaaggggatgtagccaatgggcaaggtaggaggattcctggagcagggccgccacgagcacggcatgcgtccgatcgaggagcgcgtgcacgactacgacgacctctccgtcacgcttcccgaggatcagcttcgcgcccaggcaggccgctgcatgtactgcggcgtcgcgttctgccagaccggcgtcaactttggcaaggcgcgcacgagcggctgcccgctgcacaacctgattcccgagtggaacgacctcatctggcgcggcctctgggacgacgcggccgagcgcctcgcgctcaccaacccgctgcccgagttcacgggccgcgtgtgccccgcgctctgcgaggcggcctgcaacctgggcctgcacgacgatcccacgaccatccgcgacgacgagcgcgccataagcgactggcagtgggagcacggcggtcccaagccgctggagcccgcgcccaagggcgcgccgctcgtgaccgtggtgggcaccggcccgtccggcctggcctgcgcgtgggagctcgcccgccgcggcctgcgcgtgcacatggtcgagaagagcgaccgtccgggcggcctgctcatgtacggcatccccaacatgaagctccccaaggacgtggtggagcgcagggccgacctcatgcgcaggagcggcatccagatcgagtgcggcgtggacgcatccgaccccaaggtcgcggcgaagctcgccaagacgagcgacgccgtcgtgctcgccgcgggcaccggccgcgcccgcacactcagggtgcctggcgccgacaaggacggtgtgcacctggccgtggagtacctcacggcccagacgaaggcacttctcgacggcaccaagagccccatttccgctgagggcaaggacgtcgtcgtgatcggcggcggcgacaccggcaccgactgcgtcgcgacggcgctgcgccagggcgccaagtccatcatgcagctcgagttcctacctgagccgcccgagcagccggctcccggcaacgcctggcccgagtggccggtggtcaagaagaccgactacggccagcaggaggccatcgcgacgtttggcgaggacaggcgtctgtgggccacggacacgctcgaggtcctgggcgatgcctcggtcgaggggctcaagatcgtctcgctcgactggacgtccggcaagcccgtccgcaaggaggagaccgagcgcacgctgcccgcgcagctcgtcgtgctggccatgggcttcctcggccccgacacgggcctcgtggaggccttcggtggcgaggtcgcgcagcaggggaggccgctgcccgtcaccgtcggcaagcgccacgtgctcgcgggcgccaaggacggccgcgtctactgcgccggcgacaccaggaacggctcgaccatcgtggtgaacgccatctccgacggcctcgcctgcgccgccgaggtcgcgtccgacctgctgggatagcggcgtagcggctccgcgcgcgacacataggttgcaagttgcctgcgaccccggacatgacgtcatgttcggggtcgcttcgtgttgggactggcgagtgcgggctgacgcgtggccatatcccagacggctccctcgcgataagcaagggagccgcaaggccaacaggcgatcgcgctcgcaagtggggggagaagtacgcccgttccaaccgacaccccggcataaaagaagccccgcctcgcttggtgcgagacggggcttcgttgcaactggtgtcaggttgcgaactacgctttcctacacgtagaagagcatgtcgttgtagctcgggacgggccagtactccttgctggtgacggtctccatcttgtcgaccgcggcgcgcagctcgtccatgagcggcaggacgatgtcgcggtaggcgttgtcctcctcggcgacgtcgtcgaggccgcgggccttgacgttggctgcctcgagcttgtcggcggcggacttgatcgccgccgcgccctcgctcagggtcttgaccgtggccttgtcggcagtcgcctcgacgccgatctcctggcgcgtcgcgacgctcgtggcgaggtcgccggcgtaggcgctgatggcgggcaggtacatggtgcgggccatgttgaccatggtgttggcctcgatgttgaggagcttggcgtactgctcggccttggcgacgtagcgggcgcgggtctccgcctcggtgaggacgccgtacttctcgaagaacttgatgttctcgggcttgacgatgctggggatggcgtcaggcgtgctcttgaggttgggcaggccgcggcgctccgcctccttctcccactcctcggagtagccgttgccgtcgaacaggatgcgctcgtggtcgcggaaggtgtgacggacgaagcgcatggctgccgtggtgaagtcatcgtcggagtgcttggcgatgtagtccacgaagcgctcgcactgctccgcgacggccgtgttgaggacgacgttggggtcggagaggttctgctggctgccgcacatgcggaactcgaacttgttgccggtgaaggcgaacggggaggtgcggttgcggtccgtgttgtcgcgcaggacgttgggcagcgcggggacgcccaggtccatgcgggcacggtcgtgggcctcgggctgctccttcttgatgagcgcgtccacgatcggggtgagggcgtcgcccaggaagacggagatgatcgcgggaggcgcctcgttggcgccgaggcggtggtcgttaccggcggaggcgacggatgccctcagcaggtcggcgtggtcgtcgacggccgcgacgaggcaggcgaggaacaccaggaactgcaggttgtcctgcgggtcgtcgccaggctcgaggaggttctcgtcgtcagcggagacggaccagttgttgtgcttgccggagccgttgacgtactcgaagggcttctcgtgctcgaggcaggcaaagccgtggtgggtcgcgaggagcttgagcttctccatggtgaggaggttgtcgtcaatggcgagcgagcccttctcgtagatgggggcgaactcgtgctgacagggggcgacctcgttgtgcttggtcttcaggggcacgccgagcttccagagctcgtcgtcgacctccttcatgaacgcgttgacggaggggcggatcgtgccgaagtagtgctcctcgagctcctggcccttggcgggctcggcgccaaacagcgtgcggccggtgaggaccaggtccgggcgggccttgtagtcgtcctcggtgatgatgaagtactcctgctccgggccgatcgtggtgtagacgcgcttcggcttcttgccaaagagctcgagcacgcgcttggcctgcgtctcgagggcgacctcggaacggagcagcggcgtcttcttgtcaagcgcctcgccggtgtagctgatgaacgccgtcgggatgcagaggacctcgtccttgatgaaggcggggctcatggggtcccacacggtgtagccgcgggcctcgaaggtggcgcgaaggccgccggaggggaagcttgatgcgtcgggctcgccctggacgagctccttgccggagaacgccatcagaacggtgccgtccccgttggggttgatgaagctgtcgtgcttctcgctcgtgatgccggtgagcggctggaaccagtgcgtgaagtgcgtggcgccgtgctcgagcgcccagtccttcatcgcgtgcgcgacctcattagcgatgtcgaggttgagctccttgccctcgtcgatgacgcgacgcagctccttgtaggtcggcttgggcagtcgctcctgcatgtcctggtcggtaaagaccaggctgccgtactcctcggtgaccttgtccttggacatcagtcctcctctgacggaatttgaccgtaggccgaatggcggcccctcgtacataatgaatcatagcgattgcccgttgcccccaaatttcgtcaatgtgacggttacgaatacgaaaccgtttcccaaccgtttcgctccggacgagaaggacgtgccgccggtgtcgccgcggcaacacgctcgccgcattcacgtgcgtgcgcggcgccgggtgccatatgctaggaaaacttgcccaaaggtccatgggcaacgttccgaaagtttccaaccttatggtatggagtgcatatgacctggttcctcatcgtgttcgcggtcgcgctggcggcaagcgcctgcggcttcaagaagtacgtctggttcatctccatcggctacggcgcggccgtggccgccatcggcgtcgtgctcctgctggcctttggcgcgcaggcgcccctggcggcctgcctgcaggcggcgctcctcgtggcgtacggcgtgcgccttgcgggctaccttgcgtaccgcgaggtcaagagccgcacgtacaaccagaagatgcgtggcgagatcaagtcgaacgacggcgtgggcatgggcgcccgtgtgggaatctgggtctccgccgcgctgctctacgcgtgcgagacgtcccccgtgctcttccgtatgggctccggggcgtccacggacgtccttctcgtcctggggctcgtcatatccgtctttggcctcgccttcgagaccgcggccgacctgcagaagagcgccgcaaagcgccgcaacccgcgccggtttgtggacagcggtctgtaccgcatcgtgcgctgccccaactacctgggcgagctcctcatctggacaggtgtcttcgtgtccggtctgggcgtgtacgagggcgcggcgcagtgggtggcggcgcttgccggctacctggggatcgtgtacgtgatgttcggcggcgccaggcgtctggagatgcggcagaaccgcagctacggcaaggacccggcgtatcaggcgtacgtgcgcagcacgccgatcctcatcccctttgtgccgctgtacagcgtagagaagtacacgtggctcgtggcgtagcgcctcgggacccgacgcggttcccagggtcccgctattgttacgtgatttctgtcatataatgggcggaccggcgcgcgcagagcgaccggagcgccagacggcgcacttacgtatatgacacctgtctgatgggagaggcacatggcggaagagaagaccgagggtaagggcacgatcgacctcacacaggagctgggaaagatcgcggctgaggcgcccgaggtgccgggggtcctggaggagcttggcttcgagcagcccgaccccgcgaagaccgtgctcgaggcatgcgaggacgccggcgtggacgcgtcgatcgtggcgcttgcccttctcgccgagggctatgacgtggaaggctacgagagcgaggacggcggcgtcgccgcaagggcgttcgacaccgtgctgaccgcgctcttcgatcccacgagcgacctgatgcccgacgcgtccggctccgacgcgccgatgctcgcgcacatggaggcggccgtccgccgtgcccagcgcgagggcaaccttcccgggtgccagtgccaccgcaagggatagactgaaggcgttcttatgtttgcgtagcgccgtgcgcgccgggtggtccggcggcgtgcggcgtgacttgaggggagaagtgcatgagcaggaacatgacgcgtcgcgaggcgcttgcgaccttcgcgggactgggttttgccggggtgctttccgcgtgcgggaattccggttccgacgggagcgacagctcctcctccgccaagaaggcgagctccaagaagaagtccgaggacgtcgtcgtccgcgtcgcctcgctcaaggggccgacgaccatcggcctcgtgcagatgatgaactcgaccacgggcatccccgagtccggcgcgtcgcttccggcgagcaacaaggccaaggcgggctccggcgtgacgtacgcgtactccgtcagcgcggcgccggacgagatccttcccctcgtgatccagggcaaggtggacatcgcgtgcgtgccgtccaacgtgggctccgtcctgtacaacaagacgaacggcaagatcaaggtgatcgacctcaacacgctgggcgtgctgagcgtggtcacgggtgactcgagcgtgaagaagttcaaggacctggccggcaagacggtctacatctccggcaagggctcgagccccgagtacgtcctcaactacctgcttgacaaggcgggcatcaaggaccaggtgaccctcgagtggaagagcgagcacaccgaggtcgcggccgtgctggccaaggacaccaatgcggtgggcgtgctgccgcagccgttcacgacggcgacgctggtgcaggtgcctgcgctgaaggcgcccatcgacctgacggacgtgtggaagaagtacgcgaaggacggcagccagttcgtgatgggtacgaccatcgtgcgcagcaagtttgcggatgagtacccgggcgccgtgcaggacttcctcgagcgccacgcgaagtcggtcaagacggtcaaggcggacccctccggcaccgcgtcgctggtcgtgaaggcgggcatcgtagcgaaggaggccatcgcgaagaaggccatccccgagtgcaacgtggtctgcatcaccggcaagaagatgaagaagggcctggagggctacctcaaggtgctgtacaaggcggacaagacgtccgtcggcggtgccctgcccgcggacgacttctactacctgggcgagtagctgcctgaatacgagtcgtgcggggaaggcttgctgacatagtgaggaggctcgcgcctgtcgcgctgtgggtgtgcgtgtggcaggtcgcgagccttgtcgtggggagcggcatcctgctggccggtcccgtggacacggttgtgaggctggcgtcgctcctgggcgatgccagcttcctttcgacggtggggttctcgctcgtgcggatcgtcgtcggctttgcgctggggtttgcgggcgcggtggcgctcgcgtttgccggggcgcgttggggcgtggtgcgcacgatcttctcgcccgcgttgagcgtgctcaagagcgtgcccatcgtctgcgtgatcgtgctgctgctcatgtgggttggcgctggcagcgtgtccgccgtggcggtgttcttggccgtgttcccggcggtgttctttagctgctccgaggcgcttgacaacgtggacgcaaagacgggcgagatgctcgaggtctttggcgtgccgcgcgtgcggcggctgctcgcgcacgtctggcccgaggtgctgccgtacctggtgggcacgagccggaacgtgtgcggcatggcgtggaaggcgggcgtcgcggcggagctcatcgggagcccgatggggtcgatcggcgagcgcatctaccagtcgaagctcctgcttgagactgcggacctgtttgcgtggaccatcgtgatcgtggtgatgtcgtggctgtgcgagcgcgcctttgtggcggtgcttgcgcgcacgggatcgtgggcactgcgggcgagcctgcgcgtcgggcgaccgaggcgtacggttggcgtaggggagtgtggcgcgcgcactgacggggtgcgccgcggtgaggtcgtgctggatggcgtcacgatcggctaccccggacgcgtggtggcgaggggcgtccgcatggacgtgacgcctggtgagcgcgtgatctgctcggacgcgtccggcgcgggcaagacgacgctgctgcggaccgtggcgggactccagccggcgcttgccggcacttgcgccgttggcggagccgtgacgatggccttccaggacgtgcggctgattggcggcatgtctgcggtgcagaacctgctgcttgtgattggttcgagccgtgacgacggggcgcgggatcgcgcgcgggagctcctggcggagcttctgcctgcggagacgctgaacgttcccgtggaccagctttctggcgggcagcgccgcagggtcgagcttgcccgggccatcgccgcgccgggcgacgtggtgctgctggacgagccgttcgcgtcgctggacgccgcatcgcacgaggtggccgcgcggtttgtgacgggccaccttgggggacgcacgctgatagtcgcctcgcacgaggctggcgacgccgagcgactggacgccacggcgtactcgctgggcgggactgcggccgaggcctaggaagcccagcgtcggcaagaattttctgcccttgtgtaactggagggggtttgtgtgtgattgccggctccggtcgaggtggcaaggcacacaaacccccttgaagtgcaatatggcgccgagaacttggtcgctaggcaccatcaaggtcgtgtgaggctgatgatcagtcgagacagtgtgaattagatgcatagatgacaccatgcatccatattattgcatcagaaattgcgcgccctcctcttgggtggagtgctgcttagaaatgtgcggcatctgggcgcctctggactcgagaatgcttggcgtcgcatcccaatcaaggctccggaggcaccaagtccgctcttcgaagggctgcaggctatctcgcaggcgcttccccagatggcgcggagccagaccttggccgttggcgccatgcatggtcatccaaagcacccagaacgagggattctttcaacgtccgtcctcgcaactcccaattcggcttgctgctttgtactgggactatttgattaaaagacatacacgcttagcagtcattcataccataaaataggtcattcgtaccagattcaagtgtgatggtagcgtgtgcgggcggtgtgcgcagcgtgaagcgcatgtgtaacttacatagtcgtatttcctttagggtatcttctccaagtcgtcaataggaaggaacgactatgtgcatgatgcttgccatcgataccagcaagcccattgttgctaacgacctgcttggctccctgttctctcacggcaacgaccatcccgagggctggggcctctcatatctgcccgccggagacgaaacgagacccgcgaccgtccgcgaggccaagaacgccgccgtcagcgagcgcgtccaggcaatcctgcgcgagcccgtcgagacagcgcacctgatcgcgcacatccgcaaggcgtccgtcggctccgcgaagctcgagaactgccatccgttcgagaaggacgaccacgagggcaggacgtgggtgctggcccacaacggcacgatgttcgagcccggcgccacccagccctactacgcccagcgcaagggcaccacggacagcgaggcgatcctgccgtacctggtcgaggcatccgacatggccgtcgcgcagggcgcggacgaggccggccgcatcgaggccatcgaccgcgccatccaggccatcgcgcccggcaacaagctcaacctcgcctttggcgacgggacgcacacctacgcgtacaccaacgacgtcaacaagaccctctggcgcctcaggctcgatgacggctgggcgttcgcaacggcgccgctcgacggccgcgcctgggagcccatgcagctctgccagctgcaggccgtgagcgacggcgagatggactacgagggcacgcccggcacgggcaccttcacgtccgacaacgtcgagtacctccgcatgctcgagctgctgagcgcctaggcgcgggctcccgcatcaatcgtcaaacaacagcggccgggtggcacacgcctcccggccgcagtcatgcccaggggagaagtgcggctcccaatcgccgcggccccatcccaaagaagcgctctgccccggttcactcctccgctgccggctcctccgtcgcagcggccgtgccatcgcccgcgcgccgcgccgcccgccaggccacgtagcgctcgaagtagatcttcaccatcgccgcgcacggcaccgccacgaacatgcccacgagcccgccgatcttgccgcccacgatgagcgccacgatcacggcgatggggtgcacctccaccgagtccgcgaggatcttggggttcacgatctgcccgtccacaaactggatcacggcgagcacgatggcggccaccacgagccttcccaggtcgcccgccacaaggcaggaaagcgcggtcgccgcgtacgccacgatcggccccacgtaggggatgaggttccccagccccgtggcgatgccgatcaggagcgcatacggcacgcccagcacctcgagcgcaatcgagacggcgacccccatcagcagcgcgtcgatcacctggccgcgcatgtagccagcaaacgcgcgccgcgcgtccatcgcaaacgtgtgcaggtgaccgtacgccttcccacccatgagcgcccgcagcgtgcggtcccagtaggcggccaggttgctgccgtcaatcaaaaagtagacgcaaaagatcgtggcgaacaccgtgtccgaggcaaacgtcctcacggcgtccacgcccgagcttacggtcttgccgatgctcccgccgccggacgtgaagacccccacgacggagcccacgacctcgtccacgtcggcccgcgagccacccagcgacgtggccagccgcacgaccccgtcgtacgcggcggacatgctgtcgcccacgtagtccaccagctcggagaggttccccggcgacaccgcgcggatgctgtccgtcacaaaggcgagaagaacagagacgaccgcggccacgatcccggccgtcagcagcaccacggccacgaccgcgagcgcgtgtcgcgcccggtcagcgccggaaagcggccgtaccttcgcaaacagccggtcgaacctggtgaccagcggccacagcaggcatgccaccagcccgcccgctatgagcgggttcaggatcgcgagcacccacgcgcagcccgcgccgatgccccgggcgatctccgcaaggtgcacgcccacgtaggagacgagcgccagcgcgatgcccgtcgcgatcacgtagcggctgatggtagagtacttgctgtcgttcagtccaaagcggctcaaggcagcctcccggtcggtcgcgtcctcgtgccaagaatgatactggagggcgccgccgtgccgctcatgttcatactctcgccagcaaagcgcatggtcgcggtggagggcgagccccgcccccgggccgcccccgcccttctcgcccgcacgcgcgtgctgcagggcgcgctgcgcggcctctcgctcggggagtgccagcagctctggcgctgcagcgacgccctcgcgcggcagagctacgagctgcaccaacgcatggacctggacgcgatcgccaccgcgggcagcgccgcgtgcgcgagcttcagcggcatcgcgtttacgcacctcgcggcgggggtcatgaccgcgtcccagttcgactacctgcagcggcgcctcaggatcgtatcggcgttctacggctgcctgcgcccgctcgacgccatcctgccctaccggctcgagatggcgcagcgcctcgacgtgcccgcggcgcccgcgctcggcctgcccgcgacggacgacctctacgcctggtggggcgactccatcgcgcgcgaggtcctgcgcggcgcgcccaccgccctcgtcaacgtcgcctccgtggagtacgcgcgcgccgtcgtgccgcacatggggcaggttcccgtcgtcacctgcctgtttggcacgcgccgcgcgacggacgggcgctttgtgcagcgcgccacggaggccaaggcagcgcgcggcagcttcgtcaggtggtgcgcggagaaggacgtggacagcgtcgcccagctccgcacgtacgcggagcgcggctacgcgctcgacgccgcggcctcggacgagcgcacgctccgcttcgtgcgcacgtaggggagcgggggccgcgcgtcttgccacaccccgcgcgttgtggcaaggtctaccttggcgcacaacgtgcgcgctggtacggcaatccgcaggaaaccgcaggatgggagggccatggcagaggcgtccaaggctgtgcgcgacggcgcgtcggtacccgcgagcgggtcgcccgattccgcggcccagccccacgagtcccgtccggaccaccgccgtcgcgtggtcgcgggcacgctcatggtcatcgccggcgcgtgcctgtggggcatctcgggcacggtgtccaagctcctgatggaccgtacgggcgtgagcccgctctggatgaccaacgtcaagatgctcgcgggttcggccgtgttcttctcctttgccgccgcgcgcacgccggatctcctgcgcgatgccggccgctcgcttcgccacccgcgcgagctcctgggcgtcgtcggcatgagcgtgatggcctacctggtgctcaacgccagctacttcgcaaacgtggacgtgaccaaccccgccaccgccacggtgctccagagcctgggcgtgcccatgacgctcgcggccgtgtgcctgcgcaagcgccgcgtgccgtacgggcgcgaggtcctctgcttcgcgatggcggtcctcggcacgttcctgctcgccacgggcggggaccccaccaccctcgccatgccggcgctcggcctcgcgctggggctgctcacggctgcgggccaggcgtcggagtcgctgctcacggtgggctacgtgcggcgttgggggagcctcgtcaccaacgcgatcggctttctggtcgcgggcctgctgctcctgccggcggtgcgcccgtgggcgtacgacgcggccgcggccttcgccccgctcgactggttcctgctcgcgttctccgtgctggtgggcacgttcggcgcgggcgcgctctacatggcgggcctcgtgcgcgtggggccggtccgcaccacgctcctttccaccacggagcagctgtcttccgcggtgagcgcctgggccctggtcggcacgaccttctcgcccgcggagcttgccggcttcgcgatcatcacggccatggtcgcgctttcggcgtaagggggaggcatgtcgcgcaggaatcgctaccgggacatagacgtgggctcgctcccgcgcagctacgtgagctacgacctcgagaccacgggcctcggggcggacgcgcgcatcgtggagatcggtgccgtccgcgtgatcgacggctatgaggacgagaagttcgacacctttgtcgcgcctcccgcgggggtgcgcttcgagccgggcgcccgcgccgtcaaccacatatctgacgcgatgctcgctggcgcgccggcggaggcgagcgcctaccgcgacttcgccgcgtttgcggaggacctgccgctcgtggggcagaacatcgtcgcgttcgacaacccgctgctcgacgccgcggccgcccgtgcgggggagcggcccctcacggcaaacggctgccacgacaccatgctcctgtaccgcgcgctcgtgggcatgcccgcgagccttgcggcgatctgcgcgcactacggcgtgcagaacccgcaggcgcaccgcgcctgggcggacgccgtcgccacgagcgactgctacctggccatactgcgcgacgccgcctcgcgcgccgtgcacgtgcgcgaccttgcggagcggccggcctcggacgagcttgcgggcgagcgcgtctgctttacgggcaacagctacgactttcccaagcgcgacatggaggtcctcgcgctcgagcacggcgcggagctgcgcgagcgcgtgaccaagcgcgtcacgatgctcgtggcgctggaggaccgccgcagcggcaaggtcatgcgcgcggaggagctgggcgtgcccgtcgtgggcgcggaggcgttcctggggcgcatcgggcttgcgccggcggacctccgccgcgagccgccagccgggcgcctagcccatacctaagcgtggggcacgtaggttttctcttctcgcacgtatacgattttaagagtggggtatccatctatcgtatgcacacgagtcgcccgggcggcgtgccgcgccgcggcgcatggtaggggaggaagccaggcatgaagcagttcaagaccgagagcaagaagctcctggacctgatgatcaactcgatctacaccaacaaggagatcttcctgagggagctcatctccaacgcgtccgacgcgctggacaagctgagcttcgagggcctcacggacgagtccaagcgcgtggacgaggagctggccatcaacctggccttcgacaaggacgcccgcacgatcaccgtgtccgacaacggcatcggcatgacggaggacgagctcgacaagaacctgggcacaatcgcacactccgggtcagagcagttcaaggagaagaacgcggacgcccagggtgacgccgtggacatcatcggccagtttggcgtgggcttctactccagcttcatggtcgcgaagcgcgtgcgcgtggtgagccgcgctctgggcgaggcgcaggccaacacctgggagtccgacggcgtgagcggctacagcatcgaggccacgcccgcggaccagctgcccgaggcgctcgccggcgagcacgcgcacggcacgcagatcacgctcttcctgcgcgactccacggaggaggacgacacggaccagttcctgagcgagtggaagctccgcgacctggtgcgccagtactccaactacgtgcgctaccccatccgcatgatggtcaccaagagccgcgagaagccggcgcccgaccccaagccggacgactacaagcccgagtacgaggactaccaggagctcgagaccctcaactccatgacgccgatctggaagaagcgcaagtcggacgtggagcagaaggactacgacgagttctacaagtccacgttccacgactgggagaagccgctgcgcaccgtgagcttccacgccgagggcgccatcagctacgacgcgctgctcttcatcccgagcgtggcgccgttcgacctctatagcaaggactaccagaagggcctcgcgctctacagctcgagcgtcctcatccaggagaagtgcgcggacctgctgcccgactactacaacttcgtccgcggcatcgtggactcgccggacgtcacgctcaacatctcgcgcgagacgctgcagcagaactcgcagctccgcgccatcgcccgccgcgtcgagaagaaggtcacgtccgagcttgaggacatgcgcgacaacgaccgcgagtcgtacgagaagttcttcaacaactttggccgcggcctgaagtttggcatctacaacagctttggctccaagtccgacgagctggcagacctgctgctgttctactccgcgcgcgacaagaagatggtcacgctcaaggagtacgtcgacggcatggccgagggccaggacaagatctactacgcggccggcgagacccgcgagctgctcgagcagacgcccgcggtccgcagcgccctcaagcacggctacgacgtccttctctgcacggagaacgtggacgagttcatgttccagttcctgcgcagctaccacgtggacgccgttgccggcgactccgagcacaaggggaccgaggcccgcgacatcgagctgcagaacgtggccgacgccaagctcgacctcgccacggaggacgagaagaaggcggccgagaaggccacggaggacaacaaggagctctttggcgagctcaaggacgccctcgacggcagggtgagcgaggtcaaggtgtctgccagcctggacgacgacacgcccgcgaccgtaagcgccgagggtcccgtctcgctcgacatggagcgccgcctgcagcagacgcccgacgccgacaaggcgcccaaggccagccgcgtgctcatgctgaacgcgaagcacccggtctttggcaagctccaggccgccaaggacgacaagaagcgccttgccctcatgggcgacatcctctacaaccaggcgctcctggtcgagggcctgcccgtggaggacccggccaagttcgcgcgcgagatcacggagctcatgtaggc

SEQ ID NO: 257 - DNA, 1561 bp, Unknown
  Metagenome-assembled genome
gtcaaacatcctaaagtaagaggtatcaagattgtgacgacaatcttgatacctcttttactatacttaaattgaggttgaggtcgtcaacatcagtggaatatacattccgagtgtcaaactggcccaacaacacgtagtgaacagttagatttaggatgtgggtccttgagatcgaatttagaaaatgaacgaatctgcgaagttgttacctcaaaaatatatggaaggcgataaagtgcacgttttaggtattgatgtgagtcgtggaaagagtaattgtgctcttttacacgatcatacggttattaaggagtttcagattatccataataagtctggattggcaaagctcaagtcaataattacgagtgacctgccagtcatggcagtatttgaaacgactggtatttattctagagttctgactcgtttttttatcgatgaaggaatgaattaccttgaaataaatcctttggagtcctcaattcgcatggcggggttgagaaggcaaaaaacagaccgttcagatgcagttaaattagcgctcctgggaattgatcagaagtcactgattcatggtcgtagaccatattcaaggccatatgagcaacttcatttaatggcacaccgctatctagaaataactaaggagagatcccggattatcaatcatttacatgccgcacttgatcaaacatttcccgagttaaacgatatatttaacccaattcgatcagtgctcggcttaacttttgttagtctctttccccaccctgattttttaacaggatatattccaggaacgatggcaaaacaaatcattggcttggtaagtcctaaaatccattcggatttaatcgtacgtagatgtaatgaggtctggcaggcaggccaattgtcgtacccagcacaacctgcgaattcatttctgactaatcaaatccatagttattgtgaagagattcagcgatataatcaggcccatgacttattaaaacgccaattgatcacttacgcgaaaacttttccggagtttaaactcattgcgagtattcctggggcgggagagatatcaactgccctgttactaggatttacaggaaaaatagcgagattcccaagctataagcagctgaatgcttacgtaggaatagatctacgacgaatccaatccggagggctcaaagaagctgaccggattaatcggagaggccaaagtagtgcccgttatattatgtttgaaatgattagatccatgcttagaaataaagcacgcattgataatcacattgtggattactactataagttaaaaaaaggaccacatcctaaaccggatatggttgccatgattgcttgtgtgaacaggcttgataggacgattatgaatttggtccgcacaaaccaaatttataattacgcaagaacttcccattaagcagactatttaaataccagtatagttgatatttatgacagcttttttctgtcaaaaagctatcactgtttagtgtactctttttttaataagttgatacttgacatcatattagaactg

SEQ ID NO: 258 - DNA, 27098 bp, Unknown
  Metagenome-assembled genome
ccgtgagtgtgctcggtgggttcgggcgacgtactgttccgaacctggtcaggaccggaaggtagcagccataaggagcctcgggcgggcgcccgttcccaccgagcacactgtgtacgacgccccaaaccgcgcaagcggcaaggggtgttgttgtaagaagaggttgcggacccgcccaatcgcgagccccggcacgcggtggcgccgccaaaggtaaggatcttctcgcatgggattcgttaactttatcgtcgagctgatacacgacccgcgcacggccattgccagcgcgatcgccgctggaccgctgtttgcgtatggcttcgtcttcctgatcgtgtttgtcgagacgggcgtcgtgttcttcccgttccttccgggtgactcgctgctctttgcgtccgggttctttgcgcacaacggcggcttcaacatctttgcgctgctgggcgtcgcgtgggccgcggccatcctgggcgaccagtgcaacttcatgatcggccacttctttgggcagaggatcgtggcatcaggcaaggtaaaggccatgacgccggagcgcgtcaagaagaccgaggacttcctggacaagtggggccacctcgccgtcttccttggcaggttcttcccgttcatccgcaccttcgtgccgttcctgagcggcatgggcggcatgcactggcgcaacttcgtgatattcaacgtgctgggcggcatcacctggtccacgctcttcacgctcctgggctacttctttggtggcatccccgcggtgcagaagcactttgagctggtcatcgtgggcatcatcctggtctccgtgattccggccgtggtgggcgtaatcaaggcgaagctcggcaacaaggcagaggccgaggcagagtagccaaaggttcgggcgagaagaacgcccgcgcggcgttggcgcattgcacgttaggggcacccgtccacgggttgtgggcgggtgcctttgcgtgtgtggacgttgcgtacgcgccttgcgtgggaggtctatcgtttacctgttgggacatgagcccgccttgccggcaggtgcgaaggaggagacgtgagcgaggacaccaagagcgagggcatggctcaggcggagcgcgagcgcaggctcgagcggtacgaggcgtttgcggcgagcgtgcgcgaggactacggcgcgacgcaacggcagatggatgacctgcgggcgaaggaccgagtgaagacggcgacgtataggcagctctacgcatacaagtgcacgctgggcgagatcctggaccgtctggaggagtgcggcctgtaggcgccgttcgtttgcatgggaccgcggctggcgggaccgttcttctcgcccgtggtggcgcgacggggcgatgcggtgtgtatatctaagtcgaagcgacttagaacacattagcgagagcgactcaaaaaatcttagaaatcgtgtttaagttccctcctggtggttacatataacagtgaacccaaggaagcccaaaggaagggcgtccagccaattgaaggagtggtaacgatggcaggcatggttccctatagcgactacgagaaggcacttcgcagggcttggccgttcgcagcgattgacgacttcttcgcaccgctggctgtgacggacgcggatgcgttcaacatggacgtcgaggacgcgggcgacaagtacgtggtcacggcagagctgccgggcgtcacgaaggaccagatcgacgtcgagctgaacgagggtcgtctttccatcagcgtcgacaagaaggagtccgacgaggacaagcagaagaactacctgcagaaggagacctcggagtggcaggcaacccgtggcgtgtacctgaaggatgcggccaacgagggcatcagcgcaaagctcgatggtggcgtgctgacggtcgacgtccccaagcaggaagagaagaagaccaacgtcaccaaggtcacgatcgagtaggcgcgcaggcgctaggtgactgaccggttctgccgggccgagcacgaggtagttcgcagctaggtgaaaggtaaaagccgattggacgaaggaggtcgaggcgaatgagagaggcaatggcgcttttgcgcacgcgaggtttcgagctgccaaagggttgtcgcgaactcaggtggcgtcgattcccggggatccacggcgccgtgagatcctaggaagacgcggacatggcgggagtgccccgccggcgcgatttggcgcgcgcactcgcgcatgcgctcaatcgaataggacgcgaaccatccacacggggcggtaccgagaggtgccgccccgttcttgtgtgtcgaggatgttccgccgtccgcggatggtggcgcgccgaccatgcggcatgcctcgtataatgcgcgtgtcaaacccgatgcgagacggaggtcccatgaggagttacaccctggacgacctggcacgcctggtcgaccacaccaacctgcaccccgacgcgacgcgcgaggacatggagcgcctgtgcgacgaggcgaagcgctaccacttcaagatggtcgcgatcaactccgtgcagtccgcgctgtgctcgcgcctgctggccggcactgacatcgacacgggcgccgcgatctccttcccgctggggcagacaagcatcgcgtgcaaggtgtacgagacgatggacgcgatttccgccggcgccaacgagatcgactacgtggtcaacctgaccgaggtcaaggcaggcaactgggcgtacgtggaggacgagatgcagcagatcgtgggcgtgtgccgcgacgccgacgtcccgagcaaggtgatcttcgagaactgcctgctgactcaggaagagaagatcaagctctgcgaggtggcgagccgtgtgctgcccacctttgtgaagacgagcaccggcttcagcacgggcggcgcgaccgtggaggacgtgcgcctgatgcgcgagcacgttgacccgcgcgtgaaggtgaaggccgcgggcggcattcgcacggccgacgcgtttttggacatggtgcgcgcgggcgcggagcgcatcggctgcagcgccggcgtgccgatcatggacgagctgcgccgccgctttgaggagaagggcgtacagagcatcgagctgtagggcttgggctggcagatagctgcacgaaggcagacgcgggcgagaagggcggggcgtccctctcgcccgcgtggccgtgcccgctatacttatgggccagacaatacggtcccgcgatgcgcgcgggatgtgggaggcgcccatggaatctctgtacaggaagtaccggccgcagacgtttgagcaggtagtgggacagcagcacgtggtctccacgctggagaacgccgtgctggaggggcgcaccagccacgcgtacctgttctgcgggccacgcggcacgggcaagaccaccatggcgcgcatcctggccaaggccctcatgtgcgagcagggtcccgggcacctgccggacggcacgtgcgagcagtgcaagctgatcgcggcgggcgagcacccggacgtgtacgagctggacgcggccagccgcaccggcgtggacaacgtgcgcgaggagatcatcaaccgcgtgagctttgcccccgtgcgaggcaattacaagttttatattatcgacgaggtccacatgctcacgacggcggcgtttaacgcgctgctcaagacccttgaggagccgcccgagcacgtggtgttcgtgctgtgcaccacggacccgcagaagattcccgagaccatactttcgcgcgtgcagcgctttgacttcaggcccatcggcaacgaggacatcgaggcgcacctggaggacgtgtgccgccaggagggcttcgagtttgacaaggccgcgcttgacctggtggttcgccacgcgcgcggcggcatgcgcgacgccctgagcacgctggagaagctgagcgtgtttggcgacggcaagatttcgctcgacgcggcccaggacctgctgggcgaggtaagcggttccatgctcgtgaacgtggcctgcgccatggccgagaggaacgtgccctccctgtttgaggccgtgggcgatctggtgagctccggccgcgacctgctggagtttacgcgcgagctggcgggtcatctgcgcgacgtgtacgtagtggctgcggtgggcgccaagcccggcgtggtggacgctacagaaaacgagctgcagaacctgcgcgacgaggcgctggcgtttggctccgtggaccgcgtggcccacgcgctggtggtgctgaacgacgccgccaaggagatgcgcacggccactgaccagcggcttgtgctggagattgccctcacgcgcgtggcgcgccccaagagcgacctgacgctcgactctctggcggaccgcgtatcgcagcttgagcgtcgggtggccgagctcatggtgggcggcgtgccggcgggtgcgggtgcggcggcgccgaaacccgtgccgatgccacagacaagtgcaaggcaggcggccccggagagggcagcgactccgacaccagctcccgctccggcgaggccagcggagccggtcaggcgagaagagcctgctcccgttgcccaggcggcgcccaagcaagagtccgcacctgcgcccaggccagcggccgcgcccgtgcagcaaccagcggccacgcctgcgcctgccactgccccgcagcaggccccgcgccccgcggcgcccagacccgcgcagtcggcacccgcgccagctccggcaccgaagccgcaaccggcaccggcgccccgcccgactcgcccgcccgagccggcaccggcttccaccccgcagccagccgcaagcgcggcggcaagtccttctccccagaccgcggccgtgaccgacggcggggagctgcagcgcatgtggaagcgcgtggtggaggagctcgtgcgcagggacccgccgcgcggatcgctgctgctcaacgcgacgcccatcagcgacgacggcacgaggctgctggtcaacctgcccaagggatcgtcgtttgcggtcaagatgctcgagcggccggacgtgagcaacgtggtcgaccccgtggtgagcgcggtctttggccgtcgccaggtggtctacgccgaggcgagcctgcgtggcgccgacatcgctcgcgcccagcgtggggcgagaagcgcgcaggcgccgtccgcggcatccgctcggcaggcggctccggcaccagctccccagccggctcccgctcccgtgcggccgacccccgcaccggctccgcgccaggcgcctgcgccgcagcctgtgcccgcaccagcgccgcagcagaacgccggccccatgccgtgggacgacgtgcctccctacgaggaggttccctacgatgacgcggcggcggtctcgtacgacgaggacgttcaggaggggctcgcgtccggcgggcatccggcatactctcagccggcgccacagccgcaggcacctgcaagccagcccgtgcccgcacctcagccggttcctgtaccgacacccgcacccgctccgcagccggtagcggccccgacgtcagcccctgctcccaagccggagccgaagcccgcgtctgcacccgcgcccaagcccgcaccggctcctgcggcggaggcctcgctcgaggacgcgccggaggacgcccagaaggtgctcgacatgctgtccagcgtgtttggcgacgtcaagtacgcgggtacggagaaggcacagggcaagtagccgccgcccagccgttaccgacagcgccccgcaccccgcgccgtccgccacggagccgcacccgcggcgtcccggcgggcggcacgacgcattttgggttttgggtatgggctcgccacgtgcggtccgccggccccgtcggcgtatcatttggtgggtacatacaataggatgcctaaaggcaactggacgagaagcacgcaccgccttgcgtcgcaacccgcacgcggcggcaaccgcggcgaaggttcgtgcaagggagccgttcttctccccgtacgacgattccccagataggagaaccacgcatgaacatgcaacagatgatgaagcaggcgcagaagatgcagaagcagctcgcgcaggcgcaggacaagctgggcgagacggaggtatccgcctccgcgggcggcggaatggtgaaggtcaccggcacggccgacggccacatcactggcatcaagctcgacccggaggcgctcgacccggaggacgtggagatgctggaggacagcatcctcgcggccgtcaacgagtgcctggagagcggccagaacgtggcaaaccagcagatgagcgccatcaccggcggcatgaacatcccggggatgttctagtggctcagactctggagtggtcgtcggcggctggcgcgcaggtgccggcggacgaccgcgcgctgcagcgcctgctggacgagctgggtcgcctgcccggcatagggcccaagtccgcccagcgcatcgcgtactacctgctcgaggccgatgacgagacggcgcgccgcctggccaacgcgatcctgcaggtaaagcagcaggtgcacttctgccccatctgcttcaactacgccacgcgcgagcactgcgacatctgcgacgaccccacgcgcgaccgcagcacgatctgcgtggtgtcagagccgcgcgacgtgacggcgatcgagcggaccggcagctaccgcgggctctaccacgtgctgggcggcgtgatatcgcccatggacaaggtgggtccggagcagctgcacgtgcgcgagctgctcaagcgccttgccgacggagaagtgcacgaggtcatcctcgccaccaacccggacgtggagggcgagaccacggccacgtacctgagccggatcatccggccgctgggcgtggaggtcacgcgcctggcgagcggcctgcccgtgggcggcgacctggagtacgcggacgaggtcacccttggccgcgcgattgaggccagaagggccctctagccaacgttgacgggcctggccccgcagattagtgcaagaatcacggcagacaccagacagggaggtctgacacatgagccaaagcgcaaacgactcctacacgtcgcgccacgcccgccatgcggcaagcggcgcgggcggggtgcgcgtgccgagggggacgggccgccctgccggtggcacgcactttgcgggatcgaccaccaaccgatacaagaactactccgtgggccgcgactacgacacggacggcatggccgagcaggccgcgccgcgccccgtgctcgacccggcggccaccggatccttccagcggatcgacgcgagcatgggcgccaaggtggagaaccgcaccaacgtggagcagctctccgcggacaacacgtcgtcctggcggcgcagcggctacggcagcgagatgcgaatctccgacgcctaccgcccgcagacgcgcagccacgagaccaagacgcacaccagccgcaagtttgtggcgattgtgacggtgctgatcgtggtggtgatcgcgtgcggcgcctacctggcgcacctggtcctcacgagcaagccgaccacgaccaccaagaccacgcaggtggagaaggtcgtggcggacgtggacgcgaccatcagctatcgcaaggtcgcctactcgctgtcgcagcaggctgacggctcgtacgcgatcgtgagcacgggcgagaagagcagcagcctcacggtgctcagctccctcagcggcacccccaagaagttcgtgctgtacaagggcacgatcctggtgccggagaacctcgagggcggctgggacgttatggcctacaccatcggcacgggccagcccgcgtcgcaggtcgtgggcacggacggcaaggccgtcacgggcacgggcacgatcaagtccgtcaagctcagcggatccaacctcgcgatcaaggacagcaagggcaagacgaccaagatctcgctcgcgagcacggccaactcgatctcgcaggggtcgtccgcgtcggacagctcgagctcaagctctggcagcaccacgtctggcagcacgtccacgggcgagtaggcgcgttcttctcgcccggcacttgtgggcaagtggtggagaagaactttcttaaatttgttctggacaaagccgcttggttgcatgtaatatagctttcgcactgatgcacggggtgttagctcagctggttagagcgccggcctgtcacgtcggaggtcgcgggttcaagtcccgcacatcccgccatttatgtactcagggcttcggggaaccgggcccttttttcttgcttcacagcaaggggtgttagctcagctggttagagcgccggcctgtcacgtcggaggtcgcgggttcaagtcccgcacatcccgccatcaacggttctgggaccctggcacgcgccggggtcccttttttgtgcgcggggcgggtatccgtcccgggtggcacgtcccgcgcgacggccccgtgccaatgggatacaatgcctaaatgctgtcaatgtgatagctttactgctgatacgggaagagacggatcgatggacatctccaggaagacagactacgcgctgcgcatgcttgcggagctcgtccggtcggacgacgtggtgtccgttcgcgcggcggccgagaagaacggcgttccgtactcgtttgcccgctccatccagcacgaccttgtgtcggccggcctcatagagagcagccgcggcgcgcacggcggcatgcgcctgtgcgtggacccgcatgacgtgacgatgcgccaggtgatcgaggcgatccaggggcccgtgtacgtgtcgacctgcgggacggccggcccggacggcgagccgtgcccctttaggccggagtgccacttcaaccccgtgtggtgcgaggcagagcgcatcctggcgcgctacttcgattccgtcacgctctaccaggtggtgtgcgagcaccagcaccccatgctcacggatggcagcggctttgagctgaccggccccacgccccgcgtgcccgacgttcccagcgcaaggtagacgcatgccaggcgcaagcggagcgtcgcgcggcgccgccggggacgcgtccgcgctgccggagggctttagggccaaggtgctcgaccgcggccgcgagctgtatcgcgatctgccgtggagaaggacgcgcgatccctaccgcatctggatatctgaggtgatgctccagcagacgcaggtcagccgcgtggacggccagtggcagcgttggtgcgagcgctttcccagcgtggacgcgctggccgcggcggccccggcggacgtgctggaggagtggcagggcctgggctacaaccgccgtgccctggcgctgtggcgtgcggccggcatcgtgagcgccgcgggcggcgccatgccgcgcgagcaggcggacctcgtggcgctgccgggcgtgggcccggccacggcggcgggcatccgcgcctttgcgtacgacctgccgggcgtctatctggagaccaacgtgcgctccgtcttcctgcacgaggtctttccgggtcgcgagggcgtgggcgaccgcgagctggtgccgctggtggcggccgcctgcccgccggacgcaagcgacccgcaggatgacccgaggacgtggtactacgcccttctcgactatggcgcgtacctaaagaaaaccgtgccaaacccgtcgcggcgctcgaaggcgcacgcgcgacagtcgcgctttgagggctcgcaccgccagaagcgcgcggagctcgtgcggctgctgctggaccaccgcgcggacaagccgcacggtgtcgacattgcgacacttgtcgacgagatgtgtagaacggagctcgaggcgggtagaaatagactgtctgcccgccaggtgactggactgcttgaggagctcgagtcagagggcttctgccacaagataggtggcaattggagcgcctgagccgtacaatgtgggtgacacggttggaagagcggacgggcgtcgggcctgtccagttcggagaggagaacgtgcatggcagtcgattttgagaactcccagaccaagaagaacctcgaggcggcgtttgccggcgagtcccaggccacgaacaagtacgcgttctacgcgagcaaggccaagaaggagggctacgttcagatctcgaacatcttcacggagacctctagcaacgagcgcgagcacgcgaagctctggttcaagtacctgcacgacggcgacgtgcccgacaccctgaccaacctcaaggatgccgccgcgggcgagcactacgagtggaccgacatgtacaagggctttgccgagaccgctgacgaggagggcttcaaggagctggccgccaagttccgcctggtgggcgacgtggagaagcaccacgaggagcgctacaacaagctggccgagaacgtcgcgaacggccacgtcttcgagcgcgagggcgtcaaggtctggaagtgcctgaactgcggccacatccacgttggccccacggcccccaaggtctgcccggtctgcaaccacccgcagagctacttcgaggagctggcggtcaactactagtcgccggcaggcagccgcaagggttcgcgcgtagcgagcccgcgacataacgtccccccaagggcggtccgcacgcatggtcgtgcgggccgcctttttgcgtgggggagaagagcgtcgcccgttgccgtccacacgctcccacgggccaggacagcgtttgtgcacgtcagattggttatcgatttggacgataaccattaaacgtatagttaaagatagtgtttacctgcggaaacgccgtttttctcgcccatgcgatatgaaaatccttgtgctcgaaatgccgtgccctattatgtgttcacaacgaaagcgagaaccaacgcaccgaacggacgtgccgaagatgaagatcagatcagacataccagccaggagcaaaacgatgctctagcccgggctcagagagctgccacagagcagaggggtaaccgggcgcacgaccaacggaacgacggaacagatcatcagagcgggcgagaagagcccgcaccaacgcataaaggagaccacatcatggcattcgaactcgaccccagctttgcaaaggaccccgagaagcacttcaacaccctgcaggtacacgccggctggtcgcccgaccccaccaccggctccgcggcgctccccatctacgcgtccgccgcgttccagtttgacgacgccgccgacggcgctgccaagttcgccctcaccaagccgggcaacgtctacggccgcctgaccaacaccaccaccgacgccgtcgcggcccgcgtcgccgcggtcgagggtggcaccggcgccgtggccgtcgcatccggccacgcggcggagatcctggcgctcaccaacctcgtcggcgccggtgacgagatcgtcgcctccgactcgctgtacggcggcacgtggaacatcttcctgcacaccctgggcgacctgggcgtcaagaccacctttgttgagaacaacgacatcgatggcttcgtcaaggccacgacccccaagaccaagctctggtacgtcgagaccatcggcaacccgctggtcgacgtcgcggacgttcccgccatcgtcgaggctgccaactccctgccgagccccgtgcccgtctttgttgacaacaccttcgccacgccgtacatctaccgtccggccgaggacggcgcggcggtcgtgatcgagtccctcaccaagtggatcggcggccacggcgcgaccctgggcggcgccgtcgtcgacacgggcaagttcgactggaagcaggaccccgacaagtggagcacgcttgccaagcccgacccctcctaccacggcatcgtcttcgcggacgcggcccccgcggcgccgttcgcaacccgcgtcctcgccaacaagctgcgtgactttggccccacgctgtccccgtacgcggcgcagctcatcggcctcggcctcgaggacctgtccctgcgcgtccagcgccactccgacaacgccctcgccgtcgccaagtggctcaaggagaaccccaaggtcacgtgggtgcgctactccggccttgaggacgacccgagccacgagaccgccacgcgcctcttcaagcacggctttggcggcgcgctggtctttggcgtcaagggcggtcgcgaggctggcctcaacgtcgtcaacaacgtgaagctcttcacgcacctcgccaacgtgggcgacgccaagtccctcatcatccaccccgcctccaccacgcactcccagctcaccaaggagcagctcgaggccgctcacctctccgaggacctcatccgcctctccgttggcatcgaggatgtggacgacatcatcgccgacctcgaccaggccatctccaaggcatagcggcgtccgcggcacggccgcaggcacacgctagtgagaagagcgccccgtcacgcccgcagctcctgcggcgcgtggtggggcgcttctgttgcggctccctgccgtgggggcacgttcttctcgcccgcgcgaccttgcgcctgtctgccgacgggcctgccgagaagggctaggcgtccttcttacccgtgccgttgtgggcagcgtcaaaggccttggccctggcggccatctgccgcctgacctccgggtcgcgcgggtgcaggcgcacgaactccgcgaagccctccacggaccagtcgtgccagtcggtggtgtctcccaggttcacaaagatgcaggtggggacctcgcccagcgctaggttcttgcggatgcacgcgtcgcagccaaagttgcccttggccaggttcgccgggttgttggggttgcacgggcacttgaggtcgtcgcaggtgcagaagtgccttccgccgtcagccatgactaccttccctctgtcttgcgggcagcggccttgccggctgccttcgcctgcgtgccggacttcgccttggagcccgacttccttgcgtttggcttgccgttcgccttgaaggccgaggggcagatgtccacgcacgggcacgcgtcgcacttgggccgctgcgccgtgcaggtgtcgcggccaaagtggatccactcctcgttgacgtaggtccagaggtcgcttgggatcaggtcaagcaggtccttctccgctgccgcgggcgtgctcgcgcgcgtgaggcccaggcgcgtggcgatgcggaacacgtgcgtgtccaccgcgatgccctcgcagatgccaaacgccttgttgagcacgatgttcgcggtcttgcggcccacgcccggcagccggcagagctcctccatggtgtgcgggacctcgccgccaaagtcgctcatgatcatgcgcgaggcctccacgcagtgcgccgccttggcgcgccagaagccgatgctgtggatgacctcgcccacctcggccgggtcggcctgggccatggcctcgggcgtgggccagcggcgaaagagctccggcgtcacgcggttgacgccggcgtccgtggtctgggccgagagcatcacgcagatcgtgagcgtgaaggggtcgtggtagtcgagcgcgctctgcacgcccgggtagcgctcgtgcatgcgccggcagaactccaccgcgcgctccctgcggcttgccttcgactcgcgtggcatgtccttctcgcccccgtccttggtgcccccatgttggtggttcatgatacccgcttttgcgcggggcatacgcgatgtcgcgcacggcccgtttgccaccgtgcgcaaactagtgtccataaccacttgttggattttatagaatgtgtagttacggtggacgcgggcaaccggtgccaccccaaagcagctgggcacaagtcggaggatggtttcatgagcgcacccattgcaaactacctgctaaccaacgatgacctgtacctcatgggcaaaggcgagtggttccgcagctacgagaagctcggcgcacatccctgcaacaaggacggggtcgagggctactggtttgccgtgtgggcgcccgacgtcaagggcgtcagcgtcataggcgacttcaacgactgggagctggacgccacgccgcttacgtgcacgcccaccaacggcgtgtggtacggctttgcccccggcgcggaggagggccagctctacaagtacgtgatagagaccgccaagggcgacctgctgtacaaggcggacccgtacgcgttctacgcggagtgccccccgggaacggcctcgcgcctgacggacccctctggctacgagtggcaggaccagaagtacctggccgcgcgctcgcagcagaacttcttcaagcgtccgctcaacatcttcgagtgccacctgggcagttggaagcgccacccggacggcctggccggcaacggcgaccctgactccgaggaccacagcggcagctaccttacctacgacgagctgtcggacgagctggtcggctacgtgaaggagatgggctactcgcacatcgaggtgctgcccgtgatggagcacccgtttgacggctcctggggctaccaggtgacgggctactacgcgcccacgagccgctacggcaacccaaggcagttcaagcactttgtggacgcctgccaccaggcgggcatcggcgtgatcctggattgggtgcccggcggcttctgccgcgacgagcacggcctggtgcacttcaacggcaacaagctgtacgagaaggaggagcaccccaactggggcacgttcaagttcgacttcaccaagaacgaggtccgcaacttcctcacgtccaacctgctgtactgggtgggggagtaccacgccgacggcatccgcatggacggcgtcacgtccatgctgtacctcaactttggcgtggacgaccccagccagaagaagttcaactcccgcgggaccgaggaggacgacgcctccatcgagttcatccgcaactgcaacgacacggtggccaagtactaccccgacgtgatgatgatcgcggaggagtccacggcgtggccgctcgtcacgtaccccacgtccgacggcggcctggggttccacttcaagtgggacatgggctggatgaacgacacgctgcactacatgcagaccgacttcccgtaccgccccggcaaccacaagctgctgaccttctccaccatgtaccagttcaacgagaacttcatcctgccgctcagccacgacgaggtcgtgcacggcaagtgctcgctcatcacccgcatgccgggcgactactggcggcagttcgcgggcatgcgcgcgctcgcgctgtaccagatgacgcacgctggcggcaagctcaacttcatgggcaacgagatcgctcagttcatcgagtggcgctactacgagggcatccagtacttcctcacggacgagtacgagagccacgcacaccagcagcactacgtgagctgcctcaaccggttctacaacgagcacccggccctgtggcaggactcctactcgcccacgggcttcgactggatcgacgctgacaacgccgaccagtgcatcatctcgtttgtgcgccactccgacgacgagaaggacgacctcgtcatcctgatcaacttcgaggtgaacccccacgaggagttccgcatcggcgtgcccaagccgggcatctacgaggaggtcttcaactccgacgacgaggagttcggcggctcgggcgtcaccaacaagggcgtcaagttcgtcaccgtggacgagccctggaaccgccaggagcagtccatcgagctccgcgtgccgccgctggccggcctcatcctgcgctacgtggggccgctccccaagcgccgcacgcgcaagccgcgcgcaaaggccgcgcccgccaaggcggcggagaaggacgaggccacgacctcggcaaaggctcccgcaagcaaggcaaaggcacccgcgagcaaggcatcggccgtaaagcctgccaagaccacggtaaagactggggcaaaaaagcccgtttccgggaagactgcctccgcaaaaactggtaccactaaaggtaccgggaaggcgtaggtgacccccggcccgtctttcgtgcggccagggaggagcgaggccctttcggagaggggtggagccgcgcgagcggcaaagccaaagcggcgttctaaggaatgacatgacagcagcagagaacatgccaaaaatcttcaaggacaaggacgacttcatcgagcagtaccgcggcgcgtgcgagcgcgagttctccaagtcctacgaggagcttggcgaccaggagcgctacttcgccctagcgagcctcatagccgacaaggccaagagcatgcgcggcgacacgctcaagcgcgtacaggacgagggcgagaagaccgtgtactacttctccatcgagttcctgctcgggcccctgcttgacaactacgtcctcaactttggctgccgcgacatcgtgaaggctggctgcaaggagctgggcaccccgctcgacgagctcgagaagtgcgagagcgaccccggcctcggcaacggcggcctcggccgtcttgccgcgtgcttcctggactccatggcggccctgggcatcaacggcaacggcaacggcatgcgctaccgctacggcctcttcaatcaggccatcgagggcggtcgccaggtcgagaagatggacaactggcttgagcacggcttcccctgggagacgcgccgcaacgagagctcggtcctcatccgctttggcggccaggtggtccgccacgaggagaacggccgctactggttcacgcaggagggcggcgagctcgtcaaggccgtcccgtacgacgtgcccatcgtgggctacggcggaaagcaggtcaacaacctgaggctctggagcgccgagcccgcggaggagaacttcgacctggacgccttcaaccagggcgactacgccaaggccatgaagttccgtgcggacgtcgaggcaatctcgacgatcctgtaccccaacgacgccggcgagcacggccgtctgctcaggctcaagcaggagtacctcttcgtctccgccggcctgcagaccgtcctgcgcgcgtacgagaaggagtacggtgacgacaactgggaggacctcggcaagcacgtctccatccacaccaacgacacgcaccccgccatgtgcggccccgagctcatgaagctcctggtggacgagcacggcgtggacttcgacctcgcgttcaagatcgccagggagaccatctcctacaccaaccacacgatcatgcccgaggcgctcgagaagtggcccatcaacacgttccgcgcccttctcccccgcacgtacatgttcatcgaggagatcgaccgccgctatcgcgagagcttcccccacaccgaccccaactggcaggaggagttcaagaacaccgccatcctctgggacggacagatccgcatggcgaacctctcggtcatcttcgcgcactccgtcaacggcgtgtccgcgctgcacacggggatcctcgaggccagcacgctgcatgacttctacaagctgacgcccgagaagttcaacaacaagaccaacggcatctcgcaccgccgcttcctgggcaacgcgaaccccaagtacgcgaagctcatctgcgacgtgatcggcgagggctggctgggcgacgccaacgagcttgccaggctcgaggactacaaggacgacccgtcgttcctggattcgttcgagaaggccaaggagtgggacaagcagcgccttgccgactacatcaaggagaccaccggcaccgagctcgacaccagcatggtgttcgacgtgcaggtcaagcgcttccacgcatacaagcgccagctgctcaacgtcttcaagatcatggacatctacaacaggctgctggacgaccccaactacaagccgcgtccgaccgcattcatcttctcgggcaaggccgcgcagagctacaccttcgccaaggaggtcatccgcctgatcaactccgtggcggacgtgatcaacaacgacaagcgcgtgaacgacgtcatccgcgtcgccttcgtgcccaacttcgccgtgtcgagcgcgcagctcatctacccggcggccgagatctccgagcagatctcgtgggcgggctccgaggcgtccggcacctcgaacatgaagctcatgatgaacggcgccatcacgctcggcacctacgacggcgccaacgtcgagatcgccaagctcgtgggcgaggacaacatcaagatcttcggcctgcgcaccgaggaggtcgacgccctgcgcgcgagcggcaactactgggccttcgacctgctgaagaaggacccggaccgtctgggccgcatcgtgaaccagctcaaggacggcaccttcgcgcacctgtccggcaacttcgacagcatctacgacgagctgatggtcggcaacgaccacgacctcgtcctgaaggacttctactcgtacgtccaggcgtgggaggagctgacccaggcctacggagaccgcaccgcctggaaccgcgcggccatccacaacacggccaggtcgggatatttctccagcgaccgaaccattcgcgaatatgcccacgacatttggcatattgattaggtgtaggaggtttcgaagccaacgcttcggagggagtaatagggctcgaaaggggagtaccaaatgagcaagagggaatgcatcgcaatgcttcttgccggcgggcagggcagcaggctcggcgtgctgacaaagagcgtcgccaagccggccgtctcgttcggcggcaagtaccgcatcatcgacttcgcgctttccaactgcgcgaactcggggatcgacacggtgggcgtcctcacgcagtacaggccgtacctgctgcacaactacctgggatccggaagcgcctggaacctcgacgagagcgacggcggcctcttcatccttccgccgtacgccacgcagacgggcggcgcctggtacgccggcacggcagacgccgtgacgcagaacctcggcttcatcaagcagaacgaccccgagtacgtcctcatcctctccggtgaccagctctacagcatggactaccagaagatgctcgacaaccacaagcgccacaacgccgacctcaccatcgcggtcatgcccgtgccctgggaggaggcgtcccgcttcggcatcctgacgaccgacgaggacgagaagatcctcaagttcacggagaagcccaacaagcccgactcgaacctcgcgtccatgggcatctacatcttcaacgccgacctgctggtcaagacgctggaggaggacgccgtcgaccagacgtccgagcacgacttcggcaagaacatcatcccgaagctcctcgacgccggcaagcgcctctacacctacgagttcaacggcttctggcgtgacgtcggcaccatcgccagctaccacgagacgagcatggacctgctgggcaccaagcccgacttcgacctgtacgacgctgaggcccccatcatgagcaacgccggcgcaatgccgcctgcctatgttggccccgacgccaccgtcgacgactgcctggtcggcaacggcagcagcatctacggcaaggccgtccactcgatcatctccacgggcgccgtcgtgggcgagcgcgccatcgtgcaggactccgtccttctccccggcgcagaggtcaagccgggtgcacacgtcgtgcgtgccatcctgggcgagaactccgtcgtcgaggacaacgtgatcctcggaagcgtcgaccagactaaggacaccgccgtcatcggaaatgacgtagtcgttggaaagggggaggagtagagatggagaagctccttggcgtcatcacggctaactactccacgaagtacccgagcgtcctctccgaggcacgccctgccgcgtccgtcccgttcctcggacgctatcgcgtcgtcgactttgccctctccaacatggtgaacgcgggcatcaagaccgtcggcacgatcatgccgtacaactaccgctcgctgatcgaccacatcggctccggccgtgactgggacctcaaccgcaagaagggtggcctgttcatcctgccgggttccgcctttggcacctcccgcacgggctcgcgcttcctgctccgcgacctcgagtacaacaaggtcttcctcaagcgcagcgaggccgagtacgtggtcctgtcctccgcgagcttcgtctacaacatggacctcaccaaactgatcgacgcccacgccgagtccggcgcggacatcacggtcctgacgcaggccgccaaggccaaggacgtcgacgtcaccggcttcaaggtcgacggcacccgcgtccacggcgtcaagcacggcgtcgagtttggcgacgtcgcgttcctcgactgcttcgtcatcggccgcgagttcctgctccagctgctcgactggtacgagcagaccgactacctcgacctcttcgaggccatggccgccgactacgagcgcgtgaacgtccaggtctacgactacgagggctacgtcgccccgatcttcaacaaggacacgtacttcaagtccaacatggacatgctcgaccccaagatcacggccgagctgttccccgcggaccgcaggattaggacgaaggcgcacgacaacgcccccgccaagttcgagaccggctcccgcgtgagcaacgcccgcgtctcgggtggctgccgcatcaagggcaccgtctccaactccgtcctcggccgcaacgtgattgtcgagaccggcgccgtcgtgagcaacgctatcgtgatgcagtcctgcgtcatcaagaccggcgcacgcgttgagaacgccatcgtcgaccgcaacaacgtcgtacccgcggggaccgagctcaggggtacccccgagtccctgctcattaaggaaaaggctacggattagcctagccggatgaggactttgcgatgagtgaccaggcaacacgcaaaatcaaggtcctgttcgccgccacggaggccgtcccgttcgtcaagacgggcggcctgggcgacgtcgtcggatcgctcccgcgctcgctcaacgccgcgggcgcggagtgctccgtcattctccccaagtacgccagcatcccgcaggagtaccaggaccagatgacccacatcgcggacttctacgtgccgctggcgtggcgcagcgtctactgcggcgtggagaagctcacctacgacggcgtggacttctacttcgtcgacaacgaggcgtacttcaagcgtgacggcatctacggctactacgacgacggcgagcgcttcgccttcttctcgaaggcgatctgcgaggccatcgagaagctgccggagctgcagtgcgacgtgctgcagtgcaacgactggcagacggcgctcgcgacggtcttcctgcgcgagttctaccaggcctccgaggcgtgccgccacgtgaagacgatcttcacggtacacaacgtcaagttccagggccagtacaacgacaaggtcctggaggacgtcctgggcctggcggacaaccccacggcggcgagccagctctacagcggctacaacaccgtgaacttcatgaagggcgcgctctgctacgcggacctcatcaccacggtgagcccgagctacgccaacgagctacagatgccgttctacggcgatggtctggacggcatcttccgcaggcgcgcctcgcagctgcgcggcatcctcaacggaatcgacgtcaagctctggaaccccgccaccgacccgatgatccccgtcgactacgacgagaacagcctggacaagaaggccgaggacaaggccgccctccagcgcgagctcggcctcaaggaggacccgacgcgcccgctcatcgtcatgatcggccgcctcaccaaccagaagggcctcggcctcgtccgctacgccatgaaccacctgatggagcgcggcacccaggtcgccatcctgggcacgggcgacaaggaccaggaggacgcgttcaagtacttcgactggacgtacggcgaccagatggtcgcgcgcatcgccttcgacaacgcgctcagccaccgcatgtacgccggcggcgacatcctgctcatgccgtcggagttcgagccctgcggcctctcccagatgatcgccatgcgctacggcacgcttcccgtcgtgcgcgagaccggtggcctgcaggacagcgtcgtcccgtacaacaagtacacgggcgagggcaccggcttccgcttcaccaacatgaacgcggacgagatggccaattgcatacttgacgcctgcgaagtgttctggacggataaggacgcttggattaagctacaaaggcaggctatggaaaccgacttcagctggaaccgggcggcggagacctacatggacatctaccactcgctgcacccagagatcggtcgttagtaacagaagagggtgtggctttgagggctaggcatattacctcagacagccagtacagaaacccattcggcgccgtccaggcgggcggcgccgtttctgtatggatagacgtctgggacgagccgtccgccacggcgcggctccgcatctgggttgacggcaagggcgagaagatcctcgacatggagcgcgtggccctttcggaggaggaggcctcccgcttcggcagcgacgtccccgtccgcttcggcgtcacgttcacgcccgaggagcccgaggtcatctggtactcgttccagatcgtcgcggccgacggcgcggtctggcgctacggcgccgcgcgcgaccacggctgcggcgagggcgccttcgcctacggcgagcccccctcgttccagatcaccgtgtacaaggacgagcgcaagcagcagcccgactggtataggaacggcatcgtctaccagatcttccccgaccgcttcttccgcggcaggggatgggagaagaacgtggccgcctcgctcgacaagccgcgccgtgggcccggccgtcgtctggtcgaggactggtacgcctacccgcactacgacaagacgccccagggccgcatggccaactgggacttctacggcggcacgctcgagggcgtgcgcgagaagctgccctacctcgaggcgctcggcatcacagtcatctacctcaacccgatcttcgaggccgcgtccaaccaccgctatgacacggcggactacctcaggatcgacccgatgctcggcatggaggatgacttcagggccctctgcaaggacgccgcctcccgcggcatctccatcatcctcgacggcgtcttcaaccacgtcggcgcggactcccgctacttcaacaagtacggcaactacggtcccgagggcgcggcgcagcccacgccctccaagtacgactcgtggttcacgttccgcgacgacggcagctactgcagctggtggggcgtggacgacctccccgccgtcaacgaggacagccccgacttccgtgagctcatctgcggtcacgacggcgtgatccgcaagtggctgcgcctgggcgcccgcggctggcggctcgacgtggcggacgagctctctgacgacttcatatcggagatcaaggctgccgccctggcggagaagcccgacgccgtggtcatcggcgaggtctgggaggacgccacctacaagctcgcgtacggcaagctcaggcactacttctggggctcggagctcgacggcaccatgaactaccccctgcgcaaggtgctcctggagtacctcaccaacagcgtgggtgcggacgaggtcgtccgcgtcacggagtccctcaaggagaactacccgcccgcggccctcgcgagcgagctcaacctgctctccagccacgaccgcatccgcatgctcacgatcctgggcaactcgccggagcctgattccctgggtgacgaccagaagtaccacttccgcctcgaccgcgaccacctcaacctggccgtgagccgcctctgggtcgcggcgttgctgcagatgaccctgcccggcgtcccctccgtctactacggcgacgaggccgggctcgagggctacggcgacccgtacaaccgcgccgccttcccctggggccgcgagaacagggactgcttcaacatctaccgcaacgccatcgcgatccgcaagtcgctgcccgtcttcacggacggcagctacaggccgttctccatcgggcgcgacgtcttcggcttctggcgtgaggacgccaactccaaggtctgcgtcctggtcaacgcgagcctcgaggcccagcacacggtggccatccccacggacggcctccaggtggacgacgtggtctccggcaagccgcccaaggtcgagggcgaccaggccagcgtcttcctgtggccgctcggcacggccgtgctcaacatgcacaaggcccagcgcctgcagaagcccatggagcgcggtatgggcgtggtctgccacgtcacgtcgctccccaaccgcgagcgccccggtcgccccggcacgctgggcgaccccgcctaccgcttcatcgactacctgcacaggggcggacagcgctactggcaggtcctgcccgtcaaccccacggaccacttcggctcgccgtacgccggcctctcggcgttcgcgggcaacgtgtcgctcatgtggggctacgacgaggagggcacgcacttctccacggacttcgagggcacgcgcgagtaccgcgacttcctgcaaaacaacgaggagtggctcatcccgtacgcaacgtttcgcgccataaagcgccaggtgggcgagaagccctggcaggtctggcccaagcgctaccgcgagtacaccccggagctggcccaggccaaggagctggccgcggacgtccgccgcgagtgcgccgtgcagttcgagttcatgcgccagtggggcgaggtgcgcgcctacgccaatgcgcgcggcatcaggatcatcggcgacatgcccatgtacgtgagcgcggactcgtcggacgtgtgggcggagcgccgctacttccgcgtggacgaggccggctaccccgcttcgcaggcgggctgcccgcccgacagcttctcggccgacggccagctgtggggcaaccccacgtaccgctgggacgcgatgcgcgcggacggctaccgctggtggatgcgccgcttcaagcgcgcgttcgagctgtacgactacgtgcgcttggaccacttcctgggcttcagcagctactacagcatccccaacggcaagctcgccacggagggcgcctggaactttggccccggcctcgagctcttccgccgcgcgtaccaggagtttggcccgctgcccgtcgtggcggaggacctgggcaccgtcacgccggccgtgcgcgcgctcgtttccgccacgggcttcccgggcatggacgtggtccagttctacaacgacgacccggccgtcagctacgtgcccgcgccggacaagatggtctacagctccacgcacgacaccaacacgctgctgggctgggtgcgcgagcactacggcctgaccgaggccaagggggcactccccgacgacatcaagcgcctgcgcgcggaggccgtggccaaggcggaccgcgtgatggaaaactgcctggccgcgcctgcggacgtggcgatggtcaccctgcaggacgtgatgcgcctggacgagacccagcgcatgaacgtccccggcacggcaacgggcaactggagctggcgcgcggacgagcagcagcttgaggactcgcagcagcacctccgcgatctggcggagaagagcggccgcatctagccgaacgcgatcccgcaaaccaacctcccccgggacggcaggcgccagccctgggggagaagaacacaagagccaggggcgacttcgtccctggctctatatatatgtgcgttggtacccagatccgccggttcgggcggtccgccccgcccgtcggccacgcccgtccgctacgcccgggtgcccgccagcccctcgcccgcggtaccggacatgatggcgagcagctcctcgcgcacctgcttggcgcggcgctccggcacggggatggaggtgccgtccgccagcaggacctccttgcgggatatctgccgcacaaacgtgacgttcaccgcgtagctgcggtggatgcgcacaaagctgtcaggcatgccctcgagcacggaggtgagcggccggcggaccacaaagtactggtccctgtgctggtgcaccaccgtgtactggtggcggctctccaagaaggtgacgtcgcgctcgcgcagcacgtgcgtgtggccgtccgtgtcgcgcaggacaaactgccggctcttgggcttggccggtttctggagctgggcgagcatgccaatctcggcctgctccacggcctggatcttgcggatggtgtccggcgtcatggagacgtgcaggtggacgagcgcgtttgcgtcctgcgcgcacgtccacacaaaggtggcccgcacgccggccggctcgtcgggagcggcggcaatggtccccaccagcaggatcgtggcggagctctcgctctggtgggtgcactgggcgtccaggatcgtgcagctcagccggggcgacaccttgcgggcacgggcgcagtagacctcgacctgcgccgcggcaccgtcaagcgggtcggtgatcgggctcacaaagctgaagctcggccccacctgcccgaggaatgcctcggcatcgccctctcacagggtggacatgagctcctgcgagcgatggcacaaatcgagaatcatcctgcacggccctcctaggccagcgttcacgcaggcaagccgatgccagacatcgggcacccacgccccaatcccgtggcccttcgaccacgattccttcagatagctgattgcatgacctctagtctatgcgggggggggtcgctctctggacatgacgagatgtcatttggaccaacggctgacctgcgtatctgaacgtttcctactatgtctgcaagtagatgtaatcctgcggaagactccgaatgttgcgcaacatttcaggaatcggcggcaggagactacatgtatctgaaagcaggaaggggctaggcggactgccggtcacactcaggccaatcggggatgc

SEQ ID NO: 259 - DNA, 1193 bp, Unknown
  Metagenome-assembled genome
gcgttctcatacgtgtcgctgctgggtgcgctgattccgcttgcagccgtgctgaccaggctcatccacgcggacctctttggcgagcgcggccagctggacctggtgccgggcgggcactaggggccgcggcgtcgcgggcgtgctacactcgtgcgaacgtcgaaaggacccgccatgaccgtgcttaccccagagtctcccgagttcagatacctgacagagcgcgactggcggctgggccggctgatcggtgcggtgggcgagctggactacgaggccggcgggcctgcgtacgcgcacctggcgcactccgtgatcgagcagatgctctccatgaaggcgggcaggactatccagtcgcggctcgaggtggcgtgcggcgggagcgtgacgcaggaggccgtgctcgcgctgcccatggaggagattcgtgcatgcggcatcgcgggacgcaaggcgcaggcgctggtgggcctggcgcgcgcgatgccggaggagaggcttgacgcgttggcgacgctgccggacgacgaggtccgtgccgagctcacgagcgtcaagggcatcggcaagtggaccgctgacatgtacctgatttttcacctggacaggccggacgtccttcccgtggaggacggcgccatccgccaggtattccagtggctctacggcgcgcccataaccgacgccaacgtgcgccaggtggtctgctcgctgtggcacccgcactgctcagttgccgtgaggtacatgtaccgcgcgctcaatcgcgggatcgtggcacaggggagcgcggtcgaggtgctggggctctaggccgggcctgcctcgtcgtaagaagaatcgagcagcggacccaccggagcccgcggctcgaatcatgttgcgaaccgtctgatgcggcggaagctagacgctcgccctgtgcgagagcgcgaacagcgccgtcgccaggcagacggccatgcaggcgatgcctagtacgaacatgagcgggaagccgcccgcggagtcgatcacgacgctccagaacaccgcggccacggcactcatgagcgagccggccatggagacgcgcgagtagatggcggggtagtcggccgagccaaaggcggcgcgcaccagcagcggcgtctggaccgtggtctgcgcgtacaccacgccaaagaggaaggcgcccacgaggagaa

SEQ ID NO: 260 - DNA, 2050 bp, Unknown
  Metagenome-assembled genome
gtgggagcctctcagccggtgggctccctctctgtccgcgggcacgcgacgggcgaacctctccgtcattgcctgtgcgtgaggatagcacacacggcgcacgcgggcgagaagaacgtcacgctccacaactttgggcgcgtgccaggggcagcccacacgcggtcgctagcgcacgaacggccactcccccgccgcgagggcgtcaatcgcgtccgccacggcaaagtcgtcgcagctgccgatgtgccagcgcgccgccgcggcggcctcgtccgtcgcgttggccacggccacggagttggggatcgcgtcgaacatggcgaggtcgttgccggcgtcgccaaacaccacgacctcctcggggtcgatctggagcgcgcccgcgagcgcgaggatgcccgacgccttgttgaggcccgggcgcatcacgttggcaaagcccggctgcgggtagtcgaagtcgaggccgtcaacctcctggttgagggcgtcgatcagcgcgcgcgtgtccttctcgcccgcgggggcaagcgtgccgtccgcagctggcgccgccatgaacacgttggccttggtgcagcggaacgcgggaagccccagcgcgccgccgtccggcgccaccctgcagagggcgccataggaggggaagctcgccttgaggtccgcgacatcgccggacacgagcgtgggcgtggcgccgtcgaacgcgatcacgccggcgtgcgggaagcacgacgcaacctgtacggcgcccgcgagcacgtcgccgccaaagctcacctcgcgcaccttggtgccgtccaggaagacctggttgccgttggtcgccacgcacgtggcaaagcaggacctgtcgccgtcgaacagcggccccagccagtcgaagccgcggcccgtcgccggtcccacgcggatgccggcgtccatggcgtggtggtacgcctcgcgcacgcgcgcgggcaccacggtctgccccgcgggcaggatcgtgcggtcgatgtcggtcaggatgagctgcacggagcgtgccatgtccttctccctccgtcgcgccgcgtcgtgcggcatccgggcatccggtcgtgacgtatgataggtcaacccaaaccacagcaccaagcgagccaggaggcaccatgtccgcacaagatggcattcgcatattcgacctgcactgcgacacgctggactgcctgtccatgcatgacgcggggcccatcgcggagtacgcgtcgggcgtgacggagggggcggacctcctgcacaacggcctgcagctctcgctcgagcgcatggctcaggcggggtcctggtgccagtgcttcgcggtgtgggtgccggacgaccttgcgggcacggggctcgcgccgcacgcgttctacaacagggtgtccgcctacttccgcgaccaggtcgcggcgcaccccgcggagctcgcccaggtgcgcgacggcaggcaggtgcaagacgcgctggcaggaggccgcgtcgcggcgatgctcacggtcgagaacgcctccccgctcgaggacgggctcgaagttctcgaccagatgtctgccgacggcgtcaagatgatcacgctcacctggaacggccagaactgcgtgggctcgggcaacacgacatcggagggcctctcggcctttggcgtcaaggcggtgcgccgcatggaggagctccgcatcgtggcggacgtctcgcacctcaacgacgccggcttcagggacctgctcgcgcactcgagccgccccttcgtggcgagccactccaacagccgtgccgtgtgcggccaccctcgcaacctcacggactacgagttccaggccatcgcggagcgcggcggcctcgtgggcatcaactactaccgcgccttcgtgtccgaccgcttcgacggcggcgcgctgcccggcccagggcgtcccgagctcaccttcgacgagctgagctaccacatcgaccacttcctggagcttgggggcgagaaggtcatcgccctcggcagcgacttcgacgggtccgcgaccccgtcctggctgggcggcgc

SEQ ID NO: 261 - DNA, 7390 bp, Unknown
  Metagenome-assembled genome
cacgaggagctcctcgtgctcatcgagaagctcgcggacatccacgcgggcctcttcaactacgagcgcaccctcacgcaggaggacctcgtgcgcttcatgcaggtcgagtacgggcgcgtgggcgccgacacccacctcacgccgcgcgaggtgatccgcgacttcgtggagatgctcgacatcctgagccagaacccgtcgctcacgatcgacaatctgctctcgagcgaccagctcaacgcacccgtgcagagtgccgtcgaggagcgcgaggcgtccgccaaccgctcgaagggagtcaccgtccccgccacgcagacgaggcgtgacgacgacttcacggagttcagcatctagcgaggggagaccggcatgtccacgttcgatcgctacgcccccttcatccaggacttcatctacgagcacgactggcagagcctccgctctgtccaggtggctgccgccgaggcgatcttcgacacggacgagaacgtccttctcaccgcctccaccgcatcgggcaagaccgaggccgcgttcttccccatactgaccgagttctgggagaacccaccagcctccgtgggtgccatctacatcgggccgctcaaggcgctcatcaacgaccagttcatccgactcgaggacctctgcgccgaggcggacattcccgtctggcactggcacggcgacgtctcgcagtcgcacaagcgaaagatgatgaaacacccctctggcatactccagatcaccccggagtccctggaggccatgctcctgcatcgccactccgctataggacgcatattcggcgacctgcgctacgtcgtcatcgacgaggtccactcgctcctgcgcggcgaccgtggcgaccagtgcctttgctgcatcgagcgactgagccgcctcgcaggcgtcaacccgcgtcgcatcggactgtcagccaccatcggtgacccggaggccacgggcaggtacctgagcgcgggaaccggcaggggttgcgtgatacctcggctggagggacccaaagagcgctggcgcatctcgatggagcatttctacacctcgggtccgcaggccccggagcggggcatcgacggccttggcaactcgaggggccaacgcaacgccgacgaggcaacgtacgaggcgccgacgcacgaggcacacgaggagctcgtgccatcccgggacgagctcgtggaggatgtggcgccagagcgaccggccccggagaccgaacagcctgccgcagaggcgccaacggacaccgcccccgtcttcgcagacccgggcctcgcctacgtgttcgaacacactcgcgggcacaagtgcctcgtgttcgcgaactcgagggaggaggccgaggccgtctgcaccacgttgaggcagtactgcgaggcgacgggcgaacccgaccggttcctcatccatcatggcaacctgtccgccagcctgcgcgagtccaccgaggcgctcatgcgcgaggaggacacgagcctcacgaccgtcacgacctccaccctggagctcggcatcgacatcggcaggctcgagagggccttccagatcgacgccccgttcaccgtgagctccttcctccagcgcatggggcgaacgggcaggcgcggacagccaagcgagatgtggttcctcatgcgcgaggacgagcccgaagcgcgtgcccttctccccgagacaataccgtggaatcttctgcagggcatcgctctggtgcagctttacctcgaggaccgctgggtcgagcctccgcgcctggacggcctcccctatagcctgctgtaccaccagaccatggcgacgctcgcgagcacgggagagctctcccccgccgagcttgcacgtcgcgtcctcacgctcacgccattccatcgaatctcgaccgacgacttcaggtgcctcctgcaacaccttatcgagatcgaccacatccaacagaccgacgaaggcggcctgattgtgggaatagcaggtgagcgggtgacgaacaacttcaagttctacgcggtgttcagcgaggacgaggagttcaccgtcaggagcgagtcgcaggaactcgggacgattgtccagccgcctcccgtgggcgagcgcatcgccatcgcgggtgcaacgtgggtcgtcgaggagatcgactacaagcggcacctcatcgagtgctctcccgtgaagggcagggttcccgcatacttcggcatggtcgcgggagacgtgaacacgcgcatcctcgaacgcatgaggggcgctctggacgaggacgcgatgtatccctacctgaggaggaacgcccaagcacgtctctcgcaggcgcgtcacgtggcccgcaacgcacacgtcaccaccgaaccgctcatctgcgtcgggggaaccgcctggtgcctgttcccctggctcggaagctacgccttcctcgcactcgagaggctcatcaagatcaagtgcgccgatgagcttgggctcaaggggctggattcctcgaggccatacttcatgcagttcacgatgagagccgacgccgagacgttctaccgggtggtgaagcgggcggcggagtcgctctcggacccactcgagctcgtctatcccggagaggtcccctacttcgacaagtacgacgagttcgtgcccgaggagctcatacgcaagggtttcgcgtacggcgtgctcgacgtcgacgggatggtgaagcgggtgctcgactggccggacgccccatcgagccaacagggtgggttcctgcccggaacgagccatcggctcacgggcgagccgaagtcgtagcaagtggacaaacgcagtatgcacgcttggggccaatcgtctaaggtagttgacgcaaacgataccgaagggggagagcatggctcagggtgacaagaaggcgcagggcacgaagagcgttcccaagggcgcgcagatggcggcatcgagccagaggatcatcgtgatagccgcgttcgtggcgacgctcgtcgtggtcttcctgctccagtacgtggcgaagctcgacaccacgaccacgttcgtcatcggcctcgtgatgctcgtggccatcgtcctcatcgcgctcttcgtcatgacgaccgcgcgcaagaccaagatgaagctggacgtcaaacagacctgcaacccgatgctggagaggttcaagcagacgggtgacgtcgcgcgcttcatggctgactacgagacgtggatctcctacgaccacgacccgagcctcgtcgcgcagttcacgcaggccaccgtcgacgctctgatcaacaccggacacgagaagcaggcgcgtcgtcagctcaagcgccttggcgaggtcatcggcaccgaccagcgctcgcagcaggagtacgcgaactaccgcaagcagtgcgagagctgtttcaagaacatgcgtaagacgcgcagataggaagtcagaaagtgtcaggcaagaccaacgccacgacaattggcgagcgcgagtcccgtcgcaacgcgttcctctcgagcacggcggggctcctcctgttcgcaaccgcaagctgcctgctctggggctcggctttcccctgcaccaagatcggtaacgtcctcttcggaatcggaagtggcgccacggcctcacagctccttttcgcaggggtgcgtttcaccatcgccggatgtatggtcatcgccttcatgagcgtcaagcgcggacgtccgctcctcccccgcgcgaccgactggaaggcgatcttctgcctgtccctcttccagaccgtcctccaatacggcctcttctaccctggactttcccgctcctccggggtggcgagctcgatcatcgaggctagcgcctcgttcgtggtcatcgtcctcgcggcactcgtcttcaggcaggagaggctcacctcgcgcaaggtgctcggctgcctggtaggcttcgccggcgtgctgctcgtgaacctgaagccaggtggttcgctcagcttcaaccccatcggcgagggactcgtcttcctctccaccatcgcggctgccacgtcgagctgcctcattcgcgacttctcggaaaggcatgaccccgtgctcctgagcggatggcagttcctcgtgggaggcgtggtcctgaccctggttggcctcgcgatgggagggcacctcgcgccatcgcgtccggcggcgctcgtgcttctcgcctacatgggcttcatctccgctgctgcctacacgatgtggtcgatgctcctctcggccaacccggtctcgcgcgtcgcggtgttcggcttcatgaaccccgtcttcggcgtggtcctctccgccatcctcctgaacgagacgtccgccctgaacccacttcttgccgcggtcgcgctcatactcgtctctgcgggaatcgtgatcgtcaacaggggccccgccaaggtcgccggcaacgcctagcccagggcgaacctcctcgcgaccgcacctgccgcgcggtagtgcggcggcctgaggtcgcggtccgcctgcgggagcgcgtccctgatcggaaggtgctgtgggcagtgcgcctcgcacttgccgcaacgtacgcactgggtggcgaaggccggctccttgcgcagactcaccacctgccagtactccttgcggccgacggccttgccctccgtgtacatctcgttccagcagcggaaggcgctggggatgtcgacccccttggggcagggcatgcagtagccgcaccccgtgcagccgatgcgcatgcgctcgttcacgatctccttcacctggtcgatcagccgcaggtccgcgtccgagacgcagccgacagtggcctcgctcgcgacgcggcagttctcctcgaccatcgggatgctgttcatgcccgagagcacgcaggtgacctgcggctggctgtagagccagcgcagagcgagctccgcgggcgaccagccgtgggcgtcgcgcgcgatgaggtcgcgcgcctccctgggaaggaggttcacgagcttgccgccacggagcggctccatgatgatgacgggaatgccgcgcttcgccgcggcgaggagtccggtcctccccgcctgggagttctcgtccatgtagttgtactggatctggcagaagtcccagtcgtaggcgtcgagcaccttgaggaacatctgcgtgttgccatggaagctgaagccgatgttgcggatctcgcccgaggccttcttgcgctcgatccactcgcggattctgagccgctcgagcttctgccaggcgaccacgtccgtgagcatgtgcatgaggtagtagtccacgcggtcggtgcgcaggcggcggagctcctcctggaagtagcgctcgatcgcggcggagctcctgatgaggtactgcggcagcttcgtggcgatgttgacgcggtcgcgcgcgtggttggactcgaggacctcgcccaggagcccctcgctcccggggtagatgtaggccgtgtcgaagtagttgacgcccaggtcgatcgcacgcatgatctgggcctctgccttggggtagtcgatgcggccgccacccggcccgccggtgcgctcgaagcgcatgcagccaaagccaaggagcgagagcggactgccgttgcggtcgtttcggtactgcacgggctactccttaagaagccgcgccttgcacgcggcaagctcgtccttctcccctgcgggaacctccgggtagtgcgggtccatgtccttgaggacgttcaccacagcctgggacaccaggtagcgggcgtgccacttctggtccgccggcacaacgtaccacggcgcgtgcttggtcgcggtcgcgttgatcgcggcctcgtaggcagacatataggcgtcccagtgctcgcgctcggccaggtcggacgcagagaacttccagttcttgctctcgtcgtcgatgcgtgcgagcaggcgcttgcgctgctcgtccagcccgacgttgaggaagatcttgagcacgtgatagccgttctggtacaggtgctcctcgaagtcgcggatctgcccgaatctgcgcgagaagaactcgtcctccgagcagtcgaggcaacgcttgggcatgcggtagccgtgccagaggccgtccacgcgcacgacgagcacgtcctcgtagtagctgcggttgaacagcgcgatcttgccgcgctcgggcaggcagcgcgccgcgcgccacaggtagtcgtgcgcgagctcgcgcgccgtgggctgcttgaagccgtacacgtcgataccctgcgggttcatgccgctcatcacgtggcggatcgtggagtccttgccggcggcgtccatggcctggagcaggatgaccagcccctctcgcccgtcggcgtagagcctgtcctgcagctcgcccatcacgacgcggttctcgtccgtgagctcggtgcacttggcgcggtcgcccttggtcatgtgcgcggacgtgggcgcgtccgcgatccggaacgtgcggtcgcccgcatagcggcagtcttcgatcgtaagtgtcatgcttggcctcccctgcgtgtgccggcgccgccacgacgcccggcataggcaaagtataggtttggtttcgcgcgcggcgcgccacgcaattgccatgcggtggggtacatactgcacatggcaggcatggcagtggcgccatgcgacgcgcgacgcgaagggaggcccgctttgccaaagagcgtgctgataaaggacaccacgcgcgaggagcgcatccagatcgtgcgcaaggggctcgactggtgcggcgacgcgtcgtgcgagcagtgctccggctgcagcatgggcgtggggtcgatcgacgcgatgtacgcgccgtacatcgacggcaagctcgagctggccgaggtcaacatgctgcacgcggccaagcgctacacgctgggatagccgggcgagagggacggctccctctgccggtgccgccgcggaccgcatgcgccgcgggggcgcggcgcctactgcttgaggcagaggatgtcgagcggctcgagcgcgaacggcagcaccgtgcggtagcggcacatcgcgcgcgagagctcgcccgcgggcacccagacctgcaggtcgtcgtcccagcgctcgagcgggcccagctcgcactcgcgcaggggctcccccggcgagagcacctgcagcgcgtcgcccacgcgtgccttgttgcggcagagcagctcggtcaggaagccgggcgcggccgcaccccggccgtcggccgcggccacggggcgcgcgtccttctcgaccgtggccaccatcaggcggtcgcgctggtactccacgcggccggggttctgcgtggggttgccatagaagaagcccgtggagtacgggcggtggctcacggcgtcgagctcgcccatccaggcggacgcgggctcgccgtccag

SEQ ID NO: 262 - DNA, 4826 bp, Unknown
  Metagenome-assembled genome
cggcgctcctgggcgcggacatcgcgaccgtgccgttcggcgcgctcaagaagtgcctgcaccacccgctgaccaccgagggcctggcgaagttcgcggccgactgggcgaaggtcaccggcgaggcgtagtagcgctggcgaagcaggcgaagttgcgatagcggcaaccgattggggcggaatccactgcgggttccgccccgcttcttgttgcggccagacatgaattggggcatctgcaggcggtcggggattttgtgtgttttgcgattcaaatacttatgatatccgacccgattctggcgactggggagctggaaacgcacaatgacctggcattggtgcatgactggcacgcttttgcgtggctgcgagctggatggggctggtccttgagtcgcgaaacgctcaaaatcccggactcggtacattcggggtagatcgtctaccggctcctttgtgttggttccgctgtaggggtgcttggggctcggctacaacaaggaggataggtgacgacggagcggccgccggcgcgtgagtcgcacgcgtgccggcggccgcccattggcctagcggattggactgtgtggctactcgccccagacgcgctccggaatgcgcttgatgagctcgcactttgcccactggtcgtcctcggtcaggacgttgccctcctcggtggagctgaagccacactgcggggagaggcgtagctggtcgaggggcacgtacttctcggcctcgtggatgcgggcaatcacggcgtcctcgtcctcgagctcggggaacttggaggtgaccaggccgagcacgacgaccttgtccttcgcgaagcgcagcggctcgaagtcgccggcgcggtcggagtcgtactcgaggaagaagccgtcgtagttggcgccaaagagggtcttggcgacgggctcgtagccgccggagctgaaccacgtgctgcggaagttgccgcggcagatgtgcgtggtgatggtcatgtcggcgggcttggtctcgaggatgcggttgatggtcgtcacgtagttctgggcgacgcggtcgaggtcgatgccctcggcctcgtaggcggcgcgcttgttggcgtcgcagaactcgccccacgcggtgtcatcaaactgcaggtagcggcaacccaggtcgtagaacgcgcgaacggcgtcctggtaggcggtgacgatgtcgtcaaacagcacctgctcgtcctggtagcgctcgatgggctgatacgtcgccttgccgcgaacgcacgggatgaggtgcagcatggacggcgaggggatggtcatcttggtggggtagtcgcccgcgatctggcggagcttggcgtagtgcttgaggaaggggtggtctccaaagccgatcttgccggtaaagcgcagctgcgcgcccttgggcttggggcccttgaactcgacggaccagttggcggtgtccacgtgctccacgccctcgagctcctccaggaagtcgaggtgccacatggcacggcggaattcgccgtcggtcacggccttgaggccgacgcgcttctcgtttgcgaccagctcggtgatgcactcgtcctcgacggtggtcagctcgttgcgggtgatcttgccggcggcaaagtccgcgcgagcctgcttgaggcgggcgggacgcaggaagcttccgacgacgtcgtaggtgtagggcggctgcttgatggccatgggcgatccttccgttggcgcggcggccaacgggtggcgtcgcgtgtcgattgcgtatgggtcagcatggcacaacgccgcaatatagagaactatccgtttgtaagagataaccatagtctgaagctatggacgagctgccgcggcccgacgcgacctgtcgcgaccagctacgagtggtcgccctgccggtacgtgctcacgtagtcctgcagcagcgtgaggtagcggctcgcgatgggcgaaagcggccggtcgccgcggcgcacgtagccaagctccatcacctcgtcgctctggagcgggacggacacgatctggctgccgttgagcgcctcggaaaggattccggaagatatggtgtagccgcccaacccgatgagcaggttgaagagcgtggcgcggtcggtcacgacgatgctcttctccgccggctccgtgatgtgcagctcttccgcaaagtagggcgagttgtggatgccctggtcatagctcaggcgcgggtaggggagaagatcctccagcgtgaccgaggcccgtttggccagcgggttgtcccggctcacaaacacgtgcggcgccgcggtgaacagcggttcgaaggcgaggcccgccgtgcggatggcgttggtgatcacgtctcggttgaagtggctgcggtacaggatgcccagctcgctgcgctgcacgcgcacgtcgtcgatgatgccggcggtgctggtctcgcgcagggagaactcgtagcggttggcgccgtactcgcgcaccagctgcacaaaggcgttcaccacaaaggcgtagtgctgggcagacaccccaaagacacggcgcacgtgcgcgccgcccttgtactccgcctcgagcaggtcggcctgctccaccacctgccgcgcgtaggaaaggaaccgtgtgccctcctccgtgagctccacgcccgtgcgcgaccgcgtgaagatggtgatgcccatctcgtgctcgagctcgctcacggccttggacaggctgggctgcgcgatgtagagccgctgcgccgccgcggtgagcgaccccgactccgccacctgtatcacgtacctgagctgctgaagcttcacgctgcctcctcacgttggacacattctgccacaactgccagccacatcgcacgctaggcgatgccggcattgcgcggccacgaacttgcgctacccttgccgcagacgccgctccagcgcggggctggccggcgccgcatcgcaaacgcatcacgcgggccgcgtgcccgcgttccggaaaggcaggccacaggatgagaaaaacttcctccaagatagcaaccggcgtcgggatcgcggcgggcgccgtggccgcgacggccgcaatcgtttcgccgcgccgcggggactcgtacgtggacgcccgctggcagcgcctgcgcacccaccgctacgcgcaccgcggcctgcacgacgtgtcgctcggcatcccggagaactcgttcgccgcgttccagcgcgcgcacgacctgggctttggcgcggagctcgacgtgcacctcaccgtggagggaaagctagccgtcatacacgactccaacaccaagcgcatgtgcggcacgtcgctcacggtcgagaagagcaccctcgcgcagctgcgcgacctcacgctcgcgggcacgcaggagcacatccccacgctcgacgaggtgctggagctgttcgagttcgacacgtcctccgacgacccggagcccgcgccgctcatcgtggaggtcaagacggcctccgcaggctgggcgcgcgtggcagagttgtgcgagaagaccatggccgcgctcgatgcgcacacggtcagctactgcatcgagagctttgaccccagggtcctgatctggctgcgccgccaccgtccggaggtcgtgcgcgggcagctctcccgcgacttcctgcgcgacggcgactttggcctcgaaaccccgcgcgactttgcgggcacggtcatgctgggcaacgccttcgcgcggccggactttgtggcgtacaagtttgcggaccgcaagacgccggccgtggagctggtggtgcgcgcgctgggcgccaagcccgtgtactggaccatcagggcgccggaggacctggtcgagtgcgagtccgagggcggcgtcgcgatattcgagggcttcgtgccggtttcctgccgcgcgggcgaggacgccaagccccgcgcataggcgcgccccccaaaggcaactgcagcacagccgcgtccttctcgcccgcgtgggcgagaaggacgttccattagaagtagcggccgatgacctccgccacgccgtcgtggtcgcagtcggcctgcgtcaccacgtccgacgcctcgagcgccgccggcgtggcgtttgccatggccacgcccaggccgcagttgcggagcatgtccaggtcgttgccgccgtcgcccacggccaccacctgggacaggtcgagccccagctcgtcgcacagccgcgcgatgccggagtccttgcgcacgccgggcgccgtgatttccacggaggcgccctccgcaaaggcaacctgcacgttagcgccgcgcagcgcctcgcgcgtgcgcacgcggccctcctgcgtaaagtggtacaggttgatcttgacggccttgttggggtggtcctgcaaaaaggcgatggggtcgtccatctgctcgtttacctgctcccagagggactggtactggcccaggcccacctcgggcgcgcgctccacatccgccatgttgaagtaggctccggtcgaggtgaggatgttcaccaggcagccacttgcaagaccggcgcgcacggcgtcgatcgcaccgtggttggggatggtggtctcgctcaccacgcgccgctcccacaggtccatcaccacggagccgttgcccagcacggcgtagcgcacgggcgccaggtcgtgcagcaggggcacgatctcgcggtagccgcggccggtcgcgatggtcgcaaagccgcccgcgtcggtcagcccgcgcagcgcctgggccgtggccgggctcacctgcttcttggagttgagcagggtcccgtccatgtcgagcgcaagcagcctgtagtcgtgcatccgtcgcccccgttacg

SEQ ID NO: 263 - DNA, 19952 bp, Unknown
  Metagenome-assembled genome
gtcgcgtctccgcctggacggcggacttcccctcggcccggcggcgcgcatcctcttccgaaatgaggcaaccaggtgccatccagctcatccgcgcagctccgtcgggcgggggcgcgatcctcccggaagagatcgaggtcccaaggcgcaagcatcacgcgattccccgccgtcaggaacaatgtcccatatccggttgtccgcaatacaggacaaaagtcgccgggggcgacgctaaaaggataagaggaaccatgccagccatgcgcaggagggaccgcgccgtaaccgaccccgcaaagatcaggcggatcctggacggcgcccgcatcctccacctgggcctcgtggacgatggccgcccctacgtggtgcccctgcactactgctacgagtacgagggcggcgacctcacgctctacatgcactccgcccgccacggccgcaagctcgacgtcatttccgcctcgcccgcgtgcttcgtggagctagagtgcgacgtcgcgctggacgacggcggtgccacgccctacaagatcgcctgccagtacggctcgttctactccagcgtcatgggcgccggcaccgcctccatcgttacggacgcggacgagaaggtccgcgccctcaggctcctgatgcggcagcagacgggcagggacttccccatgaacaggctcatggccaagaccgtcgccatcatcaaggtgcaggtacccgcaggcgagctctcctgcaaggcccacgtgcgcaagtagcgcacttttgagcgtcccgtgtcgcccctgtgtagacaaaattgaacccttgcgttcaatatccctgtgctagagtgtccgtagttcaattcgcaaattgaactacggacatcttcgtaacacagaaattgaactcgaaaggtcggacatgtcccaggatctctttagcgagcgtcttgcggaggcaatggagaagaacgacctccgtcaggcggacctcatccgcatcgcggcggagcagggtcacaagctgggcaagagccagctgagccagtacctcagcggcaaggtgacgccccgggcccaggccgtcgtcattctcgcccaggcgttgggcgtgagcgaggagtggctgcaggagggtgacgccgcaccggcagagtccgccgcggagccggcgcccgcgccgtccgctgcaagccagccgcaagaaaccaccgtcagcaccacaggggagaagggcactgccgccgccaggggcaggcaaggggaaggaagctccatgcgccagttcacgaagtctcacaagctcgacaacgtcctgtacgacatccgcgggcccgtcctggacgaggcctaccgcatggaggaccagggcatccacgtgctcaagctcaacatcggcaaccccgcgccgtttggcttccgcacgcctgacgaggtcgtaaaggacatgcaggaccagctgacggagtgcgagggctactccaacagccgcggcctctttaccgcgcgcaaggccatcatgcagtacgaccagctcaagggcatccccaacgtggacgtggaggacatctacaccggcaacggcgcgtccgagctcatccagctcgcgatgaacgccttcatggacgagggcgacgagatcctggtccccagcccggactacccgctgtggaccgcgtgcgccacgctggccggcggcaccgccgtgcactacatctgcgacgagcaggccaactggtaccctgacatcgacgacatccgcagcaaggtcacgccgcgcaccaagggcatcgtcgtgatcaaccccaacaaccccacgggcgcgctctacccgcgcgaggtcctgcaggagatcgtggacgttgcgcgcgagcaccagctcgtcatctttgcggacgagatctacgaccgcctcgtgatggacggcaagcagcacgtctccatcgcgagcctggcgccggacctgttctgcatcacgttcaacggactctccaagagccacatggtcgcgggctaccgcatcggctggatgagcctctccggcaacaagcgcatcgccaaggacctgatcgacggcatcaacatgctgtccaacatgcgtctgtgctccaacgtgcccgcgcagtccatcgtgcagacctgcctgggcggcatccagcgctcgcagcagctgctccagcccggcggccgcatctacgagcagcgcgagtacgtgtacgaccgcctctcgcacatggacggcgtcaccgtcaccaagcccgaggccgcgttctacatcttcccgcacctctccgaggagaagttccacatcacagacgacgaccagttcgcgctcgacctcctcaaggacaagcacgtgctgatcacggccggcaagggcttcaactgggcaaagcccggctacttccgcatcgtgtacctgccgcgcaaacacaccctgcacgaggccatggacgcgctggaggacttcctcagctactaccgccaggactagcgggctgcggtctaggtaacgtcgaggctgcaagcggcccaaagacaagctaaagacaggggcgagaagaacgggggattcgttcttctcgcccttttgcatccgcggaaagggcgccgactgcggagactcagggctggagcttggacgctcgaatgccgatggctagatttggcaggggagaaacctagtttgattgccgattttgaacgaatttgacaaaatttgggattatattaggtagcaatagattctgctgggaggtgcctcatgctcgtcgacttcacattcgagaacttcaagtgctacagggaccagcaggccttctcgatgcgcaggtacaatcggtctgggtacgccccgtttgacgatgtgtcgaccgtcaccgcaatctatggggcaaacgcgtccggcaagtcgtcgctactcgaggcgatgacctatgccgccaggtttgccgtgaacggctatcgtcgcgggagctctggagaggggatagccaggctgccgttcctgctggacagcgagtacgctacgcggccctcgaccttctacttcgaattgattgccagcgatgagcgcaggtacaagtactggttctctatcgacgacaagcaggtgctgtcagaggatcttgtggtgtacaggtcctcgaggccgagcacgctcttctcgaggtgggttggcgacgacggaagctataccaacgagcatggtcagtcgatcgagtttggtccgtcgttcactgggcccaagaagcagctttggagcatcacacgagagaacgcgctgttcctctccgccgcggcagcgggtgggagcaaggtgatcgagccggtctatcgcgagcttggcaaggtgtctatctacaaggcccgtttttacgagcgggagatgccgcgcgtcaagcgcgagctcgagggcgggtcgcaggatgccggcgcactgaggagcctcatcaagtttgcggatcttggcattgatgacatcgggctcgtcgagcgcaagactggtgtggacgaggagaatgacatcgccgatggtggtgatgcgtccatcgcgcaggaaggcggcaagagaccgaccgacatcgtcttcctgcatgaagggaaggatgcgcgggcgatgtttcccactggatacgagtccgacggcaccgttggtgcgctctcgttcttctccgtggcgcttcgctcgctccgcagcggcggaatcgcgcttgtggatgagatcgacagcagcctacacccgacactcgtcaaggaactcgtgctggcctttgctgaccgcgagtcgaaccccaacgcggcgcaactgatattcaccacgcacgatgtcagcctgatagacgtcagcgggtcagaggaccgggtcctggatagggaccagatatggttcgctagcaagtcggacggcgcatcggagatattcccggcgaccgagttccacgtaaggaggggcgagaacgtgggcaggaactacctcaacgacgtgtacggagcccttcccgacccacggctgcacgacgttttcctcgagttcgctggcgggtgccacgatggcaaggaagactaagccgccgcgggccggtcgcccgaagacatcaaggaacagaaagcgcagggtcctcgtcgcgacgaacggcagggtcaccgagccggcgtacttcgatctgctgaagtcatgcttcggtgacgctaccttccacctgcagcatgggttggaggggaagtcccctctcgaactggtggatgccgcgttgagtgctctgaaggacgacgcggatgaatcgaggcggcgcagctcggacgcgtactcagttgcgtttgtggtcaccgacaccgaccagtttaccgacctcgccaaggcggagcgccgtgccaaagacagcaaggctcatctcatcctctcaaatccctgctttgaggtctggctcatagaccacgttaagcagtgtccaaacaggtcgctcgatgcgaagccatacgaaaagctcgcgcatgatcttggaataaccgcccctccgagtgcgaagaggggtacgtccaggtcgaaggcgatagtcgagaagcggataacgccactggacgaaagccttaaaaccgcgatggagaatgcccggggccactgcacgcaagagaagctaaaggtaagggagtcggatccggacaagacgtccgactacgtaaactggacggacatgacgcgcgttatcgagtggctggagggccgccatgcgtaaagagtacgacttttccaaaggcaagcgaaacacctacacgcgggacctcaagaggcgagtggcgacggacgctgacgcggataaagccgactgcaagagggagacagttgcggctgaggcagaagtgcaggcagcagaaaagccgaccccaggagcaagggaattctaagcccagcggcctacccccattcggggacccagctgtaatccacccaagtcggctttgccttgcaaggatgccaatcgattgtattaatgataagggcgagaagaacggggacacgttcttctcgccccttgccttggctgcgggtgcttgcgggttgtgcgctgctgctactgctccgacggggaccgcgggatgtcgtcctgctccacgtcgtccgggacgtccgtgccggcgtgggtgccgtggaacagctcgaagaagtcgtgcacggcgtcgcggctggtgtccgacgtgcggaagtggaactcgggattcttcttcttgagctggcggtagtctgccatcatgtcgccaaagatctgcgcgttcgagggcggcgtgtacacgatggagttggcgccggcgtcgatggtctgctggatggactcgtccgtgcggccgcccgtcgcgatgatgggcaccttgggaaagctcttgcggatctcgcgcacgacctgggcggtcttgccgccggccgccacgttgaagatcgtggcgcccgcgtcgaggcgggcctggatgtcctcgccctccgtggcgaccgtcgcgatgatgggaatgtcgatcacgcggcggatcaggcggatgttggagttgctcatgggggagttgacgaccacgccaaacgcgccctgggcctccgcgtcctgcgcgatcacgacggagcgcatgccgcgcgtggtgccgccgcctacgcccacgaagacggggctgaccgcggcggagatgatggcctgcgaaatggcctgctgcggcgtgaaggggtagaccgcgaggacggcgtccgcgttgcagttgcggatgatggcgacgtccgtcgagaacacgatcgacttgatgcggcgccccatgatgaccatgcccttggcctcgtagatcacgtccggaacctgtatggagtgggcgcggagcgtccctgtgatgcggggtacgtggttgttgtcctcggtggtggtgaccatgaaccgcttcccttcccgcgcgcgtgcgcgtagtcgcttgctggtgcgttgttgccggcggcgtgccgtgcggcgccgccgcgcttgccctgcatgcgattaggatatccactgaggcgccgcctaaacaaggatttttggtgagaaggtcggcggcgcgcgttgcgggtttgttaggtcttcgtgcggggtaggtaatggcaagacggacccgccggcgccgctggcgcgacggggacgcaaccgcgattgaaaccacgattggagggcctgatggctacctttgacgatttgaagctttatgttctgcccggctgcccctactgcgccaaggtggaccgctttatggacgagcacgacatcaaggttgagcacctggacgtgacgcagggcaccaacggcgacgacctggtggccctgggcggcaagcgccagtgcccgtgcctggtgatcgacggcaagccgatgtacgagagcggcgacatcatcgagtacctggccggccgcatcggcgcgaaggcgcccgcgagcgacggtgcgagcggggcgtgccacttcaccccgggcggaggccacgtctgcgactaggcgtcgcgcgaggggggccgttcttctcggccgcttgacgctgcataagaatgtgaatcgcccgcgccggccttgtggtgccggcgcgggcgactttgtgccgcgagctgcggggttgccggggtgtctgcctgggcgttcgctactcgaacgtggaggcgacctcctgcaggaggctgatgatgggcaggtgctgcgggcaggcgtcctcgcactggccgcaggcgacgcactccgaggccttggggccgccggggcgccagccgtagtcctcgcgcgagcgatcgaggtcgccgtagagcttgtactcgttcatgacctggaagatctctgggatgtgcatgccgacggggcagccgggcgtgcagtagtggcagcccgtgcactggatgcggtcgatcgactcgaactcgaggcgcgcgcggtggacggcgtcgcgctccgcgggggagagcggcttgaagtcgcgcatgaacgagaggttgtcctgcatctgctgaggcgtggacatgccgctgagcaccatcatcacgttggggagcgacgccacgaagcggatggcccagcttgcgggcgaggcggcggggtcggcggccttgaggatgctgcccacgcggtcgggaagcttggcgagcgtgccgcccttgacgggctccatcacgacgacgggcacgccgtggcgcgtggctacctcgtagttggcgtgggactggacgacggggctctcccagtccgcgtagttgatctgcagctggacgaactcgacgtcgggatggtccgtgagcagctggtcgaggagctccggcatgtcgtggaacgagaagccgtagtgcttgaccaggccctgggccttgaggtcgcgcacgtagccccagatgtcgtacttgtcgtagagctcgacgttgtccttggaaagggcgtgcagcaggtagaagtcgaagtagcccgcgcccgtgcgctcgaggctctggcggaactcgtcctttgcggcggcctcgtcctttgcggcccaggtgccggcgttgagcttggtcgcgaggtagtacgagtcgcgcgggtggcgctcgaccagcgcctggcgcacggcgtcctccgagccctggtagacgtaggcggtatcgacgtacttgccgcccgccgcgaggaagtcatccaccatggtcttggtggtctcgacgtcgatggtgccgtcctcgagcttgggcaggcgcatcatgccaaagccgagcttcatgcaatcggaaaccaacgtgctcatgttgcccctcctgtgtgccgggccgaccagccgcccccacggctgagccgactgtctgatggcacgattatcgcgcgtcgcgggtcagaagaagcggtgcgactgccccgaggggaagataattcggcttgcttgtgacaggggaggatgccttgatggcttgcctatggctcgaaaactaatgtaattccatgacagcaatgagtgactacatgtggaattacattagtctcaatgtgggaaatcaacgtttgagcaggtaaatcatgtgtttatgagtctggagtaagtggggctacatcatccgacaagaggatttcctgctggcccagttggtgctatggcaagtgaggtctggatcgagtgaaagaacttccggctctcttgtaacacggaggggtttgtgcacgattgagtgcgacccgaccaggttggcaaccacacacaaaccctccgacgtgtcatgtagggaggcttgtgtgtggttctggccacttcgtcggctcattcggggctcgtccagccttctcgtggcagtcggaatcatgcacaagcgttcatgaattacggacgggcttgaaattcttgtccaggcgaccccgtccttggccggccagagggagttgattcgcctcggctgcaccaagcacgggattttgtgtgtttcgggaggcagcgaagagcactggcgaaggcttctctggctccacagcccccgaccgaggttgcgaaacacacagaaccccggtccaagtgacggcgggggaggactttgagtgtttgccagcatccgaccgggctgcgaaacgcacaaaatccccgacgccgtgcaccgggcgaaaatcatctcgtcccaacggcccttccatcccgtgcccagctgcccccgccggcgttcagcccgccaaatcccgtgacgcaacggtggcggcatgacgcataattggggatggccattgggcgtcgattggagagagtcgcatgaagaccagccacgttaccgttcagagcacggacctgctacgagagatggacgtcgtttcatacggagacgcgggaccggccgtcatcgcgttccccgagggcaattcctcctttgcgagctggcaggacggcggcatggtcgacgccctcgcccccatgatcgacgcgggcaagctgcgcctcttctgccccgattccacggacctcatgggctggtactcgcgctacgccgtgcccgagtaccgcctcgccaacatcgagggcttcttcaagttcgtcaagaacgacctcatcccgctcatcaacaaggcctgcggcagcgagcagcgcccctacctggtgggcgccggcatgggcgcgctcaacgcgtgcctgctcatgctgcgcgagccggagctcttcagcggcctgctggcgctgtccggcacctatgacgcccgccgcttcgtggtgggcgatctgcccgagggctgggaggaggtctcgcccatcgacatcgtcgaggcgctcccgcagaacggcaaggcgcgccgcgtgctcaagggcctgcccgtcgcgttcgtgtgcggccaggacgcgagcgaggatggcatcgacacccagcgcgcgctcgagcaggcgttcaaggaccgcgacatcgaggccacgttcgagtactggggctacgacgtcacccactcgtgggagtggtggcagcgcgaggtgaccgagatgctgcccgtcgtcctcacgcccgagggcctcgcggaccgcaagctcggtgcgtccctcgcctacgccaagcgcgaggccgagcacgcccgcacggagctcgtggacgcgcaggccaacctctcggccgcgcgcgacgcgctcaagatcgccaaggaggacctcgaggtcacgtccaagcgcgtcaagaccgaggaggagagcgtccgcaagtgcggcatcgccgaggacgagctggtcgagaaggcccgccaggcctggtcggagcgtgaccgcatcgccaagcagctccaggacatagaggccaaggcgcaggacgcgcagaacaaggccgacgccgcgacgaaggcgcgcaaggacgccgagtggatcctgggcgaggcccgcgccgcggccgcccaggcccgcaccaacaacgaggccgccgagcaggagctccagacccgcgacgcagccgccgtcaaggcgaccaaggacgacgcgaccgcccaggagcgcctgaaggagaccgaggcggacctcaagcgcgagcacgagaaggcccgcgcagccctcgagaccgcgatggagatctcggcccccaagaagcctgccgccaagaaggagcacaagcagggcgagaagagcgcggcccccaaggccgcggcaaagcccgctgccagcaagtccgccaagaagccggccgcagccaagcccaaggcagcagccaagaagccggccgcgaccaaggcgcccgcagccaaggcaaagcctgcagccgcaaagccagccgcagcccccaagccggctgcagccgcgcccaagcctgacgctcccgccggcaagtagccccatcacccaatcgcaccagcaagaagccgggtcgcgcaccatcgcgcggcccggcttctcttaccagcaactctccctcggccgctacacccacatggcgttcgcgatccccaccacggcgggcacggtcacgatcgagagcagcacggatatcaccacggtctccaccgcgtaggcgtagtccgcgtcgtgcagctgcgcgtacacggcaacgttggcgcctacggggcaggcagccgcaatcagcagcgccatccgcatctggtaggaggggatgggcagcacgctcagcagcgccagcgatgccagcggcgacactacgatgcgcgcaagggagacgcgatagttcgccacccgcgtgaacatcctccgcaggtccgtctgcgcaaggtagacgccgatcatgaacatcgcgagcggcgtgttgagtgcggccacgtcgtccaggcaggtcgtgaccacgcccggcagcggcagctgcgtcgcgtacagaacgatcccaatcagcgccgccaccataaatggcgcggtcgcgatgctgtgcgccacgtcgcgcgcggtcggcgccggctcgccctgctcgcgcgtgagcagccccacgccgtacgtccactgtccaatgttcatgagcgcgatgaaccccacgttgtagaacacgctcttcgcgcccacggtcgcgaccaccaaaggtatcccaaagaagctcgggttcgagaacgtccccgcaaagttcccaatcgcgtcgcgcccgcacacgagccgcgccacaaccgcggctaccaccaaaaggagaagcgcgaccgccgtgccccacaccagcgcctcggtgtgcgccaccgtccggctcaccatcaggctcttcactatcacggcgggaagcgacaggtagatcaggatgttcccgatcacgcggttgccctccatcgtgatcttcccggcgcggaacatcgcgtacccgatccccaccaacaggaacatcaccagcacctgcagcgcaagcacggcggacatgttcatacggagactccctcgttcagccgggcgtagcaggtggcgcggggcgtgcggtcaaagcggtcccaccatgataggccaccttccgccaacgccgataggccacccgtcacagaccccgccccgccgcctctcgcccacgccagaacgaagccccgccccatgggaacggccaatgcacaaatacgccagaatgtcctcccaatatcggacattccaaagtcggacccaacaaataccagcccgtatgcaaagtcgattgaatattacctgcaagttgggtaatatcacgggcaaacgcagttttacctgcgtagggggcggaaagcaaacctcaagggaatggggagcagccatgcgtaagaccaagatgttcgagggcaagcgccacgtatacaacaccgagaaggcggaggagtgcggccaccgcgacttcggcgacttcggcgaccccgcgggttatgaggagaccctctatcgcaccaggggcggtctatacttcgtggtgggcaagggcggggaggactccccgtatcccaccgaggacatcaggccgatcaccgcggtggaggccaagcagttctaggcggcgcaggccgcggggaggatgcgcgatggcggagcagcgcagcgacgtgatctcgtgggacgagttcttcatgcgggtggcagttgccgcccagctcaggagcaaggatcccaacacgcaggtcggcgcctgcatagcggataccgatcatcgcatactctccgtgggctacaacggcacgccccacgccatagcggacgaggacttcccctggggcgacagcgacgacccgctcacggacaagcacagctacgtgatacacgcggaggccaacgcgatcctcaacttccgcggcagcctcaaggacatgcagggcgcgacggtctacgtcacgctcttcccctgccacgagtgcgccaagctcctcgtgcaggtcggcgtcggcgaggtcgtctacctgtctgacaagtacgacggcacgatggacaacctcatcagcaagcacacgttcgacacctgcggcgtcacgtatcgcaaggtcaagctgccgcacggcctgcagtagcggccctccgtcgcaatcatctgggcgagaagaacgcgacccctcgtgcgcatcctcatgctgggcaacagcctcaccacggcccatggcttgccaacccaacttgcctccgcgcttgacgcggaggtggtggtgcacgcccgtggcggcgcgcgcctggccgagcacctcaatccaaagacaagaaatggcgcccgcacgctcgcggccctcgcgccaactcccgccgacgacgcgccgcagcctctcgcctgggacttcgttgtcctgcaggagatgtcccacgccccggccacaacgcccgaggcctatgcaagaagcgcatctgccctatgcgcgctcgcccgtgcggcgggagccacgcccgtcatctacgcaacctgggcctatcgcgccggcagcacaaagctccagcgcctcggcctcacctacgcccagatgcacgcccttatgcacgcatcgtttgcccaggtggcggccaacaaccacgccgtccttgcagatgcctgcgacgccttctattacgcgccggaccctgccgcgctctacgcgccagacggcgtccacccctccgagctaggaacaagggtcgcggcgtccgtgctggccaatgccatggacgccgcgacccccaagtcgcacgctatgtaaccggcggctgcctgccagcggcaacccgccgcggccgcctgcgagcccgcgctacttcacgttgtagaacgcagccttcccgaggaactcggcggagtcgcccagcctgtcctcgatcctcagcagctggttgtacttggcaacgcggtcggtgcgcgcgggggcgccggtcttgatctggccggcgttggtcgccacggccaggtccgcgatcgtggtgtcctcggtctcgccggagcggtggctcaccacggcggcgtagccggcgcgcttggccatctcgatggcctccagcgtctcggtcaggctgccaatctggttcaccttgatcaggatggcgttcgcggcgccaagctcgatgcccttcttcaggcgctcggtgttagtcacaaacaggtcgtcgccaaccagctgaaccttgtggcccaggcgctgcgtcagcttcacccagccgtcccagtcctcctcggccaggccgtcctcgatcgatacgatcgggtacttctcaacaagctcctcccagtagtcgatcatctggtcggaggtgagggtgcggccctcgcccttcagctcgtagttgccggtctccttgttatagagctcgctcgtggcggggtccatcgcaaacttgaagtcgcggcccggctcaaagcccgcctcgctcacggcgcgcatcaggtactcaaacggctcggcgttggtcttgaggtcgggggcaaagccaccctcgtcgcccacgccggtggaaaggccggccttgcgcaggacgtccttcagggtgtggtagacctggctcgaccagcgcagcgcggtcttgaagtcgggcgcgcccaccggcatgatcatgaactcctggaagtcaacgttgttgtccgcgtggacgccgccgttgaggacgttcatcatcgggacggggagggtgtggccgttggcgccgcccaggtactcgtacagcggcaggttcgcgccggcagcggccgcgcgagccacggcaagggatgcgcccaggatggcgttggcgccaaagcggcccttgttgggggtgccgtccgcctcgatcatcgcgcggtcgacggcgcgctggtccgtggcctccatgccaaccagcaggtcgcggatctcgccgttcacgtggccgacggccttcagtacgcccttgccaaggtagcggtccgcgtcgccgtcgcgcagctccacggcctcaaactcgccggtcgaagcgccggagggaacgatggccctgccaaacgacccgtcctcaagcgtgacctcgacctcgacggtggggttggcgcgggagtccagaacctcgcgtccgtatacgttctttatcttgctcatgtctgctccaaaccttgagttacctacggtttacttccacgctttcatactacccatactacggtaggaattcagcacgattcggaaatcgtcttcgcactgttgctcgggcaacactggtttgatcgtccaacaaaaacctgccttccgtcgggcgagaagaacggcccccattaccgcaggtagaggcctttagtcaaatgccaataacgggcatttagtcgttcgttacttaaagtctgctgttcataccagaaaaaaagtaaaacaattggtgatacttgctgtatgataccgttcacccgcgaatagctaccgtttgcatattggcgaactcgatttgagaccgaggttacgcccgctgactcagctagtcgtaaactggatgaaagttactggaaacgttttcagtcggcttggctgacagatctcttttccggtggacgtatttccgcaggtcgctagaaaaatgtcacagggacgatttcccttagatatgccttttctggccccggcggttggtggcgcgagcgaggtgccaagctctggcagcaagcggaacgtgacctgactgaataaatttcggtcgaaggtggctcgaaacgcctttttataggcttgaacgatggttatgaaggttcgaagcttgatgaattgggatgcattcaaaaacagagcgcagaccaatggcaagaggaggatgccgcgcaggcatcgtcatgccgtcgagctgaccgccacctgcgcctgcgcactgctcgtcacgctgtccctcgtgctgcctgcgttcgccgccggcgcctccaacgatgcccagaccgagtccacgaccgtcgcagccacaacggacaactccttatcttcctcgagcaatgaaaatgtgtcgggggggggtacctctcaggacggtagcgcctctgcatccgtagagaaggacgattcatcctctgacgagtcgtcgagcgcaagtgacagcgattcttcctctgatacatctgctgcaaaggcagcgccaatgctcacggctgctaacgcacagtcgatttctagtgttaacgactttacccaaactgaggggaacaaaagatatgcagaggaaggtgtctaccagctggattgcaatatctccactggtgacacgatttgggttgcaaatgacgttacgattgatctcaacggccacactcttgactacacggggacagagagtctcttccacgtacagagtggtggcaagctgactatcacggattctaagtttgcaaccgacgacgatagcaagacggcagtatctggcggcgataagtacggcaacgaagccagcatcacgtacagcaatggcaagcccacgcagctgacctattacgtgaccgagtccactccttcgagcgacggcgccagcacgaccgagacgctctaccagcacaccgtaactcctaagggcatcattactgcgaccaacggctccggcgccaactccgtcatctatatggacggcggtaccctgaacgtccagggcggcactatctgcatgccgaagagcgcaagccatggttctgactgccacatcatcaacgttacgggtaacagtacgttcaatctgagtggcggctacatcgcgggcggacagcgcacctcgaactggggtggtggcgtgtgcctgactggcagctctaagctcaacatgtctggtggcgtcatctgcgccaacaagggccagtccggtgcaggtgtctatgccgcgcagggcacgacggtcagcgtgagcaacaatgctgtcatctcaggcaacactgtggtatctggatcgtatggctactccgagaaagatagcgctggctacggcggaggcatctatgcagtcggtgcaaccgtcaatgtcagcggtggctacatcacaaacaacaggatggaagctacctccagtgtgacgcatgtcggcaacctcggtggcggcggtattgccgtggtcagcacgaacagtggtgccaagaatggcaagttcagcatgtccggcggctatgtgacgggcaactactcgaatgaatccggtggcggcatctatgcaggacactatggtaacggtctggacagcaactgcaccttcactggtggcaccattgcttcgaatgtcgcgcagaactccgagggtggcggcatccgcgtctccgggaatacctatgcaacgttctacgtttcctctggtcatgcctatgtgacgaacaaccagtgcaacagccatgatgactggggcggaggcggcgtcttcgtccaggctgacggcaagttcaccgtcaagaacgcccttgtcaccaacaacaccgcaggcggctatggtggaggcgtggcagcctgcccgactggccagacagtcattacgcacacgaacggtgcagctatctattccaacagggatgatgtggatagcgacagcccgcacttcgcaacaggcaacaagtacggcaaggtccaggaccattcgattgcttataatgactcaacgttcaccagtcatggccatgctgactacttcctcgtaaaggatcgcggcaacacccctgtcacggtcgtgactggccgcatgctgggcggtggcgcagccaattggtcaggcagcgttgacggaagtgctgtcacgattgacccgaactctggcgtagagggcaagtacctcgttggcctcacggccaatccggaagacgcagccaagtctgtagcagtggcggccgcggcagttaccttcagcggcaactacgcctacaaccacggcggcggcatcatgaccaacggcggactcatcctgggcgaggttagcaacatcgacatctatcctggtctcaagctcaatgccaagaagtctcttatgcaggacggcgcagatgcatcaggccagctgacaaaggatgcttatacctttgtcctgctgagccccacctctaaggacagcgttgctccgtcttggaccaaggacgacaagcagaacgacaagctgaactacggtggctgcacggagtctgcgcgtacgacgaatgacgagaatggcaacatccagtttaatgtcaacagcgaatactctcaggcgggcgtatatcgctactacgtggctgagctccccaactcaaacgacacgaagacccagtcgtacgacaagaccatctatgagatcacggcaagcgtgaccgaggatgagagccagcgcacgactctgctgggaatcaccttcaagcactacaccatctcgaacctgaccgttactccgattgtggatggcaagaatgccgacagctacaagcctgaaaccacaaactccgacaactcggtccagttcacgctggtcaagtcgatgggcacggacggctctaccacgacgcccgcgttcacgaacacgctgaagccatactccacttccggctcgttcacgcccgaggtcaagaagcacgtcgagggcggcgaggtcaaggagttcaccttcgagctctttgatgagaagggctacgacggcggcaagtgggacggcactgcgctccagaccaagcacaccacgaagtccgacacctcggatgcgacggtgaaattcgacaccatcaactacaccaacctcggcgtgaacaagaatttcactgctggcaagggtggcaccaagacctacacctactacatccgcgagaagtcgggttccgacaacggctacacctacgacggtggctactacaaggtggtcgtgaaggtgacagatcatccggcggatgacaagttcagcggtacgctctcgaccacggccacctacacctacgtggcggctgatggtacggagacggacgtcgaggaaggtaaggaacccacgttcaacaacaagtacgcgaccacgcttcccagcgccggacaggccggcatcgcgctcgcctacgtggcgggagccgcggccctcgcgtacgggatcgcgaggctccgcaagacccgcggcggttcccgcaggggaggtgaccgctgatggcgatctcgaaggcgatccgcaacgtggtccgcaccatggttctcgcggcgtgcgcgctcgtgctggcactggcggcaccggcgacggcgctcgcgggagaggtcaccgtcacgggtgacaacgcgaccgactacctggcataccaggtcttctccgctgacgtggcaaacggcaaggcaagcgacgtcgcgtggggctcggctgccgcgcgcgatgcggccgccaaggcgggcgcccccaccaccaccgcgcaggacgcggcggactggatcgacgcaaacctctcggacggcaactccgtggcgtacgggctcgcgtccgcgctcatggcatccggcgccacgcccgtcaggctgacggcgggcaaggccgcgacgctgcagaacggctactggctcgtcgtggcggacgagtccgcgctgggtgagcagcagagcggcaccgcgccggtcttcgtgctggtgggcggcggcagcaggagcgtcaagcccaagtccgtggtgcccaccgtgaccaagcacgtgcaggagaacagcacctccgcctggcagaaggcggccgacgccaccgtgggcgacgacgtgctgtggcgcctggaggccaccgtgccggcgggcgtgcagggctacaccagctacgacgtggtgtttgcggacacgatgtccgccgggctcgaccccggcaaggtcgcgtcctcggcccgcgtgtacgccagggcgggcacgggctccgcgtgggtcaagtccactgcggacgtccccaccacgggggagaaggacacggccggctggcaggacgtgactgcccagtgcaccatcgcggtggagggccagtccttctccgtcaagtcaccaaacctggtggcgacgctcggggcggacgcgctcaaggccggcggcgcgcaggtgtgcgtgatctacaacgcgcccctcaaccagaggtgcaaccacggcgcggccaagggcaaccccaacgaggtctacctcaagtaccccaagtcgccctttagctaccgggagtacctgagcacccccaaggacgacgccacggcctacacctgggacgtgctgctgaccaagcgctccagcgcgggcgacgccgtgctgagcggcgcggtgctgagcgtgacggacccgcagggccgccacctggcgcaggacggcagctggcacaagtccggccagaccgttaccaccaacgccaagggccaggtgcgcctgagcggcgtggactccggcacctatcgcgtgagcgaggccagggcgcccgagggctaccagcgcttcgagggcacgcgcaagctggtcctcgccgtgacgggcctcgacgtgaggcaggtcgcctccgcgcaccccacgctcaccatccaggcggaaagcccgctgcgcgcggacgccgtcgaaggctccaccagcctcgcccaggcgagcatcctcaacacccccacgaccaccgtcccgcccacgagcaagggcggcaacgggatcgtcaagacgggagacctgatcaaccttgcgccggtcgctctgctggcgctcgcgggagccggattggcggtgatgggcctaagggtgcgcaagaggggcgagaaga

SEQ ID NO: 264 - DNA, 6287 bp, Unknown
  Metagenome-assembled genome
gaggtgccatggctaacgcgagcctggggtttcgcagggtggacggcttgggcgagaggagcgtgagcggcacgcttgcgggcctgctccagctcacgagcgacgccgtgctcgcgtttgacggcatggggcgcatcctgcttgcgaacgaggccgcggagcacctgttccgctcccaggagctcgtgggcacggacgtgcgggcgctcttcccgccggccgtgggcgtgacgcccgaggcggccttcgacacgagggccctgcccttctcgacagacggaaacaccacctcgctcacgtgcgccggtgcgcacggggagcccgtgggcatagcggtgcgctgccagcgcgtgagcgcgccgggcgagacgtacctgctcgtggcctacgaggacgactcggagcaggcggaggcgcgcgagcacgaccggctggtgcgcgagctgcagcgcgccaaccaccggctttccggcacgctgagcatcgtgctcgagacgctggactccaaggacgtgcagacgctcttcgagcgggtgctcgaggagctgacggacacgatggacgccacgggcacggtgttctacgtggcggagtccgatggctaccacctgcgcgggaccagcagctcgctggacgagtcccgcgtgccgcggttcatgccggcgggccgcaacatcgagcgcatggtgatgcaggtgggccactcgatgcggctgagggtcctggcgccgcagggggcggagctgcgccgcggccgcctggtgcgccgcaacgtggtgaacgaggagacacgcgaggtctaccacgtcgcctcgaccatgctgccgccctttgtgagcttcatcgcggtgcccgtgtggtttggccggcacctgatcgccctgatcgaggtcggctgggaccagatgcaccccacgcgccgcgaggacgcggagctgctggacgccgtggcgcagtacctatcggtccagctggcgggcgcgttttccgccatgcgcgtccagcgcgagcaggacctgcgcgaggcgtcgtccggcatacgcgaggacatgatgagcctgggcgcggtggacgagcagacggtgcgcgccgcgctgcagtccgcgggaggcgtgctggacgccacgtgctacatgctgcacgaggacccgaaggcgcccggcaagatcggcgcggaggtccctggcggcaccggcgagctgttggacgtggacctgggcaccgtggaggcggaccaggccggccaggaggtcgtggtggtgccagtggcgccggactccgaccttgcggccgcgctcgccaaggtgggccttcccaccgtgggcgccctggtggacactggcatggtgggcgagaagagaagcttctgcctcgagctgcgcgacgtgggcgccgagcccctggacgacctcgagctcgcgttcctggagcgtgtggcgacggacgcgaacggccttgcgcacggcgacgaggcgcgccggcaggacaagcgcatctcgcaggcgctgcagacgggcatgaagaacgagctgcagcgcgtgccgggcatatccgcggacggcatctactcgtccgccacgcaggcggccgtcatcggcggcgacttctacgacctcatacggctcccgggtgatagggcctgcgtcatcatgggcgacgtctctggcaagggggttgaggcggcctccgtgtcagccgccgtcaggacggcgctcggcgcgtacagctggcaggggctctccccggcgcacatggtgaggctcctcaacgagttcctcctgggcttctcgcgcctcgagacctttgccacgctcttcgtgggcatcgtcgacctgggggcgggcaggatcacgtactgctccgccgggcacccgcccgcgtttttgatccgctccggaacgggcgcgatcgaggcgctggacgtgcagtcgggcgtggtgggcgcgttccacgagatgcgctacaggaacggcagggcgggcatccggccgggtgacatgctgctgctgtacacggacggcacgacggaggcgcgtgcgacggacgggtcgttctttggcgaggacggcctgcgcgacaccgtgatgcgcgaggcgcccaagggcttcgacgggttcctggggcggcttctggacgccctggaccgctttacgagccgccatctggaggacgacgtggccatggtggccctgcgctttgacgaggtgggcaaaggctccggcgcgcgtgcttaggcggcgccgtttgtgggaacaagcagggtatggacaacatgcctaacatagccctcgtccccgtggaccgcgacctggacgtgaccacggtgccgcgggtgcgcaaggcgatcgactcgctgatagactccggctgcaagaggatcatcctcaacatggccggggtcggctttgtggactccgccggcatggcgctcctctttagggaggtgcgccgcatgcgtcaggcgggcggcctgctctcgctcaccaacgtgagcgaccgagtgatgcgcgggctcaggatcgcgcgcctggtggacttcgctccggtgtccgccgcgggcaacgggcaggaggtgccggagctcgacccctcggccatgccgctgtggcgcaccgcgctgcgcgtggacccggacaacctgcaggacacgcgccagaaggtggagcacctgctggcacgcatgcccttctcggatgaccagatgttcgacatcacgcttgccataggcgaggccatgggcaacgcgatcgaccacacggacggtaaggacgccctggtcacggtgacggcgtacgaggaccgcgccgtgatcgacgtgactgaccgcggctgcggcatcagcgtgtcggcggggcagcccctgccgtgctcgggcaagcccaacgaggagcgggggagaggcatcaagctcatgaggctgctggccgactccgtggtgatctgcaggcgctcgggagggcgcggcacgctcgtgcgcatcgtcaagctggtgtgactgagcctgtgagctgggcgtttgcggacggccgcaatttttcgaaattagtgcttgcatcgcggccgcggctcacgtatattattcctcgcgttcgcgggcttagcgcagttggtagcgcgccaccttgccaaggtggaggtcgcgggttcgatccccgtagcccgctccatgcattcatcggagccggtttcaatcggctcttttcatatggcgagatggccaagtggtaaggcagaggcctgcaaagcctttatccccggttcgaatccgggtctcgcctccatcaaatgcgaagggcaccccaagcgggtgcccttttcgtatgggcgagaagggcgattggccattcgtgtagaagtcgtgagcaaggcgcacttccaaaattgccccttgcgcttgggcgtggggtcacgtatattaatccctgcgcttgcgggcttagcgcagttggtagcgcgccaccttgccaaggtggaggtcgcgggttcgatccccgtagcccgctccatgtgagcacgaggccggtttcgaccggcctttttcatatggcgagatggccaagtggtaaggcaggggcctgcaaagccctcatccccggttcgaatccgggtctcgcctccagcaagcaggcagggcacccgctccggcaggtgccctttttgtagatgggaagcagatgcctgacgcgtcgaatccaacgcccgccgcgcaccgggaggtctacctggactacgccgcggcgaccccgatggcgcccgaggtggtggaggccatgctcccgtacctttcggaccgcttccagaacccgtccgccccgtacgcgtccgcccgtgccgccaaccgcgacctggaggacgcccgtgcgcgtctggcccacgccatcggtgcgcgcccggccaacgtcacgctcacggccggcgccacggaggccaacaacctcgcactcgccgcggtcgacggcgaggtgcttgtctgcgccacggagcacgagagcgtgctcgcggcggcggaggtccgcgcccaccggctcatccccgtcggaccggacggccgcgtcgaccccgccgaggtcgctcgtgccatcacgccggagacggaactcgtctccgtcgcgctcgccaacggggaggtgggcgccatccagcccatccgtcagatcgcccaggtcgtgcgccgcgagcgcgagcgccgcctcgccgggggagaagagcgtcccatcctcctccacaccgatgccagccaggcggccggctactgctccgtcaacgtctcctcgctcggcgcggacctcatgacggtgtctgccgccaagctgtacggccccaagcaggtcggcctcctctggagcgcggacggcatccggctgcgtccgctcgtgctcggcggcggccaggagggcggcgtccgctccggcacgcagaacgtggccggcgcggtcgcgttcgcccgcgcgctcgagctcgcggaggagctccgtcccgcggagtcccgccgcctcgccaccctgcgcgacggcctgcagcgcgcactcaccacacgcttcccgtggtgcgtggtctcgggccccaggcgcagcgccaaccgcctgccgggcctgctgcacgtgtcctttccggggctcgaggcgcgccgcctcgtgatcctgctcgagcgcgagggcgtgagcgtgggcacgggctccgcctgcgccgccagcaagatgcgcgtgagccacgtgctcgcggccatgggagcgccccaggacgttgcccagggctcgctccggatcacgctcggccgccccaccacggcggaggacgtcgcctacgcggccgatgccatcacccgcgcggtcgaggcggagtgccgccgcgtgggcctctcgcacccaaacccgtcgcacccaaaggaggagggtcaccgtgactgagtccgtttttctcggcatgagcggcggcgtggactccgcgctcgcggcggcgctgctgctggagcaggggtacgacgtgcacgccgtctacatgcgcaactggtcgcgcgacctgcccggcttcaagtgcacctgggccgacgaccttgcggacgcggagcgcgtcgccgtcacgctcgggatcgacctcgacgtgtgggactgcgaggcggagtacaagtcgaccgtggtcgactacctggtggacgcctacgcccacggcctcacgcccaaccccgacgtcatgtgcaaccagacggtcaagttcggcacgttcgcggagcgcgcctttgccgagggcgcggacttcgtggcgacgggccactacgcgcgcgtccgccgcgacgtcgcgcccgacggcgccggcacacgaacgcacctcctgcgcgccgcggacgaacataaggaccagacgtacttcctgtggcgcgtgcccgccgccacgtttgcgcgcacgctcttccctataggcgacatccccacaaaggcgcaggtacgccgcatgtgcgcggagcgcggcctcggcgtcgagtccaagcccgattcggacggcatctgcttcatcggccccgtgggcatccgcaacttcctgctgagcacgctcgagcgccgcgccggcgacatcgtggagtgggagaccggctgcgtcctgggccatcacgacggcgccttcctcttcacggtggggcagcgcaagggcctgggcgtgggcggcggccccaagcgctacgtcgtcacgacggacgtgcagagcaacgtggtctacgcgacggcggacccaaattgccccgcgctgtggacgcgcgaggtcgagctcgaggacgcccactgggtgcagggcgagccgcccgcggcgggggagtacctcgtgcgcagccgccacaccggcgagctccgtcccgcccgcgtaacgccgctttcgggcgagaagaacgaccattcccacgtgcgcgtggaatatcccgagcccgtgcgcaccgtggcccccggccagagcgccgtcatctacgacgggctcgagtgcctgggtggcggcatcatctcgcgcccacggctcgtgccgccgttcatggcgtaggcgcgtgccgagtgggccgcggggacgaggcgccgttcttctcgtccgcgtcatcaccgtcgggccgcactgcgcgttccaattttcactttccccaaattcgtgcttgcgctgcgtcggacgttcctctatagttactaacgcactgcgcgaccccagccggtgcaaacacattcgggcgtttagctcagggggagagcgcttccctgacacggaagaggtcagaagttcaaatcttctaacgcccaccataaactcgcagg

SEQ ID NO: 265 - DNA, 3259 bp, Unknown
  Metagenome-assembled genome
ccaaggcgcagttcgaggcgcttgagcagtacggtcgcaacgtgacggacctcgcccgtcagggcaagctcgacccggtcatcggccgcgtcgaggagatccgccgcaccatccaggtcctgagccgccgcacgaagaacaaccccgtcctcatcggcgagccgggcgtcggcaagacggccatcgtcgaggggctggcggagcgcatcgcgtcgggtgacgtgccctcgaccatcaaggacaaggaggtcgtggagcttgaaatgagcgccctcgtggccggtgccaagtaccgcggcgagttcgaggaccgcctcaagagcgtgctcaaggaggtccagaaggcaaacggcaggatcatcctgttcatcgacgagctgcacaccatcgtgggcgcgggcgcgaccgagggctccatggacgccggcaacatcctgaagccggccctggcccgtggcgagctgcacatgataggcgcgacgacgctggacgagtaccacaagtacatagagaaggaccaggcgctggcccgccgcttccagccagtcatggttggcgagccttccgtcgaggagaccatctccatccttcgtggcatcaaggacaagtacgagcagcaccaccgcgtccgcatcacggacgcagcactcgtgtccgcagccgacctctccaaccgctacatcagcgaccgcttcctgcccgacaaggccatcgacctcgtggacgaggctgcgagccgcctgcgcatggagctcgactccatgcccgccgacatcgacgccgtggaccgcgacctgacccagaagcagatcgaggagcaggccctcatgaaggaggacgacgaggcctccaaggagcgcctgacgaagctccgcaaggagatcgccaccacgcgcgagaagctcgacggcatgaaggccaagtggcagaacgagaagggcgcgatcgaccacgtccaggatctgaagagccagatcgaggacgccaagaccgagatggagcgcgtgacccgcgagggcaacctcgcccgcgcatccgagctgcgctactccacgatccccacgctccagaagcagtacgaggcggccgagaaggtcctcgacaacaagaaggaggagggcggcctgctcaaggaggaggtcaccagcgaggagatcgcggaggtcgtgagctcttggaccggcgtccccgtcagcaagatgatgcagggcgagatggacaagctcaagaacctcgaggcggagctccacaagcgcgtcgtcggccaggacgaggccgtcaaggcggtcgcggcggcagtgcgccgcagccgtgccggactctccgaccccaaccgccccatcggcagcttcttcttcctcggccccaccggcgtgggcaagaccgagctcgccaaggcgctggcagagtgcctgttcgacgacgagaaggccctggtccgcatcgacatgtccgagtacatggagaagttcagcgtccagcgcctcatcggcgcgcccccaggatacgtgggttacgacgagggcggccagctcaccgaggccgtgcgccgtcgtccgtactccgtcatcctgctcgacgagatggagaaggcccatcccgacgtcttcaacatcctgctccaggtgcttgacgacggtcgcctgaccgatggccagggccgcgtcgtgagcttcaagaacacgatcatcatcatgacctccaacgtgggcagccagtacatcgccggcgccaacgcctcgagcgaccccaaggtcgtccagaagcaggtaaacgacgcgctgcgctccacgttcaagccagagttcctgaaccgtatcgacgatgtggtggtcttccacgcccttggcctggatgacatcgagaagatcgtggacatccagctgagggacgtccgcaagcgcctcgaccgcgagcgcatcaagctcgagctcacgcctgccgcggtgcagtcgctctcgctcgacggactcgaccccgtctacggcgcgcgtccgctcaagaggctgatccagcgccaggtggtcgacaatgtcgcgtcgctcatcatcgacggcaagctgcacgagggcgacaccgtgcgcatcgacgtcggtgcggacgactcgctctttgcggagccggtgcccagggatgacgacgacaacgcgagcgaggccgaggacgacaccccggtcgagcccgacacggtggagtagccaccatcccgctgccgtccggcatatccggcggcagcgtacacaaagcgtcacggcggccggccaggcaacccctggtcggccgctttcttgtgcgtagcggcggggaggccatcccctttgcgcgataatgtctgcaacacaaagccgcgcgccacgcgcaggcaagcgcaagccacgccaaaggaagcccccgtgtcggacgagaagaacgacatccatcccagcagccaagagcaagagccggtatccgcgtcggccccggcccatgccgccgaggactcctcccgctacgaggacgtggttcccgtgagccagaactccgaggacgcggtggaggacgcggacgccaccgtcgtgcgcgacgtggacgccttcggtcccgacgcggagggcatcggccaggcgccgctgccccgggaggttcccggcgagggcaggagccgcaggcgcggccgcgcgcttctcgccctggtgatcgtcgcgggcatcgcggcgtgcctcgtagctgcgacgacgtacggggccgagctctggggcggcaaggtcgtcccgtacgtggtgggctacacgcaggcacgcgcgacggcgcgcctcgagcagaagggctttgccgtgcgcgtgcgcaaggtcgcgtccgacgcggacgcggacaccgtcaccgcgaccgaccccaaggcgggccagcggcgagacgcggggagcaccgtcacggtcagcgtcgcgacgccgcgcacggtgccggacgtcacgggcaagacgctcgccgcggccaaggcggcgctgcgcaaggcaggcgcaaggaacttctcgatcgcctacgtcgcgtccgacgcggagcagggcacggtcgtggccacgagcccggccgccggcgcgcagtttgcgtcctcggacgaggtgaccatcaaggtcgcgcagccctacaccgtgccctacgtggtggggaaggacgaggacgccgccaagtcagccgtcgcggaggcggggctgaccgcgagcgtcgcgtacgtggagtcgagcgaggacgcgggcaccgtcgtggctgcggaccccgcgcc

SEQ ID NO: 266 - DNA, 3459 bp, Unknown
  Metagenome-assembled genome
agagcgcgtacagcgggtacgacgtgacgatctggctccgcagcgagggctccatcggccgctgccagcccaagctcgactacctgcacgccacgtacctcaagacgctcgacgccatgaagcagagtcccgccgcctacgcgtacggcctcatgcccaaggaggacgtcacgcccgaggcctgcgaggcggccaagcagaaggtcgaggacgcctacaagggcatcaagctcaccaccgactgggacgaggccttcaacgacgccgacctcgtgatcgaggccgtggccgagaacgtccagcagaagatcgacttctacacagagctcgccaagcacctgcccgagcgcacgatcatcgacaccaactcctccacgctgctgccctcgcagttcgcggaagccacgggccgtccggaaaagttcctcgcgctccacttcgcaaacgagatctgggcgcaccccacggccgaggtcatgcgccacgccggcaccggcgacgaggccttcgagacgaccatcgccttcgcggcgtccatccgcatgatcccgctgcgcgtcaacaaggagcagccgggttacctgctcaactccatgctcgtgccgttcctgagctccgccgaggccctctgggccaacgacgtcgccacgcccgaggacatcgaccgcgcctggacgctgggcaccggcgcccccgcaggcccgttccgcatcctcgacatcgtgggcctcaccacggcgtacaacatcggcatcatggacccgcgcgccaaggaccccagcaccgtccagggcaagatcgtggcaaagctcaaggagaagatcgacaacggcgagctgggcctcaacgccggcaagggcttctacgagtacggcaagaaatagcttctactagcgccggactggcgctccaacgcagataactgccccccaaagtgcccgggcaccgcatcgccgctcgcgaccggtgcccgggcactgtcgtatctgtcggtaagggagaaggacaagcgtccgctcctatagctctaccattgcgttcattccgacacgcttctcctcgaagctcctttcgcccacaagatagcgaacgctgtcgtactgcttttcagtcatgcagaacacgcaaatcgcgcccgtagagggaacgccttcctcaagcgctctcacgcaccttgcagctaccttcttgctcggaactgcgcgaatgtacacctcaggttgcaacaggacgaacccattggacatgagtcttttcctgtaagccgtatactcgctcttcgtcccgcgtcggttcgtgggcctcagcattacgactatgcgcacttctcccccactcccatgtcagtgtcatcaatgggacgcacgataggcagctgcatgaccctggcgtcaccgcagttgatcgcgccacgcagcgtctcgctcatgcgactgactgcgttgtgaacggagacgattcgatcctctaggtctaccttgcacaacgcaacctcgcgaagcttgctgcgctggttcctggacagccggcacgtcgtgcccaccacgccaagcgcaacgagatcgaccgcgggacgcaaaggctccatcaggtcatcggccaagttgaaggcattgagctgcgaatggtgatgaattccgaatgcggggatgaaccccgtcgatacgagcgagcgcgccaccagcgaccgcacgattgcatagccatagttcagagcactgttcagtggatcttcgcaacgcctgttgagtcccagctgtaggtgttgaaaatagcacttggctgcagcaccctcgcgattcgtagggtcgccgggcatcacgccttgtgagaacgaccagacctcctcagcgccaggcaatcccaagatggcgagtgaacgtgcctgattctggattttcgaaacgacgatgcgaccccaaatcgcatctcgcaggtcgcctggcatggttgcctgtgcatatgccacacgtgattgcctcgcattcgccaccataggtatggtcatgctcgatggcatgtggttccttcccatagtgacgaccataacgtgatgaaccgcaagcatatccaaacacatggtcgaaatacggatgtctggagcatccgcaattaacatcatgatgtcctcaattggaattgacgcggtaccctcgctctcaatcacaaccagctgtccattgcgggcatgaacctctgcggggtgctctatagaaactattcgaaaggccacatgaccatcgccttagttgagctttcaacgacaggctcgggatacatccttgcagctttggcaacaatgtccatacggtattcggagtcgaaatctaggtaagcgcagctactataggttgaacggcgggacgaaatcagcccgccgttcaaccgcatgacgtcgtagttccggcccattaaatcacccacaattacggcttagaaagctaccccgtacggataggtgtctctcacgaagcgcgcttcaccaaactccttgcggagtgcttcttcgcaaattgagcgtgtttgctcttttgtaggtacgtagtcgacctcggaccatgcgctatcaagcgcagagattgctcgactgaccacttcgtttggaacatccgaattttcgtaaagttctgggttaccccgaagcgagtcaatgctgtaccactttcccttatatgggacatcaatgacgattgttcccttatacagcatggcgcactcaccctacttgccaagcagctgtctcaatgcaaacgaaaatagcttagggtccttgctcttcaaagagattggatccgtgtacagatattgtatccccatggatgacacctcgtaggcgtcgccaccataatccttgtacacatacggcgaataggcatcatccactattcgagccatctcgttatacctataggcatcgtttttcatcatccgctgcagagacactattgccgcaccctttgttctctcgtcaaagaatgctttactttccgtcctgaagtgttcgtcgacattatccatggcgtgcatcagctcgtgcacaatcgtaaactcgtccgtcttttctctcaagatctgttgaacggcgggacgaaatcagcccgccgttcaactgtcctcgggcttctcctcgggctcggtcttggtctcctgctcgtctgccatgtgcctctccaatccacgtgtttggttgcgcgcttccctgcgcggctgtggcggccattttgcgctggccgggcgtcgtggcccttttacgctggccgggcgtctgcatggatggtctgacggcggtaacgggcaagaaaaaggccgccccgaagggcggcccgcttctgctgattattcgcacgaagaagcaccggcggtctcagcgtcagcgccgccggtgctcgcattatgtgcaccagccttctcactgggtgcaccggttggctaggccttgcccgacgcaaccgttgacgt

SEQ ID NO: 267 - DNA, 112400 bp, Unknown
  Metagenome-assembled genome
ctgcgaatttacatggagccagctatcagactcgaactgatgacccccgctttacgagagcggtgctctaccaactgagctaagctggcaaccgatggctgcctgaacagcgaatatttattatacggacgtctcgcgatgatgcaagcacaagttttcaattcgcagagcgcacaaaactctgggtggcaaatgataccccgcaccacaggcttccagaccgatggcaaggggaccattcgttttctacagcaggtgcaggacgcccctgaccaggcgctcaaagtcgtccgcgtggcggccggcctcctctagcacgctctcgtgcgtgacggtaggatcgccggactcgttggcggcaagcgtcaggccaagcacgttcatgcccagcgcgtgagccatgatgacctcgcacaccgtggacatgcccacgtagctcacgcccaggcccttgagcatcgcgacctcggccggggtctcgaaggtggggccgagcatgcccgcgtagacgccctcctccaccgtgatgccggcgtcatccgcaacgccgcgcgcaagcgtgcgcaggtacggcgtgtaggcgtctgccatgcccacaaacggcgtgtcgagctcgcgcacgtggtcccactccgccagggggttcctgcccgtgaggttgatctggtccgtcaggatgcccaggcccttgtgggcgttgccggggatgcagcccgtcgcgcacgcgaagatgatgtcgcggcagcccaggtggtgggcatggcgcaccagcgaggtgacctccgcggcactgtagccctggtacaggtgcactcggccggggtacacgaccacgggcacgccgtcgatgctgccgatggtcgcctcgaacttgtggccgctgatgggacgggcctccttggggaagccctcaatctcgtgatagtcgatgcgtcggacgggcttcacgagctgcgccaggtggccgaggcccgaccccagcacgatcgcgacaggatgctcgacggacggcctgcagctttccacaacgtcttcggtaaccacgcagataccttcttcctccaagaggcgcgcaaacacgcccgtgccccgggtcagacttcccgtatacgttccatcgtagatgactcccacgccgcaggaggggctcttcgccttcagaatcgcaagcggcgcgggatgcgcgtgcaccttggcaagggatatgcaagcaccgcgggcaaagtcctccgtcacgtccgtgccgtcgcgtagcatcacgcggccgtcgcgctgctccgcgggcggcctcggcacgggcagcccgctggcagactccgggcacacgcccaccacgtccaccttgccgcacagctcccgcacggcggcgttgggtttcgctcccccgtcgtacctgcatgcggtgccgcgcaggcactcgctcactatgacgcgcatggccacctccccgcaaggtctgccaacgattatggcacgacgtccggacgagaaaaaccgccgcctcggacgacgccgtctcgggcagcagcgcgatgccagtcgaaccgtccgccgcgccgcctcggcataaagcacgagggccccggaacttccgaggccctcgcgaggatggctcatgttcttctcgcccgtggtgggcgcgacgtcgctcttaggcgaccagggagaccatgttcacctgggcgttgcagagcagtttgttgacgtagttggtccactcggtcgtgatcttggtctggttggtcgagtactcctggtacgcgacgtagtaggcggcctgcgcggcctcgtacgtggcggaggtggaggtgatggtgtagctcttcagagcggtctcgtaggtgccacccttgccggaccaggtgcccttggtggcatcccactcgtcgccggcgaggttgatgatgtacttggcgtagtccgcgctggcggtctgggtgttgccgtcggagggctgggtcggcgcggtgggagcgctgacggacttggtcttgacgaccttgttgcgcagcttctgcatgagggcggactgcttgatgagcttcttgaccgtggacttgctcatgccgtagttggaggcgatggtggcgtagtcgctggagccaatcgtggactccgcgtaggacttcatctccttggcggagacggtcaggcccttctccttggcggcctgctcgatgatctcggagcgcgcgtaggaaaggacgccgtccgtggacgggatcttgtacgtgccgtcgctctgcttctgcgcgctgagcgaggacgtgctgttgatgacgtcacgcacggtgaccttgtacgtgacgcccttgtaggtgtaggtggccatcgtcgcgtccaggtcgctcttggagaccgtggtcttgccgctcacggcaccgctgccggaggacgctgccccgccaaacgcgaagtagccgatgcccaggcccacggcgagcgcgacgatggcgcacaccagcggcaccacaaacttgggaagcggcttcttggccttgggagctgccttcttggcggccttgtcagccttcttttcggccttcttgtcagccttgtcggccttcttgccggactctttggtcttctcgacctcgtccttctcgtccttagcgtccttgggagtggactccatgctcatacctccagaaaccgtggggccgcatggccctgacgacgaaaccacttgactctactacaaatcgcgcgcggccaccccgcggtgaccgcgtttgccacccaggccacacgctctgtcaaaacattaaggcgaccttatgggagaagaacgcgccaccgcgccagctgccgcctcgggacggccgccacccgtggctgcggctacttgtcctccgcggcgtcgatgatttcctgcgagaggcgcttgacgtagtcgcggccgttcttggcgtcaaacgacacgcgctcgaccagcgcgtcacgcaccttctgggagatcgtgccgtgcgcgaactcgcccagcgccaccagcatgtcgtggtactccgggtcgccgtggtagcactggacggcctcggccagaagcggccacaccgcctcggagagccgtgcggagtggctgcccacctccgcgaggaacttgaaggccgcgagcctcacgatggcggagtcctcgtcgaacagggacgactccgcgccctcgagggcatcctccgtcgcgtccgcgtccacggtcgcgagcgaggtcagcgcctcgagcacctgccagcgcgtctgggcctccgggcgctccagggcgtctaccaggtcgtccacgtagggcagcacggcatcggggctcgccttcgcgatggcggccacgatcttggatgcctcctgcctgctgcggcgacgcggccccccgagctggctcacgagcagctccaggctcttctcgtccgcggtcttgctatcctctgccatggcggcttcctttcctacgcgctactcgcggaacccgtccaccatgacggtcccgctcttgctgtcctgatgaatgtcgataaagcccagcttggaggcctcgcgaaggagcgtggagaacgacctgtagccgtagctgcgctccgagaactgcggccgcttgcgcttcatggtgtccttgaggcgcgacgccaggatggcgctgtcgctttccgcctgcagcgcgtcgatggtctcgaacagcagctggtagcaggggtgcttatcgggcgccacgcgcgaggcgaagtccggcacgccgctcgtgtgcacgatgtcctcgtaaaagaggaactcgtcgcacacctccgccagaagcgggctcgtggactgcttcatgcccacgccgatgaccgtcttgccaaactccttcagcttggtcacgaggggcgagaagtccgagtcgccggacaggatggcgaaggtgtcgatgtggtccttcgtgaggcacatctccatcgcgtcgaccgaaagcctgatgtccgcggagttcttgcccgtgtacgcgcggtccgggatctctatcaactcgatgcccagctcgtgcaggggcgttatcgcatcctcgaagcgctgccagtcgcagtacgcgcgctttgcggtgatgcggcccttgtcgaccaggcgctccaggatgcgcttcacgtcaggcctggggcccggctcctggtgcccgttcttcttgcgcttgccggttccaagcgcgaggttctcgtagtctataagaactgccagagagctctggctggattcgctcatgtatcacttgcctttcgaacgcttgcgcggcgcccccttcgccttgccggagccctccttgggagagtcgtccgcgacgcttatgacctcgggcatgggggtgccgtccctcctggcgcggcgcacggcctcggcgttgccgtcctgcgcgcggcgcagctggtccttatttaccctaaaggccttgtcatgaaacttccaaggacccacgctctcgccaaagtccatcttgagcgaagcgatggcgccggccatggcgccaatggggatgcccgcgaccagcgtgaaccccgtgaggccgatcagcgcggacacgagcacgccgccgaccaggatcttaaggttggcaatccagtactcgcgcttggtgacgcagcccttggcgagctcgctgccgatgcgcacgccgatgatgatgccgagcaagaacagcatcacggccacgatcgcgagcgcgaaggctccgttgccgcccaagctatgcctccccgttctggctggccgtgcgcgtgtggctcacaagctgcacgcgcttgcgtcccgcggcggcctgggagggcgcgtccttctcgcccgcggagtccttgtccacgtaaccgccgtcgtccgcgtccaagagcgaccagtcgagcccggccgccgcggcatcgccctcgttctggtacaggagcgtcagcgcctgcgtgcccagcttggagccgccgatctggcacagcacgtcgtacaggttgaacgccgtgtccgcaccgggcaggtccacgccgatgtcctccgcgtccttgagcgcgaggccgatgtccttgcgcatgtgctcgttcaggaagccggggcggtagtcgcccaccacggatttgggcgccagcctctcgagcgcggccgagtcgcccatgccctggctcagcacgtcgaccacctggtcgaggtcgagcccggactgccgcgccagcgcaagcgcgtccgcgtagcccaccatgcacgacgctagcgacacctggttgcagagcttgcaggtctggccgtcgcccggcctgcccaggtagttgatgctcttggcaaaggtgtcgagcacggggagaaggaccttggcctccacctcggtggcccccatcatgagcgtgagcgtgccgtcctccgcgccctgctggccgcccgtcaccgggcagtccacggcgtgcttgttcacgacctccgcggcgtcgtgcagctcgcgcgcgagcgtgggcgagctcgtggtgaggtcgaccatccaggcgcccttgggcgcggcgtccaggatgccgttcttgcccaggtagacgtcctccacgtcgtcgggatagcccaccatggtaaagatcacgtccgcgtccttggcggcagcggcgggggtgtcggcccaatgggcgcccgcctccaccagggggtcggccttctccttggtcctgttgtggacggtcaggtcgaagccggcgtccagaatgtgacgggcgatcggggcgcccatgatgccggtacccacgaacgccaccttgcgtacgcgcacaaatgccatgtagatcccttcaagacgcggccgggcctaggcgcccgcgccgcccttcctcaccttgcgggcgatcctgtccgtaagggacatcttctccctgcggtccgtgccccagaacaccagggccaccatgcccggccccacgtggctgccaaggatgggagagacgctgctgtggatgatcgccacgtcctcgcagcccttctccttgcggacctccttctcgagccagtcggcgtccttctgggcgtccgtgctcacgatcgcgagcggcagcgtcgtgtcgtgggcgtagttgtcgcggaagtcctgcaggatcgcgcgcagggccttcttgcggccgcggcacatgccgcgcagcgtgagggcgccgttggtgtcgtacgagagctcgggcttgatgtcgagcttgccgcccacgttggcagccgcgggcggaatgcgcccgcccgccgccagcgcgtcaaagctgtcgagcgtgaagtagccgtgcacaaagtagcgggcgtcgcaggcccagtcgtacagctccttggccgaaagcccgtttgccgcctggcgcacgacctcgatggccagcagctcgcccgcggcggagtcgcacttgttgtccagcacgtagatctcgaagtcgggatactccttcttcaccatctcagccgcctggcgcgccgcgttaatggaggaggaaagcccctcggacaggcccatgtacatcgtaggcgtgccctcctcagccgcgcgcttgaacacctcgtagtacttgccgggcgtgaccgccgcggtcttgaagtgcacgtccgggtgcttgcgcatgtactcgtagaactcgtgcgggtcgctgttgcgccacatgtcgtcaacgtgctcgccgtcgggccccacgtacgagaacgggatgacctcgaccccgagctgctcgaccacgccaggcgcaaagtccgacgtggagtccacgatgatcctgacgtttcgcctttgatgatacgcacggccggcgctttggacgccggccggaacgtcagaggcgttggttgaagaaccctgcttctgatccatcagcttttaaacctcactcagcgttacgcgtcctctggctccagacgcggcttgatgattccatatcctccattatgacggtggtagataacgttcaccagcccggtcgcagcattttcaaacacgtagaagtcgtggcccagcaggtcggtctgcaccagcgcctgctcctcggtcatgggcttgaggtcgatgtacttctcgcgcaccagcacgtcgtcgtcctcgggctcctcctcggtcggctcgattaggtccgccaggtccttcacgtgctccggctccgcgatgaccgcgcgctgcttcttgtcgatcacgcgcgtcttgtacttgcggagctggcgggtgaccttctccgccgcctcgtcgatggccgcgtacatgtcggggctgctcgcctcgacgcgcaccacgtagtcgcgcacgaacaccgtgacctcgcacatcttgcggtcggggttcgacgggttcttgtccacgcgcagcacgacgtcgcagctcatcggcttgatatcgaataccttgagcgcgtcgccgatcttatcgttcacgtggtcacgcatggaatcggacacggagaccttgcgcccggaaatcttgatatcagccatcagtgcctcccactatcgcgtcttctgctcgtttggagcacttgcgtaccctattaatacccaatggtgccgatgttggcgtgttgcattcgacagtcggtacgttttcgtaaagtttgggaaaagatgctgacgcaggcgagaaggacgcgccccctcgcctgatggcaccgtgcccacggcatcgccgatgccgctagatggtcgcggcgttggcccccgccgtcgccgcgccgccgccgacggaggccgtggtcccgtccgaggtgtcgctcgtgcctgccgggacgttttggatctgcatgctcgagtccaggctcttctccccgttgacccagcgcttgcggatgagctccatcacgccgttgccgtcgatcttcttgagggcgctcgcgagggcctcggagagctccgcgttgccggaggacacggccacgccgcgctcgaccggggcgtcaagcgtgcccgcaaagcttgcctctggatagctttcctgcaggtagaagccacaataggcgtcgcaaagcacgtagttgatcttgccggacgaaagcgccgcaaaggcggagttgaggtcgttgtagctcttgacggtcatcttgaggcccgtcttctggagcgtgctctgcgacacggaggcgccctgcaggcccacggtcttggacgagaggtcctcgaccttggccacgcccgtgctgccgtcgtggaagaacgcggacgccgtctgcgtgtagttgcccaccacggtcgagccgctcacgtcgcccttggcggcgcccatcaccacgtcgcacgtgctgcccagttttgccgagccggcgctcacgctcacgaagcgcacgcgcagccccagctcgtcggccagcgcctccgccacgtccacgtcgagcccgtacgccttgcccgaagcctccacaaagagcagcgcgctgtcagagtccgggtcgatgcccaccgtgagcacgttcttctcgaccgtgttcgtgaccttaggagagagcgccgccgtcttctttgcgatggagtcggacacgctcgtgtgcgtgccggcaagctgggagaacgggttggagcagcctgcgagcagcaccgcgagcgatgccgcggctgtggtgcagaatgacctgcggctgatggctcgtgtggatgctcttctcatggtgctacctcgcgttccgtcgtgtcccaagcgtcccacccagctgacctggtatttgaccccacactcgcgcaccggggccgtcgcttcggggctgctcggccccccactgttggccctctcgcccgtggggccggatgccccaaatgtggcgggcggtgcgacttgcttctaggacgagccatgctcgctcggccgcgcacgtccgaacttacgtggatccctttggcctcgtctgccatggactaggggactggccccgcaaccacagacctggatggaacgaccagagtataccaattccgttgttattttcgcacgttggaacgttggaactaccacacgcgggccaatgcgcatgcgctcacctcccccgcgccacgcgcaaggagcgcgcgggcggcctcgcgcaccgtcgctcccgtggtgatcacatcgtccaaaagcagcaggttgaggccccgcacgtcgtccacgacgtccacggagccggccaggttgagcgcgcgctcggcccgccccagctcgcgctggtcccgtgcggagcgcctggcaagcacgtccaccaggggaatccccgttgcggccgagaagtgcgaggccacgagctccatgtggtcgaacccacggcgggtgtaggcctcggccgtggcggggacgaagcacacgccgtcgagcgtcgccacgtcgaagcgcgaccgaccgtccacgcggggccaggacgaggcctcgtccagcgaggtcagcattgccgccgcgatcacgggcgccatgcgacgctcgccctcgtccttgtagcaggtgatcatgcgcgccgccacgccggaaaacggcaggcaacacacggtggtggcaagctcccagtcgcgcttgcactccgtgcaggtgagccacccaaacggcgccccgcacacggggcacgcccagcgctgccctatccacggcatgcgctcgcgacagtccccgcacaagagctcgccaggcatgtcgcatccaacgcagcgcgttggccacaggagttcctggattccctccagtgcctccgcgcaaaagtcttgttgccccaatacgcacacgaccctccggcgcttggcgcggggggtcgcggtgtacgtacatagtagcacgcgacgagggccgcgtccacggttctacgtgggaagacgcgtgccgcgagcacggccgagccgacgctacggacgaagcgtgagcagctcgttcgcgtttctccaacaggcgtcgtacgttgcctggcgggagtggccctgccccgcgcggacgtcagccaggcggctgaccgtgaacgcgaccatggccggctcgcactcctcaccgcgtagcgggacgggcgccatgtagggggcgtcggtctcggtcaggaggagctcctccggacagacggcagcggccgcgcggatgtcatccgagcggttgaaggtcatggcgccgccgaaggcgatgtggcagccaagctcgacgaagggggccatcacgtcctgcccctgcgtgaagcagtgcaggtcgcagccgcgggccgggacgccctcctcggccaggacccgggccgcgagcacgtgggccgagttcctctcgtcctcgggattgtcgcgaatgtgcagctcgacgggaaggtcgcgctcgtgcgcgatgcgcagctgcgcgcggaacgcccgctcctgcacgtccgcgggaagctcgttgtaggggccgtagtcgaggccgatctcccccacgcccacgcagcgcgggctgtcgagaaggacgtcgagcctggccagcgcctccgccgtgaggtcggccgcgccgtaggggtgggcacccgccacgatgcgcacgttgtccacgagcgcgggcacgtccggcgagaaagcgggcggcacgaggccgtgttccgcgcactcgtccagacgctgcgcagcgcgctccacctgctcgtcgagccaggagagcatcgcctgggccgtggggaacttgcgcgggatctcgtccaccgggtcgacggggaccacgagcagacgcacgcctgcgagcgccgcgcggcagatcgcaacggacgcgtcgtgcttgtgaaagctcgtgaggtggccgtgcgagtccgcaatgggcgcgagcggcgtggggaggggcttgggacgacccttgcggtcgtgaaagagctcgccgtcctcgagcgtgagggcgtccatgcccaggatctcctgcggcatcaggcctcgcctcccgcgggaagcgcgtccgcaagccggatgaagtcggcggtgtcgagcttctcggcacgcgtcgtgggcgagatgcccgtggactcgaacgcggcatcgagcgcctgcttgtcgaagcccgaggacgacatggagttcctgatggtcttgcggcgctgtgcgaacgcggcgtcaatcacgttcctcacgtgggagagccgcgcctccgtcaggatggcacccgtctggggatcggtcgcgggctcgcggtcgatgcgcacgacggcggagtccacgtggggcggtggcatgaagttgccgggagagacctcgaagcggcccgtcacgcgaccgtagagcgagagcttggccgtgtaggcgccataggtcttgccgccgggctgggcggagatcctgtccgccacctcggcctggaccatcacgaccgcacgacggaccgtgggcatctgctcgaacgtctggaggatgatgctggcagccacctgatagggcaggtttgatacgagcatcgtggggctggggtcgagaccctcgatcccgagcccatcgacggcctcgcgcagctggtcggcgtcgaccttgagcgcgtcgcccatcaggagggcgaagcgctcggagtcacgcgagcaggtcttggccagcacgggcgcgagcgtccggtcagcctcgacggagcacacggccccggcgtggcgcagcagcgccacggtcagggtcccgatgcccggtccgacctcgaacaccacgtccttctcgcccaggttggcaaggtcgaggatgcgcgtgatgaccgagtcgttgaccaggaagttctgaccgaggcggtgctttgtgtagagcccgaaatcatccaggaccgcacgcgtctgcgtggggttggcgagccaagagctgggcgcctgcgccatggccgctacttcttggcgaggcgcgggaagagcgcgtcgcccttggtgacggggagcccgcccttgagctggccccaggcgcaggcagccgcaaggtccgtgcactcggcctcatctgcgtggctcatgcgcgcgagcgcctccgcggaggtcttgggcatgaagggcgcaagcagatgcgcgctgatgcggatggactcgagcaggttgaggatgatgcggacgagctcgccctcgcgggcggggtccttcgcgacgttccagggctcggagtcctcgatgtagtggttggcggcgtggacgagctccatcacgacgtccttggcctggacgtactcgatcttgtccatgtgctcgctgtagcgctgctcgatgccctccgcgatgtcgtgcagggggttcttctcgcccgcccagccctcgggcaccgcggggctcttgccgtcgaagtacttggcgctcatgttgagggcgcgggacactaggttgccccagctgttagcgaggtccgcgttgtagacctgctccatgcggctgaagctgatggcgccgtcctcgccgggcgtcacgtccgtcatgaagtagtagcggtagccctcgacgcccaggaggtcgatgacctcctgcggggcgatcgcgttgccgcgagacttggacatcttctcgccctggccggtctcctcgttcttcaccatgaggaagccatgcgcgaagacgtgctcgggcagggcctcgtcgatcgccatgagcatggcgggccagatcacgcagtggaagcggatgatgtccttgccgacgacgtggaactgggcgggccagcggtaggcgagctccttctgggcggcctcgctcgggtcgccgtagccgacggcagtcatgtagttgaggagcgcgtcgaaccagacgtaggtgacatgcttctcgtcaaacggcagcttgataccccagtcgaagctggtacggctgacggagaggtcctgcaggccaccctcgacgaaggtgcggacctcgttcatgcggaaggagggcatcacgaagtcgggatgctcgtcatagagcttgagcagcttgtcctggaaggcggagagcttgaagaaccaggactcctcctggacgcgctcgagcgggcggccgcagtccgggcagaggtgctggccctcggtgtggcgctcctcgtccgcgtgggccacctgggtctccgtgaagtaggtctcctcgggcacgcagtaccagccatcataggagcccttgtagatgtagccggactccttcatgcgttcccacaggtactggaccgcgcgggtctggcgcggctccgtggtgcggatgaagtcgtcgttggagatctcgagcgtcttccagaggtccttgaagtacggcgcctggctgtcgcaccactcctgcggctccatgccgtgctcgtgtgcggcctcctcgaccttctcgccatgctcgtccatgcccgtgaggaacttgacgtcgtagcccttggcacgacggtagcgcgcctgcacgtcgcacaggatcgtggagtaggcggttcccaggtggggcttggcgttgacgtagtagatgggcgttgtgatgaagaatgagttcttgtctgccatggcgtgggtctcctcatgacggaatggatggctttggcgtcgcgacactggggcgacgctgacaatgggcaattgtaacgcaggcgacgcagagggtgcagcggctcatgcggtcgcacatctgctccacccctaggtacaatacggtgcgatatgggcaggctactcaccctgctgacgcaggatggcatcgtaggcctgggccttgctgagcgagaagtccttggcaatgcgcttggcgagctttgtcttgggttcgcccgcctcgagcccctggcggatggcctcctccatcgtggtggcaccggactgcgtggcttggcggcgctgctcgagctcctcctgcgagggcgcacctatcacgatcacgcactcgccacgaaggtcctcgcgcgccgcgatgatggccgcgagttccgccgaggagccgcggacgcactcctcgtgcagcttcgtgagctcgcgcacgagggcgacctggcgctgcgggaacacctccgcgatgcgtgcgagcgtctgggccgcgcgatgcggggactcgtacacgacgagggcgccgggtatgggggcaagctcccccaggcgctcgcgcatggcacccgccctgcggggcaggaagccctcgaagaagaagtgctccatgggaagccccgacgcgacgagcgcgcagatggcagccgacggaccagggatgacctcgaccctgatgcccctgtcgagcgcggcgtccacgagcctctggccagggtcggacacgcccggcatgcccgcgtccgacacgaaggagacgcgctcccccgcctcgaggcgcgagagcgtgggctcgatcttctcgcccaggacgttctcgtccgcacgctgcagcgggacgcggatgccgaagcgcgcgaggagcttgctcgtgacgcgcgtgtcctcgcagagcagcaggtcggatgacctgagcgtctggagcacgcgtggcgaggcgtcatcgaggttgccgatgggcgtgccgaccaccgagagcacgcccgccccctcggccgccgtcacgagagcatccttcgctcgaaggacgcgagcgagatgcgcgcgtcccagctcgagagcttgccgtccgtcttccacgtctggtagaaccagcccgcgcagtcgcggaacgcggcgagctgctccgagatgtagacgcgctcgagcgcgatgcgcccctccggcgtcgtcatggagtccgcgaagggcagcgccgccgaccacttgccgaccatgacgggaaggccgctcctgcgcgcggcgcgaagcgacttctgggacttgttgaccagcgtgcggacgcccgagggaccggccgtcctcacgtcatccgtgtagtggtagagatggcagtcgagccagacgttcttgtagcggtcgtgcgccatgaagtggcgccacgaggcgggctcgtgtgccgcggggatgatgacgcgcagatcgtcgcccgcctcgcggcggatggcgtcgtacgcgtcgcggtagtagttgcggagcctgtggataggcacgccgtccgtgagcgtgaggccatgacggacctgcgccacgggcgaatcggccacctcgatgccagcaaacgacgcacgcgtggcatagcgtttggcgagcatcccgaggacggcgatcatgtcgttgcggtagtggccgaagtcgctgtggttgcgcacgagtgacgtctggtcgctggcggagccaggcgcgatgtccagcacgaggacgaggttgaggttgatgtcgtccgcccagtcgaacgccctgtccacctgagcgatgcagcccaggaagggaccggcatcgggcccgtcgtccccgaagacgtaccagggaaccggaagacgcaccgcgttgaagccacgtgccgcgatgtgcgtgaagtccgtctgcttgacgaagttcgcgcgatgctcgcgcacgaggtcgcgatagtgggtcttgccgagcgaggtgaccaggctctcctcgtccaacgcaccggaatccgcgaacaggacgggagacacccatggctcgagcgtgagccaaccgctgaggttcaccccgtgcaacgccctttcagccatctgacctccattcctgctggtaactgctttggttcgagtatacccgctcttcgggacacaaaattgacagtaagcttttctcgcccatacgccatcgtccacccgccgacggcactagtccggatatgttggcggaacctttgcctccacgaaccagcgaggtccctcgaagtagaggaaggtgctccttccccctatcctcacggtgtagcgcatgcctgtacctcccgtcctgagcgagtgtgcctgcctgcagtcgagcacgcggtctatgtcgtagcgcgtgccgtcgtcccacacgaccaccaggggtcgcgtcctgccctccgcgtcggtcttggagatgacctccacgtagtgcttcttcctctccacgatgccgtccaacgcgggtcacctcacgcgaagtaggagaccgggtgcgtgaagtggtcgcgctcgggatcgagtcccgagaggcgcgggtccgtcagctccgacgcccggcgcaccgcatggttgccaaagcgatgcctgagctcgtctatggacttatcgagggctcgacgcctcaggcgcccggcctctatcccctcaaggtcgagttggacgggacccgtcgcgggaacgaggttggacgcgcgcaccccgatggctctgatcttctcgtaccgaaagtcccagtccgagcacaggaggcttgccgcgagcgagcagatctcgctcgtgatgttgctgggccgttcgagcggcgcctgcctgccgtgacaggccagggtgcggaagtcccgtcccgtggcggagaccgtccgcgccgccaggccaagctggcgcaggcgctgggccacggactcccccatgagccagacgacctgcctggcagtgtgggcatcctccacgtcgaacggacaggtgatgccgttgccgacgctcttgacctcgtggtcgatgtccgtgacggcgaggtcgagcggccgcaccgggcttgcgtccctaccctgggcgaacgcctggacgacgaggccgggcttgcccaggagccgacgtatgagggactcgtccgcgcgggcgagctggccgatggtcatgatgcccaggtggttgagcttgtgctccgtcgcgggccccacgtagagcaggtcgcccacgggcgccttccatacgaggtcggtcgcgttgtccgggagcacctccatgtagccgtcaggcttgtcgtggtcgctcccgaactttgcgaatatcttgttccacgagtagccgatggagcaggtaatgcccagctcgtgcttgacgcgcgacgcgatgtccgccgcgacggctcggacgtcgccatcccagaggtggatggaccccgtgaggtcgagccaggcctcgtccgggccgaacggctccacgaggtccgtgtagtcgtagtagatgcgccgcgcggcatgcgagtagcggcggtacagctcgtagcggggaggcacgatcacggcgtccggacagacctgacgcgcctgccagagcgccatggcggtcttgaccccacgccgcttggcctcgtagctcgccgtgagcacgatcccgtgacgcagctcctcgttgccgcccacgatgagcgggaggcccctcagctccggccgctccgcctgctcgacgctcgcgtagaaggcgttcatgtcacagtgcagtatgatgcgagatgtgtccaacgctccccctccgtcgacttccatttaagaacatctgttcgtagtttggaagtggcagaggacattaattccgcgcgtgcgcggccccatcgggatggtggcagacgttggcgcagctcagtgcgggcagcatacgaattcgaacacctgtactaatttcttggcagtcacgagggtgtctcccgatggcccaaggccacgcaaactgccgagaagggcgcccttctcggcagggacgtcggcggcaaggttccggtcgagtgccgagggcccgccctgacgtcgcgtcggggcgggcccctccttgtcccatgccctacaggtacagcaccgtgggatcgaacaatctggtgtcgcgaacacccgtgtagagcatgagctcgctaagctgctcgttcatcgcgcagaccttcttcaccacgcccgcggtcccctctgcgaggagcggcctcaggatgccccggcccacggagaccgcgtcggcgccgagcgcaagcaccttgtaggcgtcatacccggtgtcgatcccgcagtcgcagaggattgcgacgcccgaaccctcgagcgcctcgcggatgcggggcagcacctgcgccggcgccacgccgaagggaatgcggccgtgatggtgcgacaccacgatggcggcgcatcccgcgttcgcggcctttcgggcgtcgcttacggacagcacgcccttggcgacaaagggcacgcccgccgccttggcgtacgcggcgaggtcccgctgcgtcaccgggcccagggggatgccgtcgaccacgtcgtagccgccatcggttccgaccacgtggtcaatgtccaagcccacggccacggcgttgttcttctccgcaaactcgatctgctccaggatcgcgtcgtggtcggcaaagggcttgatgatgcggaccgtcggcgcgcccacggcggcgatcctggcgtactcgtcgtccggctccatgcccacccagttgaggacgcccagctcgcgggcggcccgcgcgtactcctccatgggcgtgcggccaccctcgcccaccttgttgaggtgcgagaacgccggcatcatgatgggggacgagaaggtcctgccaaagacgctcgtcgtgaggtccggccgcgcggagtcgatcacgcgcatctccacgtggatgcggtcgaggtaggcccggttgtagacgttggcgtcctcggccttgccgctagtgacgggaatcaggcccgcgggtcccggccagggacttcctgtcgcttcgctcatgtcagcctcccaactcgtgcgggcgcggccacgggcgagaagaaccgcccggccacccgcggcctggtccctgttggcgcgcccgcgatccgggacgcgggctcgcttggcaggacggctactccgaggagggtgatgccgcaccgccgggcttgccgcccccgttgccgttggagccgccgttgccgttggccccaccgttgccgccattgccgcggtggcggcggcggcgcctctgcctgccctcgctctgggcgtcggccggtccgttgcccccgttgccgttggcaccggcgccaggcgtgccggccgcctggcctccgtgatcgcccggacggcgacggcgcctcgcgccctgcttctgcgcgggtgccgaccccttgccggacgcgccctcgggcttgggggcgcgacgctggcgctgggaggctcccgcctgcgcgccggcgtcctgcgcctggccgtcggccgcgctgtgatggtggcgcctgcggtgcatgccaccgttgcgaggctggtcggacgcgttcttctcgcccgagtgacgctcgccgcgcggcgtgggggcactcgtctgggcatcctcggcctcggccttcttgcgacggcggcggcgcggcgtgccctcctgcgcgggctcgttgcccgctgcggacgcggggcacgcgtgctttggacggggcttgcggccggcttcctcggcggaggcggcgttgggaccggacgcctgctggccctgctggcccgcgccgcggcgacggcgacgcggcttggtctccacgaagatgtccgagtcgtcaaaggactcctccggggccttgcccatcttgcggtcgaggtccgccagggccatctgcacctcgggggactgcagcttctcgagcgcggcgcggctcacggtgtcggggcggcaggggcagcccagctcctcgctcttcttgtgcgcggcgggagaggcctccatgtccgccaggggcaccctgacctgcttgccgttttccagcctgaggcagatctgctccttaggggtgtcgtactccacgatcttggccttgccgagcggcgtctcgatcacggcgttgcgcttgggcgcgcggctcttgaagtcgcggtaggcctcgaactcgtagcgcaggcagcacatgaggcggccgcacgcgccggaaatcttggacgagttgaggggcaggtcctgctccttggccatgcggatcgagaccggctcgaagcgcctgccaaagcgcgtgcagcacagctcctggccgcagtggccaaagccgcccacgatcgcggcctcctcgcgcacgccgatctggcgcatgtccacgcgctcgtgcagctcgcgcgagaggtcgcgcacgagctgcctgaagtcgacgcggtcctcggccgagaagtagcagacgaccttgccgccgccaaacaggtactccacgcccacgggcttcatgtcgagcccggactcgtgcgcgagccgcttgaacgtggggaaggcctcgtccccgcggtccgcgagcatctcggcccggtcgaggtccttctcgcccgccacgcgaatgacgggctggagcttgccggactcgcctatgacctcgcggaggtgctccttggtgacctccatggggtccatcgtggcgaggccgatctcctggccgcgctccgtggcgcatatgacgtggtcgccctcctgcgcgcccgactttgccgggtcgaaccacaggtcatgggcggcatacttgaacttcaccgagagtacggtgggcattaaagtgcctccttgacggcaagcagcatgacctcgagggccagctggggtgtgacgttgtgaaggatgtcgtcggcagcgtggcgcaccgcctcgagcgcgcgcacgacgccctcggtcgtagcgtgcgtggccaggcggtccacgatgtccgcggcatcctcgttggtgatcgcctctgggacgccctcgcagcgcagcagcacgtccctcagcagggactccgcggccgcgagtgcctccatcatacccgaacgctcacgggcggtgagctcgcgcttgttggcgtcctccagctgcttcatggcagacctggccaggtagtcggcgctttcgcccagcgcggcctcctgctccgccttgaggtcggccagcggcgcgcgggccgcctccacgatggccttggcagagctgagcacgtcccagctgtcgtcgcgggcgagctcacccagcgtgcgcaccacgagccgccgcacctcacgccggcccgggctcgcgaggaactccgcggcgcccttgggcgtgtgcgtgacggccagggcgatgcgggcctcggtcccgccgatgccggacaggcgctcgaccgcgcgctgcgccgcgtcgggcgacacgatggcgaacgggatctgctggcagcgcgacacgatggtgggcatgaccgaggccacggaacgcgcgatcaggatgaacatgacgcccgcgggcggctcctcgagggtcttgagcagcgcgtttgccgcggcgccgcgcaggagccccgcgttgtccaggatgtagaccttcgcgtgcgcgcggatgggcgcgcgcgagacgtcctccgtgagctcgcgcacctgagacaccaggtagcccgtgacgctctgtgggctgaggtagcgcacgtcggggtgggtgtggtgcgccacgcggatgcactcgtcgcagctgccgtcgcccccgttggggcacacggcggcctgggccacggcataggcggcctcgagcatgccggagcccggcgcccccacaaagaggtacgcgtggctcagccgtccctcgtcaatggcggcggcgagaaactcctgcaccctcggctgggaggacagtccctccagcaccttgggaacgggcatggaggccgcggccggctcggacgcgctacccatggcgcaccccctcgcccacgggaagccccagccccgccagggcctcgtccacgcggcgcgcaacttcgtccggcgtgccggatgcgtccaccacgcgcacgcgcgcgggatcctcctgcgccaggcccaggtaagcgtcgcgcacccgccgctggaaggcgaggcccgctgcctcgatgcggtccgcgccgccggacgcgcccacggcacggcccagcgcctcgcgcgcgggcatatcgagcacgagcgtgcggtctggcagcacgccacacgagcccagcgcgttgcagctgcgcacgagcccggcgtccagcccgcgcccgcccgcctggtaggcgaacgtggagtccaggtagcggtcgcacaccaccacggcgccgcgcgccagggcgggctcgatcacctcgcgcacgagctgcgcgcgcgaggcctcgtacagcaggagctcgcactcgtcgcacatggccccgttggcggggtcgagcagaatgcccctgatcttctcgcccagggcggtgccgcccggctcgcgcacgctcaccacgtcgagcccggccgcgcgaaggcgctccgccagggcgcgggcttgcgtggacttgccacagccgtcaacgccctcgagcgagaggaacgtgccgccgcgccttgcgggcgcgtgcgctgccgcgtctgctgccatggccgtcacctactccgcgtccttggcgcttgccttggtcgcgcgcttggtggtggacttggaagccgtcttgcgggtggtggacttggcagtcgtcttgcgcttggcggtggacttggtgccggacttggcgcccgcggccttggtgccggactttgccgacgccttgcttgcggagccacggcccttggcctcggccttcttctgcttggcggggcagtccatgttgacgcagaggcgccacgggccgcgctgcgtcacgacctccacgatgggcgcgccgcagtcagggcagacctcgcccgtggcgtgcagctcgccgcgctgcggcagcgggtagctcgtgccgcactcgtcgtagttggtgcagcgtatgaagcgcttgccggtgcgctcgctcttgtgcgccaccaggtcgccgtggcggcccgccgccttgcacgcggcgcactcgcccacgatcacgtcgggctcgcggttggtggggcaggcggggttcacgcacagctcgtagggccgctgcctgaagggatgcacgcgcacgcgcggggcgtggcacacgggacacacgcccttctcgccctcgatcgcctggatgcggcccttgggcacggggtaggtcacgtcgcagtcgggccagcccatgcagcctatgaagttggagtggttcttggcggacgtcttgagcaccaggtccttgccgcacttggggcacacacccaccttggcgtcggccgtgacggcgtccgcgatggcctcgcccaggtccttctggtgctcgatgagcgggcccaccatgctcgcgaggagcgcgcgggagtggtccacgacctcgcgctgggtctcctctccctccgcgacctcggtcatgtcgtgctcgagctcggccgtcatgtccgggctcgtgatgtgcggcgcgtacttggtgagcgcctcgatcacggcgatgcccagctggctgggctccacggggtcgttgcgcaggtacttcacgtcgtacaggcgctggatgatgctcgcgcgcgtggacttggtgccaaggttgcgcttctccatctcctggatgaggcggccctggctgtagcgcgcgggcggctccgtctgcttggcgtcgaggttcatggtcagaacgtcgcaggtgtcgcccacctcaagcgcgggcagctgctcgtccttgcgcaggccaaacggatagatacggcggaacccgggcttgacgagcaccgtgcccgacgccgtgagcggctcgccctcggcctcgaagctgaacttggtgctctcgctcacggacgcctcggagagcgtcgccaggaagcgccgcgcgatgaggttgtagagcttccacgccgcgccgtcgagcctgtccgggtcggccgccgcggtgggatagatgggcgggtggtccgtcgtctcctgcttgccgcgcgttgccgtgagctttggccgggcgagaagatcgttgcacaccgcccggtagtttggcacggccgcgagcgtctgcacgcactcgcgcaggtcgagcgacttgggatagaccgtgttgtcgacgcgcgggtacgagatgaggccgtccatgtagagcgactcggccaggcgcatggtgcgtgccgggctgatgccctcccccgccgccgcggtctggagcgacgtggtgttgaacggcgcgggcggcttggtggtgcggctcttgcgctcgatgttggtgacggtcgcgaccttggcgtccttgaggtgggaccaggcgaggtcggccttctgcttgtccttgaagcgcgccgtggcgtgcgtcaccttgaagctgtccgcctcgtccttgtcacccgcaggcaccatcgtgcccgagatgacccagtagtcctccggcacgaaggcgtcgcgctcgcgctccttctgtaccacgagggcgagcgtgggcgtctgcacgcggccggcggagcgaacgttgcccaggccgccgcggcgcgccgtggtgaggtagcgcgtgaggacggcgccccagatgaggtcgatgtactggcgggactcgccggcgtcggccaggtcctggtcgaggtccacgaggttcgcgaaggcatggtcgatctcggccttggtgaaggcggagtagcgggccctcgagacgggcgtgtcgggcgcgacctcgcgcatctggcgcagggcgtcggagccgatgagctctccctcgcggtcgaagtccgtgccgatcacgatggaatcggccttcttggcgaggttcttgagggcgcggatgatgcccttctcggccgggagcttctcgatgggggcccagacgaggtacggcaggctgagcgggcgccagcccttgatgtccacgccgtcagcgaggaagggcttgcgcttgctttcgtagggcggcttggcgagcgaatccggcaggttggcgggcatgacctcgccctcctgcgagacggcccaccagccgtccttcttgctgtagtggagctcgctcgggaagtctggcgccatgatgtggccgcgcagaccaatggtgacccaatcctccccgtcgtgcttgaagcggtagacgggggtgtcgtacaccttgtctgccttgggcttgcccaccgtgcaaagcaggcgggctatctgctgggcagcgtcgttcttctcggttactacaagcctcaatctgtcccccgtaggccgtcgcgttagttcgtgcgcccgcacgaaattgccgtgcgaccgcgtcttgccgttatacccgaagggcgccttgcggcgcccgtaagtcggtaggttgcatcaaatactagaggtccgtcactttaccagaccggcgacccctaggactttgacatctcctcctcgtacttgtggtcctcgtactcctcgcgcgaccacttgagcgctgccttgccgtcgcgcgcaatgatcacgtagcgcgcgatgccgagggcgacctcgtacagggcgatgagcgccgcgaacatgaggatcatggtgacgggcgaggcgtcgggcgtgacgacggcggagaggaccatgaggccgacgtagatgtagcgccactgggcgcggaacgtcttgtacggcacgaggtgcagcaccgagaggtagaagatcacgagcggcagctggaacgcgatgccgaagccgatctcgagcagcatcatgatgttgaggtagtcctcggcgttggcgagcacgttggcgaagtcgatggactgatcgaccatccaaccgatggccgccttctggatcacgaggtagcagaagatcatgccgaggtagaacagggcaaccatggccgcgaccgtggggacgacccacttgcgctcgttcttcttgagcgcggggaggaagaaggccatgatctcccagatgatgattggcgagcagacgatgcccgcgaagaacatggcgatcttgaagcggatggtgaagccgccgaggacggagaggaccgtgagcctggtgccgtgcggaagcgcggagcggatggggtccatcatgaagtcgatgaggacgggcgtcgcgttgtagaggacgaccgccgtgatgatgagcgacaccacgatgatggtgaggcgtcgcctgagctcgccgaggtggtcggtgagcggcatgcgtgctggtccgatgggcattactcgtccctcccgtcagaggcggcgcctgtcggggcgtcagcgtcggagtcagaatcgaggtcggcgtcggaatccgcatcggaatcggaatcgatgtccgcgtcggagtcgacgtcggcgggagccgcctgcttggcatcagcgtcggagtccgcgtccgcgtcgctgtcggcatcggagtcggagtccgcggcctcgtccttctcgctcggctttgccttgcgcttgcccttcatggcatagagcgaggcgacgctcttgcggggctcgggcttggcgtcggagtcgtccgcgtcggagtcggagtcggcatctgcgtcggacgtggcgtccgcgtcggagtcggagtccgcgtcggagtcgaagctggcggatgcggccttggaatcggaggaagcctcctcgtcggagggcgcgttcttctcggcctcctcgcgctcgcgctcgaggcgctccctgcgctcggcgaacgtctcgcgcttgggggcgtcgccatcggagtcggagtcgaggtctgcgtcctcgcccatggcggccgcgcggtccgcgtgacgcttcttctcgtcgtcgttcaggggctcgttcatcgcgttgttgagcgggtccatgacctcggtctgcacgacctccgtgaagccctcctgcgcctcgcggaactgcctgagcatgcggccgatcgtcctgcccatgctgggcagcttgtccggcccgaagatcaggaacgcgaagatcaggatgagggcaagctctgtctcaccgataccaaacacgaaagcacacctcccagtgcgtctttgtggtcgagtgtgctactcgccgattccaagctcgccgctcacgcccagcatgtcgaggacgcgcgcgacgttgcgctgcgggttggagacggagaggctgaggcctgcgtccgccgcgcggtggacgccgcccacgaggacgccgattcccgtcgagtctatataagtgacctgggagaggtcgacctcgatggagggcgccttctcctcgagcgcggcatcgattgcgtcgcgcaggccggaggcgttggagacgtcgacctcgcccgagaccgaaatcttgctgccggtgtcagtcttgctggtggagacgttcatgttcttctcccctttgccttagttgctagtggaaagccccaggccgccgagcgcgccggaaaggcccgtgctgctcgagctggtgccagaggtagagctggtgccgctcgtggtgctcgacgtactcgaggcgctcgcctccgccttgatggccgcgaggcgctggttggcgaaggacttggcaccgtactcgtccttcgggtcggtcttcttggccttcttgtaggcggcctccgccgacgtggtgtcacccttggactcgtacacgagacccaggtttgcccaggccagcgcgcacttgggcgagtcctgcgtgatcttctgcagggccgcgagggcggcgtcggtgtcgccctggtagaactggcagagcgcgcggttgaccttgacggtgtccgagtcgttcagcttgaggtactggtcgtagtagctgattgccttgttgagcacgtccttcacgtgcgtctgctcggtgtccgtcgtggcgtacgaggaggcggagtagccccaggccatgtagtcgttgccgaggttgaggatcgtcgcgaggtcgtccgggtccttcttgagcttcttctcgagcgcggaggtcgtcttctggtagttggcgtcgattttcttgagcgaagtggtcgagctcgaactgctcgaggagtcgctggagctggaatccgaggagtcgctggagctggcgctgtcgctcgtggactccttgctcgagctgttggcgctgttgttggacgcgatggccgagcaggagggaagcatcatcgcgagcgccatgatcaccgcgaagatggcgatcacgatggtcgtgatgcgcttcttgcgctccgcgcgcttctgtgcgggggtcttggtgggagccgccttggacttggcagcgccgtccttctccgcggagtcagactccgtggacttgaccttggcatgcgcgaggcgcttcttgttgttccttcccgagctggacatcggtcagacctttctacagccacgccggctggcgcgggacaagacgagggtacgccctgtagcggacgcgaaagtccattctacagaaactcgtgggcgttctgtgtgtggccgcgcgggcaccggctctacgcgcgctccgccttggcaagcttggccgagacgagcttgaccgcgacgacgaagacgtcgagcgccttgccgaggtcctcgatcgaggggtacgtcggcgcgatgcggatgttggtgtcgttggggtcgtcaccgtacggccaggtggcgcctgccggcgtgagctttacgcccagctctgccatgagcgcgacgatcctgcgcgcggagcccttggggccgtcgaacgacacgaagtagccgccgtgcgggtgcgtccaggtggcgacgcccaggtcgcccaggccttcggtgagcttctgctccacgagcgagaagcgcgggcccacgatcttggcgtgctttgccatgtgcgccttgacgccgtcgaggtccttcaggaagagggcgtgcgcgagctgcgagaacttctcggagctgacgcgctcgacctggaaggccttgcggatctccttgatgtcgttcttgctggcggcgacgaacgcgatgccggagctcgggaacgtgatcttggccgtcgagccaaactcgtagaccaggtcctccttaccggcctccgcaagcgcgtcgaagatgttgaggaggtgatcctcctccgggccaaacgtgtggacgcagtaggcgttgtcccagtagatgcggaagtcgggcgcggcgggctcgagcgacgcgaagcgacgtacgacctcgtcggagtaggtgatgccggtggggttggcgtacttggggacgcaccagatgcccttgacggagggatcgccctccaccaggcgctggaccacgtccatgtcgggaccgtcctcgagcatgggcacgggcacgttcttgatgccaaggtgcgccgtcacgccaaagtggcggtcatagccgggggccgggcagagccacttgacctcaccctgctggtagaagggcttgttgcccgcgacgccgttggtgaagccgttggtcaccaggtcgtgcatgaggttgaggctcgaggagccggacacgacgacgttgtcagcgtcgacgcccaggatctctgccgcaagcctgcgcgcggagggaaggccctcgggcgtgccgtagttgtccacgatggcgttgccgtcgacgagcggcgtgctggagttgatgaggtcgagcatgggacgggagagcgccgtctgctcgggcgagggcttgccgcgcgccatgtcgagcgcgaggtgctcgtcctttagcttgtctgcctcggtctggagctggtcgatcgcgttgtcgagctcctccgtcgtcatctgttgataggcattagccatggttgctccttggtccaagtgtgcactggacagaaagtatatcgccacctgcacgtgatggttcatacggtaataatatgtcaagacacgatgcgcgtatgccgcgacagggcggcgcgcgcaagccccgcaaccaggcgcaagggagaagagcgatggcagactgggacgccacctacacggacggcaggcaggcacccgactttggggagctgcagtcgcttgtggacgagctgttcgcggacggccccgtcacgcgcgtgacaaagctggacgccctcgagcgcgcccagatcgacgacctgggcgaggacctgctcgaggtaatcgatcttctccccagcgggcactatgcccgtcgggcgctctgcaaccagctcaactcgatcatcacggcacacggctggggctacacgcacgggacggtctcgtaacccgagttgcacccctcgcccacggcttacagcatgcagttcaaatcgttctcgacaagcctccgcaggtagtcagagcggcgtatgccaagctgctttgcgcggcgatccatggcgcgaacgacttcgctcgactccttgaaagtcacctgttgcacaggctcctcaaacatgggagggcgacctggtccagtgacgctcgaaacggcatcaccctcaagctcgcctcgcgacgccttctcatcgacctcgcgtatcctttcggatgagatgccgaacatgttctcaagctctttagccgtcttcatagtctgtccccccttctccctcgaatacccaactccctcagaacccgtggttgaggtggtgtcattgcgtgaataatgagcgtcccaaattcctttacgatgccaaccatttgaatcgcaccagaagtatgtcttccgtaaccgattcttacgcattggtcttcacgtggagtttttcgaaattggcttctgacgaagttgttccatgcatacagaatctcgtcttcagagaggccgtgcttcagagcatggggatgcacatagatgttctgcacaggcctcacctccaatttcgtaacacgaattatatcacgaaatctgattcagtctaattgccgccgcccttacaaaagagcaatctaccaaccctacccgatgtcctccacctggtcggccatctcgtcctcggggtcgggctcgtcgtcaccgtcatccgagtcctgcccgcggttcatgatcgcgtcgtgcacgcgcacgaagacgatgcccagcaggccagccgtgatggagccggccagaatcgcgcacttggcgccgagcacctcctccgggttggggaacgcgaggcccgcaatgagaatggacatggtgaagcccatgccgcccatgatgcccacggcgatgatctggtcccagctcacgttgtgcggcagcttggcgaagccgatcttgaccagcagcagcgtcaccaggatgatgccgatgggcttgcccagcacggcgcccaggtacacgccctgcgtgacggggtcgtgcagaagcatccccaggtcaacgcccacaaggcgcacctgcgcgttggcaaacgcaaacagcggcagaatcacaaagttgacgggggtcgaaatgttgcgctccacgcgctgcagcggcggcgtcacgtggtgcatgatgtgctcgaccctactggcggccgccgtgaagtcgtgctggcccaggatgtgcgtggcgtcatcgtagtcgtcctcgagcttggtcgccttggactgcagccactcgcccaggttgcccagccgcacgtcggagcgcgacggcaggaagaacgccaggatcacgccggcaagcgtggcgtggatgccgctgttgtacatgcacacccacagcaccaggcccacgatcatgtacggcttggcggagtacacgcgcgccttgttaaggcaggcgagaagaacgaccaccacgagcgacgccgcgcaccaggcgatgtccggcgtctgcccgtagaacagcgccagcaccacgatggccaggatgtcgtccgcgatggcgagcgtctggaagaagaccttggtctcgggcgccacgcggtcgcccagaagcgacatgacgcccagcgcgaaggcgatgtccgtggcgatggggatggcccagccgtgcggcgcacccgcatggttgaagagcaggtagatgatggcgggaacggccacgccgcccacggccgcaagcatgggcagcgccgcctggcggggcttgcgcagctggcccacggtcatctcgtacttgagctcgatccccacgagcaggaagaaaatcgccatcaggaagtcgtttatgaagccctcgagcgagatccccacaaaggccgggccaatcctcagccccagcggcatctccaaaaactcgtgaaccgccccgtaggcgggcgagttggccacgatcacggcaagcagcgccgcgatgaccatgaccgcggcggccacggtgccgttcgaggtgaccttgcccagggccagccgctggtcctggcggcgcacgacggccggctcgcggatgatggcgctgcgcctgccgcggcggcggtccttctcgcccgaggcgcccgttacctgcgcgttcttggttgctgcgacgtccctttcccgaaccttgccctgtgtcatgagtaagaatctcctccaaagcgtgaacgagtggcggcccgccgcatggcgaggcccctaccaagagcatacggtacgccgatttgccgccggccgatttggaatccgactacagagcgtctccaacagtcaccgccgaacttctcgcccgcgtgcccgcgcacccgccttgggcgagaagaacgcccccgcgcccgcggagtttgtcggggccaagtatgcgagcgtgcggggaggggaactatagtaggtatgtccctgcttggggcgcgacgccgcacgccgccgacacgtcggccgatgcggacaccagacctcggaggcaacatgaacgaccagaggatcgcagtcatcacggattccggtacggacacgccggcagacttctgcaaggcgcacgacgtccgcgtgatgccgctgcacatcaactattccgacggcagcacgttccagagcggggtcgacatcacggcggacgaggtggtccgccgcctggagaaggagatcccgacgacgagcctcccctccccgcaccagatccaggccgcgctcgagcaggccaaggcggacggctaccagaaggccgtggtggtcacgatcgcgtccgcactttccgccaccaaccagacggcccacatggtcgcaagtcagatggaggacttccccaccctggtgatcgacaccaaatccatcggcatggtcgcgggcatggtcgtggagcgtgcggtggagctggtggagaagggcgtgccctttgaccagctggaggccaggctcgacgaggtggccaggcagtcccacgtgttctttgcggtcaagtccctcgactacctgtacaagggcggccgcataaacggtcatatatatcgcataggctcagtcctgaacatcaagcccgtgctcacgtgcgacgaggacggctactatgccatcgccaagaaggcccgcggctgggaccgcgcgctcgacaccatggtgagcctcgcgtgcgagaaggcccgtgcctacaagagggcgcgcctggccgtgtgctgctccacggcgacctcggccctgtacaagccgctggaggaccgcctgcgcgacgcgctcgacaacatagagagcatccagcggcacgacctctcggccgacctgctggtccacaccggaccggacatggcgggcctgggcgtgcagaacgcggagctggcctagcaagcaaacccggcgcacgccgccccacggccacggcgccacaagacggcgggaggccgtatggagaaggacatgcagagcgacgttcgcgaagacatctgcaaggtgggaaggctcctgtacgaccgcggctacgtggcctccaacgacggcaacatctccgtccgcaccggcgaggacgagctgatcatcaccccctccggcgtgagcaagggccgcatggaccccggcatgctcgtgcgctgcgacctgcagggcaacgtggtcgcgggcgatgcgtcaggccgctttccctcttcggaggtaaagatgcacctggcggtctaccgcaaccggccggacgtgcgcgccgtggtgcacgcgcaccccgtatacgcgacggccttcgccatctgccggcacgcgctcgaggagccgtacctccccgagctcatcctcaactttggcaagattcccgtggcagacttcgcgatgctctctacggacgaggtccccaacagcatcctgccctacgtgcacgactacaacggcctcctgctcgcaaaccacggggccgtggcctggggaaaggacgtctgggcggccttcgacctcatggagaccatcgagcacagcgccaagatcttcaaggcagtgcacgacctgggcggcggcgtggagctcacgcccggccaggtggaccacctgcgcggcatgcacgagttctatcgcaagcgcgcctcgcaccgcgacgacgacgcgggcaccgcaaacagcagcaagaacaaaggcgaataggagaagaacgtggcaactaacgaggaagacggcgccgtgacggcaggctcccccgaggccgcagccgcggccaaggcgggcgcgagcgcgtcgacgggcgtcacgaacgtggacgccgtggagctggcgcccgagggcgacgccgtggtcattatcgaccagacgctcctgcccaacaggctcgagcacatccgcctcaccacggcggagcagatgtacgacgccatcctcaagctcaaggtgcgcggcgcaccggccatcggcgtgtgcgcgggctactgctactacgtgctcgcccgccaggaggcgcagcgcgccagctcctatgacgacttcgcctccgccatggacgcccagcgcgcctacctcaactcctcgcgccccacggcggtcaacctctcgtgggcgctcaaccgcatgcacggcgtgacgctcgcgcacaagggcgaggccccagccggcatcgtcgaccttctccacaaggaggctgtggccatccaccgcgaggacctcgccatgtccgaggagatcagccgtctgggcgcgagcctcctcaacgatggcgacggcgtgctcacgcactgcaacgccggcccgctcgcgtgcctgggctacggtacaggccaggggccgctcttctacgcgcacgaccacggcaagaccgtgcacgtgtttgctgacgagacgcggccgctcctgcagggcgcgcgcctcacgagctacgagctccagcgcgccggcatcgacgtgacgctcatctgcgacaacatggcgtccatcgtgatgaagaacggctgggtgcaggcctgcatggtaggctgcgaccgcgtcgccatgaacggcgacgccgccaacaagatcggcacctccggcgtggcgatcctggccgcgcactacggtataccgttctacgtgctgggacccacctccaccatcgaccagggctgccccaccggcgacgacatcaagatcgaggagcgcgacccggacgagatcaagaccatgtggtacgcggagcccaaggcgctgcccgaggtcaagtgctacaacccggccttcgacgtgacggaccacagcctgatcacggccatcatcacggagaagggcatctgccgtcccccgtacacggagtccctggcagccctctttaggtagcgcacccgtcgccccgcgcgacggtacataaaacgagaaaggaatcgcatcatggcagacctcccgcaggcagaaatcggcatctttggcggctcgggcttctatagcctcttcgagggcgactacgaggaggtgtccctcgacacgcgctggggccagccgtccgacgtctacaccgtgggcaccatcgcgggtcgcaaggtcgcgttcctgccccgccacggccacaagcacacgtttgcccccggcgaggtcaactaccgcgccaacctctggggcatgcacatgctgggcgtcaagcaggtcatcggcccctgctccgtgggatcgctctcgcttgacatccaccccggcgactttgtggtatgcgaccagttcgtagaccgcaccaagggccgcgcggacacgttcttcacgcatgacctgggcctgggcgtgcagcacctgcctggcgccgagccctactgcgcagagatgcgcaaggtggccgtcgactgctgccgcgagctgtacatccccgtgcacgacggcggcaccgtcgtcaccatccaggggccgcgcttctccaccaaggcggaaagcgagtggttccagaagatgggctggagcgtcgtcaacatgacccagtaccccgaggcgtggctcgcccgcgagctgggcatgcactactgcaacatcagcctggtgaccgactacgacgccggcctgggcaagtacgcggccgtcaccaacgaccaggtgctcaaggtcttcaacgagaacctgcacctcctgcgcgagctcatcaataagatggtgcccgccctgcccgagcagattgacgacggctgcaccgcctccgccccgctcttcgacaagctggcgtaggcagcgccgcaggcatccgcaaggcacgacgcatcaggcgagaaggacggctcacccaaggtggccgtccttctcctttagtacgcgacgcgtgcccgccggcctgggggtcgcgctcctcgacgcaaaagtgcgacgatgcgacaagacgtccgtcgcatatgcgacataacttgcgtcgcatatgcgacgctgatatcatcgcattgtcgcgtttgcatcgaaaggcgaggtggccatggccataccggttgacatggcagagctcgtaaacgggacgaccgtcgaatccactcgcatcgagttcaagaccgacttcaatcccgagcccatcgtccacaccatatgcgccttcgcaaacgacatcgacaacatcggcggaggctacatcatcatcggcgtggaggagagggactccgttccccaactgccgcccaggggcatcccaaagtcccgcatcgaccccatcctcaagaagctcgaggggttctgccactgcatcgagcccctgtaccaacccatcgtcgagccacggctccttgacggcaagtacgtcatcgtcatctggtgccccggcggcttcggccgtccgtaccaggcggccaagaacgtgtacaagaacacctcggacaagcgctactacatccgcaagatggcaagcacggtcatcgcgtcgccccaagaggagcgcgagctgttctacgtgtcgtctgacatcccgtttgacgacaggccaaacctgacggcgagcccggaggccctcagcaaggagcgcatgcgcgactacctgcggtccgtcggaagcgcgctctatagcgactccgaggggctaacgctggaggagctggcaaacgacctgcagctcctgtctggcccgccagaggaccgccacccacgaaacgtcggcctcctcatgttttcggatcacaccgagcgctacttcaggtacgcgcgcatcgaggtcgtggaccttcccgaccccacgggcgagggcatgacggagcaggtgttcacgggtcccatccaagcccagctcaaggacgccctcctcttcctgaggaactacgccatcaggagcatgaccttcaagaggcccgaccaggccgaggcggtcacggtgttcaactacccctacgccgccgtggaggagatcctctccaacgccgtgtaccaccgctcgtatcagatatccgaacccatcgtggtccgcatcacgccggagtcgatggaggtcacgagctatcccggcttcgaccgcagcatcacggacgacgacatcgccaacctgcacatccagtcacgcatctaccgcaaccggcgcatcggagacttcctcaaggagctccacctgatcgaggggtgcaacaccggcttccccacgacgttcagggcgctacggcagaacggctcccccctgcccaggttccacatggacccagcgcgcagctacctcggcgtggagattcccgtgcacccggccttcgcgccaaccgacaagcagggcgagaaggacgacgccctcgagcggcagatcatggctcagctacaggaccatcccctactgatgtccgagctctcacgccagttgggatacaagagcgtgagcaagcgcctgcgcagggtcgtcacggccatgctgggcgacggcaggctgtcagccgtccacgagggtgcccgcgtccgctacacggccacgaagtaaagagctgcccctgtccccacacgtgggacagggacagtcgtattgctgacacaaacccgtatgggccgatacccggctcgctcctacgccaggtgggccaccatgtggcgtacgatcctggcgcagtgctcggcggccttcgcctcgaacacggggtactccacctcggccgagccgtccgccttgtcgcttatggcgcgcacgatcacgaagggcacgccgttgagccacgccgtctgcgcgatgctcgcgccctccatctccacgcagctcgcatcgaactccctcttgatgcggtccttctggtcctgcgtgcgaacgaactggtcgcccgaggccacgcggccctccacgcacgccacgtccggcgccgccgcgcggacggcctccacggccgcggcgcgcaggcccgcgtccgcagggaagaacctgatgcccaggctgggcacctcacctgtcgcatagccaaagttggtcgcgtccacgtcgtggtggacggcgtccgtgcttacgagcacgtcgccgatgttgaggcgtgcatcaagcgagcccgccacgccggtgttgatgatgcggtccacgccaaagcggtcgatcagcacctgcgcgcacatcgcggcgtcgaccttgcccacgccacagcgcacgaccgtgaccggcgtgccgccgatggtcccgtcgtcaaacaccatgccggccaccgtcgtggtggtcccatcctgcaccgcgtcgcgcaggtggcgcacctcgacgtccatcgcgccgatgattccgatcttcatgcaatcctccaggtagtcgtagtggttgggacgcccgcgccgggcgccgttgggtcgcggcagctagcgcgagggcacgaccttctcgcccgcgtcgtccccgtccgcgatcgcatccgcaagccagggcctgccctgcagcacgcgcgccacgcgatcctgcgctgcggagaaggtcgcgtcctccttcacgtgcacccacaccgtgccgtgcgtgccgtaggcgtccatgccggtaaagctcacgcttacctcgtacgcggggtcggccacgccctcgagcgccaccgccacgtcgcgcgccacctcggccgtcacggcggaaaggtccgcgtccgggcgagccaggaagtcgacgccgcagctgcccgccgaggaggcgctcttgcgcgtgaacgccgtcttgttgagcacgctgttggggatgatctgctggtttcccaggcggtcctgcaccgtggtgtggcgccagttgacgtccgtcacgaagccctcgaacccggcgacctccacgtagtcgcccggctggaccaccttgcccagcatgagccccagcccgctgaacacgtttgacaccgtgtcctgcaggccaaacgacagcacgacggacgtgacgcccagggcggccacaaaggccgtggccttgatgccaaacacgggatccaacacggagagcaggccaaacgcccagatcacgccgcggatgatgttcacgaagatcgaggccgagggtatggacgaggcgtccagcacgcgccgggttacgcgcgtgacgccgcagtccaccagcgccgtgaccgccatggccacggcaaggtagaccaccctccccaaaagatcgttccagtccatgggcacgtccccccgctagctgatcttgacgatgggcgcgaagcccttcatgagcttcttggtcttgcccgtgcgcgtgaagtacaccgtgatggtgtcgccctgtgcctccttcacgacgccggggccaaacgtcttgtgcgaaatctggtcgccgggcgcgaaggtctccgccgccttcttgcggtcggggcgcatcgccgggcgagaagagccgggcaccgtgcccgagccgccgtgcccgcccagggtcgccttggaccccgtgggcctgccgggccaggtgggcaggcccgtgtcctgcggccggccgccggtcgagcgcgtgtgactgccaaacacgtgcccgccatagacctcggacccgcggcccgagccgtacgtgccgtgacggtcgccgcgcttctcccatcccacgccgctgaagccggaggagcccacgccgatggcgtccacgtcctctgccggaatctcgttgaggaagcggctgcgcgggttggtctgcacggagccaaacatgcgcctggtgacggcatacgtgaggtagagccgctcctccgcgcgcgtgatggccacgtaggccaggcgccgctcctcctcgatggactccgcgtcgccctcgtgcgcgcgatgcgggaagatgccctcctccatgccggccacgaacacgacggggaactccaggcccttggcagagtggatcgtcatcatcgtgacggcgctcgactggcccgcgagggagtcgaggtcgctcctgagcgcgagccactccatgaaggccgggagcttctgcgccgcgaccgggggcagggcagcccccgcctcccctgtgggctcggcgctcggctcctgcgtcgcctcgctcgctcgctgcgctcgcgactcgccctccggggagccggcggcgccctgcgcaccctgggcgtccagcgccccggcctcgcgcagctgctccaggctctcgagcgtggccacggcgtcgtcgtgcgtctcgtcaaactcctgcgcgacgccaaagaactccttgatgttctctaccctgctgtccgcctcgacggtctgctccgcctcgagcgcctggataagccccgtgcggtcgattatcatctgcaccacgtccgccagctcgccgtcaaagtggcgcgccgcctcgatggcgttggtgaagcccgccagcgcgtttctggccttggccccaatgagccccggctccgtcacgcaggcctccgcggccgagaagaacgatatgccgtgctccgtggcatagttcctgatgcggttgaccgacgtggtgccgatgccgcgccttggcgtgttgatgacgcgcagcgcgctcacgtcgtcgtccgggttcaccacgagcttgaggtaggccatcacgtcgcgaatctccgcgcggtcgaagaacctggtgccgcccacgatcttgtacggcacgcccgcgcgcaggaacatgtcctcgagcgtacgcgactgcgcgttggtgcggtagaacacggccacgtcgtcgtagctcgtgccgtggtcgtgcagcttctcgatctccgagccgatccagcggccctcgtcccgctcgtccgccgcctggaagaccttgatcttctcgccgtcgccacgggtcgtgaacaggcgctttgactcgcgcttggagttgttgcgcaccacggcgtttgccgcgttgaggatgtggccgtacgagcggtagttctgctcgagcttgaccaccacggcgtccgggtagtccttgcggaagctcaggatgttcttgatgtccgcgccgcgccagctgtagatggactggtcgtcgtcgcccacgaccatgaggttgcggtacttgcgcgccagcaggttggtgatcgcgtactgcaccgcgttggtgtcctggtactcgtccacgctgatctggcggaagcgctcctggtagtggtcgagcacctccggctccttgctcagcagctcgaaggtcttgaccagcaggtcgtcaaagtccatggcgtttgcgcgggccaggcggcggtccagctccatgtacacgcgggccgcggcgcgctccacgggcgactgcgcctgggagctcatctcctccgcgctgacgagcgcgttcttggcctggctgatcttggagcggatggccggcagcgggcactgcttggagtcgatgtcgaggtcgctcatgatgctcttgaccaggcgcttcgagtcatcgtcgtcgtagatggtgaagtttggcttgtagcccaagaggtccgcatcctcgcgcagcatcctcacgcacatggcgtggaacgtgcagatccacatgccgcgcgtgccaccgggcaggagcctgcccaggcgctcgcgcatctccgccgcagccttgttggtgaacgtaatggccagcacctgccacgggcgcacgccctcgtccgcgatcatgtgcgcgatgcggtacgtgagcacgcgcgtcttgccggaccccgcgccggcaagcaccaggagcggaccgtgcgtgcactcggcagcctggcgctgctcgttgttcaggccgtccaggtcgacctttggggtcgcggggacgggcgcgggcgagaaggacgcggcgtcctgataggcggactcctcctcaggctcgggcgcggcgccataggcgtcgagcggcaccaggtcgggctccggagcctgcgcggaggcgggctgcgccgccgcgccgccgggcgccggctggccgcccgctagggaaaagagggattgttgctggtcaaagggcatgtacttctcctatagcctcattgttgtaccgaaagagtctaacgcaggttccggacacaaagccctccgctgggagacctccgcacgaacgctgcaaggccgggcgggggtcgcgcgcgctgccttgcggggcgatggacggccgtgcaggcaaacgctatgattgccgcactggccgcacgcccgatgggagcccccatgaagatgagcaaaaagttctgcaactgccgcgacgtgacctacgcggacatcatgaaggccatccgcggcggggcgaccaccgcggacgaggtctctcgcgtgaccggcgcgggcacgggatgcggcaggtgccgcgaggcgctggactacgtggtgcgcgacttcttggaggagttccgcgcggagtccgaggggacgctcgggatctaggcggcgtgccgcttcggcggcctcgcacacatcctgccggggccgcacggtaccagacaattggcaaatcatccttctgacgcttgacagtgccaaaggcagatgcaacactgtcatcagtacttatgaactattgctcatgtgttcacttcatactcaagttcgcgtaagcagacctctggggtaaagggaaccggggcacaggccaaaggagacgccatgtcctgcaagtgctgcaaacacgacgacgaggagctcgagtcccacccgggcgcgccggtacacggcgacggctgtgattgcgacggctgccacgacgcggacgtcgagccggaggatgaggacgaggatgacgacgatgacgaggaccccgccgtcctcaagaggaagatcgcactttccgctgtcctgctggtcgcggccgtcgtggtgaacgacctggtcgcgcccggcctgccgctctgggtgcagctcgtcacgtacctccccgcctacctggtggcgggcggcagcgtcctcaaggaggccgcggagtccgtcgcgtccggccacccgtttgacgaggacttcctcatgtccgtggcgaccctgggcgcgctgctcatcggctttgtcccgggaggcgagccccagtttgccgaggccgtcttcgtgatgctgttcttccaggttggcgagctcttcgagggcctggccgaggaccgctccaagcgctcgatcgcggacctcatgaacatccgtcccgacgtcgccaacgtggagcgcgacggcaaggtggtgagcgtcgaccccaacgacgtgcgcattggcgaggtcatccaggtacgcccgggcgagaaggtcgcgctcgacggcgtcgtgaccgagggcgagtccagtctggacaccgtggccctgaccggcgagagcgtgccgcgcgacgtcaccgtgggccaggaggtcgcatccggctgcatcaacgtgtctggcctgctgcgcgtccgcgtgaccaaggcgtttggcgagtccaccgcgagcaggatcctcgacctcgtgcagaacgcgggcaagagcaagtcccggtcggaaaacttcatcaagcgcttcgccaaggtgtacacccccatcgtggtgtacctggccatcgccgtcgccctgctgccgccgctcttctcgggcgactttgccggcacgtttgccacgtggctgctgcgcgcgctcacgttcctggtcgcgagctgcccctgcgcgctcgtgctttccgtaccgctgacgttctttggcggcatcggcggcgcgtcccgccgcggcatcctcgtcaagggctccaactacctggaggcgctcgccaagaccagggtcgtcgtgttcgacaagacgggcacgctcaccaagggcacgttcaaggtgacgcaggtgcactcgaccgacctttccgacgagcagctcctgcacctggccgcccacgtggaggcaagctccacgcaccccatcgccgcggcgctgcgcgaggccttcccctgcgacggtgacgactgcaaggtatccgacgtgaccgagcgcgccggcgagggcgtcatcgcgaccgtgaacggccaccgcgtcgccgtgggcaacgaccgcctgatgcagacggtgggcgccacgcccgtgacctgccacacgctgggtgggaccatcgtccacgtggcggtggacggcacgtacgccggccacgtgcacatctccgacgaggtcaagcccgattccgcgcaggcaatcgcaagcctgcgggccgagggcgtcgccaagtccgtcatgctcacgggcgaccgcaagcccgccgcggcggccgtcgccaaggagctgggcctggacgagtaccacgcggagctcatgccgcaggacaagatcgcgcaggtggagcgtctcatgggcgagaagggcgaggacgccacgctcgcattcgtgggcgacggcatcaacgacgcgccggtcctggcccgcgcggacgtgggcgtggccatgggcgcgctcggctccgacgccgcgatcgaggcggcggacgtggtgctgatggacgacaagccctccaaggtcgccgtcgccatccgcatcgcacgcagaacccttgccatcgcgcgtcagaacatcgtgttcgccatcgcggtcaaggtggccatcctggtgctcgcggtcttcggcctcgcacccatgtggctcgcggtctttggcgacgtgggcgtgatggtgctgtgcgtcctcaacgcgacgcgcacgctcgcggcaggctccagcaagtagcagaatccgttggcagaggctccgcccgcccgactcggtgctcagacagcacgccttcggcgtgaactgcgcccgagtcgggcgggcggagccatgtcgagggccgtttgcagttggttgccggcacgtggccaggtcgacggtgccgcagcctctacgccaggttcgtcacgacccagagcagcacgttgaccgcgagcaccacgaacgtgatcgccgtgaacgcgcgcttgcgcagcaccacgtatgccacccactcgcgcacgagcgcgttgagcgagaagtacaacctcacgtgcgcgccaaggccatcggccctcacgccggcctcgcgtgcaagcagcagcgcgcggaacacgtggtagtcgtcgctcaccacgaggatgcgtccttctcccctgggcccgcgcgcttctcccccaccagtcgcggtcgcgcggatgaggtcgcgcgagaagcggatgttctcgcgcgtgttgcgggagcgctcctcgcagaggatggcctcggcgggaacgccctgcccgagcgcgtagtcgcgcatagcgctggcctcgctcacggcctcgtccgggccctgcccgcccgacatcacgatcctggagcccgggttgcgccgccacgcccagatggctcggtccacgcggtgcgcgagcagcggtgtcacacgtcggccgtcgatgagccccgagccaagcgccacaatgtagcgatagcgcctcatcgggtgcggcacctgcgccaccaggccgctcaccgtgtagagcgcaaaggcgacgcccgccacgccgatcaggcccgccgagatgccaaacagcaggtcaagcacgcttcccaccacgggcagccccgtcaggcgcccgcgcagcagcggccacaccagcacataggcgaccatcgccacgcccagtcccagcgagagcaggttggccggtcgcgcgccctcgcggcggatcagccgcacgcccgacacgatgagcgtcaccacgagcaccgctgggaacgcgagcagcatgacgagcaggatccccatcacgacgaggttcgccgtctgcgcgaggggatggtcgcccagcggcaggtagcccacaatcagcacctctatcagcaccaccagggacgccgccccggccagcgcccagaagccaagccagagggtgcgctcctctcgcacgcgcacgatggcaaacgccaccggcgccacgcagagaagtgctatgagcaagggaaatacagggtctgacgtcaaactttccatttggcccctcagaattgatggctaatcgtgcccgattatatgacgttgccccgcccgcccgactcgggcgcagttcacgccgaaggcgtgctgtccgagcaccgagtcgggcgggcgggaaattggtgacattcgtcatgtggcgcgggtgcgtcggctgggctacattagagcttcgacagcgcggggcagggagcccatcgcgcttgtcccttggaaggaggcgcgatgcacatcccagagaactacctgagcccgcagacctgcggcgtgatagccgtggccatggtgcccgtgtgggtgcgcgccgcccggcacatgcgcgaggaggtcccccgccagaagatgccgctcgtgggcgtggccgccgcgttctgcttcctcgcgatgatgttcaacatcccgctccccggcggcaccacgggccacgccgttgccggcacgctggtggccatactcttcggcccatggacggcctgcatcgccatcagcatcgccctcgcgatccaggcggtcctctttggcgacggcggcatactcgccctgccggccaactgcctcaacatggccttcgtgctccccatgtgcggctacgcggtcttctcgctcgtgcgcaggcgccaggcgcgccatgcgggcgagaaggacggcggctccgggtcctcgagccttggccaggagcttcgcgccgccggcatcgcctcgtacgtgggcatcaacgccgcggcgctctgctgcgccctggagctgggaatccagccgttgctctttcacgacgcggctgggcgcgcgctcttctgcccctacccgctctgggtgagcgtgcccgccatgatgattggccacctcaccgtgtggggcgccgcggaggtcgtcttcacggtggggatcctgggcttcgtgcggcgcgtcgcgccggactttggcctcgcgcgctttggcgggacggggttggcgggcgccagcgacgacgtgggcgcgcagccggctcccgtgcgcaccgtgcgcgcggcggggccggtgctcggcctcgtggcggcgctcgcaattgcgacgccgctgggactcatcgccacaggcgatgcctggggcgagtggtccacggcagacctcgccacgcgcgtgggatacacgccctcgggcatggcacgcggctgggagtggtcgtcgctcatgcccgactactccctcggggcgcttcccagctggctcggctacgtgctgagcgccgtcgcgggagtctccctgctgctgatagccttccgcctgctgtcaggcgcatccacgcccaaggtcgactttggaccgcgtgacgatgactagcccgcgtgacgcgcagatacccgcttggctcacgcagggcgagagctacgatcccccgcgggaccacgacggcttcctcaccaagagcctgctctcgctcgcgggcgtgctcgcgcgcatgcgcctggacgacggccagtcaaccccggtgagtccctccaccccgctcaagctcgtgctgggactcggcctcatcctgctcacgtcgctttccggcaacttcgccttcgtgctggtggtgctctgccttgccctggcgagggccgcgcttctccccctgcgcgcgctgcgtcgctccatggccgtggcctgtgcggcggcgggcctcacctttctgctgatggcccccgcgctcctcctgggccaggcgcactccccgctcctgctgggcacgaaggtcctcaccacctgcctcgtggccatgggggtcgcactctccacccctgccgcacggctcacgcgcgcactccgcacgctccgcgttcccgcaacggccatcctcacgctcgacctcgcgctcaggagcatcgtggagctgggtcgcaccgcgtcagaggtgctcgtggcactgcgcctgcgcagcgtgggacgcgaccgcgacaagcgctcctccatcgggggcgtgggaggcgtgcttcttctcaaggcggggcgctccgcggccgacacggccgatgccatggcctgccgctgcttcgacggcacgtaccaggcggcgcccgacgccacccgcccgcatgcccgcgcggtggacgccgcgtggctggcgggaggcctcgtccttctcgtcctcttcttctacctgcagggactggtatagatgcatggcaacgtacacccgctgggactccaccatccgcacgccggggactctcgcccaccgctcatgcgctttgacgacttctgctttgcctacggggacaggccggtgctgcgtcacatcgacctctccatcgacgcgggcgactccgtggtgctgatgggagacaacggctcgggcaagtccacgctgctcaaggccatgagcgggctcgtccacccgcaggttgggacgtaccgcttcgacggacaggtggtggacgcggcatccatgcgcgacgcggacttctcgcgccggctacaccagcgcgtgggcttcgtcttccaggacagcgacgccatgctcttcacggcaagcgttgaggacgaggtcgcgttcggtcccgcgcagatggggctgcccgccgacgagcagcgacgccgcgtggacgactgcctgcgcctgctggggatcgaggacctgcgcgaccgcgcgccgtacaacctcagcggtggcgagaagaagaaggttgccatagccgcggtcctggccctcaacccggacgtgctctgcctggacgagcccatggccgcgctcgacgcacgcacgcaggagtggctgctcggattcctcaaggagctcaagcgggccggcaagacgctcgtggtggcgacgcacgaccagtcgctcgcggacgagcttgcggactactttgtctacatgggcgacttccacggctacgcggaccgtccgcacgtgcacgtgaacgagtagcgcaggcgagaagagcgcggcggacggccccgatgcccgggtgccgtccgccgctcttctcccctagatgggttttcctggtcagacgctaggcgtcgagcctcgcgtagaacgagtgcaggagctccgccgacttctgcagcgcggagagctcgtcctcctgcaggccgatctccacgatctccttggcgccggtgtggtccaggatcgtcgggacggacaggtaggtgccgttgatgccgtacatgccgtccacgtagacggagacgggcatgatgcgcccctcgtccaacaggatcgacttggcgatggacgtcacgctcgcgccgatgccgtagcaggtgttgcccttgcggctgaagacgtcccagcccgcctggaccgtgcgcttgcgcaggtcctcgagcgtggtacccttggtgcggggcgcgttgtcgcgcagcacggcgtccacgcgcttgccgccgatggtcgcgctgttccagctcacgatctcggagtcgccgtgctcgcccaggacgtaggcctcaacgctcgcgggcgcgaggtcgtacatgtcggaaagcgcgcggcacaggcgcgcggtgtccaggttggtgccggagccgatcacgcgctcgcgcggcaggccggagacgcgccacgtgtagtacgtcatcacgtcgacggggttggacaccacgatgaagatgccgttgaagcccgaggccatgaccttctccaccacatcacgcaccacgtggaggctcggcttgagcatctccaggcggtcgttggagtccttaggcatgggcgccgcggcggtgatgaccacgatgtccgcgtcctcgcactcgccgtagtcgccggcgtggacgtgcatgttgcggttcatgaagtacacggcgtcgcgcatgtcgagcgcctggccctccgcgacctccttgttgatgtcgatgaggcagacgtcctcgcagagaccctggctgacgatgctgaacgccgtggtggagccgacgttgcccgcgccgacgatcacgaccttggagttcctgaagctcatgtgcgctcctcgctggttgagtccttccgcggcgagccgcggccgcggtcatggttgcacaacgcagcgcgctcgcacgaaacattttggagacagcctgaaacagcgcagcactgtcacaaagcaggcgagaagaacgaggcgcctcgctcgcggcaccaacgtcagagcgtcaggatgtagcgccgcgtgggactcgtggccgcgcctggcgtgacggagaccatgccccgctgcagcagccgccgcagcaccttggcgaccgtgctccggccaagtccggcgcgctccgcgatctcggacgtccgcgccgggccaagctccccaagtgcggaaatgacggcgccctcggtccccgggaagcccgcaacgtcctggtgcggcctcgcccccggcaccgccccggcctcggcggcatcgcctgcgccacgcctccgcatcacaatctggaagagcgacggcctgtccgtcacctcgggcccgggcatgccgctcgcagcgagctcggacctgatgagggcaaatccggtccccctgttttccgccacgtacccgccgtcctcgtagggcgtggtctcgagcagcgccgcaagggacgggttcctcgtggatgacgcgccgacctcgccgagcgtctccacggtcacggcgccgtacagcccgccggggctcagcacctcgagccggtcctcgtacaggttcacctgtatctgcgagccgcgtcccatgggcgagtagtcgcggtgcatgagcgcgttgcagacggcctcgcgcaccgcgtcgagcggatagtccggccgatcgtacctgagcccgccctcgagcacgccgccgacgcgcatgttcctgcgcaccgcggcaacggtgtccaccaaaactgcggggatcggcccggccatgctctgggagtccagaaacttgacgctcccctgcggggccttgtccctcccgggaaagcacgcgaacgtgacggtgagccgcggaaagaagtgctgtggatacgtgcccagggccagcagccccgcaagcgtgacgcagttccgcccgtccttccgcacaagcacgttgagcgcacgcagggcgtcctcgtcggaaagccgcgcgaatatccgcgggtgaatctcccgctgcctgcggatcacgccgctcacgagtccctgatccaggtcgtccagcgtggcgccctccacaacgtccaggtcgtggtgcggctgcgttcgctcctccacgagccggtcgacctcgtactgcgtaagcagccggtcgccgtcacccgtccggataaatgagccccggtacatgccccgcgagctgacgtagcagggcttctccgctggcagaagctcgggaatcgtgcccacgaccacctgtccgtcctcaaagggcacctgctcgacctccgcgcgcacgggaggcgtgaggtcgtccgcgcagagcctcgcaagcgcgtcggcgcgggcacgagcgtcgaaccccggcaccggcgcaaagccgtgcttttccgacaggccgagaaggacgaggccacccgagccgttggcgagtgcggagaccgactcccccatcgacttcgggagcccgccggccgcctccttcacctcgacgcgctgcgagtcgtttccggacagccgaagcgcctcgacaacctttgtcaggctcttctcgtccatgcctccccctccccacgcgaaggacaatctactgtccagtatacccactactctctccatagagacagttactctctacgtactgtctctctactatctttcacatctctttattgcaagacacgtcagcccaagcgccacgtccttctccccccgccacgcgtggcgcgatctgatagcacgttggcgcgtgctgatgttctttggcacgggcggctcccgtactctcttcatcgtcaagagagcggcggccacgggtgccgcacggaggaaagggacccacaccatgcagaacgcaagcctcaagaacgcggcactcgtcaccggctcctacggcgggctcggcacctgcttcgtgaacatccatgccggaaagggcggcgactcatcctggtcggccgcagccagaagaagctcgacgcccaagccgagcagatgcgccagcgctacggcgtccaggccgtgggcgagctggcgcctggcgtggacgccgcgtccgcgctgatgcaggaacctcccgagggcacgtccttctccaccttcctgggatgcgagccaaaggccgggccgcagaacgcgctggccttccgctcggaggacatggacgtcccctttgtgagccacaacgatgccatgtggggctacttcgagcccgaactggggcgtcgcctggccaagcactacctcaagaccacggccatgggaaccgaccagatcgcctacctgctgggatacctggagctcaacagcttcttgcgggcgttcagctcgtggtgcgacatgagcccgagcgagtggcgcaggcgcaacgcgtagggcgggcggcgctaactcataataagaacgctccatagtatgagttattcgctaagtcatactatggagccgcggctcgcctgctcgcctaccccttgtgccacggcgcgcggccgttggccacgttgaggagcacccgcgccattcccgcggacaaggcaccacccgagctgttgaccagcccaaacaacgcgcagcccgcgctggacatgatggacatgcggcactgcgggtcggtcttgtccttgtagccgcgctcgacggcggccttgatctggcccgcgacaaagcggcagacgccggaggtcctgcccatctccagcagtgagtccgtctcgtcgtaagtgcccctgctgtgatgtgcctccggcgggatgggtcggccgagaagtgcctggaagtcctccctgcccggcttgccgtggggcgcgacgtaccacgtgcccgagagccttgccgggcgcgcgatgcccttgccggagaccgcgagctcgcccgcgagtcgcacgtcctcgaccgaggccccaacaaatacctggtagatgccgccaatcgtcttccgcgcgccgtcccacacggcaaacgccgccgtgtccaggggcacgctcacgcgcttcgtctggccgggggccagctccacgcgcgcgaagccggcgagcacccgcgccggtcgcggcagcccgccctcgggcgcgcccacgtagacctgcacgacctccgcgccggcgaccgcaccgacgttggtcacgtcgaagctcgccgtggcgccgtggccgcggccgtcgcccgggtcaagctccaagttggcatacgagaagctcgtgtacgagaggccgtgcccaaagcagtgcgccacgggcacgcccgccgtctggtagtagcggtatcccacaaagacgccctcgcggtactgcgactggcggtgcggcctgccccaccagcccatgcagggggcgtcgtccgccgtgagcggccaggtctcgggcaggcgcccggacgggttgaccgcaccctccagcacgtcgaccgtcgcctccgcgccggcctcgccgcccaggcccgcgtacagcaccgcggccacgtccttctcccacggaagctcgacggggcttccgcactgcagcaccaccacggtgttggggttggcgaccgccacggcctccaccaggcggttcatgccctcgggaaggcgcatgtcgtcgcggtcgtagccctcggactccacggtctcgggcaggccgcacaccaccacggccacgtccgcgccgcgggccgtgcgcacggcctcggccaccagcgcgtccgtggtggcgccggtgcgtgcgtcgtagccggcggcataggcccagccgggacgcagcccgcggatgctgctcacgtggcgcgcgttgatgtggctggagcctccgccctggtagcggggcctgtccgccatctggcccaccagcgccacgctcgtacccgcggcaagcggcagcacgccgttattggtgagaaggacatgcccctcggccgcgacgcggcgcgcgacggcacggtttgcctccacgtccaccgcgggcgcgccctgggcgtcgttcgcgtgggagatcgcgagcgccgcaaggcgacgcgcagactcgcgcacgcgcccctcgcggagcgtcccagcgtccagcgcggcggtcgcctgggcctgcaggtgcctggtgccgccgggcatggccaggtcgcagcccgcctcgtaggcggcggcgcggtcatgcatgccgccccagtccgtcaccaccacgccgtcgaacccccactcgtcgcgcaggatgtcgcgaagcaggtggtcgttgtcgctgcaataggtgccgttcagcatcacgtaggcgctcatgaccatctgcggcctggcctcgcgcaccaccatctggaaggcgcgcaggtagacctcgcgcagggtgcgctcgtccaccacgcagtcgttactgaagcgcttgtactcctggttgttgacggcaaagtgcttgatgcaggaccccacgcccgtggactgcacgcccctcacgtagcttgtgcccagcgtgcccgccaggtacgggtcctcgctcaggtactcgaagttgcggccgcagagcgggctgcgcttgatgttgaggcccggccccagcaccacgcccacgccgagcgagcgcgcctcgtgcccgatggcacgccccatctggcccgcgagctccgcgtcccacgtggcggccacggtagccaggcacgggaagcaggtggcgggctcggcgggacccgcgccgcgcacgtcgtttccgggcctctggtagcggaggccattgggcccgtcgctcaccgtgagcgcggggatgccggcctcgggataggccctggtgcgccagaagtccgcgccgacgtccaggtcaagcagctgctcgcggctcagcttggccacccccttctcggcggcgtccgtgcacttggaatccatctaggcctcccgttcgggccccgaggcctcgcccttctcgcatagcgtggagcccacggccacgatgagccggcagaggctctggttgagctcctccacggtctcgctgccgtacgtgccctcgagccaggagccgtacgcgtcgcgcacgccgccgagcacgaagtcgaccacctcgaccgggtagttgccggaatccgggaactcctgcctgatcatctggtgcaggcgctccgcgatgcggttcatgatggccgtgaggaagggcccgagccggtcgttgtccacgagcttgcggatgagcgagaggttgtcgcacacgaagtctcccaggcgctgcaggagcggcatggggtcctggaagaacgagcggctcaccagcgggctgagcgaggcggagagccgctccgtcaggtcgtccatcgtctggtccatgagctggtccacgctctggaagtgggcatagaacgtgccgcgattgaggtccgcgcggcgcgtgatgtccgtcacggtgatcttgtcgtacggcttctccgcgatgagaagcgtgagcgcctcctcgagcaggcgtatcgacctcagggcgttgcgattcttggtggcagccatctttcccccaaacccatgcgccggccggtgccgtgtcattctcgcacacacaagtgcgaaattgtcgctatttgaacggcattcaaaatgctgtgcaaatagctcccccacacccttttcagccctgatgtgggtaatttccaacatgtgtatgttttaccacatttggacatactcaaacggtcgttcgccagcaacgagaaaagtcgtcggcgggcgcggagagggaggcaccaggaaatggaacggctgtttcgcggggtcctgaagcaccgcggcatcgtgatcggcgtcttcgtgacgcttgcggtcatctgcgcgtgcctgatcccgcaggtcaagatcgacgcgaacatgagcgactacctgccgcccacggccaagtcgtccgaggacctcgacgcgatgaagcgcatctacggcaacgacatcaccaacgcacgcgtctacgtcacgggcatcagcctgcccgacgccaaggcgctcgacaagcgcctcaagggcgagaaggacgtgatctcggtcacgtggctcggcgacgaggtggacgtgagcgagccgcttgagacccaggacgcggacacgatatccgactggtacgacggcaagggctacctgttccaggccgtgctcaagtccggcgtgaagcagagccagatcgaccacatccgcaaggtcgccaaggccgtccccggcgccaagaaggtcgccatcgacggatcggccgcggacgacgcggccaacatggccaccatcaacaccgacatgggcaagatcatgacgatcgccgtgatcgtggtgctcgtcgtggtggcgctcaacaccaccagctacctgcacccgatcgtgatgctgctcaccataggcgtggccatcatcctcaacatgggcacgaacatcttcagggggaccatctcgtccatcacgcagcttgtggcgagcgtcctgcagctggcggtctccatggactactccatcgtccttctcaccaacttcgggcgcgcgcagcagaagacggacgaccagttcgaggccatggtcgcggccatgaccaagtcgttcccggtcatcctgagctccgcggccgtcacgttcttcggattcctgtcgctttccgccatgcagttcctcatcggcgcggacatgggcatagcgctggccaagggcattgtgtgctcgttcttctccatcacgctcctcatgccctgcatcctgtacaacatgcgcaacctcgtggccaagaccacgcacaagccgttcttccgcagcttccatggcatggccaaggtctgccacgcgctgtccgtccccgcgctcatcatcgcggccgtcgtggccgtgccggcgctcctggcctcccagtccgtgagcttcacgtacgggtctgccgccaacatgtcgcccacctcgcaggtcaagcttgacggcgacgtgatcaacaaggcgttcggccagcagcagacgtgggccatcatggtcccggccgagcactggggcgacgagaacgccctggtggaggacctgcagaagctccccaccaccaagagcgtcctctcctactccaccatcgcgagctccgcgatgccccaccagctggctgacaagagccagataaagcagctcttcagcggcggctacagccgcatcgtcctcacgtccaagatcccggacgagtccaagcaggcctttgacctggtcgacaaggtccgcagcctctgcaaggcgcgctatggcaacaggtaccgcctcgtgggcaacgccgtgagctactcggacatcaagtccgtcacgtccagcgacaacaccacggtcaagctcgcctcgatcctggccatcggcgccgtgctgctggtcatgttcaggtccatctccatccccatcatcctcatcatggcgatcgaggtctccatctggatgaacgaggccgtcccctacctcatggggcagaccatgaacttcgtggccttcctcgtgatcgactccgtgcagctgggcgccgcggtcgactacgccatcatctacacggaggagtacctggcgcgccgcaagcgcatgcccaagggcgacgcctccttccaggcggtcgagaagaccgcgcagcccatcatgacatcgagctcgatcctgatcctcgcgtgcctgggcatctacttcagcgtgtcgagccccatgatccagcaggtgggcatgctgatcgcccgtggcgccctcatcagcgtcatcctgatcttcttcgtgctgccgctgctcttcaggctgctcgacggcttcgtgcgcgtcaccagctacaagatcggcttctatcgcggcgagcccaagcaggacaccgcggccgcagacagcggcaacccagaccccaaccagggcgccggccaaggcgccaacgcatagcgcccacacggcgcacgtcaggcacaaccacacgaacggagtgacagacatgagcaagacaaacgcaagcgagatccccctcggcaagcggatagcgaccggcgccataggcgcggtgctgagcctcagcatgaccatcccgtttggcaccacacaggccatcgcggaggaggcctccgacacgggcgagaagagcgtgacccacggggccagcaccgccaccacggcaaagcgcgaggtggtgtacacgaggaccaacgcctccggctcctccaccggctcgtacgtggtgaacgcgttcgacacgcccaccaagacgaacatccaggaccccggcagctaccagaagctgacgaacctcaccaccaacaagaagctggaggagaaggacggcaaggtcgacctgacgaccgtcgcgggcgagcccttctactaccagggcaacctcgacaaggacacgacgctcccctggacggtgcagataacctacaggctcgacggcaaggtcgtgaagccgagcgagctcgcgggcaaggacggcaagctggacatcgagctcaaggtgaccggcctggtcgacgactccgccaccgcggactttgccaagagcttcctgctgcaggcgcagggcaccttccccaaccagaacttcaagctcgaccaggccaacaacgccaccgtcgccacgagcggcagcaacaccgtcctcacctacgtactcatccccgggcaggacggcgactggcacatcacgggcaaggccaaggacttcacctacagcggctggcagatagccgccatgccgcttgacctcaacctcgacacgagcaagatcgacacctcggagctcacgagcgccacggacaagctgcagagcggcgtcgcgcagctcgaccagggcggcgccaagctgcgtgacgccctcggcgagctcgccaatggcgccggccaggcacagtccggcgcgggcacgctcgcgtccggcgcggaccagctcgctgcgggcacgcgtgaggccaaggcgggcgtgggcaagctggactccggtgcgggcacgctcgcgtccggcagctcgagcctggcgtccggcagcgccagcctcgcgtccggcagcaggagcctggcgtccggcaacggcaggctcgccaccggcgccaggcagctgagccagggcgccaagtccctgcagggcgcgctccagagccagaacggcaacttcaccaagctcgactcgggcgccaagcaggtgtcccagggcacgcagcagctgtaccagacgctttccgccacgctgccgcagcagctcctgcaggtcaaccagggcctcaaccagacgcgcgcgtcgctcgagggcatccagcagaagctcgcgaccatcaagcagcaagcgggcagcatgtcctccgcggcgcagggcgccatccagcaggccgaggccgtcaagagcgacctcacgacgctcgagaagggcgcgagcggcctcacgacggcgctgggccaggccggccagtccgccggcacggcgcaggccgaagccacgggctccaagcaggcggcggacggcgccaagcaggccgcggacgcggccagctccagcgccgcgtcggccagctcccagctcgatgcgctgctttccgacaccacgctgaccgccgaccagaaggccaagatccaggccgctgacgagcaggccaaggcggccgagaagggcgcgggcacggcgtcgcagtacgccgccaccgcctccacgtatgccggcaaggcagcgcaggactcgggctccgcgctcaacacgatcaagggccttggctcctctctgcagggcatgcaggccgctggcgcgcagctccagaaggacgccgagtcgctcaagtccacgctcggccagatgcaggccggcatcaagggcgtgaccggcgagtccgccgacgtgctcgacagctcgcagaaggtgctcgacggctcgcagcagctcgtcaacaagacgcagcagcagctgtccggctttgacctcagccagctcaagcagctgtccgacggcgcggcacaggtatccagcggcgtgagctccctcgtgagctcgctcaaggccacgagcggcaccaccacgattggcggcgcggtgagcagcctcgcgagcggcgcggaccagctcagcagcggagccgactccgcggcgtccggtgccaaccaggtcgccagcggcgcgggcaaggtcgcgtccggcgcaagccaggtcgcgggcggcgcgtcccagctcaagaacgggctcgacacgctcgactccggcgcgacgcgcctcgacagcggcgccagccagctcgcgtccggcgcgcacacgctcgacagcggcctgggcacgctggccagcggcgcctcgcaggcgcactccggctccgccacgctcgcgagcggcctcgacacgctcgcctcgtccacgagcggcctcgaccagaaggtgattgacaagctcaagagcaccattcgccagaagctcggccaggactaccagatccactcgttcgtggacccctccaacaccaacgtgagcgaggtgcagttcgtctacgtggtggacggcgtcaaggaggccaagtcctcgagcgagaagagcagtgactccaagagcagctccaagtccgagtccaagtcctccaaggaggacgagggttccaagagctcatcgttcatggagcggctgggcgcgctcttctccggcaagaaggaggacgagtagcgggctgacgggcagccgctagtggcggccaacaacagtgcgcggtatcgggccacgtcgcgggggcatcctcgcggcgcggcccgattgccgtccatttcccatgcgtggcacatgggaaacgtctcttaggccatcagtgcaacacgccaagttggagcagggtcgcagcgagtcacgatcgaccccaattttaaatgcggtacaacccgtccgctttcggacgcaacaattcgtcgattggaccatcctttcaagtaatgttccgtcgagcttcaggtatctttgtgtcatgcactgccagacctaaagaacttggaggtcccatggggaacaaactgctcaggatttgcacggcgctcctgctggtcgttggaatcgccgcatgcagcaacggcgccgacagcaaggacgcaagctcttcaaacaactacgcggatggcaaggccatgcaggtaatcgcgaacggcctcgaggctcgttggaagcttacggatgagtttgactccgccggcaaggatgcgaccgccagcgactacaaggattggattaacgccgagctcaagattgataagtcactcaggaacgaaaagttcaagagttcggccatgcaaaaggacgtcatcgactacatcaacgttcttgaggaatccaagactgttgtcgacaagtaccccatgtcaggccttgacttctggaccaagtggagcgagacgtacgacaagaggactgcactcatcaagaagttcgtagacaagtacgatctcaaggtcagcaaggagtactccaagaccctgaaggagctcgtcgataacggcaaagccgcacaatcgcaaaccgaaaagaaggacgccatcaacgcgctggtatcctccctcgcttggactacgactgacgacggatacgggaactacaccctcacagcaaccgcacagaacaacaccaagtacaacatcaaagatctcagcatcgtcctctccatatatgatcagaacaacgtgaagcagcaggagacttacacttccgtcgactcgtggaaggctggagagaccatcaagcttgaagcgtatgcgcaaagcgcccccacgcgcgtcgaatcaagcgtggattacttcgacacctctgatgaatagccagtgattatcgctcaatagcacggcgtaacaaatcgaaggtgcgcgtaccaatacacacagcgggccacatcacgagaatcgtctcgtagtgtggcccgcttccgtacgctgcgcaaatgcatgagaatcaatcgcacctgcatttacagtagcctccatggcgaaaggaacgaacatgcgcgaaagcacgaacggcccagtcgatcacaatatgtcccctttcaccactgcagagagccactccgacaggcccgtcgcaatctccgaaaacggcaagcccatgacgggcagctcccccactgtcgaaacctctagtccgagcatggaggccgcagccgccagcttcatggacgagtatgccgacgtcttcgggcggctcgccagatagcgggcccctatcccaaaacgaggcaagcccaccccacccccaaaacgtggataacttcgcaacctcttgcggccagccgccgacccgcccctcccccgtgctacagtaggatgcaagaacgcgctgttactgacggataatcgtgggctaccacggggaagcagcgtgaaacattaccgccgaccgtctgggcaagcgcattccgcatggggtgccttgcccttttgtgtggcgggcgggcctcccgggtgcgccaagagaaagggagaccatgcaggacctgctcgagctcttacgcaacaacccctaccccggccgcggcatcgtcgtgggcaagggccgtgtctactactggatcatgggacgcagctccaacagccgcaaccgcgtcttcaccaagacggacgacggcatcaggaccgaggcctacgaccccaccaagctcgaggaccccagcctcatcatctaccaccccgtccgcaccatgggcgacgccctcgtggtcaccaacggcgaccagacggacaccatcgtggagaagaacagcttccgcgacggctgcatggcccgcaagttcgagcccgacggccccaacttcacgccgcgcatcagctgcatcgtcaacgccgacggcagctttgagctcagcatcctcaaggcggaggaccacgccctggccgacggcggccgctgcgtgcgcgagttcttctgctacgagggcgcggacgagggccacggctacttcatcagcacctaccagggcgacggcaacccgctgcccagctttgccggcgagcccgtggaggtcaccatgccggagccgaccgaggtctgggccgccctcaacgcggacaacaaggtgagcctgtacgccaacgtcgcgggcaccgtgcgcctgttcaacaagaacctgggcgactagcccgctatcaggacgagaggaacaagatgaacgaactgcagctcaagtatggcgtgaaccccaaccagaagccggcccgcatctacatgaaggacggctcggacctgcccgtcaaggtgctccagggccgccccggctacatcaacttcctggacgcgctcaactcgtggcagctcgtgcgcgagctcgcgaaggagaccggcatggccgccgccgcgtccttcaagcacgtgagccccgccggcgccgccgtgggcaagccgctgtcagataccgataagaagatctacttcgtggatgacgagggcgagctctcgcccatcgcgtgcgcctacatccgcgcgcgcggcgcggaccgcatgagctcctacggcgactgggccgcgctctccgagacctgcgacgcccgcaccgcccagtacatcaagcacgaggtgtccgacggcatcatcgcgccgggctacacgcccgaggcgctggaaatcctctcccagaagaagaagggcaactacaacgtcgtccagatcgaccctaactacgagtgcgcccccatcgagaccaaggacgtctttggcatcacgttcgagcagggacacaacttcttccgcatcaacgaggacctgctcacggacgtcgtgaccaagaacaaggacatccccgcggacgccaagctcgacatgatcgtgagcctcatcacgctcaagtacacgcagtccaactccgtctgctacgtaaaggacggccaggccatcggcgtgggcgccggccagcagagccgcgtccactgcacgcgcctcgccggcaacaaggcagacacctggtacctgcgccagcaccccaaggtgctcggcctcaagttcgtggatggcatccgtcgcgccaaccgcgacaacgcgatcgacgtctacatcagcgacgagcacgacgacgtcctgcgcgacggcgagtggcagaagtggtttgcggagaagcccgaggtcctcacccgcgaggagaaggccgcctggatcgccacgcagaccggcgtgaccctgggctccgacgccttcttcccgtttggcgacaacgtcgagcgcgcccacaagtccggcgtgagctacatcgccgagcccggcggctccatccgcgacgacaacgtgatcgagaccgcagacaagtacaacatggccatgtgcttcacccacatgaggctcttccaccactaagcgcggcaggcagccagccggcagccatctgccagaaacacgcgcagccagcacaaccgggcgcgccgattcccacgcggggtcggcgcgcccgttcttctcccccggcgccccgtaacctggcggcagcatcggcagtgtagaatgcttgccaaacgaccaaggcgaaggcgagaagaacgtggaagagctgatcgacatctacaccgaggacggcaccccaactgggcggacgctcgtgcgcaagggcgcgcgcctgcccgagggcgagtacatgctgtacgtgctcgccatcatccagagcgaggacgggcgcttcctcatcacgcgtcgcgcgctggacaagcactgggcggccggctggtgggaggtcacgggcggcggagtcagcgcgggagagacctccgcgcaggccgtcgtgcgcgaggtccgtgaggagaccggactcgacgtgtctggccagcccctcgtgcccgtctggcgctaccgcaacgttgacctggaccgcggcgacaactacatcgtggacatctaccacttccacctgagcttccgccccgaagacgtccgcctgcaagagcgcgaggccattgggtgccagctcgccacgcgcgagcagatcgacgcgctggccgcggatggcgtctttctgcactacgagcgcctgcgccaggcccttgcggccgaggccgagggcaagccagcgcctgcacccctggccccgccgcccgccagcgcgtagcgccgcgcgcaagggggctcgcatggacatctgcagctacgtggcctggtttggcctctacagcgtgctcggctgggtgtacgagtgcacctactgcgccatccgcaccaagcggtgggacaaccgcggctttttgtttggccccgtctgtcccatctacggctttgggatgtctgcactggtgattgccgcgcaggcgctttccgcctccggcgccggcagcgcaaacgtgccatggtggcaggtctttttgtgcgccgccgcgggcagcgccgtgctcgagtacaccacgtcctacgtgttggagaagtgcttccacgcgcgctggtgggactacagcaacatcccgctcaacctcaatggtcgcatctgcctgccgttcgcgctctgctttggcgcggtcgggacgctcctgtactactttgtctgcccgctcatcggcggcgccaccgtcacgctgccgctcaccgcgtgggaggtcctcgcgctcctgaccgtgggcctcatgtccgcggacctggcgctcacgctgtccgcgctcaccaacctggacaagcgcgtccagcaggacaagtccaacttcgacgccgtgatggagaccgccgtggacgacatcgcagccggccgcaagccgctcgaggtcgaccggcagatcgcgcgcgagcacgcaacagaggagctggagtccgccgcccaccgcgccgcgcgtgagatgtccctggtgcagaggcgcacgctcaagagcatcaagtactactcggaggagcatcgcgaggcgcgcgccgccaagctgcgcgaggccgtcgccaaggtcgagcgcgagcgcaaggcccgcaagcacagcaggtagcgcaggcagacacccgagcccaggccgccctcggtcacgcctcgcccagcacgcgcctgcgccagtcggacgacacgtagcacagccgcagcagcgtcaccacatgcgcatcgtcgtccacgccgtagaccgccacaaagacgccgagccgccgccagcgcagccccgagtcacccaccctggagccgtgcccgggaagcgccgccacgagcctgcggaacgagtcgaactcgtccatcaggcgcccagcgctgatgggacccgactgctcgaggtagtagcgcaccgccgcatcgaggtccctctcgaacgacggcgtgaccacgacctcgtagctaggcgaggccataccgcgccctcagatcggcggaaagctcactggccgcgcgcgtctgtcccgcgcccgcctcgtccagggcctgcgcgatgccgtcccagaactcctccgaggtacagacctcgttgggaacgggcggctcggcggtcacggtcgcgcggccgtcagacagctgccagtagacccgcgactcgtccgtgatgcccaaggccacacgaacctccttgggaacggtggtctggccacccttggtgagctttgtcgcaaacgtcatgatgcgcgcctttcgccattgatatcatggtttcaatactaccatccgccacaaccaccgtcgaggggagccggccatgtgccacaggatgtcacccctgctcctgcgcgagttgcaggagggcctcaagtacatgcaggtcacgggccacgcgcacgtgccgcggcgcgacccctccgtcgtggtgccggacgcctacccaggcacgcaggtcccgctcttcgttccggacgagaagaacaacctcaccgcccgcgagctcacctgggggttccagcccaggagcggcggcagccgcggcaacggcccctctgggcagggcagctcttctcgcctggtcttcaacaccaggatcgagacggctctggagcaggcacacaccggccgcggcatgtgggccgagcccatccggtacggccgctgcctggtacccgttcgcgcgttctacgagtggtggacgcaacccaacccgcccgaggtgcccgtggccgcggacggcacggccgatggcgagcccgcaggcgcaggcaaacgcaagaaggccccgcgcccgcaggttcgctacgggctttcgggtcacagcatcttcctcatggcatgcgtgtgggagggcgagcgcttctccgtggtgaccacgcggcccaacgcgagcgtggcgcaagtccacaaccgcatgccgctggtacttggccccggcgagagccgcatctggctgggggacgactggccgcagctagccgatagaagcgccgtcccgctcacggccacgctcgagccgcagtcgtagcgtcgccgcggcctacaggtcgaagcgcgtgttgaccaggcggccctccgcatccttccccacgcggatcacaaagtcaaagcggtcgcagtccacgcagtacggaaagtccgccgcggggtactggggctgtgccgggtcgaagaacttcgcgcccgcggtgtcgcggagtgccgccgccttgccggccacgtcaaagcccgcggccgtgcccttgagcagcgcctctatgtaacgggcgcacagcacgtcctcccccgcgctctgcgtgccggaggtgcccatcgccacgatggagacctccgccggctggcggtgctggatgtacgtggccacggcgcgcgcgttggccaggctgccggtcacgacctccgacgcgcccgtggcgctgacgatgccctgcgtgcccgcgctcgtggtgtggatgcacgtgcggcccgtcaggtccacgccagccacctgcgagggagagttgccgtagtcaaagccctccacctgccagccgccgcgctcgccaaagcacaaccagtccgggtgctccgccttgagcgcccgcgcgtcgtccacggacccgatgggatagatcgccttcgcaccctgcgcaaacaggtagcactcgagcgtgaacgcgcggaacacgtcgatcaccaccgtgagcccgcgcgcctcgcgcgcaccctcgacaagctccagcaccctcacgtccatgttgctccctccgcagacccatgcgagaaacaccgcctactgtagcgcttccgcaccgcgctcgcagcatcccacggagccgacacgtcgctaggcaagcgcaaggctgagcgcgatgagcatctgcccggcgtagtacgtccccaggctggccgccctcaggcgctggctgtcgactcccccaaagttgttgacggcaagcatcacgtccgaggcgagaaacgcggccgtccccaccgcaagcgtggccctgggcgcaagccgcgcgggggccgcaggcacggctggcgcgagcgccgccgcgacggcacccgccgcggcaaagcccaccacggccgaggtaaccgcaaggtaggcgccgcctgcgacgaactccgcacggctctgcacgctcatgcgcggcagcaccgcaacgtccaccacaagcgcgagcgcgcacgaggcggcaaggccccaggccggcgccaggcacgcgggcaccacggccaccaggtacgcaaggtgccccagcaggaaggagacagccccgacgttgaagagtagccgcttgcgcgcgggccacacaaagcgcagcgcgtgcaggacgtcccccacggcccccagtgccaggcccaggcagatggtaccggcctccgggctcggcgcacctgcggccccaaccatacccaccagcacaaaggcaagtgcggcaaggcccttcaacaccgccgcggcgccatagcggtgcgcgcggtcggcccgtatgaagcatgtctgcaagacgccgcccacgatcacgagcgcggccagaagcagaggcgccatgtccttctcccccgttgtctatcgcgcgacggcgctgcgccttacctagcggaagtccgccagctcgcccagggacttgcgcttggcgtgcaggtgcgcgggatgcgcctccggcgcggcgtagccaaggttgagcgccagcaccacgcgctcggatgcgggcagttccagcagctcggccacgccggcgttgggcaggtagttgcaccagagcgtggcgaggcccaggccctgcgcctcgagcatggcgtgcgtcgccgcgatggaggcgtcctgctcgccggagtggacgccctcctccaggggattcttccagtcctccgccacgtcgtaggtgaagacgagcaccgtgggcgccccgtagcgcatggtcgtcagctcgtcatagcgctcgagtacgtccgcaccctggagcacgtggacgcgccacggctgcaggttgcaggcggttggggcaacgcgggccgcctcgagcacaaggtcgagcttctggcgctccacggcgcgcgacgcgtacttcctcacgctgtagcgctcgcgagccagctgcaagaagtccatggcgccccccgttcaaagctgcctgcagcggcggggctgccggcgtgtccgttgcgaaaactatatatgatgcacgccagccacgcggcgtgggccgcgggggcacgttcttctcgcccgccaggcgtaccgcccgcgccacgcctggcgagtccgtgtattgaacgtgaaagcggtggcaacgtccgcgcatttgggtacgaacccctagacttccattcggcagacaagcgaaaggccccgcagggccagttgaggagggcacatgccccagaagaatcccgtaaagatcgtcatgctcaccggctacctaggcgccggcaagaccacgatcctcaacaacatcctcgccaacgaccagggcatccgcgccgccgtgatcgtgaacgacatcggcgaggtcaacgtggacgcgagcctcatcaaggacggcggcctcaaccagaccgacagcctcatcccgctcaccaacggctgcatctgctgcacgctctccgacgacctggccaagcagctcggcggcatcgcggagtccggcgacttcgactacatcatcatcgaggcgtcaggcatctgcgagcccatccccatcgcctacaccatcagccagttctgcgaccagagcaagttcaacggcaacgcgccgctcgacctggacaacatcgtggccgtggtcgactgcgcccgcatgtacgacgagttcaacggcggcaaggacctcctggacgacaacattgacgaggaggacatcgagtccctgctgatccagcagatcgagttctgctccacgctggtcctcaacaagaccgatctcgtgaacccggaccagatcgccgagctcaaggccatcgtccgcagcctccagaaggacgccgtgatcgtcgaggcagaaaacggtaacgtccccatggaccagatcctcaacaccggccgcttcagcttcgagaaggcctacaactccgccgcgtggatcgacgcgatggagcaccccgaggagcacgaggacccggaggtgctcgagtacgacatcgagacctttgtctacgcgcgccgcaagccctttgacgtggacaagttcaacgacctgctgcagaacttcccggacgagatcatccgcaccaagggcacgttctgggcgcagcagaaccccgagatgtgctacatcttcgagcaggccggccaccaggtgcgcctgaacgagaacggcctctgggtcgccacggcccccgaggccgagttcaagcagatcatcgcggacaaccccgagatcatggacaattgggaccccgaggtgggcgaccgcgagaaccgcctctgcatcatcggccgccacatggacaaggacgacatcatcgccaagctggacgcctgcctgaccgactatgtgcccgacgaggacccctacgaggatggcgagtagcatgggcgcgctcgacacgatgtaccggcgcgcgagcgtgcgcaacttcacggacgagaaggtcacgtcctttgaggctgaggcccttctccacgccgcgatgtccgcgccctcggcaggcaaccagcagccgtgggagttctacctcgtgtgggacgacgaggcgcgcgccgcgctttccaaggcgtcgccctacgcccttgccgccgccaaggcgcccctcgtggtggtcccctgcttcaggcagaacgtgcgctttcccgagtgcgcgccgctcgacatggccgccgcgacccagaacatgctgctcgaggcaacggacctgggcctgggcgccgtctggatggcgatcaaccccgttcgcgaccgcgaggagaaggtccgcgccacgctcgacctgccggacgacctgacgcccttctgcctgattgccgtcggccgccccgcagacgacgtgaccccgcacggcgcggagcgctacgacgagaagcgcatccacacggtttaggtcggtcatctgcaatttaaacgggtttgtgtgtgctttggaagcccgtcccaagcgcaataccgacattcgtcccccaatagcaagtcatcaaaccccacacaaccctccccacatgcactccggggagggttgtgtggggttccgtttggttctccaacagcttccagagcaccaaagcacacataaacctccttcggctgcggtggcgtgagaatactactagcggattccccgaatctaccccctcaaccaaagtcgggccctagatcgaagctggcacaatcacgtcatagcgtaccgccttgccagatatctggtaggaaggcttcattcctgccagaagctggcctttgagcggtcgcttgatgaccaccttgcgcggatgtgccgcaatcgcggcatccagcatttctcgctcgtcctgtgcggggcgctccaaccgttgcagcagctgcgccttcttcttcaccgaggcgctcttgcgccgctcgggaaacatcgggtccagaaggaccacgtccgggcgcagcgtttcgtcggcattggcgagctcacgcagcgcggtaacgctgtccccctgcaccaagctcatgcgcgcaaccacgggcgcaagcgcctcgtaccgcgcggcacggtcgagcgcgtcccgcagcagcgccgcaatcacggcgtcgtgctcgtacagggtgaccatgaagcccgcggcggcgagcagcagggagtcctcccccatgccagccgtggcgtcaaacgcgcggggatgctcgaccccgcgcacgcgcgccgcccgcacgagcagctcgtgagagaggttcgcggggcgaaggcgcctgaggtcgcgcgtgaagtcgccgcacatggagagcccgtcgtccgacacgagcgtgagggcaccgtccacccgctcgagcgagaggcccgcgggcagatctggcatgttcgttacgtgctcgcccattgccgccccagttactccgcctgcgaggcggcggccagcacggcgcggtaggcgtcctggtagctgacgcccgcgctctccgcgagcgccacgacggaatcgtgctccgggtacgcgcgcgtggcgccgcccggcagcgtgaccaccttgacctgggcgggacccagcggcgtgcgcacgtccttctcctcccggggcagcgccgtgcgctcaacgggatggcggcgcacgccgatggtcgtggtctcctcaaagaggacgcgctcgcacgccgcgacgcggtcttgcgagcacaggacctcgatctgccaggcggggcggttcttcttcatgtagatgggcacgtagtgggcctcgcgcgcgccggccgagaagagcttggcgagcgcgttgccaagcgcctcgccggtgcagtcgtcaacctcggtttcaagttttataagcacgtccggtgcggaggtcggctgggcagggcgcggctcgatcagcatcgcgcgcaccatgctcacgggctcgtaggcgcgcttgccgcggccgtagcccaccgccctgaccgcgtatgcgggcgggagcgcgtctgccgtttggatggccgccgcgatggccgcgcccgtgggggtcacgagttcgccctgcgcgtcgcgcggcgcgagcgtgaggccgtgggccgccgcgatgttgaccacggcaggcaccggcacgggaagcacgccgtgctgcgtgcgcacgcggccgtggccctcggccagggggctcacgacggcgctggtcacgcccaggttgtccaggcagacggccgcggccacgacgtcaacgatggagtcgacggcgcccacctcgtggaagtggacctggtcgacgggcacgccgtgcgccttggactcggcatccgccaggatctggaagatacggtgcgccagattgcgcgcgccgggcgttaggctgcccgcgtcgatcacggcgagcacgtcggacaggttgcgatgctcgtggtgatgggcgtggtcgtggtggtcgtactcgtgatcgtgcgcgtggtcgtggtcatgttcatggtggtgatggtcgtgcgcgtggtcgtgatggtcgtgcacgccgtcgaggtcgccgtaaaggtaggccatgtcgtggtcgtggttctggtgcgcgtcgtccagtaccacgtcgaagtcgcagcagtcgatcccgttggcgggcttgcgcgtgatgcggacgtcgtatccgcccaagggcaggctcgcgagcgcgtcgcgcacggccttctcgctcgctcccgcatcaagcagcgccgcgaccaccatgtcgccgctgatgccgctctcgcactcaagatagagcgtcctggcgcctgccgagcgcgcctccgttggacctgccgccatgttctaccttcccacgtggttgatgagactcgcctggtagcccgcgccaaagccgttgtcgatgttgacgacggagacgccgctcgcgcacgagttgagcatgctgagcagcgcggagactccgccaagcgaggcgccgtagcccacgctcgtgggacaggctatcacggggcaggccgcgaggcccccgatcacgcttgcgagcgcgccctccatcccggcgaccgccacgatgacggacgcgttctggatgagctcggcctgagccaggagccggtggatgccggccacgcccacgtcgtaggcgcgacggacctcgctccccagcatgcgcgccgtgagggcggcctcctccgcgcagtagaggtcgctcgtgcccgcgcacgccacgagcacgtagccgtggccgctgggctttggcgggttgccccacacgcccatgcgcgcgacctcgtggtagcggtagcccgtgaccatctgcaggctctggcacagcagcagccggtggagctcgtcgctcttggcggggtcgagcctggtcacgagcacgcgctcctgcccggactcgaccagcgcgcgcatgatgcccgcgatctgggcggccgtcttgcccgcgccgtagatgacctcggacacgccctgcctcacgccgcgctggacgtccggcttggcgtagcccaggtccgcaaagcccggaccctcgagcgacgccccgcccaggcgggcgcacgcctcgtccgaggtgacggtgcccgccgccacggcatctagcagggacctgagttcttctcgctccaaggggtaccttcctggttgcatcgacgcctcccatgatagcgccggggcggcgcgtcccgtcccggcgtcggttgtcacaacgttgttccgcggcgccgcgacggcgccgggcggacggcccgccccttagcggtagctcttgaggtagatgcccgcgatgtcctcgtccgtggtgggcgcggggtccgccgcgaagagccggcccatggtctcgcgcgcggtgcgggcgagcaggagcgcctcctcgcgcgtgcccgcaaagccgtagtcgctcatccgaaggccgtccacgccgcaggccacctgcaggtcgcgcagcgcctcgaggaagtcctccggcttggtggcgcccgtcttgcccagggcgcgcgccatcgccacaaagcgctcgtcgcacacgtggcggccgacccagtagccaaagtacgcgaggctgatcatggtgaggcccgcgccgtgcgggagctccgggtggaaggcgctcatcgcgtgctccatcgagtgctccgagcagttggacgccacgtccatggagtagccgcccatggtgttggcaaacgccacgtgggtgcgcgcctccaggttggagccgtcgcgcacggccacgggcagccacgcgccgatgttgcgcatggcctcaagctgcaccatctgtccaaacgggttggcgatgttgcagatgtagccctccatgttgtggaacagcgcgtcgaacccctggtacgccgtgaacttgggcggcacgctcaacatgagctccgggtccaccacggcgatcctggcaaagttgttgggcgaggatatgccgatcttctcgtgcgtgtccagctttgatatgacgccgccgcggtcgacctcggagccggtgcccgccgtggtggtgatggccacccacggcacctccggcttctggagcggcaggttcttgcccgtgctgcccgtggcgtagtcccacaggtcgtcggagggttgcggggcgagaagtgccatcaccttggccgcgtccattacggatccgccgcccagcgccacgatgaagtccacgccgtgctcgcgcgcgaagtgggcgccctcctcaaccacctgcttggtggggttggccgccaccttgtcgaacagtaccgcgtccacgcccgcgagccgcagctgctcgagcgtgcggtccaggtagccgttggcgcgcgtggacttgccgttggatatcacgagcatggcgcgcttgccgggcaggggctgctcgtgcaggtggccgagctggccggggccaaagagcaggcgggttggtgcgtagaggctgaagctatccgagggcatcgtgaggtccttccctgtgcgtgcgtctggcgcggccaccgccgcgtcgcctgcggccatggtagtttgccgtggttgcggggcgtggcacgccaggttacgggaagcttgtgcgcgtgtttcgagttgggacggggtgcgcgaccgcggtcgcagtcgcgggccgcgggctgccgggcctcctgtcgcgggcacgggcctccgagcgcggtcccgcaccgcacttcatgaagtgcgatgggaggcaaaacccgctcaactgggcaaacacaggcagaccccgcaccgcacttcatgaagtgcggtgcggggtctgctcgacgcggccgcgtcctagcgcggcgcgacctcgaaggcactcgcgggcaccaggttcctgagcggcccgcccgcagccagcgcgcgcaggttgtcgcagcagatcgcgcagatgttgtcctccgtctggcggtggcgcccaaacgagccgccggacacgtgcggcgtgatgaagcaacgcggctcctgccagagcgggtgcccggccggcagcggctcgggagcggtcacgtcgagcgccgcgccgcggattgcgccctctgccagcacctccgcaagcgcgttcgagtccacaaagctgccgcgccccacgttcacgagcacggcgcccggccccatgagccgcagccgacgcccgtccagccagccggcagtcgatcgcgtgttggggagcgcgcccacgaccacgtccgcgccggcaagctccgcctcggcatcgtccagcgtgacgagccggtcaaacccctcgcgcgggcgggaggggtcgcggcacacgccggtcaccgtgcagtcaaagccgcgcagacggcgtgccacccatccgcctatgttgcccgcgccaaacacgagcacgcgcgccccgtcgagcgaccccacggcgcccagatcctcccagctggcgcctctctgccggtctcggtacgcgggcaggttctgcatgaggcccaggacctgcgccaccacgtactgagagatcagctgcccaaagccgcccacggcggagcacaggctcacgcccgcgggaaacgcgacgtcacccctggtgtaacggtccgtcccggcccatgtcgcctgcacgagcctcagccgcgagccctcgtccgccgcgcgtcgcaggagcgggagcgcaggctcccctatcaccgcgtcggcgcgctcgagcgccgccaccagctcgtcgtcggaaaggtcgtacctgcccgagcacatggccttgggcgtcgacatgtccgccggccaatgccgctcgatgacccagccaggtcccgccgcctcgcgcaacgcgtcgacgtgctcgtcgcagaacggtgcaagaagaaggagcgtgggcatggcgcctccagtccgtgtcgtcacctcggagcccaagaccgggcccatccatccgaccgcggcgagaaggactccccgcctcgcccgctgccgcgtcctagaacgtgacgttgccaaactccgagagcctgagctcggggttgcgctcctccgcccagcggacgttgaactcgttggtgaagagcagcaggcggccgccgcgcatgtcctccacgcggccggtatcgcgcgagaggttcaggctcgtcatgtcgagctcctccgggtcgttctggatccagcggatctcatggtagggcagcgggtggcggctcacctccacgccgtactcgctcttgaggcgccgctccagcacgtcgagctgcagcacgcccacgacgcccacgatcacgctctccatacccatgccaagctcgcggaagatctggatggcgccctcctgcgcaagctcctccacgcccttgatgaactgcttgcgcttcagggtatccacctgcgtgatgcgtgcgaagtgctccggcgcaaacgtggggatctggggaaactgcacgtggggcttgccagcgcacacggtgtcgccgatagagaagattccagggtcgaacaggcccacgatgtcgcccgcataggcctcgtccacgatggcacggtcgtcggccatcatggacgtgccggtcgcgagcttgatggcgcggttgccctgcacgtggtaggcgctcatgccgcgctcgaacttgccggagcagatgcgcacaaaggcgatgcggtcgcggtggtggcggtccatgttggcctggatcttgaacacaaagccgctgaaatctggccgagagggctcgaccttctcgcccgtaaggacgtccgtgtacgccaggggctccggggcaaggcgcaggaagtccttaaggaagggctccacgccaaagttggtgagtgccgagccaaagaacaccggggtcaggcggccggtgcggaccgcctcgaggtcaaactcgttgtcggcgccgtccaggagctcgatgtcgtccatgagcgtgcggtggttctcctcgccgatgagctcgtccagggcggggtcgcccagctcggcctcgatctcgttcaccttcttggtggcgttggcgtggccgtcgccctcgaacgcgatcacgtggcgcgagttgcggtcgaacacgccgcggaagttgcggccgctgccaatgggccagttcatggggtacgtgccgatgcccaggaccgtctcgatctcctccgtgaggtcaaaggggtcgcgggtgtcgtggtcgagcttgttcacgaacgtgaagatggggatgtggcgcagcgtgcagaccttgaagagcttcttggtctgggcctcgacgccctttgcgccgtcgatcaccatgaccgcggcgtccgccgccatgagcgtgcggtacgtgtcctcagaaaagtcctggtggcccggggtgtccaagatgttcacgcacttgccctcgtacgtgaactgcagcacggacgacgtgaccgagatgccacgctccttctcgatgtccatccagtcggacactgcgtggcgcgcactcgccttgcccttgacggagcccgccgtctggatgctgccggtgtacagcagcagcttctcggtcagggtcgtcttgcccgcgtcggggtggctgatgatggcgaaggttcgccgcgatgcgatctggtcggacaggcttggcatgcattctccttagatggcgtaaccatcgtattgtacgagaagagccgccccctccgcccggaagcggcgcctctcacaatgacggcacgttgccgcgggcacgcgtcacgtggaccgcgagccccacgcccaggcccaccgccgcgggcaccacccagccaaagccccaggcggcaaggggcagcaccgccgcaacgcgcgacatggcgcgcacgacgggcgtgccggccagcaccgcgggagcggacccggccgcccccagcagcgccgccggaagcgtcaggccctccgcccacgcaagcaccacgcggtcgtacccaaacgccccgcccgcgagcgccagcgctatgagcacgatggccagcgggtacatgacgtaaagcacgggaagcgaccacgcgatgagcgcgtcaagcccaccgtttgccagcgcaaatgacacgagcgtgaacgccaccgcccagccccggtacgtcaccctgccgccaaacatgcccacgaacgtctgcgagcagctcgtcaccaggccaacggccgtcttcaggcacgccacggtcacggtgacggcaagcaccaccaggccggcatcgcccaggtacaggcgagctatctgcgcaaacgcgacgccgccgttgctggagggcgcaagcgcgcccctgctctgggcgccaacgacggtcacgagcgcatacaccaccgccatgatgaggccgctccccacgccggagaggatcgtgtcccgcgcgacgttggcggggtcgctcaccccaaggtcgcgcacgacccccaccaccacgatgccaaacgccaggcccgcgagcgcgtccatcgtgttgtatccctcgagcaggcccgtcgcaaacggcgacgtcgcgtacgcgccccgcggcaccacgtccgccacgcgcgcggccggcgacgcgagcgccgcggccaccaggatgcccaagaacaccaggaaccccggcgtcagcaccttgcccacccacgtcaggatctttcccggcctgagcgaaagcgccagcaccacgccaaagaacgcgaacgagaagagcaggagccacgggccgtgcgcgcccgcgggaagcgactgggcgatgccaacggtgtaggccaccgtggcacagcgcggtatggcaaacagcggcccgatcgtgaggtacagcacgcacgtgaacgccaggccaaagcgccgccccaccctggagctcaggtccaggaggcccttggagcggctggcgcccagcgccgcgacgcccagtatgggaagccccactcccgtcacgaggaagcccagcagcgcccaccacgcgttcctgcccgcaagctggcccatgtggatgggaaatatcaggttgccggccccaaagaagagcccgaagagcatgctcgagacggcgatcccgtcccgcacgcccagcttgttgccatcagtcatgaaaccgccaccgtcccgtgggagtcgttcttctccgcctgtccaggggacatgatacggctccgcggcaagacagcaagggcggcggtccggcctcgcgcggctcgagcgcctccggagcacgtgacgccccgacgccccaggcgacctgtggagtgtttgtactgcctcgcaaacgcgggcacgcgcggcggcaccgcgcgtggtaacgttcctaggccatattcttagctgcaggtatcctttggaaacgcacaccctcccgggtgataacgaacaacactgcacacaaccgggaggtatacatgccgcaaactcgcacccagaagctcgtctttaccgtaatgatggtcatcgtcatggtctatggcatgatctgctataacgtctcgctcgaggttggtggcctttccaactttgtctttgccgccgggctgccggagctcgcgttcatggggccggtcgcgttcctccttgacctgtttgtggtctcgcccgtcgtaggccgccgcgcccagaagctggtgggccccaaccccaagacgccgttcgcgatggtcgcggcgatctctgcgctcagcgtgcagatgatgtgcccgctcatgagccttgtcgccacgctcgtcatcaagcgccccgccgcgccggacatcgtgtccacgtggatccagacgaccctcctcaacctgcccatggcgctgctgtggcagttcttcgtggccggccccatcgtgcgcggcgcgtttggcgcgctcgtccgccccagcgccgttgcctcgggcagcgaggccaggtagccgtcgccgctgccgcagggggtaggcgcgccgccccctgcggcagcaatgccgcgcgggccgaaacgccgccggcggccacgtgccgccggcccgcgaccgggccgcgactggcccgcgccctaccccgcgagcgagagctcgttcacggcgtcctcgggcttctcgccatccagcgcctgcagggcgttcttgagcgcacgggtgcgcatctccgtataggagtcggacgaatggtacgcgcagtgcggcgtgacgatgcagttgtccagccccacgagcgggctctgggcgttggtctcgtcgcgcttgacgtccacggccgccgcgcggatcgtgccgtccgtgagggcctcggccaggtcgtcctccaccacgcagccgccgcgcgacgtgttgacaaggaacgccgtcggcttcatcaggtgcagcgtgcgcgagcagatgatgtcgcgcgtcgcgtccacgagcgggcagtgcaggctcaccacgtcagacttttgcagcagctcctccaggctctgggccttggtcacgccgtggctggcgagaaacgcgggcgacttcgttggcgcgtaggccatgacgttcatgccgatggcctgcagcatgggcgtgaccgtctgcgcgatggagccgaagaacacgaggcccgccgtctggccctgcgggcgcggggcgtcgtagccggccatgtcgtcccacacgccgtcgcgcacctgccggtcgaaccaggtgatcttcttgtacaggtcgaccaccaggccaagcgtgtgcagggccacgtcgtaggtgcagtagtcgggcacgttggtgacccagcagccgtggcgcgaggccgcgcggtcgtctatgttgtcgtgcccgatggccatcatgctcacgcaccgcagctggggcgcgtcgtcaaacgtgcgagcgtcagccttgccccactcgatcacgagggcgtcggccccgtcgagcgagccccgctgcgggcgcccggcgttgtcggaatcgacctcgtacacctcgacgtccgtgcggccaaggtccttgagcatcctccgctcctgatcgagcggaacggcgcttcccaggtatgcgatgcgtggcatgacggcctcctacgtggttgatggccctgcggctggaagcccggcggctagtagcccagctcggtcatggagcggtccaggatcccgacgccctcgtccagctccttcgtggtgacgttcaggcgcgtggcgaagcgcatgccgttgccgtggacgccgcagttgagcgtgatcatgtggttcttgaggcactgcgccttgacggccttccagatctcgggcgcgggcgagccgtcctcggggtggtcgaactcgatggcgcgcatgagcccgataccgcgcacgtcgcccaccacggggtgcgccttctgcagcgcgtcgagcttgccggcgaggtaggcgcccttctcggccacgttgtccaggatgtgctgctcctcaaactggtcgagcaccgcgaggcccgccgcggcggccacggggttgccgccaaaggtgccgccgtgcatgccgggcagccacttgctcataatctcctccgttgagacgacggcgctcatgggcatgccgccggcgatggccttgcccaggttcatgatatccggcgtgacgccaaagttctggcccgcccacatcttgcccgtgcggccgtagccgctctggatctcgtcgaagatgagcaggatgccgtgctcgtcgcacatcttgcggacgccctgcacaaagctcgcaggcgggacaaagtagccgccctcgccctgcacgggctccatgatcacggccgcgacctcctcaggctcaaccaggtagtcgaagatctggcgcaggtcgtcaaggcagtaggccgagcgctcctccgcgtccatccccttggggcagaggtccttctgcgggtacgtggcaaagtacacgcccggcatgcacggctggtacgcctcgcggtagtgcgcggcggagccggtgacggaaagcgcgcccagcgtgcggccgtggaacgagccgcggaacgcgatgacgcacgggcgcctggtgtaggcgcgcgcgagcttgatggagccgtccgtggcctccgcgcctccgtttgagaagaacgtgcagccaagcttgcccggcgcgatctgggccaggcgctcggccagggtgagcgtcgtggggaagttgaccatgttgaagctgccgttgacgagcttgtcaacctgctcgtggatggcggcacggacgtgcgggtcgttgtggcccagcgcattgacggcgatgccctggacaaagtcgaggtacttctcgccattgacgtcgtacatgtagccgccctcgccgcgctcgatcacgaggtcggtggtcttggcgagcgcggggctcaggtagcgcttgtagtcctcgtacttcatgggcatggttggctcctctcctcccgcggcgcccggccggctggtccggcgggcggggcggcatcgcttcatccgatgcccaaaatgtagtccccgcaggttgagcggctgtttatggagcgttacgccgcgggcgccaaacgtcgcgagtctggtttcggcatcgttgccagattgtgtatcgcatggcgaggcggccggggcgcgccgccttcacgacccgcacgcgccgcgcacgtataatgcgggcgatacggacgagaaggaccgcgccccacgccgcacgcgcgccgggtctgcggagatgggagccccatgcgcatagacagggaccgcgccgccgcggcgtttgacggctacgtggcgcgctttgacgccgccgaccccaagatcgccctcaagcgggaccacaccctgcgggtggctgccctcgcggagcagatcgcggccaccgtgcccgagcttgccgcgccggaggacgttgacctggcctggctgctcgggctcctgcacgacgtgggccgctttgagcaggtgcgccgctacggcacgttttccgacgcggactccacgagccacgccctgcttggcgcaaaggtgctgtttgacgggctcgacggcgccgcgcccacgatccgcgactacgtggacgacgcgtccgaggacgatctgctgcgcacggccgtgtcgctgcacagctcgtggcggctgccgcccgacctgcccgctcggacgcgcgccctgtgcgaggtgctgcgcgacgcggacaaggcagacatcctcaaggtcaactgcacgagccccgtggaggacatctatccctttggccgtgaggcgctgctcgcgagcgagctttcgccggaggccacgtcgtggttctggcgtcactccaccatcccgcgcgcggcgcgccaccaccccgcggacgtcctgctgggccacgtctgctttgcgtgggagctcgcctacccggaaagcctgcgcatcgtcgcgcggcaggggtacgtgttccagatgatggagcggccctgggttcgcgacgacacccgccacgagttcgtgcggatggaagacgagctcaagggccacatgcgcgagaagggcgtgctcccggaggcgtagggtctgcggcaccggaggtccgtcgccggcggcacggctccgggcaacgcagctgtgctgcttaattgttgctgcattagtgacaattgttgcgacggcaacggcatgttcttctcccctcgcgtatgctcaggcaaaacaacaacagcgaggaggtcgacatgaaggaaaccgcaggcaaggtctttagcatcgcccaggacaggaagcccgtccccgggtgcaccacctccgtcggcgtgcacgattccgacgcgctcgccgtgattcactttagcctggctgccgacacggacatcagcgccgagacgcatcccgacccaaagctgctggtcgtggccgcgggctcgatggaggcgtacgcgacggacggccgcacctggcagctctctgccggcgacggcatggtcacgcccacggacgtgccggttggcatgcgcagcgagacgggctgcgtctacacggaagtcatcatgagaaaggaaaccaccatgaacaacgcgatcaaggcgggcgacgtcttcaagctggccgacctccttccctaccaggagggcaccatcgtcaacatggacgtcgcgcacaactccggcatgaagctcgcgctcatgagcttcgacgcgggcaccggcctctcggagcactccgcgccgggcgaggcgctcatcttcgcgctcgacggcgagggcgtcatcggctacgagggcgaggagcacgtcatccacgcgggagagaacttcaagttcgacaagaatggccgccacttcgtgcgcgcggacaagcgcttcaagatggcgctgctcctgacgctggagtaaggcaagcgcaaggggcgagaagggcgcggcatccgcgcccgcaggccgcatcctccacggccatcgccgccatcgcctatcatgggtcgttggaaatcgagccgcccgcactggcacgcgccggcgcgggcggcgccgcgaacatggaggatcccgcatggaaacctttgacgagctctactacaccgacccctacgcgcgcgagttcgacgcgcacgtcacgtcgtgcacgcccacggacgacggctttgcgatcgagctcgaccgcaccgccttctatcccaccggcggcggccagcccggcgaccgcggcacgattgcgctggcggacgccgcggcggcgcaggccccggccacgggcgagaaggacgaggccaccgcggccgacgccgagtccgggtccgacggtgaagccgagcccgagcccacccttgcccacgtgcgcgaggccgtccccggcgcggagcccggccaggtggtccaccttacggacgcgccgctgcccgtgggcgccgccgtccacggcaagctggactggacgtggcgccgcgacaacatggaggcccacaccggcgagcacatcgtgtccggcatcgtgcacaggctctacggctacaacaacatcggcttccacatgggcgagaagtgcatcgaggtcgacttcgacggcaccctcacgcccgagcaggcgctcgacgtggagcgccgcgccaacgccgccgtgcgagacaacgtaaaggtgaaggcacttctcccctcgcccgccgagctcgaggcgatggactaccgcagcaagaaggaccacgagggccagatccgcgtggtcgtgatcgacggcgtggactcctgcgcctgctgcggcacgcacgtctccacgtccggccaggtcggcctcatcaagatcctgcgcatcggcaccaaaaagaagaagacccgcctcgagctgctgtgcggccgccgcgcgctcgagctctgcgaggagcgcatggaccagctgcgcgacgtgagcaacttcctctccgtcgcggacgaggaggtgccggaggccgtgcgtcgcctctcgggcgagaaggacgagctcaagcaccagctcaaggcagccaaccgcaaggcgatcgagcaggaggtcgcgacgatgcccaagcaggacggcgccctcgtgagctaccgcgacgcggcggacatggacgagctccgctacctgtgcgagtgcgtgatggagaagaacgtggcccccgtggtcgcggcgctttcccccatggagggctcggacggccgcatcaacttcgcgatttccagcgccgagctcgacctgcgtcccgtctgcaaggagctgaacaagcgcctcgacgggcgcggcggcggcaagccgaacatggtccagggcagctgggccaccacgcgcggtcaggcggaggccgcactcaaggagctgctggcctagcgctcgtctgccgggaaggtcacgcccgcagacctgcgcgcctgcgtctgaaccttgctcaccacgagccccagctcgtccatcttctggcactgctccaggccgtagcgcccgccctccgcaaagccgcgaagcgcctcgaactccgcacggtactggtcctgctccgggggcaggtacttctccaccgtgccgtcgttgaggtgcagctccacggtgcacagcgcgttgggcttgccgtccatgcggatgtagccctccgtcccctgcacgatgccgtagctgggggcgccgcagtcctttgccgcgatcgcggtcgccttgaagtcgccgtagtccaagagcgtcacgcccgaggtgtcgatcccacgctcgacgttggccaggtaggtcacgtccttgggttcgccaaacaggcggcacagccaggacaggcaatagtggcccaggtccatgagcgcgccgccggagtgcgccgggtcaaacgccggcgcgatgtcgccgcgcttgaagcggtcgtagcggctggagtactggctgtagttgaccacggccatcttgaccgtgcccacgcgtggcagccactccatcgccttgagcgtgctgggctggtacagcgtggtcgtcgcgtcaaacaggatgaggcccttctcgtccgcaagctccaccaggcggcgcgcctcctcgtagttggagcacatgggcttctccaggatcacgtgcttgcccgccagcagcgcgcgcgtggcgtagtcatagtgcaggtcgttgggaatccccaggtagaccgcatcgaccttgtccgaggccagcacggcgtcgtagtcgcagctcgcgagcgcgcccacctgcgcggccagctgctcggccttcatgagcgagcgcggcgtcgataccacgtacgtcacgtcgtacccccacgccgccagctttggcgtcacgagcttgccgatgaaccccgttccaactgcagcgaccctcatgcgttcctccaagcctcgaagtgtgtacggggcgattctattacgcatccgccccgcccgcatgcgcacttttcggcagaggccgccgttcttctccccggcaaacgggcatatacacaggcgagaagaacaaccgccaaacaaggaggagccatggagcttttggacgcactcaaccagcgcacgtcggttcgcagctacacgggagagccggcgaacccgcggcagatggaggccatactcgccgccgcgagcgaggcgcccgtcggcatgggccgctacgacagcctgcacctcaccatcgtgtctgaccgcaagctgctcgccgcgatcgacgccgcggcggccaggctctttggcgaccccagcgcgcacccgctctacaacgcgcccacgctcgtagtcgtctcgagcaacgcggagggcaacgtggccagcgcaaacgtcgccgccgtcatccagaacatgtcgctcgcggccgtggaccagggcgtgggcagctgctacatctacggcgccacgcgcgccctggcgcaggaccccaagctcgtggccgcgctcgaccttccggatggctttgcgccggtgggctccatcgcgctgggtctcacggaccagaggtacgcgccgcgcgagctcgacgccaagcaccacatcgcgagcaatgtcgtggcgtagccgactgcggaaaagttgcaatacgaagcccaagtgggtgctaaaaagttgcattttgacatgcgaacaagtgtcaaaaagctgcatcgcctcccacagggaacttgttaaacgtaacagatatttctataattctgttcaacagaaatatctatttttgttaaggacatagctcatggctggacgcacccccatacccgtctctcgcgcgatgcgtgccatatcctccaacctcgacctcgcacggcgccagcagcgaatcaccgtcgagctgctcgcaaaccgtgcaaacctcagcgttcccacggtgagaaagatgctcaacgaggggtccggctcgtttgagaatttcctgcgtatagcccgactgctgggcttcctcgacggcgtcgtcgaggccacggacccgcttcgaaccggcattggccgcatccgtgccgaggaagacgtgcccaaacgtgtgaggctgaactgatggaatgcctggtcacagtacaaatcggcggccaggacatctcctgcggaaggctctttcagaacgttcgccacggcgaggagacgaccacgttctcctacgacccttcctatctgtcgcatcccaaggcgtttgccttgtgtccagacatgccgctgggaccgggaacgttccattcgtccggacttcgtaacctccgggcgttcgaggactgcatgcccgatcgatggggccgcaacctcctgatgcgatcggagcgaaatcaagcgcgactcgagcagcgtaccgagcggaccctttttgaagccgacatgctctgcggcgtgagcgacttcacccggcaaggtgcccttcgcatctggagtccggacggcagggaggcacttgccaaggagtccgcgggcgtaccgcgcgaggttgagctccccgccctcctgagttccgctgacctagcggtcgaggacctgaacgcagacgttcgggacctcgtggccgcggggtcaagcctcggcggagcgaggccaaaggcatcaatacaagacacggacggcacactcctcatcgccaagttcccaaaggcgagcgaaagccaagccgaggatgtctgcgcctgggaacacgtgtgcctccgcctgatgaaagcctgcgggatagcggttcccccctcgaggctgacgcgcattaagggacgctccgtgcttctcctcgcgcgattcgatcgccgtgaaaagctgagggtcccctatataagcggcctgaccgcagtgcagggcgatgatggtgagcgctactcctacctcgagcttgcggagtttatcgaggagtctgggtcaaatccggacagggaccttccggagctgtggagaagagcggcgttttcctgcgcagttgggaataccgataaccatctgcgcaactacggcttcttgtggaacgggagcggatgggcgctctctccggcattcgatgtcaacccaacgcctggcgacaaccagaagtatcttgccaccgcgcttgacttcgacaggcccgaagccgacccaaggattgcgctcgaggtgtcagactacttccgcgtgtccgaggaccaggcaaaggcctatatgagaaaaaccgcccacgtcctggaagcatggcctgccatagcgcgaggcgagggaatatccgaagcctcaatccagcgcatgagctcgaacttccaaagcgggattgcctcgctcgaaagcaccagctgagcgagagggttcttccccagcgcgacgcaaatgcggcggccaccctcctcgggttgccgccgcatccatgcttgcgccttgatctgtgcgggacgccttcgcggggcgctaccgcctaccagctcagcagctcgtagcccgtgtccgtcacgaccagctggacctcccactgggcggagtcgctgccgtcggccgtacgcacgatccagccgttctcgcggtcgatggtgatgtcatgcttgccggcgttgaccatgggctcgatggtgaagcacatgcccggcatgaggatggggcccgtgccagcctcggtcgtgaagcccacaaacgggtcctcgtggaactcgacgccgatgccgtggccaccgtactcctccacgacgctgtagccggcgtcctggcacaccttgttcacggcggcgcccacgtcgcccaggtggccccacggcttgaccgcggccaggcccgccttgacggagtcgtggcacacgtccaccaggcgcttgcgctcggggctcacgtcgccgatgcagaacatgcggctggagtccgagaagtacccgcccttgatcgtggacatgtcgacgttgatgatgtcgccgtccttgaggacgtcctccttgttggggaagccgtggcagaccacgtcgttgatggaggtgcagacgctgtacgggtagccctcgaagttgaggtccgcggagaccgcgtcgtgcgcgcccaggtactcctcgacccactcgttgatgtccatggtggtggtgccggcgcagatgcgctcgcccaccaggtcgagcacgcccatgttgaccgcagcggaggcctttatgccctcgatgtccttggcggtcttgatgagcgagcggggcaggacctcctcgccctcgtggtagagctggtcgagcctgtcgtcctcggcggcgtggcacttcttgtacttcttgccgctgccgcaccagcaggcatcgttgcgtccgggtaccggaagcttgtcatacatgtgaagtctccttataaggccaatcgttgttctcatccccaccttagcgcttgggcgtggctactgctcgcggaacgtgatcttacccgtggcggggtccatcgagtccacgatggcgagggactcgaggtggtagccgcgctcccgcaggctcttgccgcccggctggaagcccttctccaccgcgatgccgatgcccgtcacgctgacgcccgcgtcctcgcaaatctggagcaggccgttgagggcgcagccatttgcaaggaagtcatcgattatgagcacgtgctcccccggggtcaggaagcgcttcgccacgatcacgtggtagtcgcggccgtgggtgtaggaatgtatctgcgtgcgatattgcgagccgtccaggttgatggactcggtcttgcgcgcgaacaccacgggcacgttgccaaagtggcgggcggccacgcaggcgatgccgatgcccgaggcctcgatcgtgaggatcttgtccaccggctcgcccgcgaacagacgcgcccactcggcgcccatgtggtcatacagctgcgtgtcgcagcggtggttgaggaagctgtccaccttgagcacgtcgccctcgcggacgatgccctcgctcagtatgcggtcctcaagctccttcatgtgcgtgccccgtttcctcgtgcagccccgttttttgtgcctaacaggatagcaggaggggcggcaggcaggtgcaagcgatgtgccactcacgcagctcacacgtaagcggtacgtctgatagcctgtgaccaggacgcagccgcgcggccggcgcgcggcacaggcagacgcaagcttgggggcgacgatggcgggtacggacaaggtgtttggcatgcactttggcagggtgtggcagtgcctggtgaacaaggccgtccgcaagggccgcgccgaggacgaggtgtttgccgtgacgcagtggatgacgggctacacccgcgcggagctcgaggcgctggccacaggcgacgccacctacggcgacttcctgcacggtgccccgcacatgaacccggagcgcctcaaggtaaggggcagcatatgcggcgtgcgcgtgcaggacatacaggaccccatgacgcgcgacatgcgtgtgctggacaagctggtcgacgagctcgcccacggcaagccggtggagaagatcgtccatccctagccgtgaccggctcgggatgatcgtccttctcgcccgcagcgtccttctcccctcccctggcgccgcgtccgaatgggcgcgtttgttacgagttatttcctattgaattgctgggatttacaagcggctagaatcgaccctgacgctttcttaacccgagtttggaggaaaacgatggagcgcaacagcatccgcactgccaaccttgaccgcaggggcttcgtgggcctcatggccctggggaccatgggcatgatgggcgcgctcgcgggatgcggcgaatccggtagcgacgcgagcggtagctcgtccagctccagctcgagctccaagtcgtcctccaaggcgctggccggcaagaagctcacgtttgtgggcgacgacgcctttgccccctaccgctacgtcaagaccgtgggcggaaagaagaaggtcgttggcctcgacatcgcgattgcggacgagatggccaagcgtctgggctttacctacacgttcgaggcgcaggagttctccgcgacgctggcgtccgttcagtcgagcaagacctcgttcacgatggcgatgtcctcaaacacggagcgcgagaagaccttcgacttcacgcgcggctactacgagccgctggtgggcgtcctgaccaagggcggcacggccatcaccaaggtgtccgagctcaagggcaagagcatcgcctgcaccaccggcaccgtgcagaacaagttcatcgaggccgtgctgccggacggcgacattcacacctacgacggcggcagccagtgcctgcaggaggtccttgccggccgcattgacgcgtacctgtgcgacggcgcggagggccagtccatgcgagacgccaacaagggcctggtgctgggcctgcttgcccgcaaggacacccaggactacgtgggcgtctaccgcgtgatggccaccaagggcgcaagctttgtgtccgccttcgacaagtgcatcggcgagatgctgaaggacggcacgatcgacaagtacattggcaagtacgtgggcaaggacttcgagtggggcgacgacacgagtgccgccggcaccgccacgaagggcgtaaactagggcgaccgcacatcccgagcacccgtggagccatggacctgaacttctcgatagtagaaccgtatgcgtcaatgttctggagcggcctcgccgtcaccctggaggtgacgggggccgccctggttcttgcgtttgccttgggcttcgtgatcgcggtgctcaaggtgatcgactgcaagccgctacgcctcgtgctcgacttctacacatcgctcttccgcggcatcccgctgatcgtgctgctgtttattgcatactttgcgacgccgcagctgacgggctacaagatatcgatgttcacggcgtccgtgctcacgctgggactcaacgggtcggccaccgtgtccgagacggtccgcggcggcatccagggcgtgagccaggggcagtacgacgccgcgcgctcgctcggcatgcgctacgtgcccatgatggtgcacgtgatcatcccgcaggcgctgctttccgtggcgccgtcgctcgtgaacgaggtgatcacggtgctcaagagctcgagcctcgtggccacgatcggccttgcggacatgatgcgcgcggcggaaagcgtgcaggcgctcacgtaccgcgccttcgagccgtttgtgctggtggcggccatctattacgtgatcgtgatggcgctggtggccgtgggcaagcgcgtggagcgccacgtgcgccgcatgcagtccggcagctaggtgcaagggagccggccgcgttcccgcgcggcgcgctagcggtagcgccgcctccacaccaggtatgagtacagcactgtccagattgacccgccaatgaccagggcgagaaggaccgcgaacacggccgcgtccggcatcaggggcgaaagcacccccagcgccacgagcccgacgcccatcgccacgaacgtccgccctcccatgcgctgcgacttctgccacaccaccgggtccgcaagcgcccacggcgtcttgacgccaaagctgtagttgcggctcacgcgcggcaccacccagaacagggcgacaagcgccacgggcagcaggtcgagcaggagctccacctgcttgggactcgtcgcgttgacggcgccgctcacgccccagtgcgagggtatccgagcgggaagccacggatacacggcaaggtgccccgcgatgctcgcgccgcagataaccgcaagcgcgaccaccgtgcgcctgccaaagcgcgggatcccgtcgttcgcgttcgcccccatgtcagccttcccttccggatgcctggctcacgtccacgagccacttcatgatgtcctgaaagaccgtggtgttgaggtgatagatgacgttctggccggagcgcttgctggtcacgagcccagccgccttgaggacccccaggtggttgctgacggacggcttggacatctggaagttgtccgctatctgccccgccgtcatgtcgccatcggacagcagctcaagaatgcgccgccgcgtcgggtcaccaagcgccttgaacgcgtcacccaccatgacacctcacctccgtcacgagcatcgtaccctggcggccgttcttctcgcccgactaactgcgtatttagatgtttgtctaaatgtctacacaaacgggcgagaagaaccgcggccaacggcgcaacgcccccgcggcctgcgctattctttcttgcagaaaactttgcggagggagcagtatggacaaggggcgcatggaggccttcagcgatggcgtgatcgccatcatcatcacgatcatggtgctggggatcgaggcgcccgatggtgcgtcgctccgcgacctgctggggttgcttcccgccgtcgcagcgtacctcgtgagcttcgtgggcgtgggcacctactggaacaaccaccatcacctgctcaagctcgtgcgccacgtcgacgggcgcatgctctgggcaaaccttgcgtttctctttgtgctttcgttcttcccgctggcgaccgactggatgcagaagacctccttcgcaccgctgcccaccacgtgctacgtcgtgctcaacatgctcgtatcgctcacgtacatgaacctcgagcgcgtcatccgccacgccatggggcgcgactgcggcgccacccccaaggaggagcttgcgcgacgcgccgtggtggagaagcgctcgctcctgaaggagcggctcacccttgtgttcgagcttgtcgggctcgtgctggcgctggcgctgcccaagtcgcacctcgccctcgtggcgctgatcgtcgcatttgccttctggatcgtgcccgacctgcgcatcgtgcgcctgctcgacttcctggctgaggacgagccggaggagtaggcgcgggcgagccccacagggtcggcgtcaaggcaaaaccgcacgaagtgacactggcgcaaaggctcgcgatagacataggaaagttaatcgaaagcggcgtggcgtatcatgcccctcacccattggaccagcggagaggggcacggcatgacacgcgacgcgattgacttcgagagcatcacgatcacggacgatctgatgtttgggacggtgttccaggacccggagctctgtcgggggctgattgagatgatcctgggcatcaaggtacgggacctccagtttgtgcaacgccaggcctggctcgacgcgggtccgctctcgcgcgcgggcatagtggacctgctggtgcgggacgccgacggcaacgagtacgacatcgagatgcagaacgtcgccacgccggacatcgtcttccgcgcgcggaggtacctctcgctcgtcgacctgagcatgctcgaccgcggccagcgctttgaggaggcaggcggcgcggtggtgatcttcatctgcgcaaacgacccgtttggggacgggtggaagcgctacgagtaccccaggcaatgccgcgagaccggacgcccgcttggcgaccggaccaacatcgtgttcgtgaacgcgaaggggaccaagggcgagctcggtgacggatttgacgcgtttctccaatacctttcgaacgatactgtcatcaggagcgattacgtcaggcgcgtgaacgacgcggtccaaacctaccgcgacgaccccaagtggaggaggttcaggatgctctggtccgagaagtaccgcgacgagattgccgacgccatgcaagccgggcgcaaggaaggtcttgaagagggtgccaagaagtgcggggcccagctcgcgcggctcgcccgtgagatggattcgagaggcaggtctgccgagttcatgtccgccctggaggacggggagaagatcgaccgtctgttggatgaattccacctcgcctagccacatcatgcaagagcatccagacgaggagctcgcgaacaacgcgcccaacgggggtcgtcacgactgaagcggaggaaacgtacgatgctctggtccgaaaagtaccgtaacgagatcgccgatgccatgagagctggacgcgaggaggcgtttaagaagagttacgaggagggctttgcagagggcttcgcggagggccttgcgaagggagccagggagtacgatgcccagctggcaagacttgcgcaagagctggaagcgcgagggcgatcttccgagcttatacccgcactggaagataaggagaagcacgctcgtctgttggatgagtttggcatcaaacgacagctctccgatgattgacaagtagacgcgcctagtcatccatgccgggacggcgcctcaggcgcttgaccttggcatgtctgctcttctcgtccagacgtcggcgcacggatgcccgcgtcggcttggtggcgtgccgcttcttgggtcttcttgcgcgacgggacagctcggccctgatcttcttcaggcacagctcgcggttttgcagctgactgcgcgactccctgctgaccacagtgatgcccgtgggaacgtggcacatgcgcaccgcggagtccgccgtgttgacgccctggccaccggggccggacgcgtggaaggcctccgcgcggcactgccgcgcaagctcgctatccggaaggcgagaaaagcgggcgtaatcggcgtatgtcagcttcttgtccatgcgtccaccttacgccactgcatgcagccagtcgagcgcggcaacgccaatcggacgcccccgtttaccgccggggcgcgacgacccgcggtgccagggcgtaccatgatgcgaagcagcgagaccaggaggccgcatgtctggatccaagtacatctgcccatgcaagcacgtgacggaggaagacatccgcgaggcgatagccaatggcgcgaccagcctcaagcaggttcgcaaggcgacgggcgccggcaccaagtgcggcaagtgcaagccagccgtgaagaagctggtcaagcggctgctcgccgagcaggagacgactgcggagccgacggtcgcggccgaacaggcagccgcaggcaagccggcggccacggcggcggacgccacgtccttctcgcccaaggcggcacccgttgccaggggagaagagcgcgaggtccttcgcgggcgcgtctatcggcacttcaagggggactactatctggtggaggacgtcgcccgctactcggagaccggcgaggagcttgtgatctaccgtaagctgtacggcgacggttcgctctgggcacggccgagggagctgttcctctcccccgtcgaccgcaagaagtacccggacgccacgcagcactggcgctttgagctgcaggaaatcgaaagcgtcgcgggccactagcggcgggccgcgcgcggatgacggacgttgggccgggcacgacccggcgcggaagggaaacgcacatgaaggtattgatggtaaacggaagcccacacaggaacggctgcaccgcgcgggcgctgcgcgaggtcgcggggccgcttcaggcggccgggatcgaggtcgaggacttctggatcggcagcagggacctgggaggctgcaaggcctgcggctactgcgagacggcaggcaagtgcgtgatgaacgacaaggtgaacgagttctgcgcgctcgcggaccacgcggacggcttcgtgtttggctcgcccgtgtactacgcctccatcgccgggcagatgcgctcgttcctggaccgcgtcttctactcctcgcaggggtcgagccgcttctacatgaagcccgtcgccggcatctccaactcgcgccgtgctggctgcgtgaccacgtatgaccagttcaaccactactttggcattggcaacatgctcatcgtgtccggcacgtactggaacgagacccacggcttcacgcccgaggacgtggagaaggacgcggagggcctgcgctgcatgcgcgccatcgggcagaacatggcgtacgtgctgagggcgaaggaggccgccgaggcggcgggcgtgcttccgcccgagccattgagcggcccgctcaccaacttcatggacggcaagtaaccgacagagagccagccggcacgtggtggaccggcgcgcgaccggcagccagacgcaagcgaacgggggcgccccaggcggacgcccccgttcttctccctagcctatgagcacctgcgccacaagcagcgccgcgttgagcgcgatggtggctatgagcagcgggttcacccacttgagccagcggctgaacggcacgtcgaccatcgcgagcgacgccaggatgaggcccgtgggcgtgatgtacgagatgaggccctggccgtagttgtacgccgcgatgacggccgcgcgcgagacgcccaccgcgtcgcccagcggcgccatgatggggatggacaggacggcgaggcccgaggacgagttgatgaagaaccccaggatgatgtagaccacgagcatcaccaggatgaagaggactgggctcatgcccgtgaccgcgcccgagaagaagtgcaggatcgtgtcggatatgaagccgttctcgagcaggatgttgacggcgcgcgccacgccgacgacgagcgcgacgctcatgaggtctccgcagccgccgatgtacttgtcgaagaagacctcctcctccagcccggaggtaaacgcaaggacgatggagcaggcgagaaaaacggcggtcatgtagtcgaaccaccactggaacgcgacgatgccgtacaccaggaccacgaacgagatgccgaacaccgcgagcgagaccttcatgtgaccggtgaactcgatctggttgccctgctggccccagcgctcctcgatcttctccttcatgtcgtagcagacggacttggaggggtcgaggcgcacccggtgcgcgtagaccatgatgtaggcgacggccatgaccgtgccgacggcaagcgcgatgaagcgccagttcatgccctcggacatggcgatgccggcggccttggtcgcgacgcccgtcgcaaaggggttgacggtggaatacatggtgccgacggaggctcccacaaagatgacggcgatgcaggtcatggcgtcgtagccggccgcgatgaacacgggcatgagaatgggatagagggcgatcgtctcctcacccaggccaaaggtggtgccgccgatgaccatcaagagcgaaaggatgatgatgagcaggtactcccgcccgcgcgtcacgcgcgaaagcgccgccacggccgcgttgagtgcgcccatgtagttgaggacgccgatgcagccacccagaaggaacacgaagaggatgatgtcgatcgtgtcgtacacgccctggatcggcgcgagcagaaactgcaccacgccctgcggcgcctgcgccacgcgcttgtacgtgcccgggatcgcgatgggctttgagatggagccgttggtgaagttctgcagcttgcccgagacgcccagcttgtcgagcgtggcctgcgtgggcggcatgaggcgcgtgctgtcatccgggttggtgatgacgaacttgtcctgcgtggcgtcgtaggtgagcttggcgtacttgcccgcagggatgaggtacgtgagcgcagccgcaaacagcatcacgatgaagagcacggttattgcggttgggaagtgcagcttgtggcgcttcttgggcgttggtgcgtccgccgtctgggcggcaaggtcctcggacacgattgctttcctttctgatggttactgttctgcgtagacgcccacgagctcgaccacgacccgcgtcgcggcgtcgatgccctcgacggtcgcatgctcgtaggggccgtggtagccctcgccaccggtgcccaggttggggcacggcagcccgcggaacgagagctggcagccgtcggtgccgccgcggatgggcgtgacgctgggcacgacgcccgcacgctcgcacgcgagcttggcgttgtctatcgtgtacatgcagccctcgatcacgccggccatgttctggtactcgtccttgatcgtgagggtgacggtcccctcgccccagcgctcgttgaggaccttggcgatgtggcgcagcgtctgcttgcggcactcgaacgacgccgcgtcgaagtcgcgcacgatgtaggacatgccacccgcgcactcgtccccgtggatctcgagcaggtgatagaagccctcgtagccctccgtgtagcgcggcgcctcgagccccgggagcatgttgttgatgtcgcagcacagctgcatggcgttgaccatgatgcccttggcggagcctgggtgcacgctcacgcccccgacctcgaagtccgcctcgcacgcgttgaagttctggtactggatctcgccctcggcgtcgccgtccagcgtgtaggccacgtccgcgtcgaagcgctccacgtcgaagttgtcaacgccggtgccgatttcctcgtccggcgtgaaggcgatgcgcagtggcccgtgcggtgcgccgctcgcgatgatgcgctcgagcgcggtcatgatctccgcgatgccagccttgtcgtccacgcccaggatggtcgtgccgtcggacgtgaggagcgtgcggcccttgagttccgccaggcgcgggaagtcgtgcaccgtgagcgtacgcccgctcgtgcccagagcaaggtcacgaccgtcgtagtttttatgaatcacaggcgtgattgtgccgtcgcagaattgtgagacggtatccatgtgtgcgatgagccccagctttgtggcaccctcgagccccggcgtcgccggcagctttgcgtagacaaagcacttctcgtccaccgcgacgtcctcgacgcccagctcgctaagctcgtccgcaagcaggttcgcgagcacgaattcgtccttcgagctgggacactccgagtcgttctcctcattgctgggcgtcttgacctcgatgtagcgcagcagcctgtcaatggcctccatcgcgaaagctcccctctcacaaactggcgagggccacgcccaagcggacatgaccctcgcgccattgctcgtaacatttttgaaatataagactttgcatctacgcgatgcaagcaatctcgtaagaggtagctttgcgcgcgcgttcggtcgttcgcgggcgagaagagcgcggccccatggccgtcaggcagccgcaagccgcgacacaaaaaggcgccccgcagccgtcacgacacccaaggtgtcagctggctgcggggcgcccctgcgtcctacgcgtatgtgacgtgggtcgttcttctcacccggcacttctctacttgaggaagtcctcgatcgacctggcgacgccctcgccgtcgaggccgtacttcctcagcaggccgagggcgggtccggactcgccgaagacgtcctgcacgccgaccttcctgacgggcacggggtgcttggcgcagagcgcgtcgcacacggcgctgccgagcccgccgatcacggagtgctcctccacggtcaccacgcggccggtcttggcggcggagctcacgacgagcccctcgtcgagcggcttcacggtgtggatgttcagcacctcgcagctcacgcccttctgggcgaggaggtcggccgcctcgagcgcggcggagaccatgaggccgcacgccacgacggtgacgtccgtgccctcgcgctccacgacgcccttcccgacctcgaagtggtagccgtcgccgtggatgacgggggcggcgagcctgccgaggcgcaggtagacggggccgtcggcctcgtaggcggcgcgcacggcggcgcgggcctccacgtcgtcggaggggacgatcacggtcatgcccgggatcgtgcgcatgagggcgacgtcctcgttgcactggtgcgtggcgccgtcctcgcccacggagatgcccgcgtgcgtggcgccgatgaccacgtgcaggtgcgggtagccgatggagttgcgcacctgctcgaacgcgcggcccgcggcgaacatcgcgaacgtgctcgcgaagaccctgtggcccgtggtcgcgatgccggccgcgacgcccatgaggttctgctcggcgatgccgcagtcgaggaagcggtccgggtaggccgccttgaacttgcccgtcttggtcgcggccgcgaggtccgcgtccagcaccatgaagtcgtcgtgctccgcgccgagggccacgagctcctcgccgtagctgtcgcgcgtcgcgaccttcctgacgtctgccatgtcctacgcctccctctcgagctccgccatggcctgggcgaactgctcgtcgttgggggccttgccgtgccagcccacctggttctccatgaacgagacgcccttgcccttcacggtgtgcgtgacgatgcacgtgggggcgcccttcgtcgcgcgcgcctccgcgaaggcgtcgcgcagctggtcgaagtcgttgccgtcggccacgtccacgacgtggaacttgaaggccttgaacttctcccctatgggctgggcggagttgacctcctcgatcgtgccgtcgatctggaggttgttgttgtccacgatcacgcagaggttgtcgagcgcgtggttgccggccagcatggcggcctcccagacctcgccctcctcgatctcgccgtcgccgcagagcgcgtaggtgcggtagtcgtcgccccagtgcttggccgcgatggccatgcccacggcggcggagatgccctggcccagcgagccggtggacatgtcgacgcccggggtgtcgttcatgttggggtgcccctgcaggtacgagccgatgtgcctgagcgtcgccaggtcctccaccgggaagaagcccctctgcgcgagcgtggcgtacaggcccggcgcgcagtggcccttggagagcacgaacctgtcgcgcttgggatcgcgcgggttcctggggtcgacgttcatctcctcgaagtagagcagggtcataatctcggtcgcggacagcgacccgccggggtggccggacttcgccgcgtgggtgcccacgaggatgcccttgcggacctcacgggcgaccttcttcaactcgtcgtcggtcatgtggttctacctccctgtcacagtcaaaaaggcggccgggcgcgcgtggtgcaccctgccgcctgcgtcaatcctagtcctgcgcggtgacctttgcccagtccgccgcaaaaagctccaaaccgcggtcggtgagcgggtggtgcacgcacttcttgagcgcgccaaacggcacggtcgcgatgtcggcgcccatgagctcggcctgcgtcacgtggtgcggcgtgcggacggaggccgtgatgatctcggggccaccctcctcgtcccagtagccgtacttgaagttgtgcacggcggtcactacgtcggcaaggtggtcgaggccctcgtcaccgatgtcgtcaaagcggcccacgaacgggctaatatagcgcgcgccggcgcgggcgcccaggagcgcctgcgtcacgctgaagaccagcgtcatgttgacgcggatgccctcctgcgcgaggtggtggattgcggggagcgactgctcggtcacgggcagcttcaccacgatgttgggcgcgagcgacgcgaggtgctcggcctccttgatcatgccctcggtcgtctcggccgtggactccgcggagacgggcagcccctcgcagatgtggcagatcttgaccatgtggtcctcgaagtcggcgagcttgccgccggtcttcgcgtacaggctcgggttggtcgtgacgccggagaggatgccccagctcgcggcctcgcggatgtcgtccaggtccgcggtatcgataaagaacttcatgtctttctcccatgtgtaccgtcgcgcccggcatgttcggcagggcacgcaaacgtcaagtcaagcttccgcgggcgagaaggaccgccgcgcggcttaagcaccgcattgggccgagcctaggactggctcgccatcgcggtgtcgatcttctccctcacgaactcggaggcgtgagcgacgtcgcgcttccagtccggggaaccgaggtaccacatctcgcacacgtagcggcggacgccctgtggcacgagctggctcagcgcgccctcatagtcggtcgtaccctcgccaaagagcatgtcgcggtactggccggccttggtggccttcatgtgcgccgcgaagatgtggccacgaccgagcgcgatgtcgtccgccacgctcttgccatagaggagcgacgcgttggtgaggttgccaacgtcgggatagacgcccaggtagggactgttgatggcgtccacgtactccatcgccttgccgacggtgtccatgaacggcgtctccatggtctcgaagcccatgaccacgcccgcctttgcggccatctcggtcgccttggcgaggttctcctcgaagcactggcgcgagccgtcccacttgtcctcgtcgtagtaggcgtcgtagccggcaagctggatgatgtgcagcccgaggtcgcacgcgagctcgagcgccttgtccatcatctcgaggctgtacgcgcgcttcttggggtccttagcgccaaacggccacttgcgatggaccgagaggcacatggaccccagcgggatgccggtctggcgcatcgcgtcgaccacggccgcgcgctcggcggcggtccagtcgaggcgtgcctggcgggcgtccgactcgtcgacggagatctccatgtagtcgaacccgcactccgccgcgacctgcaggcgctcctcccacgtgaggtcctgcggggtcgccttctcgtacaggccgagcttgtattgcctgctcattgttggtcccctttcacaagggcgccctcatggccctgccatggggggcgccccctcttgcaacgttgtcgccgcgtcaagcggccttatgtccggctcctacttctggccgtagtaggcgttggggccgtgcttgcgcgagtagtgcttgtcgagcaggtactggggcgccttcgcgtcgtcgagcctgatgccggcggcggtgcagagcatctcggtgtcgcgggacatcttcgcgacctcctcgacgaccacggcatggtagaccgccgcggcggcgtccttgccccaggtgaagggaccgtggttgcggacgaggcagccaggctgggccatggggtccatgccgccgaagccctccacgatgaccttgcccgtgttgagctcgtaggcctcctcgatctcctccttggtcaggcccctcatgcaggggacctcgccgtagaagtagtcggcctgggtcgtgccgtagcacgggatggagcgcccggcctgcgcccacgcggtcgcggccgcggagtgggtgtggacgatgccgccgacctgctcccaagtacggtagaggtaggcgtgcgtcgcggtgtcggacgaggggttgaggtcgccctcgaccacgttgccgtcgaggtcgcacacgaccatggactcgggtgtgagcttgtcgtagtcgacgccggagggcttgatcacgaacaggcccttgtcgcggtcgatctcggaggcgttgccccacgtgaagacgaccagaccatgcttgggaaggtccatgttggcctcgtagaccttctcgcgcagttccttgagcatcatgttcgctaccccttagaggaccgagcggaagggtacgttgggctcgtgctcgaagcagtcgtggaagccacggtcgtacatgtactccttcttgtccttgtcgagcgggtaggtgtagtcgccgccgggctgccagtagaacgggtggaacttgtactgcagacggtccttgcgcatctggtacaggacctcgatctcgcgctggtccgccatgaagttggtccagacgtcccagtggatggggatgacgaccttggcctggagcgcctcggccatgcgcaggatgtccgtggcctccatcttgtcctggatgccgacggggttgcagccgtaggagccgaagcagacgtcgacgccgccgtactccttcatgatgtccttgccgtgcttggcgaagtagatggagtagtgggagtcgccgctgtggtagatgttgccgccgggggtcacgagcaggtagttgacggccttctcgtccatgtcggtcgggcacttgccggcgaggtcctcgcggtcggggccggtggagtcggtcgtggtaatgcaggtgcggtcgaaggagtccatggccacgatggtcatgtccttgatcttgatcttgtcacccggcttgacaacgtggatgcggtcctcggggacgccccacttgcgccagaagtctgcggacttctccgggccgatgaacggcacggggatctcattgccatcctcgtcggtggtggtcatgccggacttgacgacgtgggctgcccactccttggacatgtggtcctggtggtagtgggtggccaggacggcgtcaacatgcttgaacgcgaaggggtcgaacacgtacgggatgttgcgcaggttgggctgcatggtgcggacgccggccatgttggccatctggtggccgaccttcatgaggccgttgccgtgggtgcgcttgccgttgccggtccagaggtcgatcgtgatgttggcgtcacctggcgtcttgatccacatgccggtgcagccgagccaccacatcttgacgttgccctcgggaaccttggcgttctcgatgtcctcgttcagccacgtgccccactcggggaacgtgttcatgatccagccctcacgggttacttcgtcgatagcggacatgcgtttctcctcttgtttgcggatttctgtctgcgttgccttgcgcgcctactcggcgtgcacgttgtagagcgcgacctcgtcggtctcgcggtttgcggagatgatgcggctctcccccgcgtcctcgaagacccacacgttcgcggggccgcggtcgtggtcgatgatctcgacggcgtagtcgccgtcctggtagtggagcctcaggaggtcgcggccgcccttgcggttgcccagcagcgcggagggctcgccggccaggtcgccggcccagatggcgtgcaggaacgggcgcttctccgggtcctcccagaccttctcgtacgtgtcctcctcggcgccggcatgccacacggacagggtgtcgccgtggaacgtggagatggtcacgatctcgtccttgccgtcgccgtcgaggtcgaccatcgtcatgtcgctcgtgggctgcacgacgaggcagtcgaccttccagtcgtccccgtccttcgcgggcggcacgtagcggaacacgcctgcggcggtgcccaccagcgcaaagctgcggtcgggagcggtgtagaagccgtggttctgcagctggcagttagtgagctgcgtcagctcaagctggtggtcggcgtcaaactgctcgaggtccttggggagcttggccacgtacacggcacccggcgtcttccagtcgttcttgaactcgcggcacgcggacttgatggtgcaggcaatgagccacatctggccgtcggcaccctcgaccacgccaaagcggtgcacgtagggaaggtcgcacaggacgcggcgctcccaggagccgtcctccttgcgcgtgtacgtcacgatcttcgcgtcgtccgcgccaaagttgggcgagaagaacttgtacgtgctcatgagctggtccgtgcgccagggggtctgcatgaccgtcatgacgccgccagggccgtcgcacacgttctcgcgctgcgtgccatcgagggtgaagcggcggatgggacccgccttctcggtcgcgacgacaaagctcttctcgcccgccgcctcgaccatgccgatcgcgtagcacttgggcatgtcagtggcgagcaccttcttctcgtacctcatgaatggcctcctcgggcaacgatgcttacgcgatggcgggactgcttactttgcgaactttttgtcgagcccagcctcgacgaacttctcctcgatctccttgtcggaaaggacgttcttgagggggatgcagatgaccttgccggagtccgccgcggacttgaacatgttctcgaagttgcgggggaagcaggcgacgtcgtagctggtcgcggtggaagtgccctcggcgagcgcgcagtggtgaatcttcgcgacgtccatgttgagcttcttgcagacgcgctcgacggtgagctgcatcatcagggaggtgccggaaccgttagcgcacgcgcacagaatctttgctgccatttttcgacctttcccggcgcggctggatgccgcgagcctttgttagaacacgctttttagaagacgcggccggcaacacagggggaatgctgccggccgcctgaaaccggatggagctcgtggagcgaggccttgctactttgcctcggcggctgcgaccgccttcttctcggctgcgtcgcggtactccgcgtacttctcgtagtcctcgacctcgaggaagtaggtgctgttgccgttctcgtccttgggggcagccttgtactgcatctgcgggatggcaagcaggaagacgatgatgagcgcgacgccgacccagccgaggtacttcatgatgaccgtgaagatcggccagacggtgacccagtcgaacatgccgaggtagccgccgaaggcgtacatcttgacccaggaggcaatcagcgcggagccgaagacctggcagaggccgcagatgaagggaaggatcaggcaggccttgaggccacccttgttgttggcgtacacgccgatgacggcgttgtcgaagaacagggggatgaagccggcgaccacgaggacggggctgtgcatgaggatgagggcaccgatggcgaggaactgtccgacagcgccggccatgaagccgatggtgacggcgttggtggagccgaagccgaaggtgacggcgcagtcaacgccggggacggagcccttgaggagcttggaggagatgccggtgaaggagacggtgagctctgcgacgaaggtgcggacgccgagctggaggatcgtcaggtagacggcgaactggaagcagttgtagaggatgtagaagacgaagctctgaccctcgacgagggcggcggtaccggtgagggtgccctccttggtgagcttgatgaggtactcggggccgatgacgatgtagatgatgccgaagaagagggtcatgagcagggcggtggagaccatgttctcgttgaacatcgagagccagccggggagctcgatgtcctcgagcttcttgtcgaacacggaggtcttctcggggtgcttgtcgtgacggaccttgtcacgcttcgccatccagccggcgatcttggaggaaaggaagatgccgaacatctgctggtggccgatggcgaagccagcgccctcggtcagctcctgggtcgggccgatggtgaggttggagccgacagcccagtacaggccgaggaggatcgtcatgaggacgagggcgggaacgctcacgaggttggggaagcagaacatgatgagccagagggccgttgcggactgctgaacctgaacgttgccggtggtgaagatggagcggagcttcgtgtgcttcttggcagccacgagcacgatgttgaggatgtaggcgaacaggagcagcagcatgtactgcgagatgttggcgcccttgaggaacgagacgtttgccagcgagaagtctcccgcctgggccgccttgacgcccgcgtcaaccgcgttgttgccgaagtaggggtcgatgaccatagcggtcaggttgaagcggcccttgaggccgacgatgatgggacggaacacgctgacgaggccgccggagccgacggaaagaatcatgtagccgaccgaggccttgatgaagcccgcgaggacctcataccacttctttccgagcagcgcgtagccaatcacgacgatgatgccgatgatccaggctggctgcgacaggatggtcttggagaaccaagttaccgctgacagcaagatgtccaatttcctctcctttacttactcttgtccgggtcttgtccgggtcgattattcgccatcgaccatggcgtcaatctcgatcaggtcctcaggggtctgggcgcccttcaggcgctcgacgacctccgggttcgacaggacggccgcgagctgctgcatgttctgcaggtgcgagtccgcgtcgacgtcgctcagcgtgaagaagatcgtcgcggtggtgtcgggatcgtcctcggcgccaaagtggaccggctcctttacgtgcatgaagctgatggcctcgcgattggttccgacggcaccctcgaccgcgtgcggcatggccacgccggggagaaggacgatgtagggtccgtgcttctcgacgttctggatcaggcagtccgcgtactcgggctcgacgctgccgtctgcgagcagcggctcgattcccttgcgcagggcctccttccactccatgggaccgtccacgaagttgtagtgcttgagttcaaccagttgacgaagtagcatgtgtgttcacctccccgtggcttattgccttgtggctggtttcccgccggctcgcgactggccccccttcggacctggtcgcgtgagggcccttccgccctctcttcaaggtggatagtacgccgatattttttgttttgaacgtgtttagttttcgtatctaacgtttttatcgttcgtattgaagcttttcagtgtttatacaaacgctgatttgcctcattgttccgcaatgctgcgaagtctaaaatgggttcgtgttcgtatgaacacggtttaatatttctttgtctgccggcgaacggtcgtttttctcgcccgagcggttattccaaaggagcctggcatgggcacgtccagaagcatcgtcgagagccgccgcgctcacatcgtcgaggagctgagcgagcggggacgcagcaaggtcaccgagctcgcaaaggacttcggcgtgtccacgctcaccatcaggagggacctcgacgagctggcggagaagggcatggtccgccggctgcacggctccgtcgaactaatcgaccccctgggcggccccatcagctcgtccgcggtcctcgcaaagcgcagcatcgccgaggaggcggcaaccctcgtcgaggacggcgacaccatcttcatcaacacgagttcgaccgcgctttccgtgatagagcacatcacggccgagaacgtgacgatcgtgacaaacaacggcaaggcgctgcagataactcccccgcccggcgtcaccatcatcctgaccggcggcgagatccgcctgcccaagtggtccatgtcgggcgagttcgccctctccaccgtgcgtcacatcaacgcggcgaaggccatcctgggatgctcgggcttctccgccgaccgcggcctgacgacgctcgtctcgcacgagacgagcgtgaactcgctcatgcttgaccattcggacatgcacataatagttgcggattgcacgaagatagggaccaactcgagctttcgctacggtcgagccgagcaggtggacgtcctcgtgacggacgagaactcggacgagcagcagatcgccctcctcaagaaggcgggcgtgcggatggtcatgtacccgggaagcgagtagcggccgcgacagcgtcaaaaccctcccccgacagccgttggcgttaccatggttagaatccagaccaagcaaggggaggcaccagtgcgcacgggcgacaacggcaacggcgagaagaacgacaaccgggtgattggcgccaccacggagccccccaccggcgtcgcactcgcgcgcgtgtccgtcacggtgctgctgctcgcgctcgcgatcggcctgttggtggggttcttctgcatcggcgcgctgtggtgcgtggaccaactgcaggagcagatctggaaccacgccgtcgcggcgg

SEQ ID NO: 268 - DNA, 34448 bp, Unknown
  Metagenome-assembled genome
gggtggttgtcgggcatgtgaatcttcctttcgtggagagccccctacgcacgggggcaatcgacacacgtggctgaacacaggttgaatgtagcttgcataggtcagctggcgcgcaggcgcgggcaagcgctgggaaacgattgcgtgaagagcgcgtaaggcagcaggtaggggcgcccgcgcgaacggtgcgccgctatagtggataggcaactgcaaaccacaccgaagcggagatgccatgccaagctcgtcctaccttgccaagcagatgatcgtgatgaggcgcgacctcaagatgcgcaaggggaaaatcgccgcacaggcggggcacgcctgcgtggaggcgacgctcatggcgctcgcacgcgagcatcgcctggaccaggtgcgcgtggcgaccgccgaggacggcagccccacctgggtctacctggacgacgacggcacgccgaggagcgcgctttccgactggttcgacgcgggcgtggcgaaggtctgcgtgtacgtggactccgaggaggacctgcgcgaccttgcggagcgcgggcgcgagcgcggctttgccgtggcgctgatccgcgacgcgggcctgacggagttccacggcgaggccacgtacacgtgcctggcgttcgagccactgcgcgcggaggacatcgacccgctcacggggaagctgcccctgtactaggggttggcacgccgtgcgccggcacggcggcgcgtccttctcccccgggcgaagcatttcagaacggttccgattgcggcgcgcccacatgcgccgcactatcatgtttggactatcttgggaaattctgaccgcactcgcgacgagggggaccacatgcgcatcgacgacatcctgaagggaaagcagaccttctctttcgagatcttcccacccaagggtgacatgtcggtccagcaggccacggccatcgcggacgagctcacgctcaaccaccccgactggatcagcgtcacgttcagcgcgggcgggtcgggcaactcgcagcacaccgtcggcgtcgccaaggccatccaacaggccggcaagacgcaggccctcgcgcacctcacgtgcctgggctcctcaaagcaggacgtcgacgcgtacgtgcaggccatcaaggatgccggcgtccagaacgtgctggcgctgcgcggcgaccgcgtgcccggacgcgaggccatcgacttcgagcacgcgtccgacctggtgagctacctcaagggcaccggcctctgcgtgggcgccgcgtgctacccggagggccacgtggagtccgcgtcgctgcgcgaggacgtggagcacctcaaggccaaggtcgacgccggtgccgacttcctggtcacgcagctcttcttcaacaacgacgacttctaccgcttccgcgacctgctggtccgcgcgcacatcaaggtgcccgtggtcgtgggcatcatgccgttcacgagcgtccagcagatccagcgcatggcgttcacctgcggcgcatccatcccgtccaaggtcatcaagcgcctggtcgcggctggcgacgacaaggaggcccagcgcagggcgggcgtcgcctacgcgtgcgagcagctggttgacctggcccagaacggcgtggacggcctgcacatctacaccatgaaccgcccgtccatcggacgcgccacgcacgactgcctgctcaaggcgggatacctcaaggagtagcatgcccgccgtcccaacccccatcctcaagagctacgaggtcacgtccgtcgaccgcaaggaggtcctgcgctacctgggctaccgcggccaggaggtcacgcctgagctcgacgcgcgcctcgacgatgccatcgcccgctgcctctccatcggcaagccgcggtcaagcctcgccacgttcgatattgccgggcgagaagaactgcccgacgggaccccgcaggtcgacctcaagggcaccgcgctcgtgctccagggcaagtccatgcgcaggcacatggacggcgccgtgcgcgtgggcgtgcttgcggtcaccatcggcatgggcgtcgagcgggagctcaagcgcctctcgctcacggaccacctggggcaggtgctcttcgacgcggccgccacgaccatggtcgagcgcgcggcggacgccgccgaggccacgctcgtgggcatggccgcgcaggacggcctctacaccaacttccgcttctcgccgggctacggcgacatgcccatgaccacgcagcccgtgctgctcgacgcgctcgacgcgcgccgccgcctgggcatcactctcagccccaccctgctcatgacgcccaccaagagcgtcacggccgtgctgggcatgttcacgacgccgcagaagtccacgcacgcgagctgcgccgactgcttctgccgcgcgttctgcaaccttcgcgcaaccacagggaggacctgccatgactagcgaaccccaggccacggccgcaggcgcaccgcgtgccaccaagtccgtgggcaccatagacgcccgcaagtactttggcacctacgacgagcgccgcctccgcataaaggacgaccacctcgcgcgcgtgctcgcgggcgaggacttcctgctgttcgacggcgccatgggcacgcagctccaggcgcgcgggctcgcggccggcgagctgccggagctcctcaacctcaccaacccggacgagatcacgcagatccaccgcgcctacgtcgaggcgggctcggaggtcgtgaccaccaacacctttggcgcgagcgcacccaagctgggggacgcggccacggtggaggaggtcttctcggccgccgtcgcctgcgccaaggcgtcgggcgcgcgctacgtcgcggcggacatcggccccacgggttcgctcctggaacccatgggcacgctgccgttcgaggacgcgtacgagctctttgcgcagcaggtgcgcgcggcggacacggcgggagcggacctcttcatcatcgagaccgttgccgacctcgcggaggccaaggccgccgtgctcgcggcaaaggagtgctctgacctgcccatattctgcaccatgacctttggcgaggacggccgcacgttcttgggcaccacgcccgaggtcgccgccaagacgctcagctcgctgggcgccaacgtcgtgggcatcaactgctcgctcggccccaaggacgtggcgccgctggtcgagcgcatgctcccctggtcgagcgtccccgtgatggcgcaggcaaacgcaggtctcccccgcgtggaggacggcgtcacgctgtacgacatcgcgcccaaggagtactgcgaggccgtcgcgaccatgctcgacgccggcgtcacggtcgtgggcggctgctgcggcaccacgccggactacatcgcgggcgagaaggacctcattgccggccgcacccccaccccgcgccacgtcaaccacgacttcgcggtcacgagctcgcagcgcctcgtgagcatccccatgggccacgtgggcgtcatcggcgagcgcatcaaccccacgggcaagcgccgcatgaaggaggccctgcgctccggtaactacgactacgtgatgcaggaggccatcggccagacggacgcgggcgcgcaggtgctcgacgtcaacgccggcctgccggaaatcgacgagtccgccaccctgcgccgcctcatggcggacctccagggcgtgacggacctgccgctgcaggtcgactccgccgtgccggaaaccatcgaggccgccgtccgcagctacccgggcaagccaatcatcaactcgaccaacggcaagcaggagacgatggacgccgtgattcccatcgcggcacactacggctgcgcgctggtcgcgctcaccattgacgagaagggcatcccccagacggcggagggtcgcctccaggtcgcgcgcaggatcgtggccgcgacggacgcggccggcatcccccgcgaggacgtggtggtggactgcctctgcatggccgcctcgaccgaccagcgcgccccgcgccagatcctggacggcatcacgctcgtcaagcgcaagctgccgggcgtgcgcacggtgctcggcgtctccaacatcagcttcggcctgccgttccgcccgctcgtcaacgccacgttccttgcggctgcctttgcggcggggctcgacctctgcatcatcaaccccatgcagcagcgcatcatggacgtggtcaacagctggcgcgtgctcacgggcgaggaccagagcgcccagtactacgtggccaactatgcgacgcgaagcgacaaggccccggccgcggcatcggcgggcggcttcggcgcaaaggacgcgcctgcagaatgcccgcctcacgccacggccggcgctggcacgcaggacgccgcctcgtcagatcccgccgcgcaggccaaggccatggtcctttccggccgcaagggccccatgccggagctcatcacccaggtcctcgcccagcacgacgtcatgtacgccatcaaccaggtgctcatccccgccctcgacgaggtgggcgtccgcttcgagaagggcacgttcttccttccgcagctcatggcctcggccgaggccgcaaaggccggcttcaacaccatccgcgaggccaacgccgcctctggcacggaggtcgcctccaagggccaggtcgccatctgcaccgtcaagggcgacatccacgacatcggcaagaacatcgtcaagatgctgctggaaaactacggctacgacgtgctcgacctcggccgcgacgtcgatccccaggtctttgcggacgccgtggtcgagcaccacgtcaagctggccggcctctccgcgctcatgaccgcgaccgtccccgccatgcaggacacgatcgagctcctgcgcaagcaggccccctggtgcaaggtcatggtgggcggcgccgtcctcaaccccgagtacgccaagatggtcggcgcggactattacgccaaggacgcggccgagtccgccaagatcgccgcggaggtcctcggcaagtagcgccgcaaccgcaatcgcccgttctgccacagtcatcatccgtggagaagaacgcccgcaccgggttgaatccggtgcgggcgtcgtcgctttgtgcgtcggccctacaggcgcagcttggcgcggacgatgcgcgtgacggactcgtcgatgcggtcctccgtgatggtgccggccttgaccgcgtcgagcacgccctggtagctcttctgcagctcgggcgtcatgagcagcatgtccacgccggcctggatcgccaccacaccgagctcggcggcggtgtgcaggccgctgaccgcgcccatctcgagcgagtccgtgatgatgatcccaccaaagccgagctcgccccgcaggacgtccgtcacgatcctttttgaaagcgaggccggctcgtccgtgcccgtgacgtttgggcagctcatgtggccgaccatcaccatggggacgcccgcggcaatggccttttggaacggcacgagctcctcctggcgcatctggtcgagcgtcttgacagtggtgatggtgtcggtctcggagtcgccctccgcgccaccgatgcccgggaagtgctttgcacagcacatgatgccgccgtccgcaaagcccctgaccgcagactcgaccatgggcgccaccacgtccgccgtcttgccaaacgagcgctttgccatggtctggctcgtgccgttgacgatgtccgcgtccggcgcgaagtcgacgttgaagcccagcggcaccaggtagcctgcgatcttcttgctcacgtcataggcgttctgggcgttgcccgtggcacccacgtcgcacatgttgcccacgttcgcgatggatgggaatcccttgttgccgccaatgcggctgaccgtcccgccctcctcgtccacggacatgaggagcggcaggctcacctcgtcctgggatatctgcgtcgagtccgcgagcatctgctcggcctgatcctggtccagcaggttctgcgcaaagtagcacacgccgcccaccgggatcttggcaaacgccttgcgtgtggtgtcccccgccgccgtgacctgacccatgcccgtgagcgcctccggcttgggaaagaacatctgcgcgaccttctgctcgagcgtgagcgaggcgaccttcttggcgacctttgtctcgaggtcgtccgccgtggacgtcgcggcatccttggcgctggctgccgagccgctgctggaaccatcgtccttctcgcccttggaacctcccgtgcatcccatgacgccacacgagagcgcgactcccgcggcaacgccgccgatggtcagcgcggcacggcgggtcatgttcgcacccggcgcccaatgttggggtgtcttgtcgctaactgccatggtcgtccaatcgcatttgtggcgcccgtcatcatatgcacgccttaaggataccgtctgatgtagccgcacgttatacaagtcaagggcaccctcgtcgaatggcgaggatgccctacgcttgcaatcagcttgttgcgacgcttggcagccggttaaaagcagggcgagaaggtctcctcgcccgcccgaggcgccgccgtgggcgcgccttagaagtccgcgttgcccacggtgcgggggtgcggcaggacgtcgcggatgttgtccacgcccgtgaggtacatgaccaggcgctcgaagcccaggccaaagcccgcgtggtggcagctgccgtagcggcgcaggtcgaggtagtacttgtactggtccttgtccatccccagctcctcgatgcggcgctccagcacgtcgaggcgctcctcgcgctgggagccgccgatgatctcgccgatgccgggaaccaggcagtccgccgcggcgaccgtcttgccgtcgtcgttctggcgcatgtagaacgccttgatgtccttggggtagtccgtcacgaacgtgggcttcttgaagtgctgctccgtgaggtagcgctcgtgctcggtctgcaggtcgatgccccacttgacggggtactcgaacttgtggcccgcggcctgcgcctcctccaggatcttgacggcgtcggtgtaggaaacgcgcgcaaagtcgctgctggcaacgtgcgccaggcggtccttcagtcccttgtcgacccacttgttgaagaagtcgagctcatcggggcagtgctccgtcacgtagttgatcacgtacttgagcatctgctcggacacgtccatctcgccctcgaggtcgcagaacgccatctcgggctcgaccatccagaactcggccgcgtggcgacgggtgttggagtcctccgcgcggaacgtggggccaaaggtgtagacgtcgccaaagctcatggcaaagttttctgcctgcagctggccggacacggtcaggttggtctgcttgccaaagaagtccttgctgtagtcaaccttgccgtcgggcgtgagcggcgggttggccgggtcgatcgtggtgacgcggaacatctcgcccgcgccctcggcgtcggacgcggtgatgatgggcgtgttgacgtagacgaagccgcgctcctggaagaagcggtggatggcgaaggccgccacgctgcgcacgcggaagaccgcgcggaacaggttggtgcggctgcgcaggtgctgctgggtgcgcaggaactcgcgggtctggcgcttcttctgcatggggtagtccggctgcgccgcgccctcgatcacgatcgtggcggcctgcagctcgaagggctgcgggcggtccggcgtgagcgcgagcgtgccctttacgatgagcgcggatcccacggtgagggccgcgacctcctcgtagttggcgagcttctcgcggttcatgacgacctgcaggtccttgaagcagctgccgtcgttgagcaccacgaagccgaagttcttcatgtcgcggatggagcgcacccatccggcaacggtgacctcctggccgccaaactcctccatgcgcgcatagagctgcgcgatccttgtgcgatccatcagcgggatccccctttggtctgcgtggcgccatcgggcgagaagaacgtccttctcccctgcgcgggcaagccgccccgacgccgacgcgcaagttttccaaccccgtaaccatatcgcaaaacagcgccccttgccgcgcgggacgggcgcgggcgggtgtgctagcgtgggctcgtcaaagccacgtgaaaggatggaccatgcagagcatcaggctggcaaacgggacgatgatcccgcaggtggggttcgggacgttcaagatcccgcgcgaggacacgcagcgggccgtggaacaggcccttgagctggggtatcgccacatcgacggcgcggcggcctaccttaacgagaaggaggtgggcgacgccctgcgcgcgaccggcatggcgggcaaggtgtttgtgaccacaaagctccgcaactgcgaccagggctacgaccaggcgctgcgcgcgttcgaggcgtcccgcgagcacctggggctcgatgtggtggacctctacctcatccactggccgtgccccgcgcgcgacagctacgtggagacctggcgcgccctcgcgcacctgcgggagcagggcgccgtgcgcgagattggcgtctcaaactttttggtggagcacctggagcgcctggtgcgcgagacgggcgtgacgcccgcggtggaccagatcgaggcgcacccgcgcttctggcagcccgaggtgagcgcctggtgccaggcccacggcgtgacggtggaggcctaccagccgctcggccgtggccgcgacatcgagtccgcgcccgtgcacgcggcggcggaggtccacggcgtcacgtgcgcgcaggtggtcctgcgctggcacgtgcagtccggccgcgtggcgattcccaagtccgtgcacgcggagcgcatgcgccagaacctggacctctttggcttcagcctcacggacgcggagatggcctccatatccgccctgcacgacgacgcaaaccgcctgagcagcgacccccgcacgttcgagagcccgcaggacgaggcggacatgcgcgcccgcatcgcatgctagcgcagctcggtctccgggtggtccttggtgaggtagtccttgttggtgaccgtcgcacccaggatctgctcgcacttctctgccagctcgtcgatggccgcgtggaggtcggccgagcgctccggcatcacgttctccatgatgaacatgcagtgcggcgtggcgtcgctcacctccgtgcgctggccgtcgcgccagttccagcagcggcacacggcgcccgcgtcgtccaggtaggcgatctcgccgggcagggtcgggtcgctctcctcctcgccgatgggcaggaagtagtcgccgccctcggtcttggccaggcggaacgtgccctcgatggcgtcgatgttctccgcgccgatgggcagcgcgtacttgagggaaattgcgttgctgatgtccacgctcggcacgatgtgccccacggggttgtccttcatcacgcgcttgagcaggttctcgaccgagcagcgcgcgcccttcttggtcttgaacttgcggtaggcctcacgccagacggccaccacggcgttctggctgatggtgctgctcgtgagccactcctccgccttggcgttggcgcggtccaggaaccttgcggctgccttcgcgttctcctcgctgatctggtccgtcggcttgatgccgtccacgcacagcacgccgatctccacctccgggaagacctcccagaacgagtcctccaccacgaacctcttgcccatgtcgctccaatcgcccgggcgcaacgccggcgccgcgttcttctccttggctcatatctataccatactttggaatattttgcgcaacaattctgcgcgtacgccaattctttcaaatcttttgtgtctaaatatgcattccaaactgcataattcccaggggagaaaatcgtgccgccgcagcttgggcgcccccttggccccgcggcgcgcgcatggttttgacccatcggggcgaatgtctgcatagtcgcgcgggaccgcggccgcaccagccgcgtggcccccgccgcaccgttgcggaacggaaacgctccgccgcaccgcgcggcgcacacggttagaatggagtgacggcgccggcggacggcgcaggtcacatggcacgcggggcgctcgcggcgtccggcggatgcggaggttgctatggcagatggcaccacgggcacgcaagacggcaccggcgaccaggcgtttcgcgtcgagcacgactccatgggcgaggtgcgggtccccgcggacgcgctctggggcgcccagacgcagcgctcgtaccagaacttccgcatcgggacggagaccatgccccgcggcatcgtccgcgccttcgccatcctcaagaaggccgccgcgcaggcaaacgcgcaactcggcaccctcgaccccacggtcgcctcgctcatagaggaggccgcggacgaggtcctggccggcaagcacgacggcgagttcccgctcaaggtgtggcagacgggctccggcacgcaatccaacatgaacgtgaacgaggtcctggccaaccgcgccaaccagctcgcggccgagaagggcatcgcccttgccagccccgtgcaccccaacgactccgtcaaccgctcgcagtcctcaaacgacaccttccccaccgccatgcacgtggcggcggtgctggccgtgcgccaggagctggagcccgcggttgagcggctcatcgccacgttcgagcggctcgaggccgagaacgccggcgtggtcaagagcggccgcacgcacctgcaggacgcggtccccatcgccttcagccaggagatctcgggctggcgcggcatgctccagacgtcgctcgagcagcttgacgcgagcctgccgatgctccggcgcctggcactgggcggcacggccgtgggcacggggctcaacgcgccggctggcttcgacacgctggtggcagagcgcatcgcggcgctcacgggcgagccgttccagaccgaccccaacaagttccacgcgctcaccagcaaggacgccatggtcttctcgcacggtgccgtaaaggcgctggcggcaaacatgatgaagatcgcaaacgacgtgcgctggctggcatccggcccgcgcctgggcctgggcgagatcaagattcccgccaacgagcccggcagctccatcatgcccggcaaggtgaaccccacccagtgcgaggccgtcacgatggtggccgtgcaggtgatgggaaacgacgccgcaatcggcttcgcggcgagccagggcaactttgagctcaacgtgttcatgccggtcatcgcttacaactacctgcagagcgcgcggctgcttgcggacgccatcgactccttcaacaggaactgcgccgtcggcatcaaggccaaccgcgaaaagatgtcccacaacctgcacaactcgcttatgctcgtaacgtgcctcaatccctacatcggctacgagcgcgccgcaaaggtcgcgcacaaggcgtttgacgagggatgcagcctcagggaggcctgcgtttccctcggttacatgacggaggagaagttcgaccaggttttcaagccagaggagatggtctagcaacatggacgagacaagcgcaaagagcctcaagctccacgaggagctccagggcaagatcgaggtcgtttctcgcgcaaaggccgagacgaatgaggacctcgcgctcctgtacacgcccggcgtcgcagagccctgccgccagatccagaaggactacagcaagtcctgggagctgacgcgccgctcgcacctggtggccgtcatcaccaacagcacggcggtcctgggccttggtgacatcggcgccgccgcgggcatgccggtcatggagggcaagtgcctgctcttcaaggagtttggcgacgtggacgccttccccatctgcgtcgacacgcacgacaccgacgaactcgtgcgcaccgtgcagctcatcagcaagagctttggcggcatcaacctcgaggacatcgctgcgcctcagtgcttcgaggtggaggaccgcctcaaggagctgtgcgacatccccgtgttccacgacgaccagcacggtaccgccatcgtgtccgccgcgggcctgcttaacgccgtcaaggtgaccggcaggaagatgggcgagctcaagatcgtgatgagcggtgcaggcgcggccggcttggccatcgcaacgctgctgacccacatgggctttggcgacgtcatcctgtgcgaccgccacggcgccatctacgagggccgcgacaacctgaacccctacaaggagaaggtcgccaagtacacgaacaagaacaaggaggccggtagcctggccgacgtcctgaagggcgccgacgcgttcctgggcgtctcgaagcccggcctggtcacccccgacatggtgcgtaccatgaacaaggacgccatcgtcttcgccatggcgaaccccacgcccgagattatgccggacgaggccaaggctggcggagccaaggtcgtcgcgacgggccgctccgacttccccaaccaaatcaacaacgtcctggtgttccccggcatcttcaagggtgcgctgcaggccagggcaaagcagatcaccgaggacatggaggtcgcggccgccgaggccatcgcgagcctcgtccccgaggacaagctctccccggacttcatcatcccgtccgcgctcgacaagagcgttgccgacgtcgtggcgaaggccgttgccgaccgcgtcgagaagtaacgctgcgttaggccaaccagctttgacaggaacggcgcgcatcagcctcgggttggtgcgcgccgcctttttttctgccgacaacagccctaataacaggttcgcgttgttagagctggccgacggattctaataacactttttggccataacctgttattagaagttgcgggaggattctaataacaggttcgcgttattagagtcgcacgagaaactctaataacagtttttgcctcaaacctgttattagttcctctcctagacccacccgacaggatgcttttgggattatcaatcgagtgggtcatcgccggcacggagtatctcgaggtatcgctcgtagctaaaggtacggtacctttgacgtttcgtgttccgctgctccaacaccccccacgtcacgaagctccccaccaagttactggcacttgtcacgctgatgccaaggctccgagacacgaacgggatatcgacgattgggttaccctccaacaggttcaggagtttgagggcattgccactcctgcgtccgcttagggacggcaggagtcgctccatctcctggtgcagctccgccagtttgatcattgactccctggcattcagtgcgctctcccggaggcaatccgagaagaacccaatccacccctcgtagtctcccttctccctgacgcgcgtcagccagccgtaatactcgcccctacgcctcttgagttcataggagggatagagcacgggcttctcgagaattccatcgttcataagggaaagcgtgatgaggagacgtccaaccctgccattcccgtcgagaaatgggtgcgccgtctcgaactgatagtgcgccaaccccgccttaacgatcgggtcgatgggctgctcgttgttgatgaagttctcaaggtcagacaacgtcctccccaaatcctcgacgttcggaggcacatagctggcctgagagagcgtgcaccccgtgggaccgacccagttctgcgacgtccgcacctctccagggtttcggtctcctcccctgacgccagctagcagaacggaatgtacgtccctaagcagcctcgtacagagtggaagggacttcatgtcctcttccgcgcgctttgttgccctcacatagttgacgacgtccgtaagatcgcgactggcattcttgtccaacgtcggatcaagaacatcgtcgaaggtgcattgagtaccctctatctgcgaggacagtaacgcctccttgcggacgtacatggtgaggtacatgccgacgttgggaacgaaccgagccatgccctgaacctcgcctatgatggcacgacattcggcaatcgaccgcatcgtcgagccatcaagctcgaggggcagtaccgactgcaagggcgcggggcagaaggagttgtaggcgagcttccccgataggttcgacacgatcctgccctgccgaccggggacgaactgatcgagcatatctctccacctcactctaataacacttttcggtcttaatctgttattagattacacggaacaattctaataacagattcgcgttgttaaaatcgcacgagaaactctaataacagtttttgcctcaaacctgttattagaatccgtcaggcgattcccatcccaaggtccgcccaccacgctcagccctctgctgatgttgtgccattgggcccgaatgccgactcctaacacgcgcggatcgtctttccatgcgaaaataagcagactagtgatgttgcgatggtatgagtgcgtgggaagggggcgttggcgtgaccgagaggcgaaggcccaccaagaggtcatcccaaggctccaggggtccacaaaggcgcagctcttctccccaaggtggaaggcacgccaacgcggacgcacgacagcgctacgacgcgcccgtccgcagcttgcacggcacgccgcgcaaggcatcgcacacgtccgaaacccgcgacacccgccgtacgcggcagggcgagcgtggcaccaggcgctcgcagcgcggaacctctccgcaggagctgcgcggcaccaggcgcgagcctggctccaggcacgagtatcgcgactacgagcgcgagatcagccggcgccccaaccgccctcccgcacggaccgcgcgccagcgccagcgcgagctcgagggcgtgcccatgcgccgcgaggagtacggccagaccggcatcgccccgcgcagccgcgagagccgccgcaagcgtgacgagcgcctgcgccagatccgcagcctggcgggcacgcgtccctccttcccgttcaagccgctcatcgcaatcgtggcggcgctgctcgtcgcggcggtggtcttcctcgtggtgaccaacgtctccaagctcgtgagcgcgccgcagcagacacagaaggcgaccaccacgaccaccgtcaagagcaagggcggcctgtccacggcgatcgcgaacgccaagaacctgttcaccaccacgtacgactgggacaacctctccgccaagggcagccgcatcacgtacaaggcagacggcaagaccgtcagccgcacgggcatcgacgtgtccgagcacaacggcagcatcaactggaccgcggtcgcggacgacgggatcgacttcgcgtacatccgcatcggctaccgcggctccgtgcacggcaacatcaaggcggacaagcgcttcaaggagaacttcgccggcgccaagaaggccgggctcgacataggcgtctatttcttctcgcaggcgacgaccaccaaggaggccaaggccgaggcccgctacgtggtcaagcagctgggcggctacgcgaccaagtaccccatcgtgtttgacatggagccttcccagtccggcaacgaccgcgtggccgagctcagcaacgcgcagctcacggccgtggcgcaggcgttctgcaaggaggtcgagagcctgggctaccacgcgtgcgtctatggcagccgcgccgacctcgcgcactacgacctttcgagcctgaccgactacggcttctggtacgcggagtacgccgaccagcccacgatggcgctgcgctttggcatctggcagtactccgactccgccacggtggacggcatcgacggcaacgtcgacctcgacctcgacctcacgaccgcgctcaagaaggtcgaggcgaaggagaagtccaagggcgagaaggacgactcctcgagctcgggctcgtcctcgtaggcaacggccaaagccaaccgcaagacacgccgccatcggccccgcgcgacccaaaccgcgcggggccaacgcgttgcggcgacacgccagccgcacatcggctaccatgcatcactaacgctcttcgtcacaaagaggcacccatgaccgaatggctcatacatcacttcatcaaggacgcggaccagacgtcgctcccccgcgtccgcgacgcccacggcacgctcgcgagcgtcgtctgcatcgtctgcaacgtcgcgctctgcgtcgccaaggcgctcgtgggcctggcggcgggatcgctctccgtcgtggccgatgccatcaacaacctgagcgacgcctcgagcaacatcgtgagcctcgtgggcttcaagctcgcgagccgccccgcggacaaggggcacccctacgggcacgggcgcatcgagtacctctcgggcgtgatagtcgcgtttctcatcctgctcgtgggcgtcgagctcgtgaagagctcggtggagaagatcgtgaagccggagccggtggacttctcgctcgtgacggtggccgtgctgctggcatccatcgccgtcaaggcgtggatggcgcgcttcaactccgcgctgggcaggcgcatcgactccgtgacgctcgaggcgacggcgcaggactccaggaacgacgtgatcacgaccgccgccgtgctggccgcgggcgccgtgtcgcagctgacggggctcgacctcgatggctgggcgggcctcgccgtgggcgcgttcatcgtgtggagcggcttctcgctcgtgcgtgagacgctggacccgctgcttggccaggcgccggaccccaagctcgtgcggcacatccacgacacgatcatgagctaccccggcgtgctggacacgcacgacctgatggtgcacgactacggccccggccgccgcttcgcgagcgcccacgtggagatgcccgccgagatcagcccgctcaagagccacgaggtgctcgactccatcgagcactacttctgcgacgaggagggcctgccgctggttctgcactacgaccccgtcgtgacgttcgaccccaaggaccgcgacctgcaccactggatgtccgagcaggtcaagtccatcgacccgcggctgaccatccacgacgtgcgcgtgacccaggagggtggcgcccagcacgtctcgctcgactgcgtgcggccgcacgggctcacgctctccgacgacgagctgagcgacatggtctgccagatcgtgcaccgccgctaccccaaggccgtctgccacgtgaccgtagacgcgagctacgtgtcgacgggcgtgtagcggcgcaggccgggcgggccgcgcaccgtcgacggtagccgccatcagtacgtaagaaagccggggccgcacgcgcccgtgcgaccccgacccattaagccttcgcctgtcggcaaccagccagccagcgctcccctagcgcgcgtcacgaccaagcgcgatgcgcccggcggcaaacgtgcaggacgcgatgccgaccttcatgaggtcgagcgccacgaacggagcgacgcccgccgcaaaggcggcagccgcagacaggtgcgcgaccaccataagctgcgcccaaccgcacaggtacacgacggcgaccatggccacgagcgacacggcggcggacacgacccacggcaggcgcgtgcgagaaacgcgcccgagcaccagcgagccgaccgcggccgcgagcacgaagcccaggatgaagccgccggtggggccggccaggcgaacgatgccgcccatgtggcccgagaagaccggggcgcccagggccccgatcgccacgtaggaggcggcgcttgccacggcctcgcgcgggcgcagcgccagcaccacgaagcagagcgcgagcacctgcagcgtgaagggcactggcacgagcggcacctcgacgttcgcgctcgcgatgagcgccagcgtgccagccgccacgcgcaggacgggcacgaccgcgctaaggccgtgggactcgcccctggaaatggaaccgttcctaagcatggaatctcccctcataccatgatcaatcaaactagtcacgccacgcgcgcgggcgtgcgggcgccccgcgcaaggcgctacttggccccctcgggcacgtcccaggccaggctcacggagcccacgcccaggtggagcgagaccacgggtccgccgtcgcgcttctccaccgtcgccttgggcagcatgcggtgcacgcagtccaccagtgcgtcggccgccgcggagtcgccgtaggacgacacgacgagcagccccttgcgggctccctcgggcacctggcgcaccagggcgcggacggtagcgcccatgccgtgcgccacgtccgtgtcgcggatgccgcccttgtcgagcaccatgatgaggtagcggtcgagcttgccggccacggcgcggcgcatcgcgccgagcctgccggagcggcgcagcacgtcgagcctgggcaccgtgaacgcgatgccctgcagcgcgcgcgtgcgctcgagctcggcggtagcctcgcccagggtcgcgccgcccgtgacgagcctccgcgcgcgcctgaccatgaagtccaggccgccggacgtcgtccacgagtccaccacgacgatgcgctccaccgcgacgccctcgcccagcagctgcttgcgggcgtccacggcactgcggtacgtgccggaaaggcgggacgacatggtgatgcacagcacgtcggacccgcggtcgagcacgcgcctgaactcgtcatggaacgcggactggaacacggcctccgtgctcaggatcttggcgttgcggaacagggcgtcgtactcctcgttctcgccctcgtacctctccgcatggcgaacgccgtccaccaggtagtgcatggagacgaccacgcaccccagggacgccgcctccgcgcgcgtgatggggacggagctgtcacacacgatcgtgacggggcggcgcgtcgcgggcgccctgcccgtgcctgtatcgctcatgcgtcgaacctccctatacgacggaacttttcgtatcgcgcgtcgagaagtgcgtccgcctcgagcggggccagctcggaaagctcctggctgagccggtcggccagcctctcggcaaacgcctgcgtacccaggccgtcggcgtcgatctcgccgtccacgatgccgagcttcatgagcgccggagccgtgatgcccagcgcctcggccgcctcggccgcgcgcttctgcgtcttccacaggatcgtggcgcagccctcggggctcaccacggaatagacggcgtcgctcagcatgagcacgcggtcggccgcggcgagcgcgagcgcgccgcccgagccgccctcgcccatgatcacgctcacctcgggcacgcgcaggccgcacatcgccatgatgtcgtccgcgatcgcggcgccctggccgcgctcctcggcctccatgccggggtaggcgcccgacgtgtccacgagcgccaccacgggacgtccgaacttctcggcctgcctcatgaggcgcagtgccttgcggtagccctcgggcgagggcgagccaaagttgcgcgccacgcgctccttggtgttgcggccgcggtccgtgcagatcacggtcacggggcgcccgcgcaggagggcgatgccgcccaccactgccgggtcgtcgccaaactcgcggtcaccgtggagctcgatcagcccctcgaaggcctgctctgccacggtgggcacgctcgcgcggttggtgtcgcgcacgcggcgcaccaggtcgtagggcgtgacgtccgtggagtcgatcggcttctgcatgcggtgcggggcgggccagcgcggctccgtggggaaggccgcgggcgcgcgcggcgccgcgtgggacgggtctgcaatcgcatcggcgtcgtgcaggaagagcaggtagccgatggtgtccttcaggtccttgcgctccaccaccatgtccacgaagccgtggtcgagcaggaactcagcccgctggaagccagccgggaggcgcttgtgggtggtctgctccaccacgcgcggtcccgcaaacgccacgagggcgtcgggctcggccaggcagatgtcgccgtccatggcaaagctcgccgtgacgccgcccgtcgtggggtcggtcagcaccaccaggtacaggaggcccgcgtcgccgtggcggcgcaccgcgttggtgaccttcgccatctgcatgagcgaggtcacgccctcctgcatgcgggccccgccagacacggtgaagcccaccacgggcaggcccttgcgggtggcccgctcaaagcagcggcagatcttctcgcccacggcacttcccatggagcccatcatgaacgaggagtccatcacaaagagcgcgcagcgctcgcccgcgatggtggcctcgcccgtcaccacggcctcggtctcgtgcgacttgacgcgcgcgacgtcgagcttggagcggtagctggggaagcccaggacgtcgtgcgggcggacgtcgcggtcccactccacaaagctgcccttgtccgcggtgatcgcgatgcgctcgcgcgcggtgagcctgaggtggtgtccgcaacgcgggcacacgtccaggttcttggacagcacgttggcctcgaccacgtggcggcagtgcgggcagcgcaccaggatcatgcgctccggcacgtcgacggggacctcggtcacgggtccctcgagctcgttcacgctcttgtcgatctggctactcatacaggtgctccatcaggttcgtgtggtagttgccgctcaggaactcctcgttcgagaggatgtcgagctgcaggtcggcgttgcactcaacgccgtccaccacgagctcgcccagggccgagcgcatcttgcggatggcctcctcgcgcgtggggctgtacacgatgagcttgcccagcagcgagtcgtagtacggcggcaccacgccgcccacgtagagcgcggagtcaaagcgcacccacgggccgttcggcacgtgcagcatggtgatgcgtccgcacgaggggagaaaatcggccgtctcggcgttgatcctgcactcgatggcatgtccgctcaggggcgcggactccacgccctcgggcagcggcatgcccgcggccacgcgaagctgccacttcacgaggtccttgcccgtcacgaactccgtcacggggtgctccacctgcaggcgggtgttcatctccatgaaccagaagtggccctcgtcgtccaccaggaactcgatggtgcccaggccctcgtagccgacggagcgcgccaggtcgcgcgcgcacttgtacatgcgctgacgcacgtcgtccgtaacggcagggcacgggctggggctctcctccaggagcttctggttcttgcgctgcacggagcactcgcgctcgcccaggctcatcacgtggccaaagctgtcgccaatgacctgcacctcgacgtggtgcgccggcgagacgaacttctccatgtagcacttgccgtcgccaaaggcggcgctcgcctcggcgctggcggtctcgaaggcctgggccgcgtcctccacgcgctcgaccttgcggatgccacggccgccgccgcccgcgcgggccttcaccagcacggggcagcctatgcgctcggcctcctcggtcgcctgctcgggcgactccaagaggtcgcagcccggcacgatgggcacgcccgccgcacgtgccgtgcggcgcgcctcgtccttgtcgcccatgcgctgcatgacctctgggctgggccctatgaagaccaggccgtgctcgcggcactcgcgggcaaactcgacgttctcggacaggaagccgtagcccgggtgcaccgcagacgcgcccgaggccagggccacggtgaggatcgcgtccatgttgaggtaggactcgctcgcgcgcgggccacctatgcagtaggcctcgtccgccagcgtcgcgtgcagggactcggcgtccgccgtggagtacaccgccacggtcttgacgcccatctccttgcaggcgcggatgacgcggaccgccacctctcccctgttcgcaatgagtaccttctggaacatgggctacttcttcccctccggcaccagcgcaaacgacatgtcggccacgcagcacacggtgtcgcccacgcgggcctcgccgtgcgcgaagtggaacatgccgtgcgagcgcgtgatctcgcagtcgagctcgacggtgtcgcccggcttcacggggtgcttgaagcgcaccttgtcgaggctcgtgtagtacggcgtcgcgcccttggtgcttccgtcctgcgccagcagcacgcagcagttctgcgcgagcatctcgcacaggatcacgccgggcaccacggggttgccggggaagtgcccctgcacaaagaactcgtcgcccgtcacgtgcgtgtggccaacagcgcgcccgtcgaccagctcgcagtcgtcgatgagcagcatcggcggacggtgtgggaggatggtctctatctcttctctgttcatgcctgccccctagtacagcttcatgagcacgcagccgtactcaacgagctcgccgtcgctcacgcagatgtccacgacctcgccgtcggcctccgcggtgacctcgttcatggccttcatggcctcgatcacgcagagcgtgtcgcccttcttcaccttggagcccacgtgcacgaagggctcggcgccaggcgcgggcgccgcgtagaacacgcccaccatgggcgccttcacggcgacgaccttggtcatgtcgagcggcttctcgccgtcctggccgtcgtctgcaccggcggcctgctcctgggcgggagcctcggcgggctctgccgcgggcgagagggacgcgggcgccgtggcagcggcggccaccggggccactgcctgcgccatggccgggaaggcctccgggcgctccatctcgatggcgcagtctccctcctcgatcctcacgcgggcgaggccgtgctcctgcatgacctgtgcgagcgcgtcaacgcgcgacgtgctggtatccatggctactcaccctcctcgtagcggcgcagggccaccacggcgttgtgtccgccaaagccgagcgacgtcgagatcgcccacttgccgtcgaacttcgcggccttgccgggcgtgtagtcgaggtcgcagtccgggtcgggcgtcgtgaggccgatggtgggcgggatgacggagtcgcgcagcgcgcaggcgcaggccatggcctcgaccgcacccgtcgcgccaagcatgtggccggtcatggacttggtggaggatatctgcgcggcacgcgcgcccttctcgcccagggcctgcttgaggccgagggtctccgtcttgtcgttgagcttggtcgaggtgccgtgcgcgttcacgtacaggccctcctccacgtcgacgccggcctcgtccacggcctgcctgatggcgcgggtgatgccgtcggcggaggggtcggggctcgtgatgtggtaggcgtcggccgtgttgccgtagccgcagacctcggccacgatgttggcgccgcgggccttggcgtgctcgagctcctcgagcaccaggatgcaggcgccctcgcccatcacgaagccgttgcggtttgcgtcgaacgggcggcacgccgtggcggggtcggggttggtcgtcagcgcgcggcagttggtgaagccggccacggagacgggcacgatggccgcctcggttccgccggccaggatcgcgtcggcgtagccgtagcggatggcgcggaacgcctcgccgatggcgttggtgctggtggcgcaggccgtcaccacgggaagggtcgggcccttggcgttgtggcggatggagacctggcccgttgccatgttagcgatgagcatgggcaccaggtacgggctcaccttgcgggcgccgccgtccatcaggcgcttgacctgcgcctcggtggtgccgatgccgcccacgcccgagcccacgtacacgcccaggcgctccgggtcgatggcgccctccgcgtcgaggccggccgaggccatggcctcgtcggacgccacgagcgcgaactgcacgttgcggtcgttgtgcagcgcgacggacttgccgagggccgcggccgcgtcaaagcccttgacctcggcggccacgctcacgcgaaagcccgtggtgtcgaacgccgtgatgggcccgatgccggactcgcccttgacgagcgcgtcccagctctggggggcggtgttgcccacgggggtgatggcccccatgcccgtgatgactaccctgcgatccatgtgttatcccctctggggcgcacgagcgccccgtctacatgcaaagtccgccgtcgaccctgatgacctcgccggtcacgtaacgcgcggcgtcggaggcgagaaacgcgacgacctcggccacctcgtctgccgtgcccaggcggcccagcgggatgcgcgcggcgtagccgtcgcgggcatcctgcgtgagcttgtcggtcatgtccgtcgcgatgaagcccggcgcgaccgcgttggcggtgacgccgcgaccggcgagctcctgggccacggacttggtgaggcccacgacgcctgccttggaggcggcgtagttgacctgaccggcgttgccgtgcaggcccaccacggagctcacgttgacgatgcggccgccgcgctggcgcacgaagttcctggccagggcgcgcgtcatgttgaacgtgcccctcaggttgacctcgatcacgcggtcgaagtcctcgtcgcgcatgcgcgcgaacaggccgtcgcgcgtgatgcccgcgtcgttcacgagcgcccacacggggccaaagtcgtccgtgacctgcttgacagtggccttgacggccgcggagtcggacacgtcgcagcggtaggccttggcgcgggcgccgagatcctcgagggcggccacgcgctcggccgccgcggcctcgttgccggcgtagacgatggccacgtcgtagccgtcgcgtgccaggcgctccgcgcaggcgcggccgatgccgcgcgagcctcccgtgacgagcgcgaccctgcgcgccgcgtcctcctggcccgtcgtgttgttgctgtccatgggctatgcctccaagatctggctcacggccgcgtcgagctggtcgggggtctcaacgcagattgcggtgacgccctcgagcgtgtgcctgacgagccccgtgagcgtgtggccaggaccgacctccacgaaggtgtcgatgccggctgcctgcatgccgcgcagctcgtccacccagcgcaccgggtgcgagacctggttcgcgagcgtctgcgccatcgcggcggcgtcgccctcgtacggcccgcccgtgaggtttgaccagcacgggaccgcgggctgcgcgagcgggtgctcgcccagccacgtggcgagcccgtccgcggcgtccgccatgtacgggctgtggaacgcgccggagacggccaccttgacggagcggccgcgcgcggccttgaccaggccgtccagcgcctcgcaggcctcgggcgagcccgcggccacggtctggagcgggctgttgtagttgacgggccacgcctcgccggcctgcgccgcgagctcctccaccttggagggctcgagcttgagcacggcgcgcatggcgccggggtgcgcctcgcagcacgcggtcatgagcgtcgcgcgctcgaccgcgagccggaacgcgcccttgggcgtgagggcgccggcaaaggccagcgcgccgagctcacccagcgagtggcccgcgacggccgcgggcaccacgccgcgctcgcgcagcgcctcggccgcggcgaggtcgacggccagcacgcacggctgcgtgttgacggtgagcgacagctcctccttggtgcccgtgaagcactggtcactcgtgccggggcggacggagtccgccgcggagaagaccgccctcgcggccgcggacgcctcgcagagctcgcggcccatgccaggcttctgcgagccctggcccgcgaagaggaacgcgacgttgggaagcgcgcgtgcggaggtgttcttctcgcccgccacagtcgctacctcacccatttggtggcctccttgaggcaggcctctgcgccgcccatcaggtcgtccacgatctgggcggccgtctgctcctcgtgcaccatggcggcaacctcgccggccatgaaggatccctcctggtagttgccgtcctttgcggccttgcggagcgaccccgcgccgaacttgcccagctcctcgggcgtggcgccctcgcgctccatgcgcgcgaactcctgcgagaagggcgtcttgaggcacctgacggcgccgttcatgctgcggcccgtgacgatggtggagaggtccttggccttgaggatgcggtccttgtactcctggctcaccgtgcactcgcgcgcaacgaggaagcgcgtgccgacctggatgccgacggcgcccagcatgaaggccgcggcggcctgcctgccgtccgcgatgccgcccgccgcgagcaccggcaccttgacggcgtcgaccacctgcggcacgagaaccatggtggacagctcgccgatgtggccgccagactcgccgccctcggccacgaaggcatcggcgccggcgcgctcgagcagacgcgcgagcgcgaccgacgagaccacggggatgaccttgacgccggcggccttccaatcgcgcatgtacttgctggggttgcccgcacccgtgaccacgacgggcacgtgctcctcggcgacgaccttggcgacgtccgccgcgaaggggctctgaagcatcacgttgacgccgaacggcttctgcgtgcgcgtgcggacgtcctgaatctgctcgcgaacccagtcaggtccggcgttcatggcggagatgatgccgaggccgccagcctcggagacggctgcggcgaggctcgcgtcggcaatccacgccatgccgccctggaagatgggcttctcgatgcccacgaggtcacagagtggggtcttgatcatgtgcgctgaatccttagtcttggcgtttgctttgggcccttggcctacttgttgagaaggccgtcgacgatgtcgacgaactcgcccacggtctgcgggttggcctcggggtcgatctcgatgccgaactcgtcctcgcaggccatgaccgcctcgacggtggccatggagtcgaggccgacgctcgcgaggttggtgtcgcgggtgagctcgacgtcgtccaggccctcctggtccttgaggatggcgacgacgcgatcgaaggtggactctgccatggttctctcctatctacaggcaccggtttccggtgcgtacgagggcacccttgtggcgcccgggttacctatgtgatggcgcggtgtcgcgccgtggaagatgcgactagcttggggttgcctttggttccgcctcccagcggacgagcgtggaggcgacgtcgagcccggcgccgaagcccacgagggccacgagctcgcctggcttgagctcgcccttgcgcgccatgccatcgagtgcgagcgggatgcaggcgctcgagacgttgcccgtgtgcgcgaggttcagcaccacgcgggacgggtccacgcccaggcgctcgactacggcgtccacgatcctctcgtttgcctgatggaggacgaagtggtcgacctggtcaagcggcacgcccgtctgctccgacatctggcgcagctcgcgggtgacctccgtcacggcgaagcggtagacgctgcggccgcgcatggtcatgtagctgccgggcgcggaatcgacggactggtcgaaggggctgttgcccgcgacgccggggacgtcgatcgccgcgacgttggggatggtgcgcagtcggcaccacagcggcgactcgcctcccgcgcgcacgacgaccgccgcggcggcgtcgccaaagagcacacaggtggtgcggtcctcccagttcatgatgcgcgagcacttctcggccgaaaggacgagggccgtcttggccctgccgcgcgagaggtacccgtccgcgacgtcgagcgcgaacacgaagcccgagcacgcggcggacacgtcgaacgcagggcagctcgcgccgagtcgctccgcgacggcgcaggcctccgccggcatgaggtggtcggccgtggtggacgagcacacgatgaggtcgaggtcctctggcgcgatgccggcggactcgagcgcgcgccttgaggcggactcccccagctcgtccagggactccgtggtgcagaccctgcgctccctgatgccggtgcgcgagctgatccactcgtcgctggtgtcgaggaacgtggagagctcgtcgttggtcacactgcgcgcgggaagtgccgagcccgtgccgatgatggtgtaggacactagcccctgcctcccttcgagacagacatcttcttgaggtattcgcgctgcgactgctgcgccttggcatagaagtgctcgagacgcctgattccgtcgagaaggacgcggcgctcggagaccgagagcccgtccgagacctcctgtgccatacgctggttgaagaccgcgtggaggcgaaagaccttctcgcccttgcgcgtgagcaccacgttgacgcggcgcgcgtcctcgggatcgcgcttcttctggacgtagcccctcttgacgagcctgttgacggccgccgtcgcggagggtacgcggatgtccagcgtgcgcgcgagctcggacatgccgatggtcgcgtccttgtgcagcgtcttgcgtcccaccacctcgatgaggttgagttcggagacggtgaggtcgatcccgtgggagcgctgcgtgagcgtctcgaggcggtcgatggagtcgtaggtgttgctgagcagtcgcgagatctcggctatgaagtcgtacccgttgctgacgtcgatttggtccgcaggggcgtcagaggataccacgagctcttgtgcatgccgctcaaaggacttgggcacgagtgcctcccccgtgtgacgacgttgaccggaacctgccatgactgcgcgaacggtgggcttggaagcccgtggggcccggcgactcgccggaccgatttcctttagttagtctatctaactatcgcagtgtacgcaatgtagtgtacgcggttatgttgacttgtcaacttatttgaggcacaaagatcgatctccccgattctgcacacggaggttcgattgggtcgcgtcaggcgtcccgcagagaagtgcgttcgcaatcgaccgagagcgtcgtgccatccgcaagccccagcacggcgtgcccccaggcgtcgacggagaggaacgtgccctcccccgccaggctgccatcggttgccacggcgcgcaccctgcgatcgaggttgtagagagatgcctggtagtcggccagaatcggcgcgagcgggccgtcgtcgggctggactgcgagcccctttgcccacgcgtccacgcgggacacgatcgcgtcgcgaaagaccgtggcgaccgcgtcgtagccgggcagctcgcgatcgcggccgtccaggcactcgcccaggtaggcgggctcgagcgcgccggccatgccgtcgtgcacggccgtggggcggatgccgttgcccttggggcgcgtcaggttcacgccgatgccgcacacggcgaagccgtccgaggtcgagccagagagctcaaccaggatgccgccaagcttgcgcgcgcggtcaacactgttgcatatgaccaggtcattgggccatttgaggcgtgggaccgtcgcacccagcgcgtggcaggcgtcaagcgcgcccagcccgctcgcaacgggcagcgcacgcaggagccccaggccgcggctgccggcacgggggccgtccttctcgcccgagacggcgtcgccgcgctcgcccaccttgggacgtagcacgatggagaggtacaggccccccgggggagaaacccacacgtgccccctgcggccgcgacccagcgtctggcggtgcgccgcgaccgcagccccgtgcggggcgcccgcgagcgcgcggcggcgggcctcgtcgttggtggactcgcaggagtcgaggacctccacggcgggaaggtccgcccttctcccccggctcgtccccggcgtgccgggtacctgcggtattttgcgcccggccgtcacgcggctacgccagctcgcgtaccatgcgctcgaccacggaggcgcacagcagcgcggagctgcgctcgaacgccgggtagtcctccgcggcatcgccgttggccttgtcgcttatggcgcgcacgaccacaaacggcacgtggttgacgtagcaggtgtgcgcgatgtcggcaccctccatctcgcagcagagcgcgccaaagtcgcggacgatgcggtccttctcctcctgcgtgcgcacgaagtggtcgccggaggccacgcggcccacaaacacgtgggcctggggcgcggcctcgcgcacggccgccgccgcggcgtcgcgcatgcgggcgtcggcgggaaacgccaccacgcccatgcccggcacctcgccgggacgatagcccaggttctgcacgtccacgtcgtagtgggccacgtcgttggacaccaccacgtcggcaaggtccacgtcgtcgctcagtgagccggccacacccgtgttgatcacgcggtccgcgccaaagcgcagcacgagcgtctgcgcgcagatggcggcgttggtgccgcccacgccgcagcgcacgaccaccacgggcacgccgcccagcgcgccctcgcagaactccatgccgctcacgaccgtcgtgtgcggacgctcgaggtgggccttgagcagctccacctcgacgtccatcgcgccgatgattcccagcgtcacgcgcgccccctagatggtgcctgggtagttcatgtgggcgtcgtcgatcacgttgagggtcttgtccaggtagcggcgggcccaccactttgcctggttgaggtcggagtcgtggtagttgccgcactcggccggcttggcgccggggatctcgccctcgaagtcgcgcacgaactcgaagccgcccttgacgaggggcaggacctcctgcggcgtgcactcgccaaagatcagcaggtagaagcccgtgcggcagcccatgggcccaaagtagaccacgcggctggcccactcggggtcgtttctgaagtacgtggccagcaggtgctcgatggcgtgggccgcggcggtgtccatgaccggctcgcggttgggggccgtgaggcgcaggtcaaacgtggtgatgacggcgcccgtcttggggtcgcggtcgacgcggctcacgtacacgcccggctcgaggcgaaggtggtcgatggtaaagcttgcaatctgctccatggtgcgcgttcccttcttgaggctggcgcgccgccacgggggcgacggccgtccttctccactgtgttttcattgcgcgtgaaattaccccgcaacgcgctatgacgatactatctttgtcccgccgcgttaagggcacgcgcgcacccgcatataaatccccgcaaccttgcggggccggcgggcccgtgcgccgcctgccacgcgacggcagccaactgcaaccaagggaggggccacgaacacccaagacacctttgccaactgggcgtgcgcgtgggcgcaggccaccaactcgtcgctggcgggaacctccgtccacgtgggcgagaaggacctccatgcggacgggggcgcgcttgccctccgcatggcggagtggggcctcgtccccacggccgaccccgcggcgcccctgcgctacccggagctgcccgcccgcgaggagccctctgccgcggaggcctggtcccgcgcccgcgagggcatgcccgtgtccgccgcgctcgcgcgcgagctcgcggcggacggcctgctgcgcggcgtgcgcatcgccatgagcctcatcgtggagcccaagacggccgtgctggtggagcgcctggcgcaggccggcgccaccgtgggcgtctactgccacgcgcacgagtgccaccagtacattgcggacgagctcgcctcccgcggctacgccatcgaggcgaactccgcctggacccccgcgcaggagcgcgagggggccctgcgcctgatggaccgcatccgccccaacgtcgtgatagacgacggcgccaactttgcgcgcctcctcgtgatggagcgccccgcacttctcccccagctgatcggcgtggcggaggagaccacgtccggtgtgcgcgccttccaggcgatgcaggctgcgcgcgagctgcccttccccgtggtggccgtcaacgactcgcagctcaagacccgctttgacaaccgccacggcacgggcgagacctgcgtggccaccacgctcgagctcctgggcgcgggctgccttgccggcgcgcgcgtcgccgtgatgggctacggccccgtgggcgagggctttgcgcgccgcgcccgcgtgttgggcgcccgcgtcaccgtggtggagctcgaccccgtccgcgcgctcgaggcgcgctttgcgggcttcgacgtggcccgcgccgcggaggccctccccgcggcggacatggtcgtctccgcaacgggcgtccgccacacgctgccgctcgacctgctgcgcaccctgcccaacggctgccgcgtggtggtgatcggcggcatcgccaacgaggtcgcgctggaccaggtggtcgccgcgggcggcgccatccttccgggcgagaaggacggcatctcccagctgcgcgttccccagggaccaacgctcgccctgcttgccgccggcgacggcgtgaactacgccgcgggccccggcaaccccattgagataatggaccttagctttgccgtgcaaatcctggccgtggagcacctgctgcgcaaccgcggcgcgctgcccaaccgggtgctgcggctggggcccgatgcggaccgccgcatcgccacgctcgcgctcgcggtccgcggcgtcacactggacgccgcgcccgaagccgacacggcggacggctccaccttcgttcccgactggcgcgtcacgcgcttctcggacgccgtcaccacgcccgccgccgcacccgcgtcacccaacccaaaggagctcccatgagccagcaaccaaaggccaccctgtacgccgcgccgctcgtcatccccgtgaccgggcccgtcatctgcggcggtgccgtcgccgtgcgcgacggccgcatcctgcacgtgggcacgcgcgactgggtggagcagaagctgaccgaggacggcctcgccccgcagcaggtggacgtgcgcccgtggcgtgggctcgtcacgcccggcctagtcaacgcgcacacgcacctgcagtacacgggcatggcctccgtcggctcgcgcgagtaccccagcttccgcgcgtgggagctcgcgttcaacaagatatatgacagcccggagcagaagccctggcgcgcctggtcgcacgagggcgcgcgccagatggtcgaggcgggcatcacggccgccgcggacgtcgtgagcgacgtggaggccgcggacgccctcctgtcccagggactccacggcatcgcgtactgggaggtgatggactgggacaacgaggactggaagcagcacggcaaggaggcccttctcgcccacatcgcagacatccgcaggatgggcgtgacggagctgggcatcagcccgcacgcgccgtactcgctgggatccggcccgctgctcgacctgccggacatcgcgcgccagctgggcatgcgcctgcacatccacctgggcgagaccccggccgaggccggccacctgccctcgcgcctcaccaaccagacgtcctgggcgtggaaccgcacggagtggcagagcttcaacgacctcaagcgcgcgggtgccggcgcgagcgccatccagttcctggaccagctcgcggtcctgggtccggacgtccacatcgcccacggcgtccacgcctcgcgcgaggaccgcaggatcctgcggcagcgcggcgtctccgtggcgctgtgcccgcgctccaaccgcgtcacctgcaccggcgcggacgcccccgtcgcgcgctacctggaggagggcaaccccctgtgcgtgggcacggactcgctttcctcctgcccgagcctcgacgtcctggacgacgtggccatgctgtacgacatcgccatcgcgcagggctacgagggcccggacctctcgcaccggctcatccgcatgatgacgctgggcggcgcggaggccatgggcctcaactgcggccccaagcgcatcggtcagatcaacgtgggcgcccaggccgacctcgcgttcttcgacgtgcctgtcgacgtgtcgtcaccccaggcgctcgaggacaccatggagcgcttcgtccgccacggctccggcacctgccgcgccaccatcatcgagggaagggtcgcctatgaccgcatctggaactgaccgca

SEQ ID NO: 269 - DNA, 15202 bp, Unknown
  Metagenome-assembled genome
agcggatcataaaaacgttactaacctatacaacgaactcaaaaattatttgaataacaatactgatattaaagtcagtgaaaagagattgtcagaacttggtggcgctaaaggctattttcaaccccgcactaatgaaatcgtcattggtggcgatgagcccgacaatgctttgaaactaaagacgttatatcacgaatatgcgcatagccagctacacggcctaaaatcagcctttaaagatcgcccgcgagcctatcaagaaacgcaagccgaagcggtcgcatatgttgccatgcaaaatattggcgttggtaccagcaactactcactcggttacgtggccacctgggccaaagataaagccgtaatccatagcgctttaagtgagatccagcaagtgagcaacaaagtgattgaacttagcgatggcttaaccaaacaattaggcttacaagaagccccaaaagagcctgcgcatgatctaaaaaagctatcagcccaggatcttaataagtcctatcaaggcttgcaacaacaagttcagcaagcaactagtccacaacagaaagcacaatttaaaaaacagttaaacgatgtgcaccaagaaatcagtgagcgaacacagaagcaactgaaatcctttgccgaagaaaatccgtcaatcaaaaaaaaagattctaaaccagatcaaagtctgcggtgttagtcagcccttaataagaatgctataatagaaaaaatacggaaaagattgttttgtgatagctataaaattatgtgaatgtaaaaagtagttcgcataaaatatatagcttaagtcgaattgcttttttgcatatcaacccgatacatctaatgataataggcctaataccatgactgaataatgattaaaaatgtttttcttaatcttttgacagtatattgacaacgggtttagtttgatagagtgttgtcgtatcagggatattagtatcgtacacctgcttttcgttagtgggtttaaagtatcaaactaattttaaaaagtcaattattagttaattaagggggttctcatggctaacagatcgtatggatggatacaaaatccaggaaagtttgatagcttgcaacatgtagtccagatattagattcaaattctgtacagtataagttattaagagacaagctagtccctgaactaatttttttcaaggatattaaaagtgaattgttgtctaaattacaagctaacacaagcacatttacatattcagaacttgttggaagtgcaaaggataagtatggaaattcagtaagtcgttccggtgttggtcggaagggtgcaatggcagatggacttatccaagtaacaataccttcgcaaaacaaatcaaagccttggaccgacaactggacttcagatggatacttacgttgggccgtgtctttaaattttgtaaagcccgatgaaaaatcaagtgaatttgaaatcactccattgggagctttgttttcaaaagctcatactgaaaaagagagggattccattttggcacgggtgtttctctcctatccccctgcaaccagaatattatccatactgtctcagaatatagatcattcattatctaaatttcaattgggacataagcttggtttttatggagaacctggttttacatcatattcaaataaattgatgcaacaatatctaaagtcggctcaagaaaaaaaggaaatttctaagataaagtcagatattgagggtactagtgataagtatgctcgtatgatttctaagtggctatctaaagttggatatgtagaaattcatggaactaagatcagaaatgattatgacgaaataatatctggctttccaacgtactcaataacgggtaagggtttgcatgccttaaaccaatcgattggaaagtcaaaaaacaatcgtgtttcaaaatttgttaggtgggagttttttgcaactacaggtaaaaatagggactatttgaggtttagaagagcaaaaattattaagatattgatgcacacgcctcgaaaatcactgcgagcattaatggacaatttaaaagcaacaggtattaatgattcgattgatgtaattaaaaatgatgttttaggtttgtcaaattgtggtatacgggtatctatagatggaaataatattgagttaaaagataaaattcaagatttttcaattccaacattgaacattaataatgtactgaaagataaacatttagagaaaataaaagaaaagtttttggaaaatacatcattagatccgcgttttatttctttgattgaaatatctcgagataaaaaacaaaaccgagcttttgaaataattacagctgagctatttaatacatcatataacctgtctgcaatacatttaggtggtggaaggcgaccagacgtattagcatacaatgataactttggaattattgttgatactaaagcttataaaaacggttacggcaggaatgtaaaccaagaagacgaaatggttcggtatattacagaaaacaagattagaaaacaagatatcagcaaaaataattggtggaagtactttagtaagtcaattccaagtacatcttattatcatttatggataagcagtgagtttgttgggatgttttcagatcagctcagagaaactagtagtagaactggagaaaatggtggagcaatgaatgttgagcagttattaatcggtgctaaccaggttctcaataatgttcttgatccaaaccgtttgcctgagtatatggaaaacaaagaaattatatttggaactttataagatatcgagttagctgaaatggagcacccggaatttttgggggtactccattttttatgtcctttatttttagaaggcatagataataataattgtttgtgctagaatgttaatcaacaaggatgtaataggatgtgattatttgagatttatcggaagcaaggctcatattttaaatgatattaatgaaatcttggaaccacatttggatggcactgaacatacatttgtggatttgtttgctggctcaaatgttgttggtcagttctttaagcctaaattctccattattagtaatgacaccatgagtttttcaaatgttattgcgaaagctactattgaattaaatacaccaccgacatttaataagcttagatccgcaggaataaataatccatttcaatactttcaatctgtagatgttaataaatactcaggggattttgtaacagaaaactattctcctgcaggaactgccaagagaatgtactttactattgataatgctaaaagaattgattttgccagaactacaattgaaatgtggaaatgcaaaaaattaattaatcgtgatgaatattattatttgttagatgctcttattcaggggataccttttgtatctaatacaactggaacctatggagcatacttaaagcactgggacaaacgagcatataaaccattagaattgatacctagcgaaattatagataatggtcaaaacaacaaagcatatagggaagatgcactaaaattaaaagaatcgttatccggtgatattgtatacattgatacgccatataattcaagacagtatattcccaattatcatgtattagaaacaattgctaggtgggattatcctaagttgcatggagtaactggtcaacgggatacgagtcgagaaaagtccagctttgcaatgaaatcaaaagcaaaagaggctatgaaagaattgtttagttctcttaaattcaaacatgtcgttgttagttattcaactgatggtattgttccagaaaacgaattaattgatatattaagagaaaactctatagataaggaggttgaggtgaaacgaatcccctacagaaaatataaatcaaaaaaagtaaatcctgatacatctgtcgaggaattattattttattttaagtccaaaaattctattaaatatgtcgaagccaaacataaccctactatttacaaccactctagtatcagtaaagctagaaaacgtggggcagcgggatttattaagagtccattgaattacatcggtggtaaatataaactacttcctcaaatttttccattattcccccaaaatattgatacatttttagacttatttagtggtggtggaaatgttgggataaatattaatgctaaccatattcagtttaatgatataaacacaaaaataaattcattattccgctattttcaggggaaaaacccggaggatttgataactaagattaacagacgcatcaccgaatatggactcagtaaaacaaatcaagcgggatttctaaaatttagaagggactataataataatccgaatccattagatctgtacgttctggttgcatatagctttaactatcaatttagatttaataacaatatggaatataataatccatttgggaaaaacagaagtcatttttctgagcaaatggccgataacctaaggagatttgtaattcatctgaatgagattgatgccgtgtttactgataattattttacagaagtagatactagtcagttgacccaaaaatcttttgtttatgctgatcccccttacttaataaccactgggtcatacaacgatggcaatagagggtttgtgaattggacagaaaagcaagaaaaagaactatataaatttctagataatttgaatttgcgtggtatatcatttgcattatccaacgtgatgttacacaagggaaaaagaaatgctatgttatgcgagtggtcgcagaactataatatccattacttgaattatagctataaaaacgcgtcccataacactaaacattcaggaagtactgaggtactgattactaactattaaccagaataataagcaaaatttacattagaggagtaacaatatgattaaattaacagattttttagcattccctgaacccgctgaagcaaaaattaaatttaacatgaatgctggtgatattacaaaaccagcctgggacttactgttgaatgatagtaatgactggttgactatgaacagatggaaaactaaacaagctaacaataatttaggaaaagcaggttatttattaacttttgctcaatattatccatatgggcctgaatactttatttttggtggtttatataaaattcaaagaatacagccggaggtatttgagacagctgggtacaatttgactttaaaaccccaatatcaagattatataaaaagattgatcatcaaattaaaacagcctattgggagaaatatctactgtcggcgctatgagaatatacaggaagggatgctagatcctgaggtatatgaattagctccagataccaagattggaaattttactggataccaaaacgttagtttacaacaaaaagacctccaaaccatctggaaaaataatgagcctagttggaaacaggccttatcctatgttaaaggagtttatgtagtaactgatataagcaactgtcgattgtatattggttctgcgtcaggaaactctgacggaatatggcaaagatggtcagcttatgctaatcccaagcaccttacgggtggcaataaggaatttgaaagagttttaaaagaggatggcattacccatattactgataattttagatactcaattattgaaatctttgatactaagaccaaagaagaaaccgttctctctcgcgaaaactactggaaaatggttttcaatactcaaaactctttattgggaatgaatcgtaactaacgaattaataataaaaatcaaaagaaaatctatcaaattagaatttacccgcactaatcaataagttgtgatgaactataatctttctaattttacaataattgcaaaattccgactacatatcttgctaaaaagtgcgctattaatgaaagtacttggaatatattcatctgtcatgggctgtaaaatcttgctgagactttcctcatatttccataaacttcgccttgtaaggaaagctcattggcatttttctaactaaccaagacaaggtcaattcctaaaaataaagatcacctcgtaattaaacgtaaatgtgaaaacatggagaattctactagataaagtggtaaataaatcataaagaagggcattcaaacgatgcgtattaatcatgtatggatttcaggatatcggaatatcaaaaaaactgattttggaataaacaataaattaattttaataggagaaaataacagtggtaaatcaaacgttcttaaagctataacctctccgttatctcctggaggagaggggtattatacacaacctatgacattgcgagatgtgaatgatgaagaaaaaaattcgtattataaatacattaaagaaaattttgatcaacttatgaaagaaaatagcgaagttatcgcacaaactgagttcctatcatatattccgaaggtcaaaattagacttcaatttgatgttgatgatgattcacggttttattttgaaaagttaatcaccgaggatactgagggaaacattgtttatcaactcgaatttcaatatcaaattgatgatcctacaaagttactagatcatttaaaaaatgttaaaagaattgctagtaatgatgacgaagaactttctcgtatccaagttaatctcctaccagaagatttatataaatcacatcttattgtccctggtaaaaatgatacagtatcctatgatctatcaaagaaccttaaatattactcacttattgcagagagagacggattttcaacaagccgctcaaaaatgggttcatcagctattatcaaactattgaatagaaatattgacgaccaaagcaagatcagcattgaacaaggatataatacattttttgatgaagttaaagattcaactaaaatggatgaagtattcaactgggctaaatatgcatcaaattacaagaatgctcaagaatttttcggcgaaatatcaattcttcctaacatgcctccaatgaattcgttgcttaacagtgtacagttgggttatgctgaagaaccattggcacaacaaggattgggataccgaaatttagtttatctatcggcaatggtaaacgcgctcgaacgtgatgatgaaacaccatttgctgttctgtcaatcgaagaacctgaagcacatcttagcaacgaaaatcaaaaattactgataagtttcttgaattcaagctcagaatcagcaaataacttccaattaatgtattcaacacataatacaaattttttaccaaaactggctcttgaaaatgttgtcattatgagtgagggaaaggccacatctttcaaaacggaaatgaatgctgaagatttaaattatctaatccgaaatccaaatcttgatgtgtacaaacttttcttttcaaccaatgtaattctagttgaaggattatcagaagaattattaatcaagtcatatctccagtcaaaaaaagatagtctcaataatattgaagtgctttcgtttcataagggattttgtgcgatcattagactttggttaaaaataaatatcaacaaccgccgtaaattagccgttataagggattttgacaatcaaccaagggccaagggaaaaattgaaaaattagcccgaaaaaacaagatttcaattaacactacaaatggttatacactcgaagatgatattgtgaaaaataattttgaaatactacgacctttttttaaaaatcatttagattggcctgatgatgtatgtcaggataaacagaaactggctaaatattgggaaaatacaagtggagccaaaggtgccgctatggcagaaataagcctagcaataaatactcccgagttagaaaactttaggcttcctgaacatattatgcaggccattaatttttttaaggatacaacaaatgaaaataactaatgccggtgctggagctggtaaaacagctaaattagctgatcagatattaaatcgctttaatcaactttcatgcccacacactcatatatttgttatcgcttacagtaattatgcgattagcgtaattaccaatcgaatcaagcaaaaacatggttcaattccagacaatattcatctatcaactattcattctttcctttggaattatatcatcaaaccatactattttttgctttttaagcaacagtttaccgaaatctctaatcagaatattattgataagccccaatatcgtgcaaaaaagttttatgaaatgagaaataatggaatacttcatgttcaagaattttcacgtgtatccaaaaaagtattagttaaaaaagcgcatgatacaaaaaaggttacaaaaaaaaggaagcatattttatacaatcttggacaattcattgattcaatatttattgatgagtcacaagatatggatatggatagtgcctcttgtatttctgctcttgatgcatcaggaattgagtgttttttggtaggcgatgaaaatcaagatctacattcaagaggaggattttcattcttaataaaaaaatattttagtcaggtttgtgtggatagtgaaaaccataggtgtcctcaaacacatgtgttacttgccaatagattctcaaaagttaaacaaatatcaaccacaggagaactgggtaacattaaatatatacttgaaacaaagtgtaatgttaaccaaattgttaaagaggtaggtgatagccttgtatttatcaataaatcgactcattctcttcgtgtccacaaaaagaatcgagaaaacattaaacaattagaatatgttataagaaaacttcattgtcaatctccggggttccaagatatttcatctactccctcaaaaaaatgggcatttgatgtaacacgcaaaatagtagacgaagttcggaaaaaacaaaaaagtccctctgtcattacaaataatgtcataaatctaatgaacttaagttatgataagcgaaaatatgcagaactaatacaaagcattaaatctataagttcacattgcaaagaaaacttgaattttcctcttaattcaatagagtctgttaagggaaatcaatgtaatgaatgtattttttttatatcaacagatctttttgcatatttgataggagaaaagactaaatctaatgcgacaatgaacgctttgtatgttggactaacaaggtcaaaaaattatctgttattaatctttaccaaagaggtcactgaaaagtataaagttgaatttattgaacaaaagatgagagatctgaatattgaaagattttgaataatttatcattaatcaatttatttagataaactcctaataatagagtagattcaataagggctttagaataatgtgcttattgggattctaaaaacagtttcaatcactatgatatattcaattgaaagcctacgaaaatgaatgccattagggaatttaaaatttatagtgtgtattatatcaaaacttaaatttggattatttgtattttacacaaaatgaggtgcatcatgaatggaaaacaaagacagtttaatttaggtgtgacaaaagctggcaaaacaaacgttgggtttgacaggaagtacactaatcctagtaaaagagaagatcagcctcatattatgcacgctcatcatggtattgtaattgatgataaaaaacaggcagtcaaaattcttcaaagggtaccatatgatttactaatatatccaggtttaaaaatttggtattctaggtccccaaatggaaacaaatttatgcaaggtacaacaattgaagaactgtatgagttatataaatttgattcctttatgaaaggtaaaatactagaggtagttcgatcatttgaaaatatgtttttaggatcattagcatatcattttgaatacgagtatcaagaagcagcaaataaaagagaactttttcaaaaaaaaagagttaggaagcataatatggggtattcaaaatcgggtgaatctaaaggggaaggtaagatcttttataaaatggtacctctatgggatcaatttttttctgataattcaaatataacaattaatgatgaaattgatatatggaaatctctaaaaagaaatagatttcttaagcgtataaaacaaaaaaatgtcgaaaatgtttacaaggatcggcttaatgcaataagatttgatacacgagaaattaatttcatgagacaaaatgtgggatttaaaagtacaactgttcagcaacaatgtatagtagatattattagattttcttgtgtttccaatacaatctggagaaaagatataggtgcaaaagattttgagtatttattagacactattcgacaatttaggaatgcttctgcgcatcctggatatattttaaacaaagtgacgacttggaacggacccattgaaaaattacccacaaaattaaagcttacagaaaatagggtaccattaaacatatttattaaaaccttcgtttattttcttccaaaagatttaattaattcttttacactagcagtcagacaagagttgttttcattaaattctaagagaaaaattgggccaaaacatttaaaaagattggaagacatcattggtatcaaaatgatgagttgagactcttacaagctactaaaaatatgttactgactgatcttataactcaaaaaatataaaatcatgttgaattattaaaacgttattgaaatcagggagtttaaagttttttgtttaatttttaattataggccattagggtataccctagtggccttttttgattctgtgctatactaggaattacaaatgttcattagaactgtccaaaaggagaactggaaatggctaaaatcggttatgcgcgtgtgagttccaaggagcaacatttagatcgacagttagcggctttaaaagacgttgataaattatttacggataaattaagtggggctaacactaatcggccagaactgcaaaaaatgctggcctatattcgtgagggtgatattgtaatggtcactgaattagatcgcttaggcagaaacaaccatgatttgactaagatcatgaactccattcaaaataagggtgccaccctagatgtgttgaatttaccgtccatgacagggattgctgacccaaatttacgtcaactgatgaccaacttgattattgaactctataagtatcaggccgaaagtgaacgtaagcgaatcattgagcgccagcagcaagggattgccttagctaagcagcagggtaaatatcatgggcgcaaaccccaatacacccaagacgatccccgcttgcaacatgcttttaagctttatcgagctggcatgagtgacattgatgtgtcccgaaatacaggtattaaacggacgacctttattcgataccgtgtgaaatacggtattaaaagaaaatagggcccccttttggttagcacatggtaactgaaagggtccctattttctttacttaaaagttgtctcaggaatcagcttacatccaaattgtgtacaatctatatcatgagaactaattttagagtacgataaagttgattaacaatttcgctaaaggcgatgatgggatgaaaagcacgacgaaatgggtaacacggtggcccgaacgaattagttacggcttaagtgacgccgccgataatttagtctttcaaatgatgacgacctatttgctattcttttacacggatgtttatggtctgacaccaagcgcggtggccattttatttgtcgtggcgcgggtagctgacgttgttgaaagttttgtcatcgggatcatgattgatcacacacactcacggtttggcaagagtcgaccgttcttcctctggtattcgttaccttacgttatttttgcggttctcacctttgtgacgcctaacttttcgtataatggtaaattaatctgggcatatgtgacgtatttaggccttggatttctgtatacggctgttaatctgccaatcacgtcaatcttaccaacgatgtcgcagaatactcgtgagttgacgttgttgggggtcattcgtcaattctttggcagttcggttcaaattgtggtggcggtattcacattacccttggttgcgttcttcggccacggtaatcagcaaaaagggttcttgggcacaatcatcgtgtttagcctgatttcatttcttttgattatcaacacgtttgtccatgttcgcgaacggttcgcgaatcctgaaattgcccatcaaccgttaacaactgtcctaaaaatgttgaaacataatcagccatggatcgttatgtcaatcgtgattatcatgtactggctggtgacggcaattaagaatcagacaaccatttactattttaaatatacggtgggaaacgaaaacctggtaccactagctaacagttttaccctggcagcgttaatcggggtattgctgatcattcgaattaccgaggttcgcagtaagaagcaaacgatgcttcgcggtattttaatagcgctggttggtcaaaccgtgattgcgattggggtttataccaaaatactgtggttcttgtttggcggtgtcttgattaactcgattggcaatgggatcattatcggcctcgtctcaatcatgattgctgacacaatccgttatggtgccagcatggggatccaagccgagggagttctggcttcaacggatgactttggcgttaacgtcggccttggtgttggcggcttgattacagctggtttgtttcacttttcgggttacgttgccaatcgaacccagaatgccgcaactctcaccatgattgatttgaattatgtttggattccgttggttatttatgtggggatgtattttgtattgcggctttatgatgaggggcggattgaacgagcaatagaagcaagaaaataagtccgaattatattctaaataatagtttttgatttgctaactaacaccggtgcggtgtgatattattggttctggtgcaaattttcctcgctgacttgattttagtatactgggtgccaagaaacgagggattgcgcgcatgaatcactttaagggacgccactttcaaaaggacatcatcttagtagccgttggctactatttcagattcagtctcagctatcgtgacatcgttgaattgcttcgggatcggggtatcactgttcatcacaccacggtcatgcgttgggttcatcactatggccccatctttaaggctctatggcgtcggcatcaaacagctcacgctaaaagttggcgaatcgatgagacctatattcgagttaaaggccgttgggcctatttgtatcgcgctattgacagtaacggtttgaccatggattttgagttacgaaaacaccgcgattataccgcatcctatcactttttgaagcgtctcttgacgaccaatggtcggcctgatcgattagtcactgatcaatatcgggcaacactgaaagcagtgaagcaaatttattgagcaaaatatgatagacattaagtaataagtgttacccttgaaaatgtaatgaagaaactattgtgttaggaggattttatggataaacgtaaaattgtaattgttggtgcttcacatggtggtcatgaatcagcaattgagctgttggataaatataatgatgtagatgtaactgtttatgaagctggcgactttatttcatttatgtcctgtggtatgcaattatacttagaaaataaagttacggctgaagatgacgtcagaaactttgctcctgaagatgttgaaaagaagggcggtcatgtttatgccaaccatgaagtaaccgcgattcatcctgaacataagacagtaacagttaaggatttaaccaataattctgaagaagaagttcaatatgataagttaattctttcatcaggtgtaacgccaaaggttttaccagtacctggcaatgatcttaagaatatctatttaatgcgtggacgtgattgggcttctaagttaatgagtgctgttaacaatccagcaattaagaatgttgctattgttggtgctggttatattggtactgaagctagtgaagtatttgctaaagctggcaagcatgtaactttaatggacatgattgatcgtccattaggaacttacttgaaccctgaattgcttgatgttttggaacctacctttaagaagaatatggacttgaagatgggcgttaaaattgaaggcttcaacggtaatgaaaaagttgaaagcgtcaagaccgatcaaggcgatataccagctgacttggttgttgtttcagcaggggtaactcctaatactgattggataaagggcacagttgatttagatcaaagaggctggattaagactgatccatacttgagaacgaatgttaaagacgtttacgctattggagatgcaattttgccactttctattccagcaggtaagccaatgccaattgctttagctactactgctagaagagaagcacaatatgtggttgatcatatctttgaagataagccagatcgcgctttcaagggtgttatcggtgcttcagctcttagcgtctttgactatcacttcgctactgcgggattaaataagttttcagctgctaagaataagcttgattatcaaactagcttctatgaagatcatatgcgtccagcttatgtcccagaagcagataatcctaaggtatatgtcagcttaacctttaatccatatactcaccaaatcttaggcggtgctgtcctttctaagtatgatattactgctcaaggcaatgttttagctttggcaattagtcataagatgcgcttggaagacttggctgaacaagacttcttcttccaaccaggatttgaccgtcaatggagtttgcttaacctagctgctcaacatgcattaggtatggcaagattctaatttaatcgttaataaaaataaattataaagataaaaactagtcatgtttttaacggctctttgtcaaatggtgttgaaggatagtttctatcctttggagatctcctcgtgtgggagatcttttttgtttttttattagttgcggcgtttaatctggtgtgtcgtctgaatatcgtacttg

SEQ ID NO: 270 - DNA, 18779 bp, Unknown
  Metagenome-assembled genome
agttttctaacgagaaggacgaggccacgtgtctgtggcccggccctgccgcgcgcgctactggttgcgcagcatcttggtgaaggacgtgtccgagtggcgcgcccacagcacgtagaccagcacgctcaccacgcaggcaagcgacacgatggaccacatggcagagtagcccagcgccgtgatgagcgagcccgcgacgccgccgcccaggccgtagccaatgtcgtagccgcacaggaacgtggagttggccgacccgcgcgtctggtccgtggaggtgtgcacggccatggactgcagggacggctcgagcccaccaaacgcgtagcccgcgaggatggcggaaagaatgtacgtgaacgtgttgggcacaaaggcaagcagcaggaacgccacgagcatcgccgcgttgcacgtgtacacaaaggcggcctcgcccttctcgtccacgagcttgcccagcgtgatacgcacgagcagcagcatgccggacatcacgaggaagtagatcgagcccgagggcaggccgttctgggccgcgaaaatcgccacaaagttctcgagcgcgccaaaggtgaacatgaacacgagcatggtcaccgttgcgggcagggagtcgcggttgatgatcgtgcgcaggtcgagcttcttgtgcggcacgtcgaccttgggtgcgtggatgaacgagaagagcacgaggccaatgatcgcgatgatcgccgcgaccgtatagagcaccttgaagccgaggccctccatgagcgagaggcccagcgccggcgcgatggcggaggcgagcgccgtggccatgccaaagtagcccatgccctcggcaaagcgcgggcggcagatcacgtcggacgcgacggtcgccgtggtggagttggagaacgaaagtcccacgccgtggatcatacggaacgcgatcgccacggagagcgtggggaccagtacgtagcccatcggcgccaggcccatgagcaggagcccgaccacaagcgcggcacgacggacgccgttgtcgagccaccagcccacgaacgggcggatcaccacggcgatgaacgagaagaccgcggcgcacacgcccgcgatcgcctccgtgccaccgaggctcttgatgtagaacgggaaggtcgagaggctcatgatgtggttcgtgaagacgcacaggttgaccaggatgatgagtacgaggtcacgcgtccagagcttgggctgggtatgggcctcaacggccgcgttcttctcttctgacaaacaaatccctcctagacgggtcgaagtttccttccagcgggaaggcgccgcaggtcagggcggcaggcgtcacggctgggcggcgtagtcatcaattggacttacaccgttcggccgcgcattgacgcaagtgattatagacgagaagcgcaccaacgcacccgcgccgacacgtgttgattttgttctgcgggccccgtggggtgctatggtagcccttgcgtgtagcgcaaagctgctgcgaccaggtgcccaacaacgccaccaggagcagcgataaagtgtagtcagcaaagcgtgcgattgtcccccggggcaaccgcacgcttttttgttgcagacgttgtggtgggaaggattcctggcagacgccagccgagcggctggggtgccaccgtaccgacccgccgcggaagggagccggcaagcatgccaaagaaccgcatccagggagtcatcttcgggatcctcatgtccgtcaccatggcctacgggatggaggtctacaacgtcgcctggaagatgggcatccccaccatgccgggcgggttctccaacatgacgaacgtggtgttctgggacgcgctgctcgaggcggcctacatgtggctcttcgtgttcctgttctccaacctctggggcacgcgcggcggcgctgccctggccgagaagatcgtggaccccgagcgcgacagcgccttcgtgcagggaaccgcccgctcgtgctgcaccgtgctcatcatgtgccccacgatgagcctcgtggcgtcgatcctgttcaacgtggtgctgggtggcatgcccgtggcgcagcttcccgcgatctgggtgggcacgctcatcaagaacttccccatggcgctgctgtggaacctgtttgcggcgggccccgtgtcgcgcctcgcgttccgcaggctcttctcgcacgtgggaatgcacgaccgcgagtccgacgccgcacccgcgccggacgcccgcgccggcctcgcgccgcagtacgtcgaggcggagtcgcgggactaggcggtcgttcttctcgcccgcttccccgtcaccgcggtcataaggctcgcccgattcttgtaatacctgcccgcggcaaagtccgcgcgggactcctccagcgcttccctgatgtcctgttcgccagcgtccgcctgcgacctgtccgcgtgcgccgcgctccacaggcgcctgccgtcctcgggcaggctgtcgggggcgccgaccatgaagtcctcgtttcctcgcttggcggccgtctcgtagtaccagcgcttccagtcgatcatcgcccgcgtgcgctcgagctcggcgatcttctcgtccaccttgcggcgctgctcctcaaacaggtccaggcgctcccggtaggtggccggaccctcctgacatagctccatgaagtgccggatgtcgcggatctcgagcccggagcgcttcaggcactcgatcacgcgcagcgcctcgagctgctcctcgccaaagcgcctggtgccagacgtgcgcgccagccccggcaggaggcccatcttgtcgtagtagcgaatggtcgagacgggcaggtcgaacatccgcgacacctggccgattgtgtacatggcgtgcctcccgagaatctatctcgacctaaagtcaggtttagattctacaacgttcctaaagacatgagcaacgggctcaggagagaggaacgacatgctcggagacttcacgtatcacaacccctgccgcgtacgctttggccccaacgccctggacgagcttcccggcgagctcgcccagtacggccccaaggtcctcctgacctacggcggcggttccatcaagcgcacgggcctgtaccagaaggtcgtcgacgcactcgccgcggccggcaagaccgtgttcgaggtgcccggcgtcatgagcaaccccacggtggagaagctccgcgagggctgcagggtcgcacgcgaaaacgacgtggacctaatcctggcagtgggcggcggctccacgatcgacttcgcaaagggcgtgagcgtgggcgcatgggccgatggcgacccgtggcagaagtactacctggacatggattcgctggacaaccgcatgatccctgtgggcgacgtgctcaccatgagcggaaccggctccgagatgaacggcggctccgtcatcaccgaccacgccgcgggcctcaaggtcggccgcgtgtttggcccggacgtgatgccgcgcttcgccatcgtgaaccccgagctcacgttcaccgtgcccgactaccagatgcgcgccggcatctacgacgccttcaaccacatctgcgagcagtacttctccggcacggacgacaacacgagcgactacatcgccgagggcctcatgcgcagcctcgtgcacgcgagccgcatcgccgttaaggacccgaccgactacgaggcccgctccaacatcagctgggcgtgcacctgggcgctcaacacgctcatcgcgtgcggcaaggccacggactgggaggtccacatgctcggccaggccatgggcgccgtgacggacgcgacgcacggcatgacgctctccgccgtgagcctcccctactacaacctggtcatgccctacggcgtggagaagttcgcgcgctttgcccgcgtggtctgggacgtggacggcgcaggcaagaccgagcgcgaggtcgcggaggccggccttctcgccatgagcgcgtggatggacgagatcggcgtcgtcaagcactcccgcgagcttggcttcagcgaggagctgatccccgccgcggtcaaggcgacgttcatcctggacggcggctaccacaagctcacgaccgaggaggtcgagaagatcttccgccagagcctgtagccgcccggcgggaccctacggattatccgatttctaaccactggagatgacagcacaatggcaaagtcactcgtcgcgtactttagcgccaccggcaccacgaagcgcctggcagagcgcctggccaaggtcgccggtgccgacctgttccagatcgagccccagcagccctatacctcggcagacctgaactggagcgacgggtcctcccgtaccacgcaggagaagaacgacccctcgacccgtcccgccatcacgggttcgcccgacaccgccccctatgacgttgtctacatcggcttccccatctggtggtacacggcaccaaacgtcgttcacacgttcctggaggcctgcaatctcgcgggcaagaccgtggtgcccttcgccacctcggacggcagctccatgggtcgcaccgcgcagtcgctggcggcgtccgcccagggagccaaggtcgagcagggagccgtgctcaacggcgcgtccgacgcacggctcgccaggttcgttggccggttccagtagaccgcctgcacgtccccacattgtttcagacaaatgcgacccctccaagccaggcggacggatgcgacgcttctgtcaacgtcccagatcggaggggccgttcttctctactgaacgatttctccgactcctactgaacgattttcacgattgctactgcacgatttccccgctctctactgaacgattttggctcccctactgatcgatttcattcaaaacccgaaaggcgagacttatccctacgccgcgcgcacgtccctctcggccagtgtcctcgcgggatgcagtgccagaagcagcacgatcaggcacgcgcagtttacgcccaggctgatgggatagacgctcatgatggtctggaacgtgtgactgacggggaacaccaccgcgatccagaagagcctgatcccgcagatcacgaccgtggtcgtgacggccggcggcgtggacatgccaaagccgcgcaggtagccgctgatcgcctcgtagaacatgctgaacgcgtacgccgggaagatcgtgcacaggcgcatgtagccatacttgaccacggcggggtccgggttgatgagcgccagcacctggcgccccaggaacacggcaaacaagttgagaaggacggccgccacggccccctccgccgcgcacacggcaagcgcgcgcttgcagcggtcgaggttgcgagcgccacggttctggcccacgaacgtggtgcacgcctggctgaacgagttgagcaggctgtagcacacgaactcgatgttcatgcccgcgctcgacgcggccatgacctcggtccccaggctgttgatggccccctggatcacgaggttggcgatggagaacacggcgccctgcacgcccgccggcaggccgatgcgcacgatgcggcggaggctcctctcgtccacgcgaagccgatgcacgtcgatgcgcaccggcgagtccagatgcgtgagcctcacaaagagcagcaccgcgatggtggtgtagcacaggtccgtcgcgatggccgaccccaccacgccccagccaaacacgccaataaagaggagatcgagaaggacgttcatcacggccgagaggcacaacgcctgcatggggagctgggcgtcgccgtccgcgcgaaggatggccgcctcgaagttgtagagcaggatggacggcatgcccagcaggaacacccgcaggaagaggacagcgtcgggcagcgtctccgcagggacctgcaagagcaccagcaccggccgggccagcagctcgcccaccacgatgaccgcgaggcccgccagtgccatcaggaccgaggtgtgcgccgccttggacgcggcgtcgcggtcgcccgcgccgagcgcacttgccaccgcgacgttggtgccgagcgacacccccacaaacagtacgatgatcaggctggttatctgcgtgttcgcgcccacggcggccatgccaaccgtgccctccggccccatcaggcggccgatcatcacggtgtcaatcaggctgctgagctgctcgaggatgctcgtgagcgccaccgggatggcgaagcgcaggatgtttgtccagaggctgccatcgaggaagcttatctcgcggtgccgcgttgccaagtcactaccatctccaaaaacgagcccgccggaagaccgacgggcgagtgagtccgttatgactgtatgagattagcgacgctgggcaacaaacttttcgagctctccatccgacgccctattgagtaccgcacacctctcgaccatcgcacatctccaggaacgtgtgcacgatattgggcgggtatgcgcgtcgctagtcaagctgctcgtacgcctgggcgtcaacgggctccagccactccgcgctcgcgcccttggcgggcacggccagcgcgatgtgctggaaccaggagtcggccgcggcgccgtgccagtgcttgacctcgggctggatgctcaccacgtcgccgggcctgagctcctgcgcaggcttgccccactcctggtaccagccacggccggcaatgcagatgagcacctggccgcccttgtggtggatgtgccagttgttgcggcagcccggctcgaaggtgacgttggtggcacccagctgcgggtcgcccagcggggccacccagctgttgcccacgaagtactgggcgtaggcgtcgttaggcacgcccttggggaactccttggagaggcccgacgggtcggcaatgcgcacgtccttctcgcccgcgggctcgtcctcgtccgcccagacctccttggccagattgaaggccgcccagcccttgggccagccgctgtacatggttgcatgagtgatgattgcggccgcctcggcgcgcgtgacgccgtggttgcgcgcgttctggaggtggtagcgcagcgagctgtccgtgatgccctggcttatcagcgccacgatggtgacgatgcacttggtcttggtggagatggcctcctggtcccacacctcgccaaagagcacgtcatcgttgaggtgtgcgaacatgggggcgaactcgcccagagcgtccctgcctgccgtctgcttcatgtctgttcctccctataccaggtcggccacgcggccggcccaatccgcaaccttgcgagggtccgtcaccatgctatctccgccgtcggacccaaacgtcaccgtgagcggctcggcaacccgcgcgccctccgcgagccccgccatgtcgtccagcgcggtgccctcccagccggcgcaggtcgaaaagggcacgacgaccttgccgttccactcccgcgagcgcagcagcgtgcggacggcgggcgccatggtgtaccaccacgtgggcgtgcccaccgcgatcacgtcgtagtccgccgggtcatgccccagcggctgcagctcgggctcgaagcccgcctcgacctcgcgcttgccctggtcgacggtccggtcgtagtcctcggaatacggcacggcggtctcgatgcgctcaaggtcggcatcgcaggcatccgcaagctcccgcgccacgcgctccgtgttgccgttcgaccaactgtagtacaggaccagagcccgtcccatgggcacctccgtcgtggttgcgtcgtcgggcacgtggcccttctcgtcattcacaacgttagtggccatgccctgcaatgtgaaatgcctatgttgatgactttggtatgtatgctgcatatatcaagtacaggacatcatggttggcacgcaggaaaatagctcgaattgtagcgatattcacgattcatcatattgtttcgagaagcaattcaggaaaatgatggtatagtttcctaaattgtttcgcgaaaggggacctgatggatgagaaagccctaatcgagaaaatcagctctggcgaatcggcgacttgcgaattcaaacgttgcagggggagaccggagaacgacacgttcgagacagtctgctctttcgcgaatcacatgggaggcaacatctacctggacgttgccgacgacggagaggtactcgggattcctgaggccggcaccctttccgttcaacgaaacatcgccaatgtcgcacgcaatccaaagctcttctcacccgtcgtaacggtcgagaccgaagccgtaaggtgccgaggaaagattgtcatccgcgtgtgggttcccatgagccccgacgtccacagctataagggaacggtctacgaccgggtggccgataccgacgtcacaatacgcggaggaggtcagctctcccagctttacctgcggaaaagcggagtgagttccgaacgccgagtgtatccctaccttgctgtagaagacttggaccccgtcctcatcgcccaggcccgcaatatggcaacccggcgtcggccggggcacccatggggagaactttcggattccgagctcctaaggagtgccggactctggcaacgcaactacgcaaccggcgaggagggactcacgttagccgcgggtctcctctttggcaccgatgacgtgattcgctccattgcgccctcctacagaactgatgcgctgcttcgcctagataacaccaatcgctatgacgaccgactgtcaacctccaccaatctgatcgacgcgtacaggcaactcatgaccttttgcgaacaatatcttcccgacccattccatctggaaggagacattcgagtaagccttcggagcgtagtctgtcgagagctagtctcgaatatgctcatccaccgtgagtactccagcccaactgccgcccagcttgagatcagccgagacggcataagaactcgcaacgcaagccggaccttctttcaaggtcggatacgactggacgactttagccccgtctccaagaacccactcatagcatccgtcttcacacaggtcggccttgccgaggaacttggcagcgggacgagaaacctatacaaatactcaaggccattccttggcagagatcccatccttgaagacggcgacatatttcgcgcctggatacctggagatccgcgcaatcgagccgaaatggagaccaacgcgaagattggcgtggacgacgtcatcatggagcttgtcgcgaatggcgccgagactactgtacgcgacgtggcagagagggcgagcgtcacaccaagaacggccagctcacatctgaatgcactcgccaacgagggtttgctcgaggcaaccggctcaacaagggaccgtcgttatcacagtgcccgcaaaggccattagccatttcaactgtttccggcataaccgtctcgtcagtcgtcaatcgttgaaagacaccaccatggagctacgaaccctgaggtacttcctcgccgtcgcgcgcgagcagaacatgaccgaggccgccaacgtcctgcacgtgacgcagcccacgctgtcgcgccagatggcagacctcgagcgcgagctgggatgcacgctcttcgtgcgcaccaaccgcgcgaccacgctgacctcggacggcatgcgcctgcgccagcgcgcggaggagatcctgcagctcgtcgagcagaccgaggacgagatgggcaccaggcgcgaggtcgcgggcgtcgtgcgcatcggcgcgggccagacccaggccatgcgcgtgctgaccgacgcctttgccgaactgcaccgcaaccacccccgcgtgacctgccagctctacaccggcaacgccgacgccgtcgaggagcgcctggagcgcggcctcgttgactttgcgctgatgatcgagcccgtgaacgtggagaagtacgatcacctcgagctgcccgtgcgggacaccgtgggcgtcgtcgtgggaacgcgcagcccctgggcaaggctggacgccgtgacgccgcagaccctggtccagatgccgctgctcgtgagctcgcgcaccacgcaccggtccttcgacctcgcggcgtggtcgggcggcctcgtgacgcccggacgcctgaacgtggtgggtaccttcgacctcatcggcaacgcggcgctcctggtcgaagccggcggcgtgtgcgcgctgggtatcgaccacctgctggagctgcagaccagcgccctgcgcttcctgccgctggaaccagagctcacaactgggtccgtggtcgcgtggaagcggcacaggatcttctcgcccgcgtgcgaggcgttcttggaacagctacgggctacgttggagcagtaggcgtcgctcctcgcgcgacatgcgcaaccccatctacctgcggcgtagaaaaaatagaggctgtagaaacgggcgagaaggacgcgacccccttggcgggagccgcgtccttaggcacaggtcaattgtggccgcgcaggcctacgccagccgctcgcgcacggcggacagcgcatcggccgcgtcgcagtcgaggatgatgctcctctcgcccaggtcggcgggagcgagcacctcgcccttgttgagctgcacgtacgtggcatggcgactctgggccgtgaaccgccagaacgggtacttgacgatgaccggcgtgttgccgcccacgcccacctccaggtagaccacgcggtcgtgacggtgcgcgcgcaggaacttgtcgtagcggcgggcggccgcgtgccagccctcgtcctccacaaaggtgtcgtcgcagcgcaggttgggcaccatgggctcgccgcagcgcgagcagcgcggcaccagctccgtgggcacgcgcaggtcgcgctgctcggccaccatccggcgtaccaggtcctcgttgtcgtacgtagcctggtggcagggcttggagcactgcagcaggccgtagtcgccctgcgtgtagaacaggcggtcgcgctcgatcccggcgcgctggaactggtggtcaacgttcgtggtcagcacaaagtggtcgcggccgcgcagcatggccaccaggtccaggtacggctggcccaccgggcagtcgtagcggttgagccagatcatgcggctccaccaggcccagtaggtctcctggtccggaaaggggtagaagccgccggaatacatgtccgttatgccgtaggcgtcgcggaagtccgcaaagttcttgtcaaagcgcggccctgcgtacgcaaagcccgccgcggtcgaaagtcccgcgcccgcaccaacaagcacggcgtccgcctcgcggatcgcgtctgcaatcctatccacgcactccaagaagctcccggtagatgtcgtgatccactggcttgaatacatcgaatatcaccctcatctggctgttggtccgtctcttccagtcgcgcaccgcggccacggccgtctgcgcggcatctcggttggggtagccaaactcccccgtcgatatgcagcagaacgccacgctggcaagtccccgctcgtgcgccagctccaggcacgacgtgtagcagccggccagaagctcgcggtcccgccacgacgggcgcgcgccgcccacgatgggacccaccgtgtgcagcacgtgcgcggccggcaggttgtagcccggcgtgatgcgcgcacggcccgtgggctcctcgtgcccccgcgccgccatctgccgcgcgcactccagccgcagctggatgcccgcgtacgtgtggatggcgttgtcgatgcagcggtggttgggcacaaagcagcccagcatctggctgttggccgcgttcacgatggcgtccgcggccagtcgcgtgatgtcgccgcgccacacggcaatgccctcggacgagaaggacacgtccttctcccccacggcgcctccgcgctcggcaaggcgtcctcgcaggtacgcgtcctgcacgcggagcagctccgcactcgccggctccggcgggcgcacgttcaccagcgcccggagcagcaggcgctgcccctccgcgtccgcgggcggctccggggtgtcgccgccccaggcacggcgctcgtcctcgagcgcacgtatgagccagaggcgccgctcgtcctgcgtcatgtccctctcttgcatgggtctgcctccaatccgcgcggcatcccgcgccctcgcctgtcgacacaagactagcaaacttgtcaacttcttattgacatgttacgtgtcacaacatatattacacgtaagccaacggagaggagaccacgatggacgtgcaggactgcctgcagatgcttcgcgagataaaggacgtgtcgttcgcgacggtggacgggaagggccacccccagattcgcatcatcgacgtgatgctggcagagaagggcgcgctctacttctgcacctcgcgcgggaaggacttccacgcccagctgcttcgcgacccgcacgtcgccatagtgggcatgacgcgcgactacaagatggtgcgcctgtccggcgaggcacgcttcgtcacggacggcccgcatgcctggatcgaccggatcttcgagcagaacccctccatgaacgacgtgtaccccggtgactcccgctacgtgctcgaccccttcgtggtcgacaacggctgcgtggagctcttcgaccttggggtctcgcccatcttccggcagacgttctcgctcggtggcgcgcccacgcacgtgcagggcttccagatcacggacgcctgcatcggctgtggcaagtgcgcccgcaactgcccgcagcagtgcatcacgccgggcaagctcttccgcatcaaccaggagcactgcctgcactgcggcctgtgctttgagaactgcccggtccaggccatcgtgaggaggtagcggtgccgtcgcaaattatcgatcttctcacccagcgctgggacttcttccaggggctgctcgtggagcacgtggagatctgcctggtcgccatactcatcgcaatcgtgttcggcggcgtcgccggcatcctcataagcgagtaccggaaggcggccaggcccacgctgggcgtggtcaacttcctgtacaccatcccgtccatcagcatgctgggattcctcatccccttcagcggcatcggcgacgcgacggccgtcatcgcgctcacgatatacgccctcctgcccatggtgcgcgccacgtacacgggcatgaccaacgtggaccccgccatcatggaggccgccaagggcatgggcggcacccgcatgcagacgctcgtgcgcgtgcagctgccgctggccatgcccgtcatcatgagcggcatccgcaacatggtcaccatgaccatcgcgctcggcggcatcgcctcctacatcggcccgggcggcctgggcgtggccatctaccgcggcatcaccaccaacaacaccgccatgaccatcgtgggcagcctcctcatcgcacttctcgcccttgtggtcgacgccatcctgggctttgtggagaggcgcatgcagatgcgcggccagagggccaggcgcaccaaccgcaggctggccattggcgcggccgtggtctgcgtggccgccgccctgggcgccacggtcccaggcatgctcgccagtcccagtgacaccatccacgtcgccaccaagcccatgacggagcagtacgtgatgggcgaggcgctcaagacgctgatcgagcacgacaccaacctcaaggtaaagctgaccgagggcgtggccggcggcacctccaacatcgaggccggcatggagtccgggcagtttgacctgtacccggagtacacgggaaccggttgggccgcggtcctcaagaacaaggggacctactccgaggaccagttcgacacgctgcaggcagactacaagaagaggctcgacatgagctgggtcggcatgtacggctttggcaacacgttcggcatcgccgtgcgcagcgacgttgcgcagaagtacaacctcaagacgtactccgacctcgccaaggtcgccagccagctcaacctgggagccgaaccggacttcttcgagcgagaggacggatacgacgcgctctgcaaggcatacggcatgagctttggcaagacgacggagatggatgcgggcctcaagtacgacgccctggaccagggcagcgtggacgcgatcatcgtctacaccacggacggcaagctcagcaccgccgacgccaaggtgctcgaggacgacaagggcttcttcccctcctaccagtgcggaaacgtggtgcgcaaccagacgctcagggagcaccccgagctgcgaaccgagctcaagaagctccagggcaccatctcacagagggacatggcccgcatgaactacgaggtggaagagaagggcaaggaccccaaggcagtggccagggagttcctgaagtcgaaggggctgatctaatgggaacgaccaccaccgacaccgcaatcgagtaccgcgacgtctgcaagtcctatggcgagaagagcgtgctcagccacctgagtctcaaggtcaagaggggcgagttcgtgacgatgatcggctcctcgggcagcggcaagaccacggcgctcaagatggtgaaccgcctgctcgagcccacgtccggcaccgtgctggtcgacgggcgcgacgtgcgcgagacggaccccatccagctgcgccgcaacatcggctacgccatccagggcagcgtcctcttcccccacatgacggtggaggacaacatctcctacgtgccaaacctgctcaacaagcgcgaccacgatcgcacgcgcaaggccgtgcacaagtggatgggcatcgtggggctgcccgacgaccttctcgaccgctacccgtccgagctctccggaggccagcagcagcgcgtgggcatcgcgcgcgccctcgcggcgtcgccggacatcctgctgatggacgagccctttggcgccgtggacgagatcacccgcggccagctccaggcggagatctcgcgcatccaccgcgagacgggcatcaccgtcatgttcgtgacgcacgacattggcgaggcgctgcgcctgggcacccgcgtgctcgtgctcgacggcggcacggtccagcagtacggtaccccagaggagatcctggccgaccccgcgacggagttcgtgagccagctggtctcgcgccagcgccacacctgcgacctgccggaggaccagctgtgcgcctgcgagcacagcggcgcggcgcgcgccagggcggcactcgacgcacggtagcggcaacgcgcgcgacaccaggcacaagagacgcaagcggtaaaaggagaaggacatggacgacgcgattcccaagacgatgcgggccatagtggtgcacgaggccggagagcccgaggtgctgcgcctggaggagcgccccgtccccgcaacgcgcccgggctggtcgctcgtgcgcgtgcgcgcccgcgggctcaaccactccgaggtgttcacgcggcagggcctctcgccctcggtcgcgttcccgcgcatcctgggaatcgagtgcgtgggcgaggtcgcggccacgaccgacccgtcgcgcctgcccgttgggcagagggtggtctccatcatgggcgagatgggccgggccttcgacggcagctacgccgactacgtccttctccccaacgcgcagatccatcccgtggagtcgagccttccctgtgaggtgcttgcggccgtgcccgagacctgctacaccgcctacggctcgctgctcaacctgcggctcgaggccgggcagacggtgctcgtgcgcggggccaccagcggcgtgggcatggcgttcgcgaggctggcgcgctccatggcgcccggcctgcgccttgtgggaaccacgcgcagcgcgtcgcgcgcggggctgctcctggacgccggctacgacgacacggttctcgacgtggacggcgccctgcaggttgagggccgtccctaccagcgcgcgttcgagctcgtggggcccgcgacccttaaggacacgtgcaggcatgtggcggagggcggcatcgtctgcagcacgggccagctcggcggcgtatggtacatggaggacttcgaccccatcgtcgacctgccggcaaacggcttcctcacgagcttctactccggaaacgtggacgaggggcgccttgcggggcttatcgggtacgtggaggagatgggcgtggacgtgcgtcccacggccgtcttcccgttggagcgcatggcggacgcccatcgcctcctggggagctcgaagggctatggcaaggtcgtagtgacggaataggtgaacgaatgcagataaccagcaggctcacgatggcggcacacatggtgtgcgcgatagactactttggcgacacgaggcccgtgaccagcaccttcctggcgggcagcatcggcacgagccccgtcatggtgcgcacgatcatgggcatgctcaagcaggcgggcatcatcagctccagcaggggcaagtcgggcatcacgctggcccgcccgctggagcagatcaccctcctggacctgtggcgcgccgtggaccagagcgacgcggactcgctcttccacttccacgagaacccctgcccacagtgccccgtaggcggcaacatccatgcggcgctggacaatcgcctgaaggccgcccagcaggcgctggaggaccagctggcacgcaccaccctggcggacgtggagaaggacgtgcgcctgctcgccgcaagctaggctccctcggcagccccgtcacatgcgcaagccgtggaggatcgagcttctcccccgccgcacgcgtgacgcgcgccatgggccagattcagagccgcagcatggccgacgcgccgctgctgatcctggacgaggcgacctccagcgtggacacccgcaccgagctcaaggtgcagaaggccatggacacgctcatgcacggccgcaccagcttcgtcatcgcgcaccgcctgtcgaccatccgcaacgccgacctcatcctctacatggatgacggcaacgtgaaggagaagggcacgcacgaggagctcctggcacagaatggcaggtacgccaagctgtacaacagccagttcgacagcgccgcatagcgcaacaaatcattcgcagggacgaagtgtgtagatagctctgattcccctgcaatagactaggtcaaaacttcgacctagtctattgcaggcttctcttactggtccgtcattggctctgtcgccaatttgcccaaccgcgcacgcttgctacgactggaacatgcgctccgcgtcaacgagtctgaggtcgttacgctcttgcgccttcttgatggtcgactcgctggcccgacgcttcgaaaagaggacgtagtccttgcgagcaccccgtgcgaaggcgttgcccctttgctctagcaggcgaatggcctcggtctggtcgaattggttgcgccacttgcattctcccagtagcatgtttttctcggcagaatccgagacaaccacgtccacgtcggctctttcccgggctattggatcggtcccccaccactttccaaacttcgtagcgataaagccgagcttgccttgagcgttgaggcgctccacccactgcaggcacacgtcctcgaagcgatctccgacatacgtatcgagcgccgagtcaaagacagactgcctggccaccgtctcacctgcacccatttcgatagcggccgtattggggctgacaaagcgataccagaacgaatagaacggatcatgcagccggtagattccctttctcgagcggacggggttctcgccaaagggcaggcgcctctcgacaatccccagcccctcgagagtcttgaggtacttgcccacggacgccgaggcgattccagccttgtccgctatggcctgcgggcgcgttgcgccagtggctatcgcatccaagacggaggtgtagagcgccaggtcgtttagctcctgcctgagcagcatctgcggctcgccatagaggagtccgtaggggtcgaagaacagccgtatgacgttctgctcgtagctctggtcagaacgaatctgagagagatagtatggcgtgccgccgaacgtcgcgtagtattccaccatctcttccggcgtcgtccatggaagcatcagacgcgcgtcgaagcagtcaaatggcttcagctcaatctgagccgtgcgtcgtccataaagcgggctcctgtggcccaagacctcgctttccatgaagccctggttagatccgcagagtacgagcgtcatgttcgtgccaagcatctggtgatcgatagccgtctgcaatattgatgggagggcggggtttgcctttgcggcgtagggaaactcgtcgaacacgagcaagagcggctcggctgtctcggcagcgcgtcttgccacgaaggccatcgcgtcatcccacgtcgagaagcgcacctccggcgcattgaagaactcggccacggcatcggagaactcccgcaggtttatcgcgtccgacttctcctgcgcggtgaagaagaggcatctcttatccttggcaaactcagcgagcagcatggtcttccccagtcggcgtctgccatagacgacaaccatctcgaacctgccggtgtcatagtgctgcgcaagggcagaaagctccctggtccttcccacaaaccgcatcataggccgctccaatgctcgactgacacgtatgatactagctaacagactttggagtaagttactcgaaagtctgttacgggaaaaccagggccatgttgccctgttgccgcggcgtctgtcagaagtccaacagc

SEQ ID NO: 271 - DNA, 3286 bp, Unknown
  Metagenome-assembled genome
cacagcaggagatccaggagaagtacggcttccccgtggcctccatcgtgaacatgcgcgaggtcgtggacgcgctgtacgaccacgaggtcgagggtcgcgtggtgattgacgacaagctcaaggcagccatcgacaagtactacaagcagtacggggccaaggagtagggcacctcggattgacgtgatgcgtgcggctgtacctctgggtgcggccgctttttgtgtggagggtacgaccgcgtttgtgtgactaggatgtgcgcggcacgccgaaggccgtgagcagggtctcgaagcgcggcttgtccagcacggtcgcgaagtcgaagcgcatgaccgcagcgccgcccagcgtgaggcgcgactcgcgaagccgctcttgggagaggttgcggagagccgtgtggaggggttcggaggccgtatggggcgccgcgggcgcgatgccagggccagcctcgggggtagttccgtccgcgatggtgtatttgcccagcccgtcgagctcgccgattatgggaaggccgttctcgcccttcccccagtagaagtcgacacggtaggtccgctgcgaatcaaaggggtcagagaagggaacctgcagctctggggaggcaaagccgagttcaatcatggtgccccgcgcgacggactctcccccgtcttccgcgcgggggtcagtgaggcgggcaacgtcttgcgcgcgatgaattccgtggaggccacaaccgacacgggcgaactctgccacgaggtcgtctggcgtgagcgacttttgccgggcataggagtccgtcaccgcaagggcgaacggcatgtcaagattgcgagcgcaatcaaagacgcaacgatcaaggggagtcaccttcacaccactggcgacggagggttggccgccaaagtagagcctcttcacgtggtcagtattcctgatatgcgatgcggaatcattggcaacgtgtatgacttcaatgttgggacacgagacttctagctcgtaggcaatggccgcagacgattcgcagaagacccagcttggatgtagtaacgcagctgccctgattactcggattgatttctcgcttggatcaaggccccgccaataggcaggctcctcgtacacgcccgggaagggcgacagcaggatgccttcacgcacgcgacgcttcaacaagtctctacccgacctctttgcagctggtagacacattctcatatctcgcgcgtgattgagtgcccgttcaatctcggcgtccttttctggccagaaggacttcgacatgcggctcctcccatcgcactcgggggagtcaccttagcaaagcctccttgcagtcggcttgctcatatctcgccgcaatcttgccgcagccagccgcaaccgcaaaaacaatgcctggcttaaagtccgagcacgcagccacgctcacactacggggcgttttggtgcgcttatctgatttctgtgcaatacggtgtggttaaggccgtaatagaggccttaaccacaccgaaaaacacagttctttgttaagcgcacctaattgccccgtaatcaaaagtcgaggggcgtcacccgtgtgccgctagcggttcgccttcagtgtcgcgaacatcttcgtgttgtggcgcttcacgaacgagatgaacttgccctcctggtaggcaagggccacgttcttctgcttgatcggcatgagcatcgcggccatcatctttgagcgggggcgcgccgtcaccacggcgacctgggcgcgctggctcgtgatcatttcctcgatctgcctgcacttgtccttctcggacagctggcacttggggttgcagacgttctcgatgcagccgatgaggcgctcgatgtagcggcgctggatcatctcgttgctggcggcgtcgccgagcaggccccagtgcttgtagaggtcgagcatccaggtgtgctcctcctcgcgcttggcgtacatgtccgggcgccagcgcgcggtctcggactcgctgcgctgccggatgaagtggtagtacggctgcgagatgacgcccacgcgctgcacgtcgcgcacgtagtccagcacgaaggggaagtcgtcccagaacgtggggcggaagcggatgtgcaggtcctcgatgcgggagcgcaggaacagcttgttccagggcggatagagctggttctcgtcaaacaggcggaaggcggcggcgcggaactcctcctgcgtgtggtagaccgcgtccgcacaggccttgacctcggtggtgtgctcgtcggccttgccgtagtacgtgtcgatgtagaagcccgcaaccacgagctcgaggctgttgcgctcggcaaacgagagcatgtcctgaagcatgtggggctcggcccaatcgtcggcgtccatgaacatgacgtagcggccacgagcgcggtcgagcgcgtagttgcgcgccgcgggagcgccgccgttctgaaggtggtacacgttcacgcgaatgtcgcgatcggcgatggagtcgaggatctggccggtgcggtcggtcgagccgtcgtccacgacgagcagctcgaagttctcgaacgtctggtgctggaggctctcgacggcccgtcgcacatagccgtccacgttgtacgcaggcatgatgaccgaaatctttggcatgcgtggggtcattcggcaggctctccaaaccacaatcggtatacgacgttgggcgacgttcgaaattatctcccaccgcgtgacctgccgtgtgtcgaagacgtggagttcaatatacgcacaaacacccgcggtctggcatatggctggcacacccatccgagtgcataaaaagcgccgggcgagaaggacgcgcccttctcgcccggcgaatcgtgccagggttctgcggtgctgccgattgcggcgagcggccagcgcatgcggctggcagccgttacgactttggcaccatgatgccgaggcttgcgccaagctgcgaggagttgatgacctcccagctgccgcccgcgccgtcgtcctccttggtcgtgggcgcatcgaggcgcgtaaggttgttgatgcccatggactgtacctgctcggctacctcggtaaggtcggccgtggtcatgtccgtgtcgatgtcgtacagaaggtcggcgccgtggctgaggagggccgtcacaccggagcccttgtacttctcgagcttgtcccacacgccgtccgtggcgagcatgacgtgggtcatgcggaggttggccgccttcgcgagcggcgcgacgcacgccgaggcgcccgacgccgcaaaca

SEQ ID NO: 272 - DNA, 1445 bp, Unknown
  Metagenome-assembled genome
aaagtttctcttggaaaagttttgtcactcccgctgcttgtagttgttcaatttgccgggctagattttgctcacgagtactaacacgtgcgtaaccaatttttgtcattttcagaacgcctccggaacacttatatgtaactaatgataatccaactttcggatgaatacaatagggtagaccttaatgttatttcttcaatctatgcattttcaaattagaaatatcttcaccaacgtagacgtgaccatgtttagtatataaggtattaaaattttctttgggattatacatatagaaacgttttgaacttttatctaaacttttatttttagcaacaataaaatgaataaagccatttttttcattccatgttcttgatttatttgtttcataataatctgtataataaatagtgtgccgatttttaacgtacattaaaacgtatctatgaccatataaatgatgatcccaaattcctagatagtgtgtgggaagtgtggcagttctaaaaccatattttaaattcttggcactaacgttatttggattaacaataaatagtgtgaataatgaaactacaaacaatattgatgcaaataatttcttcacaacgaacccctcttattacaatattttaatcttttacaaatacatgataagattaaataaacgcttagtaaaggaggtttaataaatatatggcgacaataaatgaaatagctaaagaattaaatgttagtcgtgtaagagtttaccaaattgttgcaaagcttcccgaggacttacaacctaataaagtcaatgggcactaccgaatagaagataaaaatgttaagtcaattaaagaatactttacaaagagttctttaaagcttaagcaagacaataatggtgagaatgaatataaaattgcaaataaggctttagaaaatgaggtgcaaactcttaaagaacagttaacaaacaaagatgaacacattaaagacttaacacaattgcttgatcaatctcaaagattgcaattagatgtccaaaacaaattgaataaattagaaaataaggaaataaaatcctctgagagcacttttaagagcgataaaaatgaagataatataaatactaatcaagaatcagaaagcccctctatggatacaagagaggcaaataatgaaaagcgtagtaatttttggagtcaattatttaggggcaaataatttgcaactagatgtagagcaaatttatagaagctgcttttttgttgattctttgccggtagtctttggtagtgatattgaatagtctgcttggagacctttaattcatctgcaagttgtttaattgtttttgccaatgtcaatcaccacctagttaaattaaaaatgtccttttttctattttgaggttaatcgattcaaagtacaactggaatctgtaaagatag

SEQ ID NO: 273 - DNA, 2871 bp, Unknown
  Metagenome-assembled genome
tgaaaacgtgataaagtagatgtacccaaagtaatcactccctatattggttggaattagctactaccattgtaagtgattgctttgggctttttaatttctgttcggattaattatagaatttgccaagtagatcaattttttgatattattttagtataattattctgataggtatatgtttgtctaaaaaatagaggtgaaaattatgtctatagatctgatttcatcaaatcattgtcaagaattcattcaggatttttcaaatacaaaaaattctctaaaaattattacgccctatttatcctttatttcaatcaaaaaattgttattaaatatttctaaggatgttcaaatagaattaattacaagatttaatagagaagattttatttctggggcaagtaatctagaagcattaaaattattaaataagcgaaatgtacgaatggaagcagtcaaaaatttgcacacaaaattgtatctttttgacacgaaaatagcaattacagggtcggcaaatcttactgagaatggactacttaataatatcgagctttccttactaatcaagaatgaaaaaaaattaaatgtagcttttcaacattattttgataatgcttttagttcagcaaataattttgccataacaggggaaaagatatccctagaaaaagagatggtagaaagaatgattcaggaaagaaaggataaaaatattgatagtaaaaatacttatcaatggggagcagatatctcgactggagcagatatttcgactactgatacaattgatattgttcaatcacaagttaaggagagagaacaagcaaaatcaaaaaattcccaaactacatattggctaaaatttgacggaactggttcagaattaaaggatcctaatcttccatttgataaaaccaaattagctgatggacaggtagttgaaaacttcggtaaaaaaaagcatccaagtggtataaaaaagggagacgttttgtacttaacccccttaagcaaaaatgataatgataatagtcatactccctttatcgtaggaaaagccatttcagatggatttgataagaataatgtagttacagacgctgatataaatagagaaggatataagtggatggaaaagtggccatattatattaaaattcataatgtacaattaattaaggaaaacatctcggaaggtgcttcattaaatcaactattatcaatcttaaaaaataatttttattcttcaacgaaagggaaaaatttatcattaccggaccttaaaaaatgtcatttgcaaaaatcgcatattagaataacggcagaagcggcacaatatattgatagtttactagggtttaagtaattttacatgaaggaaaaggcattgcaaaaaaatatataatccaagcacaaaaagcttctaaaatagatactaaattttatgagagtgctaatagtttatttaattttatgggggaattggattttataaaaaagctattagcgagatggctttacttccaagatataataaggaagatgttagttatctcaatttaaaaatgaagaataaaaacatcattaataatattgcccttccgatgttgtgcttttgcgatattaatcttcatcaattgaaatatcatttgggcacttatgggcactgtggaataggaataaataaacaatgggctacagatagttatggagtacagccggttaactacatctctaaagattctcccgttatgaaagatttctgcaactaaaaaaagtaaagtacttgtcaaggcctataaaactagacctaaggatataagtgatgttattcaaaaaatagttgctaaatatgaaaataaggagaattaacctcttagcatataaatactaatgtaataagcaaatttaaataagaggttggaagaaagtctaaagtttagatgaatccacttttaatttcaaaataaaaattctatagaatcaacatttgtactgatgcctgtcaaattgataattgaaatgatataaaattaactaaatagttatttattaaaaatggttttatttcggaattttttcggaataagatcattttttgaggaacgtttttctgcattgaaatagataattccttatttgtagccaatatattttaaactcattccattaaaaaattattataaggcgtttccggctacgacactcattcgcttaataccatgttaaaatataaaatcgttaaaatttccggaagcataaggtaactcataattaagtacgtaccagcatggagttgaatcgaaaaacttggtgaaagttctggatagtgttggtttcactcatatcatgaacgactaaataactactagggcttacgtaacaattttgtcattctcaaagcgctttcgaaacacttaattgttactaatgaaattagtcgttttcagtgattacattagggtagaccctattgaatgcttttgtggaaaactatatctatttaattactggttgtgtctttaagtaccatgaatcattatctttaaaaataataaagagtttttgacaattccttaagatttgataactattaccagatttacaaaccttaatatctttagattgaatttttaaattattattagctattacactataaacacagttttcaatttctgggataatcttttcctttggagactgatcaagctttttactaatatttgaatgaactattggatgtaagctgattcctgagacaacttttaagagagggtataatgaataaatcgtctctcaaaaggaaggaatttttacatgccaactcgttacgacaaagaattcaaacaaaacattatcaac

SEQ ID NO: 274 - DNA, 27628 bp, Unknown
  Metagenome-assembled genome
gttcagcctctacacggtgctgggctcgctggtgtggaacgcggtcctgtgcagcgtgggctactttgccggctccgcctggagccaggcagctgccaacgcgtccaacgccatcaactccgcaaccgtcgtggtgatcgcggcggcgctggtcgcggcaggcgcctgggtcgtcgtgagggtcgtgccctccatcaaggcggccgtccgctccgagggcgaaaggtagccgcaagctcaggggaacatgagcgactcatcctccccgtggttactggttgtggccgcgttactgcaatagccttggaatcgcaaggggccaggcggtgccgccgtccggccagtcacgttctgaggagaagtatgcactacgcggacggcgccttctggcgcccgctgttcgagaccaacatggagctgctgctggtggcctccggctgctcgcacaaccgctgccggttctgcaacatgtaccggaacggctttcgcgtctccccgcgggaggaggtggaggcggacctgcaggagctgcgcgagttcgtggcgacgtaccccaagcaggcctacctcttgggctaccacgtctcaaacgtcgtgcgcctgcaggggacgctgccaaaccaggcccagcagatgctcacctacctggacaaggcgatcgcggacctcgcggaggaccagatggagagcttccgctcgagcctcacctcgatctagcgctagacgccggccgcctcgatcgcacggaccaggaactccgcggcgccgggtgcccaggcctcgtagtacgcgcggaagcgctcgtccgcaaggtacgagcgggcgagaaggacgtgcgcctcgggcgtgtacgtgcccttgggccagaacgcctgcagccagccggcatgagcgcgggccgcgggcgccgcgtgggccccgtccgggtcgccgtccgcaagaccggccagcacctcggccctgacctcagcctcaagcttctgggcgcgctcgtactccgcctgggaaagccccatcacgcgtgcgttggcggcgtccgcggccgcgttgccccatcggtcccggacctccgcgccgtacgtgcgctcgttcttctcaaccaggtcgcgcttgaacgcctcgaacttgccgttgtctgccacgggtcctcccccctccggagtgcatgccaccagtagcttggcacagaatcggtcgagcatttcgcgtgacgcgggacagatctgacgggcgcaagccatgtggcggcactgcccaactgcggccctcctctggaatcccgccgcccgcggctgggcgcgctcccccgcgtgctaccctacaccgtcggacaacggacgacggaaacggaggcagcggcacgatggcacaggcagaggtagcgatggtaggaagcgcacgcggcgggaggggactcacgatcctgcggctggcgctgctcgtgctcatgggcttctcgcttggctgcgcggagttcatcgtcatcggcatccagaccaacctcgcgcacggcctgggcgtgagcatcgcccagacggggcagctcgtcagcctgttcgcgctgctctacgccatcatgacgcccgtgctggcgctctccaccgggcggttccgccgctactcgctcatgctcgtctaccttgcgctcttctgcgtgggcaacgtcatgtccgcctttgccacgagctttggcgtgctgctggccgcgcgcatgctgctgggctccatatccggcgcgctcctggccgtgggcgtcacgttcatcccggagctcgcgggcccgcgcaagtcgtcgctcgcacttaccttggtgtactcgagctactccgtggcgctcatcgtcagcaccagcgtgggaaagatcctggcaagcaccgtgggctggcacgcggcgatgtacggcacgctcgcgttctcggtcgtgacgagcgtccttctcgccctcgtcatgccgcgcacggggcagacggacgagcccgccaccgtcgcggagcaggcgagcctgctcaaggagccgagcgtcctcacggggattcttgtgtttgtctttggcatcagctccgtgtacacgttctacggctacgtgaccccctacctcgagcaggtgctggacatgggcaccgtgcgcgtgagcgagacgctgctggtctacggcgcgatcacgttcgtctcgaacctgatgagcggctggcttgacgcgcgctttggcctgaggtctctgttcttcacgttcctggcgcaggcggtggcgctcgcgggcctgttcgtggtgggctccgccatgccggcggcgctcgtcttcgtgatggtgattgcgcttctgatgtacctcgtgtccatccccagcgtgtccaacttcatgcgcgtctcgcgcgagaggcaccccaaggccctcacgctcgcaagctcgctcgagccgctctcgttcaacatcggcatctcgttcggcacgctcgtgggcggtgccgtggtgtccggccccgggatccgctccatcggcctcgtgggcgcggtgctcgcgctcgtggccgccgcgatggtcaccgtcacggtgcggcttgggcgcaagcgcgggtagcaagggccgcgtgatttgctcgcgcttcgcaattgcaatatcaccagaaaattgagaaactgaacacggtcttcccagcgggagggcctccaggagccgggggttgtcccccggcattttttcttacgtgcggtcgccgtcgttacagcagctcgtcacgtacctgccggattgagatgccagggcaggactccgcctcgtcgatgcgaccacgcaggagcgaggcaagctcgtcatcgctcatggctgacgcgtcaatcacgcgcggaacagctggcaatttgacgccgtgcggaatgcctccaagatcgagcgttgcgttcttctccatcggtcctcccatcgtcacgcatattgtggcgcaatccacgttatcgctcgcacgaggacgacggcttccaccgctacgtgcacgcgtttctccccctggcgtaggggcggcgcgggtgacatcgaccttggggagaagttcgcgatctttgggctgatgctgctcttctgggtgatctgggtcgccttcgcggacgcctcgatcagcaccgccaggagcaacttccgcaggcaccccgcagcctgcgcgctggcgctcctgatcttcgcgtacctggcggtaccatccatcctgagcgccatcgcctcgtgcctggaggtcggctcgcttgtgcccgtctacggcgccatcggcatcaggttcatgttcgcgcccttcgtgacggaggtcgccctgcggctcttcctcacgatcgcggagtctgtggacgggctcacaggcagccgcaagaaggaacccgcggcggataccaggcaggccacgagcgaaaaggacgcggaccactgagcccacgccccaacgcagcggcaacggcgtggcacgagccctgacgcagcccttacacactgcgaacccctcccgcgcacgcaccccatatcatcgggtcaaggcacgtgcacggttccctcggcagaggaggcacccatgtacaaggcgttcgtcgtggcgtacagcccggcagcagaccgcatggccgagctcgtggagcaaaaggccaacgaggtcgcgagggacggctacgaggtcgtctccttctccgtcaccaacagcgcccgggccatcatcctggccaggcggcgcgacgacttccccagggagcgtgcctcatgagcggcggcaaccccggcggcgtgcaggccgcgataggcatactgggcgtggcgtgcggcgcaatcggctacgtcgcgctcgccatgggcggcgactttgccagcttcatgcagggtgccctacccggcgtcatgatcggcctttccgccctcgccctcatcatgcgtcccaggtaggcaccgctagatcttgtccctaaagccaggcagaagcctgagcagccgcgtgatcgcgaccgaacccagcactcccactacaaagatgcccagctgcagcgcgggcacgggaatggctccgtagttggtgaaccagatggcaaggtgcccaaagagcgggtggaagaggtagatgccaaagctgtcgcgcgcgaggcccgccgcgatgccgcgctcgcgctgcgggcgattcgcaaaccgcttgaacgccaaaaacaccatgagcgagaagggcatgaccagcccgtattgcggcagcgccacggcaccggccacctcagcgcccgcagccgagcgcagccccagccccgcgctcaggcagcaaagtgcgagcgacgccactcccgccgccacgatgcgccagtcaagctcaaggtactcgtaggcgtagcggcccagcatgtagtagaccaccgcgccgctcaggtccacaaactggtacaggttgacgttgagcagcaggttcgcgagcggcacaaggcagagcagcgcccacgccagcaccacggccagcccaatctgtcggcgcgttgcgtgcgcctggaagccgcgaatgaacggcgtgagcaggtacagcccgatcagcgcgtacacgtaccacagatggtcccaggagttgccctccagcaggttgagcagcgcgcgcccgagcatgccccacgtgagcgtgatcgcacccgtctgcgcgcgcacgtccgccacctgctccatcacgcagaacgcgagccccacggtcaggagcacaaaggccatgcgccacacgtggcggccaatcttgcggggcggcatttctcgccctgggtcaagcagcagcgcgcccgacaccatgaggaacactggcacggcccagcgtgccagcggaatctgcagcacagcctcgaccccaaagagccgcgcgtgcgcggcggccaaccctggggcaagctccgtcacgcgcatggcgtgcagcgcgacgatggcgagggcgccaagcaccctcgcccactcaaagcagtagattttcccgtgttccgtcaagccagtccccgttgcgtcgcgtgccctcgcgggcgagaaggacggctactccgccttgtgggcggccaggaacttctccacgtccgcaaacgtgggcatcgcggcctgcgcgcccaccttggtgacgcagagcgccgccgcggcggaggcgtacaccatgctctcgcggatgtcgccgccaaaggcaatgtgcgcggcaagctcgcccacgtaggcatcgcccgcgccggtggtgtccaccgtctccacggagaagcacggcaccttgaccggctggccgtccaccagcgtgacggagccgcggcgtcccagcgtgatgatggtgctcttgacgccgcgacgctcgaaaaagcgcagcgccttctcgcgcgaggcgtcgtccagcgggctgatgccgctcaggaactcgcactcgccctcgttgatgcacagcacgtcgagcgccttgtagacgtcctccgggatgctgcgggccggcgtcgcgttgaggatcgtgaagagcccgttgcgcttggcgcacaggatggactccatcgtggcctccaggtcgcagcccagctggcacaggaacacgttgccgtggcccgccaggccgtggatggccgcacggacctcctggtaggtgatggtggcgttggcgcccgggtcgtacacggcgcggttgtcgccctcgccgcgcagcaccaggccgatgcccgtgtgctcgtcctcggagatgctcacgttggagcagaccacgccgtggcgcgcgagcgacgccatgagctcgcgtccgtaggcgtcgtcacccaccttgcccaccataaaggtgtccgcacccatgcgcgagcacatgacggcctggttgccgcccatgccgccaggcgtggtcaggaagtcggagccaaacgccgtctcgcccctgtgcgggatggcgcggcacctcacggacatgtccatgctcaagctaccgaagacgacgaccttctccatggttactcctccacctcgcccgccatcaggcggtcaaacatgaccttgttggccgcaagctcctcggcatcgtccaggggctcgaggtcagcactaccatacttcctttccaaggcgcgcgctatcaggtaatccgcaacgcccgggttcttgggcaggagcggcccgtgcacgtaggtgcccaccacgttcttgtacaggcagccctcgtagccggactcgccgtcgttgccgtggccgtacaggaccttgcccatgggctccacgccgtcacccaggtgcgtgcgcccgccgtggttctcgtagcccacgatgggctgcgggctgatgcggctctccaccgcgatgttgcctatgatgcgcggctcgcctcggtccgtgtagaggtccaccagcccgaggccctcgaccttctcgtcccccatgaggtagctgtggcccagcagctggtagccgccgcagacggccgcaagcacgccgccgtcctccacaaaggagcgcagctcctcctgctcggccagcagcttgtcgcacacgatcttctgctcgcggtcggacccgccgccgatgaaggcgatgtccacgttggagaaggacgggcggtcgtccacgtggacctccagcacccgcggctctatgccgcgccaggccatgcgcttcttgagcacgaggatgttgcccgagtcgccgtagaggttgaggagctcggggtacaggtgcgcgatgcgcaggctcctgcccgtgccggtcgtgccgtccgtgccagcgaacgcgttagtcatggcgctcacccatcctctcgagctcggccttcgcgggccagagcgcgctgtagttcgtgagcacgtacagcggctcggccaggtccgtgttgcccaagcggcccagggcctcgcccacgctgcccgcgatgtcggccctgatgcccgcgtacttgaggcgcacctgcacgtcgttggcgcggtgcccgccgcagatcacgcgcatgtgctccgcggccagccgctcaaagtccacgtcccagatccagctgatgtccttgccgtcgttgaagtcgtcatttatcacgaagtacgccgccttgggacgctcgtccgcaagcagcagcgatatgttctggttgaagcccgtggggttcttggcgaggttcagcaccacctcgcgcccgcccacgcggaagtgctgcaggcggccgttctcgggatggtagccgtcgagggtgcgctggaactgctcgcccgtgacgcccgcgagcgacgccgccgcaaaggccgccagcaggttgtacaccatgtacacgccgccaaagcccgcgtgcaggcgcaccgtgccgtcgattcccttgccgcgcacgtcaaagctcacgcccgtgcggtcaactttgacgccggtcgcggcaaaatccaggcccggtcgcgcaaagtcgccgttggggcaacggaacttgcccagctgtgcgtacgtgcgccagtcgtagtccagctccgcgccgcacacctggcagaagcgcgcctcaggcacgcggtcagccggaaggtgcaggtcctcgtccacgccaaacgccagcaccttggtgccgttctgggcggcgcggcgcgccacgcccatgctcagcgggtcgtccccgcagactaggagcgtggtctcgggcgagctctgcagcgcgtgcacgatggtgtcctgcacgtggtcgatctcgcccgcgcggtccagctggtccctaaagaggttgagaaggacgaggtattttggcttgaggtttggcaggatgtgcaccgtggagagctcgtcggcctccatcacggcccagtccgcggacctcccaggcagaagcgcgctcgtcacgccggcggccatgttggcgccagcgcggttgcacagcaccgtgttgcccgccgcctcgatggccgaggccagcacgttgtttgtcgtcgtcttgccgttggtgccgcacaccacgatggagcccttgcggagcttgcccgcaagctcgcccatcaggttggggtcgattcccagggcaacgcgccccggcagctgcgaggcgctgcggtgcagcacgctgtgcagcccccagtgcgagagccttcccgcgcctacggccagggctgacctcacgcccacgctactccgccgtcccgtctgcgtcgacgctcgcggcagccgcctcggccagggccttgtcctccgcgaccttctcggccttgttgcgcgcggcgacctcgtcggccgtgagcacgtcctcgatgcgcaggttgacgcccgcgacggaaagccccgtcatgcccgtgacgttcttcacgacggccttcttcacgtcctcaaagacttgcggggcgtaggcgccgtactcgatcagcacgctgatgttcacgcgcacggacgcgtccggggtgacctccacggtcacgcccttgcgcgagtcgctcacgccgatcacgtcctgcacgcggttgagccagccgcccttcatgccgatcacgcccggcacgtcgcgcatggcgatggccacgatcttctcgatcacgccgttgctgaaggtgagggagtcctcgccgtccaggtcctcctcggcgtccgcgtctgcctgcgcgtcggacacctcgtcggcggcgtccgcatcggccgcagcctcgacctcggcgtccgtggcaggggcctcgtccttctcggcctcgtccgtggcttccacactcgccacgatctcctcaacggactgggcgtcgtcagccgctggctcgtccaccgtgttcagggcggcgtcctcggcggtcgcgtcagtcgcggtggctgccgcgttgtcgctgtccgtgtgggcccagggcctcctgccattcctcttgttcgacatcgcaaactcctctcgggaatcttcgggaaatcacgtcatgcgcacggcgtcgcggccgcgcgcgccggggctagtctcccccgttgccaaagaacctgcggaacgccttcaccacggtttggttgccgtccatgtactggccgatggccacgcccaccagcacgcagatgaccacgaagagcgccttccagaacccgatgatgaagatcaaaagtgccaccaccaggccgcagattccgccgaacacggcgttctcgtggccggggaagttgctggaaagccagtgcgtggtcgcgctcctggcgtgcgagaaggcgcttcccgccttggccgggccctcgtgctggtccgcggcagtgccaccagccgcgcccctgggctcctccgcgtccgactctatcgtgagctttggcttgttgtccggcatcgcctactcctcccccgtcggctcgctgcccttgccggcgtagcggcccatgggaaccgtgatctcggaaccctcctcgcgctcgccctcggcatcgcctgccgcggcggaaggatcggcctccgctgcaggagccacgtcctcctttgcgagtgcgtcgtccgcgggctcggccggcgccgcgccagcgtcagtatcggctgcaggggcgtcggtcgtggcattgtccgcggcaccagtgcccgtcacagccgcgtcgccctcgtccttctctcccgcgtcctcgttcgttgcaggcgcaggctcggaagccgcggcgtccgtcgtcgcgggtgtcgcgggcatgctgtagtcatagtcgtacgtgtacgaggcgtccgacgccggcgtgtactccgccgcgttcgtgaactccaggtcaacgctgtcaacgttgtcgccgcacacggtggtgaggcccgcgaccagtttgtcgtgcagctcctcgcccgcacggaccgtgtccaccgtcatctgcggctgcacgcgcgcgtacacgcgaacgtggccgcgcttcttggcccacacgcgcacgcgcttggccctaaacgcgccgtcctcctcgatcacgtgcgttgcctgcgaggatatcgcgtcgcgcgccacggtgatctggtcgccgccctgctgcgaaacgatgaccaccttgcggttgcgcttgaagatggagcgcagcaggcagatcaggcagcccaccccggtgatcagcaccaggacctcgacagccatgtagtactcgtccacgcccaacagcgccgtggcctccgtggtccacgggccgtaccacggcaggaccagcgccgccagcgccaggagcccgcccaggccaaacacgaacaggcagagccgcttgaagaatcccataagacaccttccgaccgtacggcccccagccgtcgggccgcttctatgtaggataccccaatgggatgcgccacaaccacccacgcgaccacatggcgccaccgggcgccgcgctgcaaaggcttacgcaagcctcgcgaccagcgcgttgattccgcgcacggcaagcctcaccacaaaggtcatcaccaaggccagcgcgagcgcgcacagcactacgacccagcgttcctgtccatgaataaagaaatcgcacgtctgtacgcagagctcgtgcaccatgtagaactcgagctcgatgccggcaagcttcctaaagggaacagcggagaagaacgcactcacccagccgcgactcagcacaaacacgagcacgagccccgtcgcaaaggccatgccaagcgtcctgcagatgagcagcggcgccgtcacgttgatgagccacacgtagaggagaagcgcggccacctcgaccgcggtctgcacaggcttgccggcggcaacgggcccgcggccctgacgccaggccagcagcaggcagccgcagacatatgccataaagtagtccagcaggcgcacgggcgggaaggtgtggaccgcaatcgcgaccgtcccgtggccaacggcgaggtcgatcagcgccctgaggacgatggtgagcgcgagcagcagccagaccctccgccagccgccattgctcttctcccttgcgcgctgcaccacgtaggacatgaacggcgtgaaggcgtagcacacaaggaggtcgcacaggaaccacgacacgccgttgaacgcgaacatggtcttggcgtcccacacctgtagcataaagagagaaagtattcccgcaaccttgttctgactcagtacccagcccgtgacgccaagctcccccaggacgattgccagcacaaacgtgacgatgtgcacggggtacatcttccgcagcttgcgcttgaagttctcgtacgtctcctgcagcgtgtagctgtacgtgccaaagtggcggattgcctcgaggatgcccgagcaagcgaagaagaactcgaccatcctgccgcccaggtcaggtcgtgtaaggatcttgagatgccagcagaaaatcacggcaagcgcgaccaccttgaggccggagagcgagttgatgcgctcgcgcctgatgtcactctgtgctagttcggacatacacacctttcgtaactaaaaatacggcagctcgtacggcaacccgtgcctattgttccatcacgttgacgccgtcaccaaagtccagggtcaccggcaggtgggtatagcgctcgtcctcgggagggagcttcatgtagtcgccgtagaggttggtgaggtaggcgtcgcagtcgtgcggggccatgaccgtcatcccgtcaaactggatgtcctgcaccgggaacagcacgtccgtcttgtacttgacgcgcgtcgcgtagcaggcgtccacccactcgtcccccgggtgcgaggtgtcgagcgcgcggtcgaagtagcgcttcatcatgctgggcgtccacagctgagccacagtcttgtgggcgagcttgcagcccagcgcgaacacgtcgtgcagggggcccttggggaccttggggttctggaggtagtggaggtacatcatgcgctcccagcgcgtcgcctcgcggcgctgcgactgggcaatcttcgggttttcgtccagcaccctgtaggggaagacgtccacaaagatgcactggtcgagtccggcctgttgggcaagctcgtccacgaacctcgtgccatcgcggtagaccttgggccacagggagtaatatccaggagtgttgctccagtcgcgaagcgaatagccgtctggaagctcagtcttggcaatctcacaaaacttgttgaagtcgtcgtatggcatgcccacgtcgatatcgtcgtcccacgggatgaagccgccgtgacgcacggcgcccagcgtcgtgcccgcgtcgataaagtacgtgagcctatgcttcctgcagagcccgtcaatcaccttgaggatcccgcgctcctcgtcctggagtctctccaggacgccgttaggatacggtcttccagacatttgcgctttccaatcgaatagttgtctcggcatcttgagaaatgccctccgtacaagtatgagcagcacaagtaagtataggcagctcagacaccacaagcctcgatggcttgccgcgccgtattatcccatgagaatgcgctctccacccattttcttgcattcttgccctgggtctcaagcacatccggattatccagataccacgagatgacctcggcgcagacgggtgccgttgcatcctcgaggacgatgccatactcgtcgctcggtatcgcctcccgagcaccagcaacgtcggacaccaatgacgggatgccgaccgcagcggactcaagaatcgatgttggcaagccctccggatagcgactcggaaagaagtggaggttgctggcaccaaacaaggcggcaacgtccgtccgtcccaatcttccaaggacatgaaggttgttcggcgtgtcatcctgcagaagggccatgtcaggaccatcgcccgcaacggcgaatgcaacgggaaggtccttctcttccagaatccttgcaacgcccagcagcgtgtcgacgcccttctccttgagaatacgtcccacaaagcagacgagaaggacgtccttcccgatcccaagctccgtcctgaagtccctgcccgacgcctgctcgcggaacccctccgcgtcgatcgcgttgtggatcacgcccgagggcgtgatgccaaaggtcctcagccactcggcgctcttctcggacacgccaaagaacctcggcgagcacgagcggatcttcctggtcatggcccgctcgtacgcatggacgacggagtccagcaccggcaccccgaacccgatgtaggaggagccgtggtccaggacgacgggcgtgatgcccagctcgcgggcaaagcgcgcgcccatgagggaaaggccgtagaacctcgtgttcacgaacacgccgtccggcatgcgccgcttcacctcgtcaaggagctcacgcgtacggccgccgttcctgacgatggggagcctcccgtccagcagctgggcggaggggagccggaacacctccacgccgttggactcgtcctcgtgctcgggcgcgtcgccataggcagacgtgaccacgatggcgtgcacgcccttccgctccaacgcggacgagaggcccttggtgaagttctccaccccgcccatgtggggcaggtactgcgcggagaagatcgctatcgtccgcctgcgaggctcgtccatcagcaaccctttccgtcatgcttccactggtcgatcatgctggcatacatgtccatcagaccgaccttgggcaaccagccgagcgagcggaccgcggtggtgtcgagcctgagcaggtcgcccttgcggaagcgcttggcggcctccgcgtcgaccttgacctcgacgtgcgtgcggccatcgccaaagcggtccgcgacctgctgggccatctccctgatggagcagatcgtatcgtcgttggcgacgttgtaggccctgccgggcacgcccttcgcgagcacggtgagaagccccgtcgccgcatcgctggtcgagaggtacatgtttctcttcttgcccgtcgtgagcagggtgatgtccttgccctccacgcagtcgcgcgcgaactccgcgaagacgcgcctgtcgtcgtacgcgacgccggggccgaaggtctgtgcgaggcgcgcgaccacggcgggggtgccgaactcggatgcgtatgccgccacgagggcctcgtccagacgcttggcctcagggtaggagttcctcacgctcatggcatcgaggaagccgccctggtcctccgcgatggggtcctcggacttgtactggccgtagacctccatggtggagagcacgagcacccgcgcgccgacgcggcgggcgtactcgagcatcgagcgggcgccgttggtggtggtctcgattacctcgaccgggcgctcgatgaaggatgcgctgtcggtcatgtttgcgcagtggacgacgaagtccgcgctgggatggccctccgcgctgggatcggacgcgtcccagtgcaggaaggtgacgtcgccgccctcaccgaacagggacttggcgcgctccacgttgcggacgagcgcgagcaccctgacgtgcctggcgggatcatccacgagctcgttgtgcgccaggagggagtagacgagcgtcttgccgatcaggcccgtcgcccccgtaatggcgaccgtcttcccctcgagttcgtgccaggggacgtcgtcctgctttgccacccaaacggctccctgccagagcggcgcgttcttctcgaccgtcattggttccttccctcccagagcatgcgcatgtccctctcgtcgacgaaggacttgaacgcgaagtagtcggttggcgtcgtgaccttgatgttctctgcgggtccgaggaccgtgaagacgtcgtagccgtagtgggacatcaggctgatggagtccacgaagtcgcggccctcgtcgcgtgccttgaggtgcgccgcgtagagctcgttggtgaagaagccctgcggggcgcgcgcgaggaagcagcgcgagcggtcctcgaccttcacgaccttgccgtcctcgtcctgcacgatgaccgtctcgacgcacggcgccgtggtcgcgacgcagtggtgctcgattgtcgcgtcgatgcagtcggagatcgtttccgtgttgatgagcggtcggacgccgtcgtgcacgaggacgattgcctcgtcgtcctcgggatggtgcgagtggatctcctcgagcgcgttgaggcggctgtcgaagccggtcttgccacccgggacgatcgtgatgggcgtcttgtagccctgcctgcggacgatctctttgagatagtcgatccagtccggcaggcacgccacggtgatgcccgtcaccctctggcactcttcgaagtggtcgagcgtgtaggcgatgatgggtttgccgcccagctcgaggaactgcttgggcctcgagccggcgcccatgcgcctgcccacgccgccggcaaagatgagtgcgtcgacggttctgttctcttccatgagcgaccctccgctgcgcaagttaattgaagccaatactcaactagcctaacactaaaggcgaaaaagacgccgcctccgcaggccaagtgcgaaggcggcgtgtcgacaggtatggctactggagcgaaatccaggcgctcctcgtaccgtagaacaggtcgaggtccaggtctgcgctgtaaccatccactcgtccgttctcggagtactggaagattgtcggactcgcccaggcaccgtaggagtagctgtcggtccacgggttcgagttgtagcccgttgtcttgttgtttgcgtattgcgccacccacaggggatagctggtggcaacggtgctccagtcgtacttgcgcgtgacgctcttgctcatgtagatgaggggcctcgcgtccataagcgtggcaatcctgtcaagaaacttcttgcaccactgcacgtcgaagcccgtgccgaagagcttgttgctcgtctgctcccaatcgagtgcgaccacggcacgacccttgtacgccttaatggcatcgtagaagtagtcagcctccttgatggggtcaccaccctccgcgtagtgatagaaaccgacgagcttaccgctcgcgagggccttatccgcccacgccgcgtagtcgtagcccttggaggagagttggttcctgtaccaagtgccctgcgtggccttgatgaagacgaagtcgcccgagaccttggagacgtcgatgcccgcctggtgggaggagatgtcatatccgttgagctggtcgacgtatgcgaagggcctcaccgtcgaacccggggcgtcggaccccttgagcttgacgatgacctcaacagcctcgatggagttggagctcacgttggtgccggcgtctgaaccgttcctcgtccagccgagccagccgacgttggagacatggacgcgataccagacgtcgtagtacttctccgcgtcgcctgttagagataggcggaccgccttgagcgcggtgcccttggtaccggcgtccgcgccattggtggctgcgctcgaccagttctccccatcagttgacacctggtacttgatgccgccaaagcttgatacggagctgagttgcgcgcggaacctttccaccgagagcgacttgcccgtggtgcccgaggtggcaccgttgctcacagccgtctgccagtcaccattgagcgcacacgtcgcataggagaccgtgggcgtctccacggagggatagctgaccttctggtcgctgctggagggagctgcggaacccttcttcacgaggaccatctgcaccgcctcgacgcgcttgccaaggcccacggtgcctgcggtctcaccatccttggcccacgccatccagccgatgtcggacacgtgcacgcggtagtacacgtcgtagctcgaggcgacgtcgcccgtgagctgcacctgtattgcctcgagcctgagcccgctgccctcggtgccggcaatggctccgtcggactgccagtcctgccagcccacgttctgcacgtgcgctttgtactgcacgccgccgctcacgccggcgacggcgatcttgagcgcctcgagcctgagtgacttgcccgtcgtgcccgcggtcgtgccgttggagacctcggtctgccaccccacgttctgcacgtgcgactggtaaaggatggtcgggctcgtatacgtggtggtcgcgcgcttggtgtagtccgcgccatcacccgtggggatggcctgcccgcgcttgaccaggagcacctgcacggcctcgacccgcagcgactggcccgtcgtaccggacgtggcgccgttcttgacccatgcgccccagcccttgccctgaacgtgggtgcggtagtagacgtcatagctcgaggcgacgtcacccgtcagctcgatctgcaccgcctcgacgcgaagcgacctgccggtagtgccgctcgtctggccgtcggacttccaatcctgccagcccacgttctgcacgtgggcacggtagcggatgccgccactcacgccgctcaggctcatggagagcgcctcgaccctgagggacttgcccgtcgtacccgcggtcgcgccatcagagacgcttgcctgccagccaatgttctgcacgtgggcgcgatagctgacggaagccttcgcatcgctcgtggtgcttgtcagcgcgaatgtgtgcacctttgccttggaggacgcgccctcgctcttctcatctgccgaggtgctggccttggtatcgtcactcttggagtcatcagcctctacatgggccttcgtctcctgcgagcccaggaacgacgtcagcgcctcggagttctcctttgcgaccagcacgacctcgacgtcgtccaccacggcgtcgtccttctcgcttcccgcggtctcgccgtcggcggtccagcccagccagcccgcgtctgccacgtgcaccctgtacacgatcgagtacttcttcgcggtctcggaatcgagcttcaactggacgcagctcacgctgtcggtcgcgtccacctgattggcgtcgcccgcggcccagtcggtccagtccgcgctccccctcttgtagcgaacctgcacctttgcggcgtcggtcccaccaaacgtaatggacgagaaggacgtgccgccttcctcgacggttgcgtcgtcagtcccgagcgtagaaacgtcggtcaccagtgcgaccgtacgggccttggcagtcgcagcatcgtctgcccgcgcattcgacgtactggtatccgacgcactcgcatccgacgtgctggcgtcagacgagctcgcgtccgtcgcgctcgcggcctccgaactggccttattcctgttcaggctatacgtcacgtcgagcgacgtcgacccggcggaggcaaccgcctcgacaccaaaggcgcgccccgcatggagcgcgccacccaaaacgaccaagcaggcggcaaccgccgcaacaaggcagagcgccgcacggcgccccgttgtcttcgagaacatgtgatgcccttctcgcgcctatcagatacgcatggcaccacacaatcggcaccatcattgtgtcagtctagccttcccacacgaaagcttgcggcattgttaccgtctgtctttggaaccatgaccgtatcgctgtcctgcgcgaccgaaggacgcgagtagcccttcgccgtccccagatagagcgtcttgccgtccgaccagcgatacgcatacatgcccgcgttgcttccctgcgagccactgccccacacaaaccagttgtcgttcatcgacgcgacgacgcttcctgagggaatctgcagccaaatgacattcttcttgaagtcgccagaccacagaccaacgtacgtctgggcggcatcgcccgtgggcgagaaggacacggcccggtacttgtgggacgcccacacgcccgtcacaccccaggtggtgctgccgctttgcacggtgagccgcgtcttggcagacgcgagcgacgcgtccggcgccgtgcagaccttggcgtagtgcccgtcggaaaggacgcccgtggcatacgcgacgccatccgaaagcgccgccgggaagctgccctcgcccaggttctggacgcttccaccgtcaagtggcatcgccagcacgtcgcactcccaagacgcctcgcccttcgccacgttggagctgaagtacgcgtacgagtcgtcagccgtgggaacgacctcgcccacgatgctcggggtgtcgccgcgaccgttgaggtcctccgcactcgcgagcacgcggaccttgttggactttgcctcccagcagctgacctgccagtcatccacgccaaacacgttggagtcgttcacgcgggcggagcgccacacgatgcggctggcgttgcccgtcccgtcctgcggctcgtagtagtcatctgcggaaggcgccgcgccaagtcccttggtgcttgagctcttgatgaggctcgcctggtacgagagcaggttgtctgggtcgtccgtcgcggagccaaacacggtcgaaccgtctatcgggaacgaccctatctcacggtagtcgcccccgaactcccactcatctgcgagggtgacctcggtcttgccctcccccaccttcacgacgcgggcgcttgagtcaacgcccgccacgccaaacggcaggctcacgttcttgcgctggcccgacgccgacgagctgccgtcgtcggaggccttgcccacggtcacaaccttcgccgcaccgtcgtcctgcgccgcagtaccacggccgccggcagcaaagtgccagatgccgaggcccacggcacaggctgcaactgcgaggcccacgccaacgatgactttcgtccttctccccctgggcgaggtggcgccagaacgagtcgcgtcgtccttatcagcctgatcggcgcgtacgtccccgtcgctcttgaagtggttagccatgcgagccgcctacctggaggtatagatgccgatgtgctgcttgccgtcgcggatgtactcgttcgcgaggtaggtgttggtgaaggtgcgcaggctcgggtaccagaagtgcggcgacgcgcctgcgtagagcgagcaggcggggtcggcaaagtagacctggtccgtggcctcgttgtagccgtcgatgaccatgatgtgcgagaaggtcgtgttgccgtggccgttgaagtgcggcccgcccctgcgctcctgctcgtccacgcacgtcgcgtagcccgtggagtaggacttgaggacggacgacctcaccgtggcgtagttcggggtgtgatacgtggtgtagacgttcctgccgagccaggcgttcatgcccttctcgaacatgcggttcgcgaagctcgtgtagccgtactgcctggtgtgcatgtaggaggccacgttctcgatcgagagcgccgtaccggacttggagtgccacgcgcccacgttgctcaggaccatgtagccggaggtggggccgcagaagaagccgttgggctggcccacggcgtggatgttgtggaagtgcacgcgtgccttggccttggtcacataggggctcgccgtcgaaccaggcgcggcagaacccttggcgagcacctgcatctcgagcgcctcgaccctgtaactgatgccggtcgacccggcgatggcgccgttcttggtccagccgagccagccgtagtcctgcacgtaggcgcggtaccagacgtcgtagtacttggccatgtcacccgtgagcgtgaccttgagggcctctacgcgtttcgcggcgccgacggtgcccgagttggtgccatcggcgacggcagccgtccagcccttgccctccacgtgcgtggagtagctgatgccgcctgtaattccatcggactttacggtcgccttgagcgcttcgatgcggagtcccttgcccgtggtgccgctcagggctccgttggactgccaagcctgccagccgacgttctgcacgtgagtggcgtagctcacagtggcagcgctgaaggacgggacggaccacttgtcgtttgccgagggtgcgcccacgtccttggcacgcaggaccacctgcatggcttcgacacgaaggccgagcttggtggtgcctgctaccgcgtcgtcctttgcccaggcgagccagccatagttctgcacgtggacgcgataccagacgtcgtacttctgggcaatgggaccagagaggcgaatcttgacagcctcgactcggagggacttgcccgtcgtgcccgcgttggcgccatcagcaacgtaggactgccagcccacgttctgcacgtgcgcgcagtactcgatgtggctgccgtcggcatcgggattcatggtgcccgcaagctggaggttgaaggcctcgagcctcttgcccttgcccgtgacgcccagttgcgcaacgtccctgtctgtcttggtccagccatagtcctgaacgtgtgcggtgcccgtgacggaagcctcctgcttctgcacaagctcgacctcaacggcttcgatacgcagggctttgcccaccgtaccggcgatgtcaccgttgtagatccattcggtccagccctcattctgcacgtgcacgcgatagcggatgtcgtaccgcttcgcgacatcgcccgtgaggcggatgcagagcgcctcaacccgcagcgccttgcccgaggttccagcgacttcaccgtccttggcccatgcctgccagcccacgttctgcacgtgggcacggtactcgatggagccggagaaatcgctcctcagcttgagctgcagcgcttcgacacgcagggccttgcccgtcgtgccggcgatggcgccgtccttggtccagtcctgccagccgacgttctggacgtgtgcacggtagttgacgaggccctcgtcttggatggcatccgaggactcggtctgggtggactccgtcgtcgattcactcgtggagacggtcttgtcagagcctgtgggctgggactcgtccttgcccttggtacccgcatcctccgctgaggtagacgtgtccctctcccccgtgcttgcagacaatgccgtggagctcgagctgtcgtcagtggtagagctgctcgtcaccgagcttgagcctgcagtgttttgcgtcgcggtcgaatccacggcgaacgccgacacctggcctagactcaggaccagaagcacgccacaggcgacgcttgccaagtacttcctcatttgatgcgctcctcaccatccatcgtgatgacgccatgcaaacagggcgcacagtcgcgcgccctgtcaagcagctagttgtagacgacgacggtcgttcccgtcgggatgttgtcgtaaatccatttggccttgttgatgttcaggcgcacacaaccctgagagatgtgcatgccgagcctgccatcaaggatgccgaaggtgccacgatgatacagcacagagtggaacaggtagttaccgtgaaactgcgtgtagtagtaacacgtgtggtcaccgccgctgaacgaatagccctttgcgccgacggtgaagacgccgtggacagtgggcgtgctgtactggccgtcagagcacacgatgtagtcgtacaggttccagccgcttgcggagcggttgaacacgccgaccctgcacgcgccgtagttgaccatgagcagccagttggtcctgctgccgtagcgctgcgcgcgatagtacatgtccgagtccgccatgaagaggcccttatcggtggtgtacgagcgccacgtcgcgccaggggcagcggagcccctgggcctcacgacgatctggacggcctcgacgcgggcggcacagccggtcgtgccggcgtatccgccgttcctggtccagcccatccaaccgagcttctggacgtggacgcgataccacacgtcgcaggtctgggccatgctgcccgtcaggcgcacgcggatcgcctcgacgcgcctgccctggccgaccgtgccggcaacggcgccctgggacttccaaccctgccagccgatgccctcgacgtgggcactgacctggacctcgccggtctgtccgacgccggacgccttgacgcgaagcgcctcgaccctgagccccctacccgtcgtgccggcaacggcaccggagccgacccagttctgccagccgatgttctggacgtgggcctgatacgtaactgtcggcgcggaaacgtacggacggttggtgtcaccaggcgcggcagcgttcttctccgtcagcttgaactggaccgcctcgacgcgcaggccacagccagtcgtacccgcaattgcaccctcggacgagtcgtccccagcctttgcccagccgagccagccaaggttctgcacgtggacgcgataccacaggtcgtgcgtctgggcagcctcgcccgtgagctttgccctgatggcctcgaccctcttggagcggccagtcgtaccggacacgttgctatcgcttgtctgcctgtagccctgccagccgaggtcctgtacatgggagttgacctgaatcgcgccctcgacaccagagagccgcacgtcaagtgcctcgacggcaaggcccatgcccgtggtgccggcggtcttgccgtcgctgaaccagccctgccagccaatgttctggacgtgtgcgcgatacgagaccgcagcctgctgctcagtacccgtctcggaggatccgctggtcgagcccggggcatccgcgcccttctccactagcgtcacctggatggcctcgacgcgcttgcccatgccggtggtgccggccatcgagccgtccttggtccaacccatccaacccttgtcctgcacgtggacgcggtaccacacgtcgtagcgggacgcgacgggaccgtcgagctttatcttgactgcctcgacgcgcagccccttgcccgtggtacccgcctgggcatagccgttctcactgtcggcgctgctcgaccaatcctgccagcccacattctggacgtgcgcgctcacgctgatggacgagccatcggtcatgttgccaagggagaggcgcagtgcctccacgcgcaggcccctgcccgtggttcccgcgacgccaccggcagagacgttcgcctgccagccgatgttctgaacgtgggccgcataggcgagctcgggctcctgcgtctgctcgtccgtgctggtgctgctctgggagtcggcgctggtcgcatcggaggtcgaggcgtcgtcctgaccagaggtcgacggcgtctgctcggaggacgagccactgtcctggctggagctgctcgtatcagtccccgtagaggactcctgccccgtcgtgtctgggaacgtggacgagctggtaccagatacaccctgctcggaggtgctctggtccgtccccgacgtggtcgtcccctgctcggtcgtagcgttgacattcggggtggcggtgagagcctccgcaagggccggcgtgggaatcagcgccgcgcacatcgcgacggacgtcagcgccgccagcatgccctggattcgagtacgcatgtgtacctccatacggacatttgacaaagtattcaagtcctctacatcttcacaatcttagcttaaatgctaggatgtcgcttgaagcctgaggttaaaacttcgccaatagcggcgttgtgacctttggtcacgaatgagcagcgtgtggacgcgctgtacccctcatccaaatatcggacgctttccgacgaccgggagtttgcaacatgcgcaacaaagattacaagtacgtgccgaagcacctcgcgaaggaggctcaatcacaaataccgtcgatgcacgtcgcgacggggctctccgcgcttgcggttacggcaggactgacgtttgcgctcacgaccctctctggtgctaccatcgcgttggcacaggatacggatacggcgacgcctgttgtcgccaataccgatacgaccacgacctcccaggcccagcaggagagccagcccaccactacgtctaagcaaagcagcacgagcggcgactcctccacccaagccaacggcgatacgtctgactcttcacaggactcaagccagagcgcgtcaacgtcaagtgaatccacaggccaggacacttcctcccaggcagcagactcatccagcaccaagacgacgaccgaccagaccaagggagaagagcagacctcagcggccgcggcatcggtccattaccaggctcacgtacaggacaagggctggcaggaggaggtctcgaccgacgcctcacaaaatgacgccgcaaccgcgggcaccaccggtgagagcaagcgcgtcgaagccgtaagggtctcgattgccgacagcgacggcaacaagctcgagaatgcagtcgaatataaggcacacgtcgcgaaccagggctgggacaagacgtggacacgcgacggcgagaccgtgggcaccacggggaagtctcgcgcaatagaggcgctcaagatccgccttattgaccaatacgcccagctctacgacatcttctaccgcgtccacatccaggatcgcggctggctcgactggacatgcaatggtgacgccgccggatccgtgggtctaggcaagcggatcgaggctctccagattcttctgaggctgaagaacgcctccgactcccccaccgcgggcgatggtgcgtttctcgacaactccggcatctcgattgcgagccatgtgcagaacgtcggctggcagggagcggcgaccacaaacggccagacgtccggcacgaccggcaagggcgagcgcatcgaggcaatcactgccaggattggcagtggctacgacatcgacggtggcatccagtaccgtacctacatccaaaacagcggctggggcagctgggtagcaaatggggcagtctctggtacgaccggaaagggcctgagggtcgaggcggtgcagtttgagctgcaaggcgacatcgcaaagtcctacgacctctattaccgtgtccacgtggccaactatggctggctcgactgggtgctcgcgggaaccgggcaggactccatcgccggcaccactggcctctcgaagcgaatcgaggccatccagctctacatgtacaagaaggaatcgcagcaaaagcctaaaaagggaatcggctacgtatcctccgcaggtgtctcctatgccggccaggaatcgaatggcacgtgggcgacagccgcaaacggcagcgtcgcagggtcgactggaaggggaattccccttgtcgcaatgagggcagcacttgcatcgggaagcgacggcctcacgggagtcatctcctaccaggtccaccttgccaacgtaggctgggtggcatcgcaatcggacggagccaatgcaggcagatcccaggccgcaaacaacatccagggcatcaggatctcgctcggcggcaccttgggacgcttcttcgacgtgtactaccacgtgcacacccataacatcggctggatggggtggacgcgcgacggaagctcagctggaaccaccggcttgggccttcccgccgaggcgttcgaaattacccttgttcccaagggcaacgccgcacccggcagcaccacgatgtccttcgtagaccagaacagttactatggtcagcctgtcgcgaccatgaacggtgctcaggcgcgcgttcgcaactcggccttcaaaaccccggccacgcctggcggctattgcgcgctctgggtcaccaacgtcgtcgccaacgccggatatggttattactctggcaatgcctgcgacctttatcgcagctactgccactccgcagatcgcaagcaactcaaggtcggaatgattattgccgtcagcagccatccccacacgcgtgcgggatctatctatggtcacgttggcatctacatcggcaacggcctcatgcgggacagtgtctacggctacgttcgtcaaatcagcgtgaaggattggattgcgtactatgggtcgacagttcagcctcgatggggttggatgggcaacagacgtcttgcatagttgcttcaagcatgtcttcacggtgcatgcaacgtcatttcaaccgatatttgctcctactcatataagataggacgggtatatcgcacatccgaggagcaacgctttgaagatactcgcagtgattcccgcctacaacgaggaggaatgcctggcagacaccgtgaacgaactcacgagcgtctgccccgacatcgattacctcgttataaacgatggctcgaaggactcgaccggagagatttgcgaccgcatgcacttcaaccacgtagaccttcctgtgaattgcggtctcacgtccggtttcaagtgcggctgcaagtatgcgtatcgcaacggttacgatgcagtggtgcagttcgactccgacggccagcacatgccccagtacatcggtccgatggcaaaggcgatgcgggcccagaaggccgacatcgtcatcgcatctcgcgggcttgcgggaggtggcgccgttggtgccagaggcgtgggcgccaagctcatcaccaaactgatcaaggccggaactggtcagacgattaccgaccccacgtccggcatgcgcatgtatgaccgccgaatgatcgagacctatgccaagagcttcgaccttgcccccgagccagactccatcgccctgctcatgcgtggcggcgcgaaggtcgtcgaggtacccgcccagatgagggagcgccagggcggcacgagctacctgaggttcttcagctcaatctcctacatggcacgtacgtgcctatccctgctgctgttcctctggttccgataggaagtcaataatgagtccagttcttcgtctagtgcttatcgttggcgcagtcatcgcactcgcaatagtcattcgctccgtacggaagtgccgcatgaccgttgcagactcagtc

SEQ ID NO: 275 - DNA, 2218 bp, Unknown
  Metagenome-assembled genome
gacccggtacgagaggtcgcccgcggccacgtgctcgacgcctcgctccagctgcccgatggggccggtgatgcggtcgtacacgtagcggcggcagaagcggttcatgagcgcgaccgccgcgaccaccgcaataagaagtgcgacgccgcttgcgatggccgcccccttgagcgtgccgtttgcgacctcgcgcaccctgccgaacacggcgacgtagctgttggcacccgagccctgcctgccaatcacgaagacggaggtcgaggacgtgcgcaggaccgagggcaggccgcccgcggagatggccgtccgcgcgagggagagctcggcgttggtggcgccgtccgagcggtacgtgaccgtggcaccgccgtcctgcagcacggcgaacgtgaggccgcccttggcgagcacgtccgccacgccgtcgagcgaggaggcgcttgagccggagcccatgcccttctccaccagctccgccgcggcctggcccgtccaatagaagtcgccctcgtcacccagtccgacgccgctgccctcgtgcatggtgttgtagatgacggccaggcaggcgacgcccaccagggccgcgatggcgacgggcaccacgatcatgaggatgttggagaccatgaggcggtgcctgatggtggtcccgcccgtggagctacccgtggaaccgcccgactgagcctgacccatgtgacctcccgcgtgcgacggcgttggatgactggctcccattatcgtgcgtccgcgggccgggtgccacgggcgggcagcgccatgcggccggcgcgtcccaccaggcggtgcgcgagcgcgacccaggcgagcgcggccagcaccccggccgccacgtcggagagatagtgcgcgcccaggtacacgcggctggcacacaccagcaccaccgacgccgtgcaggcagccgcaaggatcgcgcgtccgcgggcgcccagacgcggacgcagcgcgagccacgccagcgcggcgaccgttgtgcagaccatggcgtggccggacgggaacgagtagcccgactccgccaccagcatgaaggcctccgggcgcgggcggcagaacgccgccttgagcaccacgtcgagcgcgcaggccccgccgagggcgatcagattgagaagaacgcgccccctaaagagcgcgagcgcgagcgtggccatgaccgcgacggccacgaggaccatcgggctgagggcgttggtcacgagcaggaacgcgcgcgtgagccacgccgtcctggcggatgcgaccagcgccagggcggccccgtccgcctgggccgtcgcgccgccgcacacgagcgccgccagcgccacgaaccccagcccgcacgcgatgcccaccacaaggtccatgccgccacccgctgctgccgttcttctcgcccgatccgttgccattgctgcctccccgtgttgtgcgacgtgcctgcaccgccgttatctgacggtcgccatgctcgcaccggcccctgtagctggggtaacggcaagctaaacgcaagataaaggtgcgcggcggcagttaacccactgtttaggaagccgtacggtgcggtttagggccgcattggaggatacgcatcgtcaggcagacgggccgccacaggggtggccgacgcaatcccacgtgattggagcacaacatgcaggcaaccatgctcgcgctgatcggaaggtttggctacgccgcgttggcggcgctcgtgtttctggagaacgtgttcccgcccatcccgagcgaagtgatcctgccggccgcgggcttcttcgcgagcattggcaccatgaccctgcccggcgccatcgtggcggccacggtaggctcgctcgtgggagcgtacgcgctgtttggcgtgggcaggctgctgagcgaggagcgcctgcgcaggctgatgggctccaggcccatgcgcacgctcggctttagggaggacgacgtccagactgccgtgggctggttccgcaaccacggcgccatcaccgtgctggtatgccgctgcgtgcccatcgtgcgcagcctgatatcgatccccgcgggtacctcgggcatgggcatcggcaagttcagcctctacacggtgctgggctcgctggtgtggaacgcggtcctgtgcagcgtgggctactttgccggctccgcctggagccaggcagctgccaacgcgtccaacgccatcaactccgcaacc

SEQ ID NO: 276 - DNA, 15348 bp, Unknown
  Metagenome-assembled genome
gccggcgacctgaacaaccgccatcctagaggggagggagttttgttgcatagcatcagtgccgtccacccgcatagcgggtggttctttgtgccgcgctacgcgcggcacaggctaaagccatgaaaaaaaaaggccacgcccaaaggcgtagcctgaacgttccatggtggagacgatggggatcgaacccacgacctcaggcttgcaaagcccgcgctctcccagctgagctacgtccccgataataatcgccccagcggcgactcggctagcgctggggcgactattcgcgaaacaagtggtgggcccgacaaggttcgaacttgtgacctcccggttatcagccggacgctctgaccaactgagctacgggcccaacgcgagaagtaatattactcaggttccccccttcggtcaaccgcttttttattttctttcgcgtccttgattcctccacatttcccgcggcccattccctccctaagccacccgtcacgtcccacatgccttgtccattctttggtaaagaatgcttgcgtcccaccagatagtgggtaacatatccacgcaacagagaggtgggtcacttggtaagaatggacattcagacggtggtggtcggcggcggacccgtcgcatcgctcatcgtcctcactacaaggaagccttcggacgcgggcatgcacacgcagctccccatccgcatcggcaccgtcgaggcgacggccatatccatgggaatcgacggcacaaaggacggccgtcccatgacgcacgacctcttcgtgtcgacgctcgacgcactgggcgccacgatcgactccgtcaacatctcggacgtccacggcaccacgttctacgcgaccgtcaacctcatcacggactccggcaggcacatctccgtcgacgcccgcccgtccgacgcgatcgcgctcgcggtccgctgcaaggcgcccatcttcgcgagcgagtcggtcctccaggccgcaaccctgcctgacttcgcctccgtcgagaaggacgagaaggagcaggagctccaggagttccacgacttcgtggagggcctctcccccgaggacttcaacaccccgcgctagcgcacggccatccccaggctcgccagcagcctcgttttgcaagcctgcctagcacatatctgcatccatgcgagaaggaccgccaccccaggtgacggtccttctcccttagtaacccttgcgttgtcgcgaggccgttactcgtcgtcctcgatcagcgagtcgtcgagctcctcctcaccgccgatgtcaacggggtcctcgtcgtcggcttccttggcgcctgctgccgcgaggtcgagcgcaccctgcatcgggttcgccttggcggccttcttcttgtgggccaccatcctcgccacggcgctgatcttgtcgctgtcggcaaggttcatgatcttcacgccctgcgtcgcgcggccgagcctggatatgtcgtttgccttcacgcggatgacgacgccctcctcggacacgatcatcagctcgtgctgcgggcccacgacgcggcaggcaaccaggttgcccttcttggccgtcatggcgatggtcgtcacgccctggccgccgcgcttgtgctcggggtactcggacacgggcgtgcgcttgccgtagccgcggtccgtgatcacgagcaggtcaccgttgccgttggtgatctccatgccgagcatcgtggcgccgtccttgagggtgatgcccctcacgccggaggtgtccctgccggtgggcctgatctcgctctcgtcgaacatgatggccttgcccatgtccgagcacatgatgaccttctcgcccttctttaccctgcggacgttgacgagctcgtcgttgcccttgaggttgatggcgatgatgccgtcgcggcggctcttgtcgtagtcgctcatggcggtcttcttgatcatgccgcccttagtcgcgaacagcaggtactcgtcggccgggaactcgcgcgtcgtgatgacggcggtcgggtgctccccctcctcgagcggcagcacgttcacgagcgccgagccacgcgcgtggcggctgccgatgggcagctcgtgcaccttcaggcggtacaccttgcccttgttcgtgaagaacagcacgtagtcgtgcgtggacgccacaaagaggtcctcgacgaagtcgttgtccttgagcgagagaccctggactcccttgccgccgcgcttctgggagcggtaggtcgccacgggcaggcacttgacgtagcccgcgtgcgtgaacgttacgaccatgtcctcctcggcgatgaggtcctctacgtccaggacgaccggggcgtcggagatcttcgtgcgacgtttgtcgccaaagcgctgtgcgatctcctgcatctcgttcttgatgactcccaggatcttcttcgggtccgcgaggagtccctcgtagtactcgatggccttgcgaagcccgtccaactcctcctggatcttgtcgcgctcgagtccggtcaggcggcgcaggcgcatctcgaggattgccgtcgtctggatcttcgtgaacccgaagcgggcgatgagccgctcggacgcctcggtgtcggtgcggctggagcggatgatggtgatgacctcgtcgatgtggtcgagcgcgagcagcaggccctcgaggatgtgggcgcgcgcctgcgccttggcgaggtcgaacttcgtgcgcctcgtgaccacatcgacctggtggtcgatgtagtactggagcatctcgcgcagggtgagcagcttgggcacgccgttgaccagcgcgaggtcgatgatgccaaacgagctctgcagcgcggagtacttgtacaggttgttgagcacgacctcgggaatcgcgccctgcttcaggacgatgacgagacggagacccttgcggttcgactcgtcgcgcatgtcggagatgccctcgatgcgcttctcgttgacgagggccgcgatcttctcctgcagcgtgcccttgttgacaccgtacgggaactctgtgaagacgagcttgctgcggccgcccttggacgtctcgacgtgcgccttggccctgaccgtgatgatgccgcggccggtctcgtaggcctgcttgatgccctcggagcccatgatgatgccgcccgtcgggaagtcggggccgggcatgacggtcatgagctcgtcgaccgtggcgtcggggttgtcgatcagcatgcaggccgcgttgatggcctcggtcaggttgtggggcgggatgttggtggccataccgacggcgatgccctgcgagccattgaccagcaggttcgggaaccttgcgggaagcacggacggctcctgcagggactcgtcgtagttgggctgccagtcgacggtgtccttgttgaggtcgcgcagcagctccatggcgggacgcgcgagacgcgcctcggtgtaacgcattgctgccgcgccgtcgccgtcgatgttgccaaagttgccgtggccgtcgaccaggggcacgcgcatgctgaaccactgggccagacgcaccatggcgtcgtacacggcagcgtcgccgtgcgggtggtacttgccgatgacttcgccgacggtccaggcggacttcttatgcggcttgttcgggaagatgccggcctcgttcatggcgtacaggatgcgcctgtggacgggcttcaggccgtctcgcacgtcggggagcgcgcgggccgtgatgaccgacatggagtactcgatgaacgactgctccatctcgtggccgaactcgtggaactgcaggcgtccgccgtggacgtccacgccgtcgccgtcgccgcggttgtccccgcccatttcgagctgggtgtcatcgccgtcctcggagtcgtcctcgtcggagtcatcgtcgtcggtgtcgtccattccggcctcgtcggccgcattcggatcgtacacgggggcgtcggaatcgtccgcctccgcacggtcgagcagacgctgcaggtcctccggcagggtgacgccgtctcccgactggtcttggttctgcccgtttacgggcgtgttgttatcatctgccacttagcgtgcctttcttcgtggttccgctcgcaagcgatgccttacgcatcaaggaatcgggcgtccttggcgtggtgctcgatgtagtcgcgcctgtactcgacggacgtacccatgaggtgcgtgacggcgagctccgccttcgcggcgtcctcgatcccgatgcgctggaggatcctcgtcttcgggtccatggtcgtgtccgcgagctgctgcgggtccatctcgcccaggcccttgtagcgctggacggtgtacttgcgctgcttgccctcggcgtcgcgcggcacgtactgctcgatggcctgcgccagcagcgtctcctcgggcgtcttgccgtccgggtagacgtagtggatcttcttgcccaccttcacaccaaaaatcggcgggcaggcgctgtagatgtagccagcgtcaatcagcgggcgcatgtacttgtagaagaacgtcatcagcaggatgcggatgtgggcgccgtcgacatctgcatcggtcatgatgatgatcttgtggtagcgggccttgttgatgtcaaagtcgccaccgtcggtcgtcacgcccgtgccgatggccgtgatcaggctctggatcgtatcggagttgaacgcgcggtggtcgccgacgcgctcgacgttcagaatcttgcccctcagcggaaggatggcctggatgtctcggcgacggccgtccttggcggatccgcctgccgagtcaccctcgacgatgaagagctcggtcatcgacgcgtccctcacggagcagtcggcgagcttgccggggagcgacgcggactcgagaatgctcttgcggcgcgttgcctggcgggccttctgcgcggcaaggcggcccctcgcggcgctcgaggccttcttgaagatctccttgccctgcttggggtgctcctcgaggtagtcggcaaggccacgggacacgatcttgttcgtgagcgtcctcatgtacgagctgccgagcttcgccttggtctggccctcgaactgcgggtctgggagcttgacggagatgacggcagtcagtccctcgcgaatgtcgtcgccggtgaggttggcgtccttctcctttaggagcttgtggctgcgcgcgtagtcgttcaccgtcttcgtgagcgcggtcctgaagccctcgaggtgcatgccgccctcttcggtgtagatgtcgttcgcgaacgacatcacgtgctccgagtagccggtgttccactgcagggacacctccacctcgcccttcctggcaaggggcgtgtcctcgtcggtcttgccctcgatgtagatcgggcgagaaaggccgggaagaaccggcttgtcatattgctttccgtcccagccgttgaggaacttcacgaagtcgttgattccgccggcatagcagaactcttccgtgcgcggcacgagctcgcgctcgtccgtcagcacgatcttgaggttcttgttcaaaaacgccgtctcgcgcaggtggtcgcgcagggtgtcgtagttgtagacggtcgtctcgaagatctcgtcatccggccagaacgagatggtcgtgcccgtcgtcttcgacttgccgacgaccttcatcttctcggtcgtcttgccgcgggcaaactgcatctcgtagatcttgccgtcacgcctgacctgcgcgatgagcttcttggagagcgcattgacgaccgagacgccgacgccgtgcaggccgccggacaccttgtaggcgttgttgtcgaacttgccgcccgcatgcaggattgtcaggacgacctcgagggtcggcttcttctccgtggggtgcatgtcgacggggatgccacggccgttgtccacgacggtgatggagttgtccgcgtgaaccgtcacgaggatcttggtgcagtagcccgccatggcctcgtcgaccgagttgtcgacaatctcccagaccaggtggtgcaggcccgtctcgctcgtggtgccgatgtacatgccgggacgcatgcgcacggcctcgagccccttgaggaccttgatctcctggccgttatagttgttcttcttttctgccactcacttttcctctctacagagcaataaagcgcactgtacattttagtgagcgcatcagatttcattgggccaaatacaaaatgggtggtctaactactgaaaaatcacgtcagaggcccttgtaaggccgatattcgcgagaaaatcaattccccgccctttttagcaattctcttctgagggacagttccatcgctcttctcgccttttccctcagaccgtccggcaggtcgtgcgtcatgtcctccacgcgccgcctctgttctgcggaaagctcgggcagctcgaccttctcctcgcggtggccgagcgtctgataggtcccggactcggccttgcgcatgtgcctcgagtcggaaagcctgaagcgtatgccggatacctgcaggccatagccatgcagtcgtgcgaggtagatctccttgttcgcgctgaagtcagatagtcgcgcgtgcgagtcgacgtagacgcacagcacggggtcacggcccttcttgacgggcgacgtgtccaggaacacgccagtggtgtgcttgcgttcgacgtcgccgttggccccgtaccacgctgcgcgggcgcgctgcgcgtcgctcatgtgggcgcgcatgtcggtcctcacgacgccgtcgaggagggacgagagggacgagtcgttcctgaagcgctccgtgtcgtacacgtagtcgctcgcatatgacttgcgcttacccaacgacgttcacgaccttcgcctcttcaagcagctcgtcgggaaagtaccccaggttcgtcgtcgtgaccacggtctggatgccggactggacgaacctcgtcatggcattcctgcgcttctcgtccaactcgctcatcacgtcgtccagcaggagcagcggctgctcccccacgatctcgcgggaaagcgcgacctctgccatcttccacgcgagcacgatggagcgctgctgaccctgcgacccaaacgccctggcatcgcggccgtctatcgtgaagctgacgtcatcgcgctgcggtccgagcgtggtctgctggcggcgcaggtcggtgtccctctcctcctgcagcctccttgcaaagaggtcgcagatctcgtcgcgagaagagcctgacaaatcctccccgagcgacgacacgtaggtgcagtcaagccgctcgccgccggcaatctcgccgtatacctcgcgaaggtgcgtgcgaagccgctcgaagagcctgagcctcgccgcgagcagcgtcgccccgcccagcgccacggacgcgtcccaggcgtccagcagcgcgaggtccgggtagtcgtccttcaggaggcggttcctctgctcaacggagcgcaggtaggcggaaagtacctttgcgtagccggcgtttgcctgccggccaaagccgtcaagctcgtcgcggcggtacgacgcgccgcgcttgacgaacgagaggtcgtccgggttaaagagaaccgacatgagcgtggctggcaggtcgagcgcggcgcacttcttcccgttgcggaagaacctgcgccgcgtcggctccacctcgcaggcaacgtcaatcacgcggccgtcgccctcgagcctcgcgcgtatctttgcggactcgcagtcctcgcgaatctgctgcgagggcttcggctttctgaacgaggagcccgcggtcagcatctgcagcgcctccacggtgttcgtcttccccacggcgttgggacccaccaggatcgtcatgccgtcgcagaagtcgatgctcttctcctcgaagttcctccagtccctgagcccgagcgtcttgacgcgaagtcccacggcctacatcctgaccggcatgagcaggtagaggtagttgatcctggagtacgacttgaagatgcccggctgcatcgtgctctgcagctcgagcgtgatctccttctggtcgctcgcggcgttcacgcagtcgaagacgtagtggtagttgagggcgatgctcatggcgctgccctcaacctcaacgggcaggagctcggtcgactcgccctggtccggcgagcttgcggatagcttcatgaccttgccgtccgggtcgatgtcaaagcggaccgacgggttggtgagcgcgatcacggacacgcgcttgagcgccgcagagaactgcgcgacgtcgatcttgacggacgtgttgcagctgggcggcagaagctgcttgtagttggggaacgtgccgtcgatcttgcgcgacacgtatgtggtgtcgccaaacgcgaacacgacctggctgttcgtggtgccgatggtgagcctgtcggtcatggacggcagcgtgagcacgtcgtggaacgtgttgccggggacgatggtctcgaaggcctcctgcagcgagctcgtctcgacgttggagtcgcacaccgccaggcggtacgagtccgtggcgaccagcctgatagtgttgtcctcaacggtgagaagaacgccggacagaatgggccgcgacgtgtcctttgaggttaccttgtacaccttgccgaccatctcggacagaaggtcgctcggcagctcgaccgtacgctccaggtcgtactcggggaactccgggaagtcgttggcgtcaagagtgttgagcctgaacgaggacttgtcgcactggatcgtcagcacgcgctcgccgccgtcgaagagcaccgcggagtcaggcagggtcttcactatgttggtgaggatcttgccggacacgacggtcgcgccctcctcctccacgtctgcggcgatcctatggcggatggagatgtccaggttcgtggtctggaactcgagcgttccctcctgcgcctttatgtatatgcccgagagcacggggagggtcgagttagatgccatgcccttcgccaccaccgagagggcttgtgcaagggctgactggcttaccgtaaacttcatttgggaccctccgtctttattagtacttatatataaaagaaaaggtaggagtaataataggcagtgtagaaaagtcgaaaagtaaagagaagtgcaggtagacgcaatagtttcgaaaactcaggcggcttcaatttcccttcggtctctcaacaccgctcagtgtcgaaaacttctttcttcgtcggcccgtcacttttcttcccttctcgacaggatttcttccaagttttaaagcggtcttctgcttcctatcggttgtctgtgatgctgtcctgcagggtctgcaccctgtcctggaacatcctgtcttcctttcgggtcttgtcgacccaatatatgctgtgcttgacggtcgcgtggctgcgcccgccaaacttcttgccgatgtccgccagcgtgttgtccgtcagctcgcgcgtcagccacaccgccacgtgccgcggctccatcagctccttgttgcgcttggagcccacgaggtccatgtgcgaaacgtcgtagtacgactcgacggccttctgtatctgctcgacggttatggtcttctgcccggtcggccacttggcgttggcaatctttatgatgtcctcgcggccaatcttctcgccctgacgctccttgcgcgacgcggtgatcagacacgtgtgcacgaacccctcgatgatgcggatgttcgtgccggagcgctccgccatgagcttgcggtcgtcctcggagatcgtgccggtcatgccggggatgtgctcgcgcacggcgtcctgcttcatcatgtcgtagaagttgttgatcagcttcagcttgagctcgtagtctggcacctggatgctcacggtcacgccggagtccatgcgcgaggtctcgcgctcgtcaaacttgctgtcgcccatgccaagctgcgacggcgagcgatcggctgccagcacgatctgcttgccgtgcgacatgagggcgttgtacgtctcgaagaagaagctgatggtgcccgccgcgcgccgcatgttctggatgtcgtcgattatcagcacgtcgacgttctggtagttgcgcaccagcgtcgccttcgcgggcgtatctcccacgttcatggccttcacgtagtcgtccacaaactccgtgccggtcctatagacgcacagccgcgacgggtcgttctgcgcgatgtagttctggatcgcgcgcagcaggtgcgtcttgccaagcccgctctttccatatatgaacagcgggttgtagctcttgttctccccgtttgcgacctgcttggccgcgtcgaacgcaaactcgttctcctcgccggacacaaagcggtcaaacgtgagcttggagtccgcggggtcgatctcctcgttggcaaagtcgctctgctcctgaggcatgcttgcggctggctttgccaccgccgggcgagaaggacttggcgccacagttgcagatgtctgcaggggtgctgcctcaaccggtggagccacggccgcgctctcacgcgcgttgatgcggccgacttcctcccgcgtcatctccgcgccggtctccacgggtcgcggattcgtgtcgtgcgagagcttcacctcaaacgcgacgtgctggaaggcggcctgctccagacactcctcgatcacgggggtctgctcggctatcttgcgctgcgcaaaccccatgttcgtggagacgaccagccgctcgccatcaaacgagactgccttgcagctcctgagcatcgcgagcgtcggggcgggcagcccgcgctccgccaggagcgtcaggacatccgtccagagtgcgatcgcatctgattcttgggtagaagtcatcctcaccatgtacctctgcaatgttgaaaagtgccaacattatatgatgaaaactaccccacttgtctaccgtaattgggcgcctattgaggcccaccagcctgctgggcatacgtccggcccagatccgtcagcacgtacttctgggcacccttgttcttgcgcacgaacccggccttctccaggcgctgcagctccctcgtccacgtgggctgcgagctgccaaactgcctcgtcaggtcggtaggcccaacgtactggttcatcagcaggtatgccagcacggtccgaccgcgctcggaaagcgcaggtgcaggagcgggtgctggctgcgcttgctgcggtgaggcaccctgcatgccgggcgcaccggccggcgcgtagccctggtaggggttggcctgcggatactgtccgtactgaggcgcgtactggggcggatacgactggtagggtgcctgcccatacccctgcgtcgccgcaccatagggttgtggcgcatacggcatctggccgtacgctggcgcgccatacccctgcgcgggcgccgcctgcggataccccgccgcgccggcctgctgcggcggcatcccatagggctgtccctgtgcgggagcctgcggcacaagcggctcgtcctcttcctcctgcacgttggagatcgtcacgaccgtcccgccggaaatgttgtcgtcaatcgtgagcgtgccgccacggtcctccatgtactgctgcacgtacggcaggccggaccccacgccgcggatgtactgcttcatctcctcggacgcggaggtcgtgccgtactcgagcgcgagctccttggacttgatgcccggtccctggtccgagaacctgatcgtctcgcccccgtcgaggatgctgatggtcggctctataaagtacgcgtggatgaagttctccacgatctcccttatgaccatgaacgggatggtgctgccctgctccttcgcgagcttcacgacggtcgtcgtgatctcctcaaggtaggagcgaacgtcctttggctcgacgatcaccacgcgcggcgccgcggacgcgtcgtcatacacggctattcgcgcgggatatttcacctcgaggctcggtccgtctgtggaggttttgggagcctcatcatgctcctcacctgcggatgagccctccacaaacggatagaagtcgcgcgccacgtccagccctttctccaacgttttcaacatttcatgaactcatgtcgaaaaccattcatcgggaatattcttcgaatgaaagttttcaacaccttgtgaaacgttgtcgataactacggtaaaactgttcccacttgggtgaaaaatcatagcatcattcgaaaacataaccgcagatgaagcagaaggttcagcaaattcattcgcgatttctttcatgaatgtcgtcattcaacgcccagtttggtgtggttttggtagtcaaaacctcccgccgcttgcccgggcgagaaaaaattgacattttggccgatagaccactacaatctgggggcttgacccgattagtcctatatgtcgatcctcgggaggatttaacaatgaagcgtacgtatcagcctaacaagcgtaagcgcgccgtcacccacggcttccgtgcccgcatggcaaccaagggcggccgcgccgttctgtcccgccgtcgcgccaagggccgcaagaggcttaccgtctaggaacgagcatggagaccatcaaatccagaagagaatttgaagaggtcttctctggcggaaaaagagtcaacagtagactcgtgcgagctacggttctgaagtgcgacggaggcgacttgggaaaggtcgccttcgtcgcgcctaagagactgggaaacgcggtctatcgcaaccgttgcaagagggtcctgcgagaggccgcccgcgcttgcggacttccaatgcaagggtccaaggtcattctcttcgcgaccagggcgacccatgacagcacgcctcaggacgtttctgtcgacatgaggtccatcctcaggcggtcgggcctgcaatgagcagtcacgatgcgcgggcgagaaggacatcgcccataaagcgcgcccttctcgcttcgattcgcttctatcagcggtacgtgtcgccgctctttccgccatcatgcatctacgagccaacctgctccgcatatgccttcgaggccatcagtaggtacggcgccctcaggggttcctggttggctttcaagaggattctgcgctgtaatccctttcacaaaggcggttttgaccccgtccccaagctctgataccggaggaacccatgtgggattggtttattgatttccttacgatgattcttaagtcgctcgcagacatctgcggggactggggcatcgctgtcatcgtcctgacgatcatcatccgtctgcttgtcatgccgctcatgaacaagtcgaccgcctcgagcgccaggatgcaggctctccagccaaagatgatggagatccagaacaagtacgccgacgaccccgagcgtcaggccgaggagcttcgcaagttcactgccgagaacaagtttaacccgcttggcggctgcctgcccatcctcatccagatgcccgtcttcttcgcactcttcacggtcgcgaagcaggtgccgaagtcggcgcacttcctcaacatcatgccgtccctctcgcagtctgctgcgggcgcaatgagccatggcatccaggccgcgctcgtctacatcatcttcgacgttctcttcggcatcctcacgttcatcccgatgatgatgaacctgcagaacaccccggacgagcagcgtcagcagaccatgatcatgggcgtcgtcatggcggtcatgatgctgtggtttggctggagcgtccccggcgctgttcttctctactacgatgcctccgccgtctggcaggtcgtgcagcagaaggtcgtcacccagcgcgttatggacaaggtgaaggccgagaccgaggccaagcttgctcagcagggccagagcgttcaggtggacgtggtccgcaaggagcacaagccccgtccgcacaagaagaactagtatcatcaagggtctagaagtattcgcgcggtgctcattgtgcgccgcgctcatttttggaggtatgtggtggaggacgagctgaacgtcgcactcgagggggatgaacccacggaggacaacggcgccgatgacaagttcgctaagattcgcgagcactacgagtctgatgtcgagctgacggatgacgagattgacctcattgctgacgttgccgtgaagtacatccgggggcttctcaactgctttggcgaggagcatatctccatcgacgagtacgacggtgacgagggcgagctcatcctcgacatcagcggtggcgatctggcagtcctcataggtcgccacggtcgtacgcttgacgccctccagatggtcgtgtcctcgtacgtgagcaacaagatcaagttccattatccgatcgtcgtggacatcgagggctacaagagccgtcgtaggaacaagcttacggagatggcgaagtccgctgcagagagggcgaagaagcagcacggccgcgtcgcactcgccccaatgaacgcctacgaccgtagaatcgttcacctcgcgcttgtggacgacgaggatgtcgacacgcattccgagggcgtggagccagagcgtcgggtcgtcgttacgtataaggcgcgctagactttaacaagcatatctgcgttagggggagacacggcaaccgtgtctccccttttttagctgatgatgttatatgggatgagggccaacagtgttcgccttcgcctcgatgtaggggtcacgtgtctgaggccgtgtcacgtttgaaatggctctcggcgattatgttcccgtcccgtgactgagagcctgggcatgataccgtgcacttctcgccattggcaattgcgagaagtgcacggtgcaatctacggatttgcgtttgtcttatctagcatcgttctcacaccgcttggatgtggacaactcgctcttaggatctggggtgcctagatagctttctctagaatcctggatggttcgtttctctttcggctctaggttttgcaactgcttgataggtgccacattgttgagacgtcatcacgcgtggtattggaacgcgatgaatgtgatgctttgcagaggagttcctcaagcgattgttagataacgtaactggtcgaccaccttttgatctggcaatttctgtagccctgtagttggaccttgcacacttctgttcagatgcgcacatattgactccggacgtgatgcacatgatttcctggacaaactcaagaccctttgaagtacaagtaggacatctgcgttatatctgtctcatattgctaatccgagagtagcgaatcgtgcgggtcctatacctaccttgagctgcggtaatgcgcatcggtcataagcaaatggcgcatgacccttgccgttttgggccatttctcctcgtcgcgtcggacgcgga

SEQ ID NO: 277 - DNA, 2348 bp, Unknown
  Metagenome-assembled genome
agtgcgcctcccggtaaaaggtacgtccgaacggttccacatgactttctacttcacctatgcaatagcggccctgctcctcgtgattcccggctacctcatgctccggagcgtggggtttgcccgcgcgtggtcggtcgcgctgtcgccgctcgtgacggcaagcgtcctcgtggtgctgggctgcgtgttggcgcgcgtgggaatcttctccaacgcgatgtcgctcctctcggccttcctcgcgatcgacgtcgtactgctcctcgtcatgcgtacgtggcgcaaggggcagaggtgcaccaaggatctccagctgcccgctatcgactggaagatcctgattgcctatgttttcgtgggactggtgctcggctactacgtcttttatcgctgcatcgatggtccgagctccttctctcaggcctgggatgtcgggcatcacatcaacgcgacccgcgcgatgatggattcgggcaggttctccatctttggtatcgatgcgtacatgacggccaaagacgttgccattgcacccttcggcgtggggcgcggtttttatccgacgggtgtctacaccctgtacgccctcgtgtgcgaggtctccggttctgcacttgcggtgtgcatcaatgcggtcaacctcgtgttttgctgcttcgtctttccccttggggcggcggctgtcatctccgtgctcttcccagaagaccagagaatgttcgcggtgggcgccgtggcatgcctgtgcctcgtgggctgcccatggaactttttaacgtggggcccgctgtttccaaatcttgcgggaatatgctgcgtgcccgccttcctcatgttttttgcgttcctcgtgtctccgcacttcaggggcattgccttcaggctttggcaactcgtcatcttcctgttggttacctttggcatcggctgcctgcatccaaacagcctgtttagtgcggcaatcctcctgattccttacctcttccatcgcatctggaccttggggagcgtcaagctcgcaggctcccgctatctctcgagtcgcttcttagcattctgcttcgcggcgctctgcgtggtgctctggtgcgccgcctataaggtcctttccatagtgtctccgggcgtggtgactttcgactggccaccctttgcgggcaagtggcaggaaatcatcaatatccttacccagtcgtaccttggtgggtttaatgggttcgacccggatattgtggtctctaactttattcctgcgattctcgccattgttggtgcatacaagatcgcacgggatggggagaagagatgggtgctcttctcgtacctccttgcttgcttcatctgctttgtgggcgcgacgacagacggcaccctcaagcacatcgtcgcgggcttctggtacacagatccggtgcgacttgctgccacggcgtccatggctgcaatcccgctggtcgtcgtaggtggtaagtggctcgtggacctcgtcaagcgcttggtctgcaagtggcgtgggaattcggtccattcggatctcaggtacgagggcgtcattctcctcgtcatcgtcgccatcgtctacatgccgtcgctcacgctgccaggcttcaatccgttccggacggcgttcggtggtttacgccagtgcgtgcacgactggtatcacattgagtctccgctcagcaggtcggaggccgacttcctcacgcaggcacaacaggttacgggtgactcgctggtcatcaacaacccgtgggatggtagccacatcgcctatggccttacgggcatgcgaacctactatcgtggctttgctggctacggctcggacggggagagcgtcgacagtaggctgattcgcgagcacctcgacgagtacgcagacaggcgggatgtgagggacgcggtaaagaagattggtgctaagtatgtcatgacgctcaataagccctccgagctcggctcgtacgtcatgatcggcattcccgaccccaacctcttcgagggtgtcaggagtacgggcacgtggagctcggccttcaaggaggtcctcacgagcgaggacggcacctgtcacctctacaagatcgtggagtagtcatcacggctccaatcgagttggcgtttttacgtgggcctttgcctcgggggtttgtgctcgggcgggtttccaatcatactgtttcgagtggaaccctatgttttgaggcaacttgaaccagcgcggccaaggtcgcgggaagtcgaggtatagatgaagcaggtcaagatcgccaacgtcctcctggagggcacgaggcagttctttatggtgccccagctctacgttcgcgccgatgcgcccg

SEQ ID NO: 278 - DNA, 18709 bp, Unknown
  Metagenome-assembled genome
aggccccggcgacatacccccgtcacgggcggccgccggccgcctggcccctcgtgccggaaaacaacgttccatatccggttgtcaaggtgctggaaaggccgaagttggcctggctaacctgttggcaaatccatagctggctcccggatgtcttgcggccgcgtggccgatggtggcggttgcacttgcactggtacccgcgctaggacaggaagcccaggtactcgtcgagcacgttgaacagcatatcacccgaggccacgggcacctccgccgtgctgcgggagatgcgcgcgtgcgtgtagaggtcgcgggcggaggtgagcacgagcgcacccaccacgttgaacgttggccccagcacgacctccaggtagggcacgtacttggcggcctggtccacctcggactgctcgatcgcgtccttcatcttgaactccaggctgaacgcgtagccggggcgcgcgggtgcgggctggcccggcgtacccggctggcccgccgcgggctcgggcggcaccagcagcaggacgtccgcgtatatgcgcacgtagcgggcgcggcggatgcgcagctcaaagcagagctcccagttgtccggcgcggggcagcccagctgccgcaggtccgcaaacagcgcggccatggtgtcgtgcgtgtccagaaacgagtggaagagtccgcgtgcgttgttgaggttgcggccgatgcgcgtacagccgcgcttgagctgcgccagccaggcgtcgcggtcctgggccaggaactcacccaccgtgccgtaccagccacagaagtccccaagcccatggtgcgggaccgtctgctggatgaggccgtaccagaggtaggcatcgtcgcggtagcagaggtcccgcacgaagggtgacgcgtacaggtagcggttgaccgtggtgtggtcgatccccgtctgccgcgcgatgtcgcgggccttcacgccgtccgcgctgcagatgagcgaatagatcgcacgctcgttggcgtccgcggctgaggatggcacgttcttctccccgccctatggcctgctagaccagcttgccctggcagtggtcgcacatgtgctggatcatctgggcctcgaagcccgtgaagtcgcggcggcgggtcttgagctcgccatcgaccagctcgtcgtagctgacctttaccttctggtagcgcgtgaccttggagggctcgtcgcgcgtgaggcaggcctcgaccgtcttgccggcgcgcaggcccatcatgatgcgggggttgtacatgacgtggggggtgccgtcgtcgtcctggtacgcgatgacggccttggtcacgccgatctggttggccgcaaggcagccgcaatcctcgagcgacttcatggtgtccacgaggtcctgggcgatgggcgcgtcctccgcggtcgcgcgctggcacttggtggaaaggactgcctcgtccttgcagagttccttgatcatgttggttccctcccggagccggtggcgcaaggcgccgtgtacgtccacgtcagtatatatgttggagaaggtcgcgcggtgcggggccgacgcgtgggccgtcgcgcgggggccgctgccggcagctaggccaaagagccctgcgtgcggagcgtgcgcaccacgtggtgcggcaccgcgtgcgttatgcagctgcctatgacgttgcccgcggcgcgcttggcgtcgtccgaggcgccgtgcgtggcatacgcgtgcgagaagcgcctgagcatcgcgatgtcgtttccgccgtcaccgtagacggccacctcgtcgtcacgaatgcccaggtggttggccagccaggacaccgcctcgcccttgtccacgcccgcggccgtaatctcgaacatgcaggggtcaaacggcgcgttggtcgccacgtccgtgtgggcgttcaggaagtcgtggatctggtccgcgcgtcccatgccggctatgtgcgcgtttatctttaccacgcgcagcgccgcgatctgggcgggcgtgcagttgtacacgtgctccggcccgccggtcatgctcatgccgcgcgtgaccacacgccgccacagcgccatgtgcgagtatgcggcgcggtgcgcctcctcgctctgcaggtggtacgtgtgctccgtggtgatgaactcgagcggctccgtggagaacctggtgaccagctcctcaacaaacgcctggtcaagcgggtggctgcggagcagcgttccgtcctcccccaggaccatggagccgttgccgcagaccacgcacacgtttttttggaaccccagctgacgggggtcgcgcacggtgcgtcccgtggcgagcgagaagtgcatgcccgccttgcgcacgcgggctatggagcgcaggatggtgcggtccgtgaggtgcaacccgttgagcagggttccgtcgaggtctgcggcaaagagcttgatcatgtggctgaggctccctccccgggatggcgtgggcacggtcgggcacgtacgaccgtggacgcgtgcgactatcatgtttgacgggcggcagtgtaccacctgcggcgcaggtagcgggcaggcttgtgcaagcccgaggtaaagccacacgcaagattcgcgggagcgggcggcggagcggcggcagcggcgcgccggtcgaaagccacgcgcaagtttggaggcccatgttcaacatcgtgctctacgcgccggagatcccggcaaacaccggcaacatcggccgcacgtgcgtgctcacgggttcgcgcctgcacctggtggaacccatcggcttcagcctggacagccgcatgctgctgcgcgcggggctgggctactggcccaacctggacgtgcagacatacgcaagctgggaggacttcctggcgcgcaacggcctcgccctccccgcaaacgcggaccggctgcacctgctgaccaagaaggcgcgccgcacctacgtggaggccacgtaccgcgacggcgactacctggtgtttgggagcgagagcacgggcataccggaggctctgctggcgagcctccccgcgcgctgcgagcgcatccccatgctgccggacgcggcctcgctcaggaaccgggacgcctgggcagcgcacgagcgtgcgttgggcgacgcggccgcaagctccgcgggccggggccacaacggggccgggaccaaggccgacgccgcgggcgagggggcacgcacttctcccccggcgagcgcgccggaaggcgccgcgtcaccgctggcggcgcaagacatctgcgggaactttgtggacccggacggctggcgcatcagcgcactcaacctttcaaactccgtggccatcgtgctgtacgaggcgctgcgtcagacgggcttttgcggaatgggagcggacgcgggcggtcgcgggcgcgcgtgatgggtagactagtggtgtccgtgcgaagcgccggagactaggagaacctcatgtcatacgacattaacgattttgatgataccaacgcgatgggcgcgggggcggacgcctcgggtgccgcgccccaggcaaggcggggctatcagcccacggacgagaaggactttggtccggaggcgatgcacgtcctgcatcgcgcgggaagcgagctttcctacctgcttgaccacgactacccgcgcgagaccgcggtggagtttgtgggcaaccgctaccagttcacgtccaggcagcgcatgttcttgagccgcggcatctgcggcaaccgccgccgcaccacgcgcgccaacacgcacctgcaggcctccgagctgcgcgggcgcgaggtgtgcatcgacggcttcaacgtgatcgtgccgcttgaggtggcgctggtgcacgggccgctcatccacgcgcaggacggcgccatccgcgacctggcgggaatatccggcacgtaccgcgccgtgcaccagaccatgcaggccatcgacctggtactggacgtgctttcagacgcgggcgcgcgctcggccacgttcttttttgaccgcccggtgcgcaactccggccgccttgccaagaccataagcgactacgtgcgcgcgctgagctccatccagccgggcatgcccaagatccagacggccctggtggacaacgtggacgcggagctggcgggccgcgagtttgtggccaccaacgacagcggcgtgatcgaccgcgtgcagagctgggtgagcctggacgcggaggccctgggccgcgtggacgacgtgtggatgctggaggccctggacccggaagacgtggacgacgcgcccgaccccggcgtggaccttctggcggcggacgagtcctccttcgtcaacgcggcgggcaacaccaagccggccacgcgcgtgcccaccatccccgtgagcgttcgcgaccccggcgacacgctcttctcgtaaaaacggacgcgccacgcggcgcgacggcataatcccaggcagaccgagcaaaggaagcagcatggacatccagaacttctatcgcggcaccgagttctatgcacaggactacctgggggcgcgcccagcggagaagggcgtggtcttccgcacgtttgcccccgcggctgacggcatcaccctgctgctcgacgggcgcgaggtgccgatgcagcgcgtgcaggacggcaacttctgggaggcccaggtgccagacgcccaggtgggcgaccactacgagtaccgcatctggcacgcggggagctacgtggaccacgcggacccgtacgcgtttgcatcggagctgcggcccaaccaccgttccatcgtgtgcgacctcacgtaccagtggggcgacgccgcgtggatgggcgcgcgcaaggcagacgccaaccaggcggaccgcccgatgaacatctacgagatgcacctgggatcctggcgcaaccgcgccggcgaggcgcagacggacgacccgtcggactggtacagctacgaggagctggcccagccgctggcagagtacctaaaggagacgggctacaactacgtggagttcatgcccctgtgcgagtacccgtttgacgggtcatggggctaccagcccacggggttcttcagtcccaccagccgctacggcacgccgcagcagctcatgcacctggttgacacgctgcaccaggccggcatcggcgtgatactggacgtggtgcccgtgcactttgccacggacccgtggggccttgccaactacgacggcacgccgctctttgagtaccccaacgaggccgtgggcgtgagcgagtggggcagccacaacttcatgtacagccgcggcgagtcctgcagcttcatgcaaagttccgtcaacttctggctgggctgctaccactttgacgccgtgcgcatggacgccatcagccgcatcatctactggcagggcgacgagtcgcgcggcatcaacaacgagaacgtgcagttcatacgccgcctcaacttcggcgtcaagtcgctcaaccccggcaccttcacggtggcggaggactccacggactttgacggcaccacgcgcgccgtggagcagggcggcctgggctttgactacaagtgggacatgggctggatgcacgacacgctctcgtacttccagaccgacccgtacttccgcagcggcaactaccacaagctcagctttagcatgatgtacttccacaacgagcgctacctgctgccgctgagccacgacgaggtggtccacggcaaggcgaccattgcccagaagatgtggggcgaccacgacaagaagttcccccaggcgcgctcgctctatatgtacatgatggtccaccccggcaagaagctgaacttcatgggcagcgaggtggcgcagctccgcgagtgggacgagaaacgcgagcaggactggttcatgcgcaagttcccgcagcacgacgcgttctaccactactgccgcgacctgaaccacctgtaccttgagcaccccgccctgtggcaggaggactacgaggagcacggctttgagtggctggacgttgcctccacggagcgctgcagctacgcgatagagcgcaggtccgcggcggacggcacgggttctggtgcggcggccggcagtggcgcgggttctggtgacaccgccgcgggcgagcgcatcgtctgcgtgctgaacctttccggtgccacgcaggaggactacgaggtcacggtgcccgccgcgaccaaggcggaggtccttctcgacagtgactgggaagagtactccggcacgacgcccaagggggacgagaagatcgagctcgaccccgcgacgcacgtcctcacctgcacgcttccgccgttcgcgagcgtgctgctgcgggtggagtagcgccgccggcgcgcgggcgcatcgcagtgcgagatgacgagggtcccgaaccaggcgaactggtccgggaccttttggtttgggggatggcgcacccgacgctagtcgttttttgccagccagtcgcgcatcatgcgcaggtagcgaggggtgtcgtccgcgtagcacatgtggcggcagccctcgaacagctcccagcgcgcgccggggatgccgtcgtacatagtcttcgcaatcagcggcgtgcagaggtcgtccgtgccgtccaccacgagcgtgggcacgtgaatctggtccaggcggtcggtgtagtcccaatcctttagcgtgccttgcggcatgagctcgttggggccccacgccacgaggtaggactccgtgccggaacgcttgggccggcgcaggcactcgggtgcgtccggtccgtagtgcaggtccgcgcaatgcaactccatgtagtggtcgatggcgtgctggtacgcctcgcccgtgaagtcgcccgaggcctccgcgtccataagggccaggtactcgtcctcgggaagcatgcgcgccatacggtgctgctcccggccccaaagctgtgaggacggcagcgtgctactgagcgtagcggaaagcacgcccttgggctggcggtccaccaggtaggtgatctcgagcatgccgccccacgactggcccagcagatggtagcgcgaaagtcccaggtagtccaccagcgccgcaagctccctcacccacgtgtccgcgcgccagagctccggatgcccctccacgtaggagttgccacagcccagctggtcgtagctgatcacggcgcggccgtcggtcgtcagcgggtcaagaagctccatgtagttgtgcgtggagccggggccgccgtgcaggcagaggagcggcgccttgccgttggccaggcccttctgtatgttgccggctatgcggtagtacgtgcaatactcgccaaagggcatgtagccctcggtcacggggacgccggacgcgccctgctgctcggtgttgctcatgcgactcccatccgcggccccggcgggccgcgctcgcttttctcgacgtttattgtatgcacacgggatggggacgtgccgtgcgggcgcggcgcggcgagcaatcttgccctatcctgtaccaaagacctaaggagggacacgttggaagatcagatactgctcatcaacgacatgtgcggctacggcaaggtggcgctcgccgccatgctgcccgtgctcacccacatggggtaccgcatccacaacctgccgaccgcgcttgtatcggacacgctcaactatccaaagttctacatccacgactgcacagagtacgtgcgcaacacgctcccgatctgggacgagcttggctttagctttgacgcgatatcgaccggcttcatccagagcgaggaggagtcgcgcatcatcgcggacttctgcgagcgccacgccgccaagggcacgcgcatcttcgtggaccccatcatggccgaccacggccgcctgtacgcgggcatcccgcagaccacggtcaagctcatgaggaggctcgtctcgctcgcggactgcaccgtgcccaactacacggaggcctgcctgctcacggacacgcccatcgacctcgagcgcggcatgtcgcagagcgacgccgtggggctggtcgacggcgtacgcgacctgggcgccaagtccgtggtgatcacgagcgcgctcgtggagggccgccccatggtgattggctacgaccaccgcaacaagaagtacttctcgctccccatcaagatggtgccggtgtacttcccgggcacgggcgacatattctcgtccgtgctgatcggccacgtgatgcgcgacatgccgttggacgaggccacgtcgcgcgccatggaggccgtgcgcaagctgatcgtgcgcaaccagtaccaggacgacaagtcgcgcggcatccccatcgagacctgcctggacgcgctggactagcgcaaccttgcacttgtctgccgccgacggacgcgccgccgcaacgcgatgcgacgccgcaccatgcaatacatcgcccaaatcatgcgggcgagaagagcgataggaaacgaccccgaagcctctcgtgaggttccggggtcgttcgttcgcttggcaggggactcaagctaggaagtcacgtacttctcccctactcgcggttgcgcttgcgcatcgcgacggcgatcacgacgatggcgacgcccgcgacggcgatggcgatgggcaccatcatgttgttggtgtcgcccgtggagacgaccttgccgggcttgccggtggtggtggcaggcgcggacttcttggtcggggcgttggtggtcgtggtgggcttggcggccgcagccttcacggtgatggtcgcagggtcggaggtgacgctctggccgttgacggtgttggtcacggtgcaggtgtaggtgtaggtgccgaccttggaggtgtcgacggagtgggtcgagccctcattggtgtcagtggtggcacgtgcggccttgagggtcgcgccggcggtggcaacggccttgttggaggtgtcgccggtgaacttgacgtcccacttgtaggagagcttggagtcggaacccttgacctggtcggggatggaggcggtcacctggaggtcagcggccttgtcaccctgcgtgtacgtggcactctggggctggccggtaatttctggcttgaaaagcagagtggcataagcaaccggggtcttgaggtcgccggtcgtggcgtcgtagtcgctcgggacgaactcgccggactggtcgcccttgaggtaggcgcgcatctcgtcgaggagggccttgcacttgttgtaggtctccttgcttgcctgctcgaagagcgtgttcgcgaggtcggtgcgggcctggccgacagccgtcttctgcatgacggagtcgacggtggtctgctgggcgatgagctgcttctgcagggcgtccaggtaggcacgggtgttcttggcgagcttggcgcggttgttgtaggcgagggtgttgatgtccatcagcacgtagtcgagcgagccgttgtccgtggaggaatccatagcagcgtcaacggagtccttggactcagacgcaccggtgtgggtctcgtcccacttgtcgatctcggggtagatggtggtgtcgaccttggtcagcagcgcggagtagctcgggacggcgacgctgaactcgtcacgggagagcgcctcccactggatggtcgcgatgtcggaggtcattgcgttcctgatctggaacatgtgcgtctcgacagtgcggttgttgccgatggcgtacagctgggagttcgtatttgcgttgaggctgctcgtctgctcgccacgcgccgcgtaggaacgaagcgcctggaagaggctcaccttgccggcaggctggaagaggagctcggggtcggtgagggaggtcacgccctgccatcccttggcggcggtgaagtccgtggtgtatgtgccgtccgcgagcgggctgccgaagtaggcgtgaccttgcgcgtaacgggtcatctgtgcgatgccgtcatcggcgccataggaggatgcgacgtcgaagttgccatcgtcgaagtacttgtcggtgccagcctccttagcgacgtccaccatcttttcggagtgcaggcacacgagaggatcttcgaggttcacgtcgaacttcaggctgctcatgttggggttgacggagaccatgtcggtcgtgtagacgtcgccgatcttggcggcgctcaggttgactgcgcaccactggtgaccggacagttgcatgaagacccaggtctccgcggagtccgcgatgatgatctggttcatgtcgtagttgcccttctcgtcaactatctgaccgagaagcttgacgccgtcacgggcggtggtggcgcagcccagcacgatgtcggggatggtgtactcgccgaggccggaggggttgtcctgatcctcgctgccggcggggtcgacggcggcgatcttgtcgttgtagttggtggtcagggtggcggagacgctcacgcccgcggagtttgtgcccgcctcggagtacgcatcagtgtagccgtcccagccggagggaaggtcgcgcacataggtgtgacggagcgtcgtgccgttgtacgtccacgtaaagttggactcgtccgaatggaacgtgggattggtctgcggctcctggatgccgaacgccttgggatggcgactggcgtagtcctcggaacgtccgacgtaggtgtcgcccgtgtcggtcacgcccttgcccatgtagatctgcgtgcacgcgagcgcgcccgtcggcagcgccatcacgatggcggcggtcacggtgagcgcctggccgaagcgcttgaagcggccgagcgcacccctggtttgggtccttctcatatgccccccttgtcctgtggcgccagtagacagaaacctggcaccaaaccacatgtctgcacgcatcatcacatggaagtgcagaatttgtaaaggtgcctaacgttggccgaaaagattctgacggcaaacggaaacgtaaaccgtaacatgaaaagttgtaatggcaggcatgagagaaggacccgccgcacgagctgcgacgggtcctttcaggtgcctgtatgcaggtgttcttctcgtccgcgtcttactggggacggtcgaccccacgttgacggagccggcggatggtgcaaacggcgcggaggacgagaagtgcggcgtcgccgctagtcgcgcgtgagcttgcggtgcaggcggtgcggcttggagaggtcagggccgaggcgcttgacgcggtccttctggtagtcctcgaagttgccctcgaaccagtgccacgcgccggggtcgtcgtccgtgccctcccacgcgaggatgtgcgtgcagatgcggtccatgaaccagcggtcgtggctcgtgatcacgcagcagcccggaaactccagaagcgcctcctccaggctctccagggtctcggtgtccaggtcgttcgtcggctcgtccagaagcaccaggttcccgccctggcgcagggtcagggccaggttcagcctgttcctctcgccgccagagagcacgccggcgcgcttctgctggtcggtgcccttgaagccaaacgcgctcacgtacgcgcggctcgggatctcctgcttgccgacggtgatgtagtcgttgccgccgctcacgacctcccacaccgtcttctgtgggtcgagtccctcgcggttctggtccacgtaggaaagcttcaccgtctcgcccagctcgagcgtaccggaggtgacgggctcctgtcccacgatcatcttgaacagggtcgacttgcccacgccgttcgggccgatgacgcccacgatgccgttgcgcggcaggctgaagctcaggtcgtccatcagcacgcggtcgccaaacgccttgtgcaggtggttcgcctcgagcaccttgttgcccaggcgcgggcccacgggaaggtggatgtcggtgtagtcgaccttctcggcccgtgccgccgcagcctccatctcctcgtacgccgcgaggcgggccttgctcttggcctggcgggccttctgcgagctgcggacccacgccagctcgtcgcgcatcttgcgggcgcgcttggcgttctgcttggactccatctccatgcgcgcggacttggtctccagataggtggaatagttgcccttgtaggggtagagcgtgccgcggtcgacctcgcagatccactcggccacgttgtccaggaagtagcggtcgtgcgtgacggcgagcaccgcaccctgatagttcttgaggaactgctccagccacagcacggactccgcgtccaggtggttggtgggctcgtccaggagcaggaggtcgggcgcctcaagcaggagcttgcacagcgcgacgcgacgcctttctcccccggagaggtgcgtgacgggctcgtcgccatcggggcactgcagcgcgtccatcgcctgcgagagctggctgtcgatgtcccagccgttggcggcgtcgatctcgttctggagctcgcccatctcggccatcagcgcgtcgaagtccgcgttggggtcgcccatctcctcgccgatctggttgaagcggttgaccttggcgatgatgtcgccaaacgccatctcgatgttctgcttgacggtcttggtctcgtccagcggcggctcctgcaggaggatccccacggagtagccgggcgagaggcgcgcctcgccgttgctgatgtcctcgatcccggccatgatcttgagcagggtcgacttgcccatgccgttggggcccacgacgccgatcttggcgccggggaagaagcccatggtcacgtcgtccaggatgaccttgccgtcgtacgccttgcggaccttctccatctggtagatgaactctgccatctgtcttgctcctttgctcgggcggacggggtgcgggtgccacggccgccacggacctttaggttgtctgcctgttggctgcctgttgggttgttgcctgccggacagtatcccatacggcgcgcgcaagaccagccgccgcagcgcgaacacgcccagcgaccattgattctcccgggtttgggcgcggtgcggcgcgcgggggcgggtcgtgacgagggtcggggcgccgggccagacggggcgcgcgtcacggcacggttcccatgcgtgacgcgtggataccgtgaaaacacgacgcaaggattccgtttcccatgcgttcgggccgacggttcccttgcgtggcgcatggcaaccggccccagaccagcccttttcggcccgaacgcaaggattccgcccttgcaaacgcatggctaacggaatccttgcatgccaaaatgtcggttcccatgcgtggcgcatgggaaccgacagacggtcaaacacacaaacctgttcccgtgcgtcgcctgccggtcgggaccctggcgtcagacggttcccgcatttgacgcaggcccgcgcaccgcggtttgcgaggaaaccgtcaaacagacaagcgaggattccgttatcctcgcgtcgcccgcccggccgggcggcccaacgggacgatccggccccagatgtcccgcggtatcctcgcgccacgcgaggataccgccagcatcgccaacaatcgtcaaaccattaagcgaggataacggtttcctcgcttaccaaagcgacggtttcctcgcatccagacgccggggcgctgctcccactacatcgcggagacgatcgcgtacagcaccgcaatcacaacaagcaccacgatcagcaccacagccacgcgcatgaggtagcccttggtgccgtagcggcgcatgttgtcctccacgccgttggtgttggccatgttgttagccaccttgccaaggccctcggccacggactccggctcctcgtcgtccaccatgggcgcgtagccctcgcgcgggttgcccgtgaagatgcgaccgccggccgtgaccacgtactccgtgccgtcgtcgtcctgccgggtgacctcgcccatcagacgcttcccctgccacacaaagctcctgccaccaggcatgccagccgcctttcccgtgtacgcccgcggcgacgcacgccgcgtcgccctcgcgcccttgctcgttgctcgtttcatgggaatgctagcagcaatcgcccgcctccgcgcgcgggacgcggccgggcggacacccgtgcgcgcgggcgtgtaccatcgtgtggtgcacaaacgaaagcgaaaggtggggccggcatgaagagcatcctggtaatggcgacgggcgggacgatcgcgtctctcccccaggcggacgggctcgcgccggcgctcacgggcgaggagctcgtggcgcgcgtgccgctcatcgaccagctgtgccacatcgacgtggtgcagcccatgaacatcgacagcaccaacatgcgcccgcgcgactggctgcgcatcgcggacggcatcgccagccgctacgacgactacgacggcttcgtggtgctgcacgggacggacacgatggcgtacacggccgcggccctcagctacctgctgcagggcggcagcaagcccatcgtgctcacgggctcgcagcagcccatggcggcgccgttcacggacgccaagctcaacctgtaccagagcctgctctttgcgacggacgactccgcccgcggcgtgagcgtggtgttcaacggcaaggcgatcgccggcacgcgcgcccacaagcagcgcacgctgagcttcaacgccttcgtgagcatgaactttcccacgctcgcctacatccgcggcggccgcgtgctgtggagcggcggccgcggtcccgctccggacgcctccgcgggcgagaaggacgagcccctgcgccgctacaccgccctggacgaccgcgtcatcgtgctgaggctgacccccgagctgaggccgtcgatcttctcgctcataaaggacgagtacgacgccgtcatcctggagacgtttggcatcggcggcatcccggactacgatggcggcgcgttccagcgcgcgatttttggctgggttgactccgggcgcacgctggtgctgaccacgcaggtgcccgaggaggggcttgacctgggcgtgtacgaggtggggcgcgcgtactccgagcaccccggcatcctgaagggtgacgacatgtcgacggaggccctggtggccaagaccatgtgggtgctgggccagacgcgcgacgcccccgaggtcaggcacctgttctaccggcccgtcaacatggaccgcacgccgcagtagccaccgcggccggcaccgcccccgcatgtatatagttcatgaccagccgccgattcgtgcttccacgctgggaatttgtgacatcatgtgagaacgcaacacacaaatgagcagcaatccgtgctcatttaacccgaaggagctgaacatgcccgatgccatccgcaaggtcaacatcatcggccacctgcatcccgacacagacagcatctgctctgccatcgcgtatgcgtacctcaagaaccagataagcgacatcgagtacgagccccgccgcgccggcgccatcaaccgcgagacggccttcgcgctcaagtcgtttggcttcgaggagcccgagctcatcacgagcgtcgccccgcagatcaaggacacgcagatctcgcgccagaagagcatcgacgcggacacctcgctcttctccgcatggaacctcatgcgcgacctcaagaccagcacgctgtgcgtcacggacgagaaggacgacctcctgggcctgatcgccgtcaaggacgtcgcgagcgccaacatggacatcttcgacaccgcgatgctctccaacgccaagacgctgtactcaaacgtgctcgacacgctcaagggcaccatggtgctgggcgaccccgcggaccgcatcacgcagggcaacatccgcatcggcaccacgcccgagatgatggagggcaacatcgagaagggcgacatcgtcctggtgaccaaccgctacgagacgcagcgctacgccgtggaggcgggtgcgagctgcctggtggtctgcaacggcgccggcgtgagcgaggtcgtgctgggcgcggccaaggccaacggctgcaccgtcctcaccaccccgtacgacacgtactccgccgcacgcctcatccccatggccacgccggtctccgccgagatgctcccggaggagaaggtcctgcgcttctccgtcaacaccgccgtggacgacgccctcaaggtgatggccaactcgcagcaccgcttcttccccgtgatggacgaggacggccactacattggcgtcgtgagctcgcccaacatgatcaacgtcaacaagaagcacgtcatcctggttgaccacaacgagcgcagccaggccgtgagcggcctcgagcgcgccgagatcatggagatcatcgaccaccaccgcatcggcacgatcgagacgagctcccccgcgtacttccgcaacgagcccgtgggctgcaccaacacgatcctcttcagcatgttccaggagaagggcgtcgagatccccaagaacatcgcgggcatcatgctttccgccatcctgtccgacacgctggcgttccgctcccccacctgcacggagcgcgacaagtttgccggccagcagctggcgcagatcgcgggcgtggacatcgacacgtacgccgacgccatgttcgacgccggcgccgacctcacgggccgcaccgccgaggaggtcttcaactccgacttcaaggtcttctcgcgcgggcacgcacgctttggcgtgggccagggcagcttcatgaccgaggccagccgcaaggccgccgaggcgctggtgggcccgtacctcaaggagggcgccgccgccaacgacatcccgatggtcttctacatgttcacggacgtgaagtcccagaccaccgagctgctgtactggggcgccaacaccgaccagatcgtgtcgcgcacgtttgacgtgacgccggtcgacggcatcgccacgctgccgggcgtcgtcagccgcaagaagcaggtcatcccgcccctcatgaccacgctccaggacatggacgaggacgaggagtagcagctagcagccgcgtccgccccacggcgacgcttcagggcgagaagaacgaccttctcatcagcaccatcaggccggccggtccgcgtgaccgaccggccttttgcgtgcgcggcgtccggcgttgcgggcgcccgcctccagccgcccggcgccgcggcattcgtgtccgccccgcgcgatagacttgtgcaaggcaacgcacaaggaggtcccatggcagagcagagcgattgcgagaacgcaagccagcaggaggcatcggcggcagcgcagccgccgcgcgggcagtcgagcttcttcgcgctcatatcgcgcatgaagtacatcgagcgctgggcgctcatgcgcagcacccacccggagaacctctcggagcactcgctcgaggtcgccgtgatcgcgcacgcgctcgcgaccatcgccaacgtgcgctacgggcgctcgctcgacgcgggcaaggccgcgctcgtggggctcttccacgacacgtcggagatcatcaccggcgacatgcccacacccgtcaagtacgccaacggccagatcctgggcgcgtacaagaacgtggaggcccacgcggagcgcacgctcctgagcgagctgcctgcggacctcgcccccacctaccggcgcatcttcttcccacaggacgagcacggcgccgtgagcgaggacgaggcgtacctgcgcgcgctcgtgaaggccgctgacaagatctccgcgctcatcaagtgcgtggacgaggcgcacgccggcaacgcggagttcacgcgcgcccgcgacgccacgcagcagcgaatcgacgccatggccgaggagtacccggaggtgcgggactttgtggaggagttcctcccgccctatggccagacgctcgaccagctgctctagcaggcctcggccggtacgggcggctccgtgggcggcacgggcgacggcagcccatctgccattcccggaatgtcagttccatgtagcggttttagcacagttccgtatacatttgtatgtttttggacaaaacggcgcccgtaggtttcaatttgaatcggtttcaaaaacaaggtgtcccccaccacgccataaggttaaaattcttcagacgtgatgcagggaggggcgcatctgtacgtctcgctcagatgaacgcgcgacctggcccgcctggcaacaggcatgcgaggccgcggattcgagaggttggtgtaatcgcatgcagaacaagttggcacacgcggcggagcgcaaggcattctccgtcgtcctcgacaagggaatcgacgccgtgcgcggcgaccatcccgaggaggctatcgagaagttcctcgacatgggccagaagatgctctccggcaccgcgcccgatatggccgcgatgctgcgcgccgcgttctaccctggctccaagtgggagaacatggtcatcgacatggcccgccgcatcgatccgcacatcctgaagaccgcccttctcgacggcgcctacgaggctgccttccgcggcctgcgcgagaccacgatctctgccgagaagaaccagtgcaacgtgccctggatcatcatcttcgaccccacgagcgcctgcaacatgcactgcgtgggctgctgggcggccgactactccaagtcgctcaacctcacgttcgacgagatggactccctcgtgcagcaggccaacgacctcggctgccactggttcttcatgaccggcggcgagcccatggtgcgctggaaggacatcgtcaagctggccgagaagca

SEQ ID NO: 279 - DNA, 20675 bp, Unknown
  Metagenome-assembled genome
gcgacgtcgcctcgaaagtgagctgtaatcttggtggacagtgggaccaagcagggactggcaacagatattgctctgtccagattacccacctaccaacaccagcaagattaagagatgagatgtcggtgtgagcgcaagcgagatagagaaggcaagtcccgcacgaagccggaaaaacccaaaacctacatgcaaggagtaccgtctcgaggctgtcgagtaccgacaggaaggcattgaggccgccgatccaagaagagccatcagggaggcgccgccgagcttttggaaataaaagaccaagaccttaaacgactggactcatcaagcacaacaagacggaagagtcaccaagcaaggacgaggagcaggaaggagcctcgacagggccaacaggcgtatacacgcgtcgcgagcgagaacagttctaaaaaaagccgcaggccttcgtcgcaagagcctcgacggaggacaggtttacggctctgctcgcggagggagggcaacctacaggtctcgtgatgggcgcgcgtaatggaggtgagcaggtccggttctacagatggctctcaggccggagggcggtgggagggacccgtggggtcccctcaaggaagccatcttgcgaagatgaggagagaagaggacggcgcttcggcttcagcaaggtctggccaagctcacaggcgacacgagtacgcaaaagttacaggcacgacacgctacctgtgcggaaatgcaggtcgagctgggcatctgcggcatctgaccgaatgcatcagaggacgacgttgcccgatccgcccgccccgagcgccccgactcattcggacgggacttctcgtgcccgttcgacacgaagcttgtgggcgatataaccatctcaacaagggaccacggcaggcttcatattatatctcgcagtcggtagacgactggcacgcgcatcatggtgggcaggctggagcatacaggacaacatgagggcagggcttgtagtctttgcccttggatgaagatggcatattcgcgcgatacgtggccaaaggggcaatattacacagcggaccgtggcagccagtatacgagtgcagagttcgccgcctggggcagagctgcgcacggccgtgaggctctccgtggggagaccggaagctttgccacgacaacgctgtgagcccgaatcgttttcaggcacgctcaagaccgaatggtactaccttgaggcctctcggatgcatccacgaccaagaacaaggcgtcaagtttatcgagtaccatactacaaccgcttccgcccgcacgagtccataggaagatcgagttgaccgcagaggtgatgcaggagttattcgagcgttcgagaagaggccttgcataccgatccgggaggtggatgatggccgaccgcataacaaaatttgagattcctctgtccattatatgacagggatcaaagcagtggacgcgccgaagccgcggttggagctgagcgcttggggtccgccgtcgatcgggcccgaggagctgggtacgagtgacgggggcgcatccccgtccttggtcttgcaacttgggaagcccagcgcgccgccccttgcgctcgcccgccttggacgcggagtagttcttgagggcgcggcacgacgttagtgatccaggccggacgtgtaggcatcttgctgttctcgcgccaccaggcgggcacgcccgtcattgcaggcgttacacacaactgcgcagggagtaactaggaccaatcgggcatcttccggcctcgattggggatttcaccgtgagcgagggcgcagcgttgtaacgcgaaccgcgcagcgccgggtgggacagaagcgcctctcggcgcacggcgtggggtcgaggccaccttcatggcactcaagcctcgtcggccgccttcatgcgctgggcctttgtgcttggcccacctccgccttccgtgagcgggcgcagaagaaggacgtggagcacctaggttcatgtcgcgaacaagttcgtagtagagctcggtgtcgtcacccaccacgacgaaggcaggaaatgacgcgagaaagggcgatcgcgattcaggcccgcgttacatccgcgccaggcggtttcgcggtgctcgacgaggatcgtccccacggtcggcgtccgccgagaagcggtgcaagccttgaggccatgcacttgttcatgccgcttccggtatacttgacgacctcggggttgctcggactcccatgccgattgcagaacgccttgagtcggttccgaatgccttgcaggtcgtcctttgtcccgacgagacgagggcgagcagaccgtactaccacgacggggcttgtcgattcgtctcatcgtattggggtcgtgtatgaggatgatccccggcgaggtcttctcgaaggcacgaggaatttgaccctcacggggaccacttccatacagtctggatcaatcctctctttgtgccaccattcgtttgcctatgagaaagaataacagaagtactccccccataacagctattacaggcatttacctatactgctgggtagccccattgccacgaccgtggcaaagatcaccaccatgtggtggatcgtctgccagtacacgggccagatctggttcatgacgcccatcatgcagataccgcggatggtgttgagctcgttgaacgtgagccagtacttcaccttggatcccaggcgctcaaagagggcacgggcgcacttcacgtagcagtcgatggtctggcgtccgccccagccgttgtagtacttcaccagctcgtatgacatctcgtcgtggcagatcgtgatgaggggctggataccgtgggccaaaaggtcgtccacaatgtcctcgtagaaggcaagcccctcctcgttcggccggtcctccaggcccgtcgggaagatcctaaaccagcaggtcgagaagcggtatacgcgaaagcccatctcggccatatcctcgatgtcctcgcgccagtgatggtaggagtccacgccgcgatgtgaggggtagtacacgtcgtcgaacatcgtaagctcaacgcccttaggcagcacttcctcccagttgatggagccgcacctgccgtccccgtccttccaggtgacctggtgcggatgcgtctggtcaccatccgtcgcgaagtctatctcgagtagtccgcgtccgccttcgccgaagccgccttagaactgccagtccggcatggcacctccgaagaggaagccctcgggaaacgctcttctgccatagcatgcatcctttctcgcgcgcttgcttagggcaagaatagctgatgtttcgacacctcatcgaacaagaaaaatgtccagccaacgagtcggctggacataatccgtctggactccatgtgggatgctactccatatccaaaggcatcctgtaattgggcggcggaaattcctcgttcagcagagccatgtcctccgccgtcaactccacatcgatcgtggaccagttctgcctgacgtgcctcgcactggagctgcgagggatggcgatcacgttctggtcatgcaagacgaacgccaggagcacctgcatgggggtgatgccgtgggcggctgcaacctcatgaaccgccttactgtccacaagcccctggcgaagtctgcctgcctgcgcgaggggacagtacgccatcagtggaatcctcctttgcctcatccaaggcagaaggtcaaactcaaccccacgcgaccccaagtggtagaggtcctgatttacgagacaatgctcaccaccgtccaccctcatgagctcttccatgtcgtcgaggtcaaagttggatactccccagcctccgatctttccactctcgaccagttcttccatgcattcgaccgtctcggccagcggaatctgcccgcgccagtgcaagaggtacaggtcaaggtaatcggtgcccaaacgtgccagcgacctgttgagtgcacggaagatgcccttccggcccgcattgtacgggtagaccttcgacacgataaagaggtcttcgcgccttcgtcctcggatggcatcgcccaccatctcctcggccgcaccgtccccatacatctcggctgtatcaatcaggcgaacgcctacgtccaatccagctcgaagcgcagacaactcgacctcccagggatgaaggccccggctagataccaggtccccataccaagacggggcattcttctgccatccctcagctctacggtacgcccgttactcaacctcgtcatctgctctctgaagtcccaggtagtccatcattcccgcaacggcatgcttggctccagccaccgcatgggccaccgtctttggcccactgaccacgtcgcccgctgcaaacacgcccggcaccgtgcacatgcagttttcgtcgaccactagcgtgcccctgtctgtggctgcaaggcccttcgtcgtcagcagcagcttgtccttcggcacctgtgacacacagatgatcacggagtcgcagttaacgtgctcggtctcgtcggaaagcccgacaacttggccctcgtcgtccaagatggagttgcgaaacaccgggcccccgtcgtcgatggactcaatcgacttccaatagacgatcttcgcaccatccagctgcgccaactcgacctcgtcggtgttagccgaggtaccgccccagttggaatatagagtcacgtgtcgtgagccctttcggatggcagttcgcgccacatccatagcaacgttgcccactcctatgatagcaacgtcagagcccaggttgcaaacagatgggttgatcaaatagtcaatgccaaagtagacgttgccacgtgcctgaccctttatgcccaaagtcctagcacgccaagctcccgtacccacaaacacggcgtcgtagccatctcgtaggaggccgtctagcttcagcgcgccacctatagttgtgttcggcctcacatgcactcccagcgcgtcaagcgccttacgatatcgagccagcagctgatgaggcagcctgaactccggaataccatagcgaagcacgccgccgatgtccatcttttgctcgaagatcgttacgtcacaccccacgcgcgccagctggattgccacggtaagaccagcaggtccagagcccactactgctacgaccttgccgttgtgcgtaggtttcacgtcacggataaatctgtccagataagtgtccgagacgtactgctcaatggccgagaagtggatcgacgtgcccttcttgccccgtatgcagtatccctcgcattgctgcgagtagttgcacacatacgagcagatgacactcatcgggttgttgtcgaacagcatctggccagccgctaccaaatcccgctgtttgaacttctggatgacctgcgggatagacgtgtgcaccgggcagcccttgcagcatagcggtcgtttacagttcagacacctatttgcctcgtcgatgatgtgcagcgccatacggcagctcccttctgagggccaagaaaaacgagacaaggacaggaggtacctatgacctcaccgtcctcgcctcgcaagacgtgacccgctgtcaactatggggcaagaagacccttagtcctgcagcttgaagtcgttgaccatctcgtaccactcggcgatgccggagtgatcgtccttctcgtggccatgggccttcagcgactgcatgatctccatggcaagcgaggtaaagggggtggacacgttgacgccgtgcgaggtatcgagcgcgttctgcaggtccttaatgtggagctcgatgcggaaaccaggctcgaagtttccgtcgaagatcttctgggacttctggtccatgacaacagaaccagcaaggccgctgcggatggcctggtacacgcgggaggggtcgacgccggccttctttgccaggctgtacgcctcggaaatacctgcaatattgatggcgacaatcatctggttggccagcttggtgatgttgccggcaccgacaccgcccaccagagtcacagtcgaagccatggtctgcagcagaggctcatacttgtcgaacacgtcctgctcaccgccgaccatgacggcaatggtgccatcaatagccttgggctcaccaccggacacaggcgcgtcgaggaagtccacacccttcttggccaggcgggcggcaaactcacgggacttgatggggttgatggagctcatgtcgataactgccttaccctcactgaggccctcgaagactccatcctcgtcgaacagggcgctctcgacgttgggagagttctgcatcatcatgatgacgacgtcagactgctcgccaacctcgcaaccgctctttgcgcccactccgccagcagcaacgatggcatcaatgcgatcctgatggtggtcgtaggccacgacggtgtggccagccttctggacgttgagtgccataggcttgcccatgatgcccagaccgatgaatcctaccttcattttgtgcttcctttcttgtgaaatacccattgattgaactatacgaaacggtagcgacaagaccacgtttgacaatgcaaagatatcacctcagggcctttcccaaaaggtacgccctgatgcagctctcgcctgcaatggggacgctgacatccacgcggtcgatgcactcctgcagagtcatggggcccgtcaccgtgggtataacaagatcgataccctgggagtagacactgcccaggtcgtccgccctgctacccaccacggcaaccaccgggatgccatggcgcttcgcaaggcgcgcaacgcccacgggagcctttccgttggcagattgcgagtccatgcgcccctcgcccgtcaccaccaggtcagcaccagtcatggccttctcgagctctatcttctgcaacacgaaatctatacctgaaacgatgctggcaccacagaaagagacaaggccggctcccaagccgcccgcggcgccggccccgggtagggcggccacgtcggatccgacatcgcgcagcagtacctcgctgtagtgtcgcatccaaccatctacacgggccagatccttactagccaggcccttctggggcccgtaaacgtacactgcaccgtcagcgccgcaaagtgggttgcgaacgtcggtcagtgctacgaactcgacatccgccagacgagggtcgagtccagaggcgtcgatggacgcaagtgagccaagcccaatggcgccgcaagggatgcccttgccagactcatccagaaagcgggctccaagggccttagccagaccagcgccgccatcgctcgtggcactgccgccaaggccaacgtagacctttcgggcgccgtccgcaatcgcggctagtacaacttgtcctacgccaaacgtagacgcatgcagcgcgttttcgggactctgatcgatgaacgtgatgccactggcctcggccatctcgatgacagcctcatcccctccatcgatgagggcatagtgcgcattgacggcgccacccagcggaccgctgaccgccactgagcgaacctctcccccacaggcgctgacgagcgcatccatggtgccttcgccgccgtcggcaatgggaaacgttatcgtgttggcattcggtaccactcgatgtatgcctaccgccagcaagtcatctacctgcctgctgctggcagaccctttgaacgtatccgacgctattaccacgctgagcgaggccattgagtccccctcctccccgcaattcttcttggctagaggccaacgaagagttacttcagatatccgccttcgcgcatggccgccttcattccgtcgagtgcggcgccctgagtgggctcggtcggcaggatggaaggaccaacctccatgcccatcaggtttgccatgtcctttgtcgccgccggaaagctggccgcatcctgggataggcggatagggttgagcttgaactgctcggttcgcgaccccacgtagtcccccgccgcgaacttgtcgtagatgccgcagaccagatccgggaagatgtttgccgtggagcacaccgcaccatctgcaccacagcaaagcccggcgtaaacaatggtgtccttgccagcgaagaccgtgaagttgatgtcagacgtcagacgaacaagctcctgaaggttcgtgatattaccggacgaatcctttatgcccacgatgttctggaagtcgtgcgccagggcaacgatggtaggaatgggcacaggatagcctgccctgccagggttgttatagatgaacatcgccgtgtccggaactgccttggcaatagctgcgtagtggttgtacagcgcctgggtcgtgggctggataaacatgggctgcagcaccgaaacggcgtcgacatccagcgctgccgccttacgtgccagctcgacgcacttgctggtgcggatgtgtccgacgccgaacatcacggggacacggccggcgacctggtccaagatggccttcgtggcgtcaatcatttcatcgtcgtcgaacatgtagaactcggaattcgagccgaaggccagaatgccgtcaacgccgtggtcaatcacgtaatccacctgcttgcgcagccttgcctcatcgatggcaccggtctggccgacgggagtcaagatgggaacaaagatgccatggtaaccatttgcactaatttcctttgacataaggccttcctccatatgcaccgtacgaaacccccagggggaactgtgggaattcgtacggccagttcgaaccgatgcaatctgctagcgcacgagtgcgggacgcttgctgtcaaacttccaaccagggatgaggtactgcatgccgatggagtcgtcacgggtccccaggttgttgtcaacgaagagcttgtgcgccttcatcagggcgtcacggtcaatctcgatgcccaggccagggacgtcgtacgggaccttcacgcgaccatcctcaatcttgggcgggttcttcgtgagcgcctggccatcctgccagatgtagtgggtgtcgcaggcgttatagaagccgggtgccgccgcagcggtttgggcgaccatagccagcgagatgtcgaagtggttgttggagtgcacgccccaggtgaggtccatgtcgtggcacagctgcgccacgcgcgtagcgccctccatggtccagaagtggggatccgccagaggaatggacacagagtccaggcggatggccgccttcatctcgcgccagtccgtggcaatcatgttcgtcgcggtcggaaggcccgtcagacggtgaaactccgccatgacctcacgaccggagaagcgtccctcagcaccacaggggtcctcgacgtaggtcagggtaccgaccatgtccttgcagaggtcgacggcttcggccagggaccagcagccgttgggatccaggtcaatgcgggcgttggggaactgcttcttcagcgccttgatggccttgatctcctccttaccctcgaagacaccacccttcagcttatagtccacgaacccgtagcgctcggtcgcggcctcggcctgcttcacgatggcctcgggagtcagagcggcctcgcgacggatgcgaccccactcgtcggagttgtcatcgtcgtggatatagggcagatcggtcttcgtgcgatcaccgacatagaacaggtaggccaggaagcgcacggagtcgcgctgctgtccctcacccagcagagccgccaccggcacctcaaggtgcttgcccagaatatcaagcatcgctgcctcgacggcggtctgcacgtggacagtagtgcgcaggtcaaacgtttgggcaccacggccacccttgtccaggttggcatacttgtcgtggatggagcgcacgacgttcttccactgcgagacaggctgtcccactaccagatcatcgatctcgttcagaacctcggtaatctttgcagagccgggaacctcgctgataccttcgacaccctcggagtcggtcagaataacaacgttgcgcgtgaagtagggaccatgagcacccgagaggttcagcagcatgctgtcatagcctgccacgggatagacttccatcttttcaatcttgggaaccattgtgacctccactattagtagttgatgaccctcattgccgtcctaaatctagaaacaatcttacgtaggtctacggaacaactcaaagtcacacaggacagatgacatcatgttcgaatacacgtgtgttgttccacgtaccatctacacaaccgacgctaacgcaccatggcaggcctgtgtgagtcgtacttccagccagggatgtagaactgcatgccacgcgcgtcatcgcgcgtgccacaaccgttgtcgacatagagcttgtgagcagccttaagcttctggtgatccagctcgatacccagcccgacgccatcgcgaggcacgcgcaggcagccgtcctcgaagtgcggagccaccttgcctagatgctggccatcctgccagatatagtgggtatcgcaggcgttcaacttgccaggtgccgcagccgccgcctgggccaccatggccagcgagatatcgaagtggttgttggagtgtacgccccaggtgaggtccatgtcgtggcacagctgtgccacacgcacacatccctccatggtccagaagtggggatccgccagaggaatgattacggagtccaggcggatagctgccttcatctcgcgccagtcggtatcaatcatattcgttgcggtcggaaggcccgtcagacggtgaaactccgccatgacctcacgaccggagaagcgtccctcggcaccacaggggtcctcgacatatgccagaacaccggtcatgtcacgacagagtttcagagactccttcagcgaccagcaaccattggggtcgatggttatgcgcgcatccgggaagcaattctttagcgccttgatggccttgatctcctccttaccctcgaagacaccacccttcagcttgaaatcatggaagccgaagcgctcctgagcggcttcggcctggtgtacgatagcctccggggtcagggcgggctcgcgacggacacgtccccactcatcggagttgtcatcgtcgtggatgtagggcaggtcggtcttcgtgcgatcaccgacatagaacaggtaggccaggaagcgcacggagtcgcgctgctgtccctcacccagcagagccgccaccggcacctcaaggtgcttgcccatgatgtcaagcatgggcgtttcgacgccggtaagcacgttggtgaccttcttgaatatctgcgcgtgagcagtctcctgacctgtgggctgagctttgccctgaatctgctgctccagcatcgtgcgacaggacctcaccacgttcttccactgcgagacgggcttgccaaccacgaggggtatgcaggactccaggcgcttggtaatgacctcgccaccaggtacctctcccacgccctcataaccctgtgagtcatgcatcacgacgacgttccgcgtgaaaaaaggctcgtgagctccagcctggttcagcagcatactgtcatagcctgctacaggaacaacttccatactctcgattgtaggtaccatgccatcctccgtttcccagggccgtttgtccttcagcaaacaaaacgataggttggttcaggacacatagccatggactcagtaacagaccgtccaggccatatagggagttgtagctgtcatgcataacatcatgtatcatattacatagtgatactcatcggacgaaagaccagagacgtgccatgaacttagaccccaaaatcgcaaagagcatcgtgaccagcctgaaggacgtggtcaaccacgagattaacctctttgacacgacgggacgcgtggtggccagcaccgatgcctcacgcgtcggtaccacgcacgatgcggccaggcttgccgcaaagaccagccaaacggtagcagttgacgacagcgaccagttcaagggtgccaagcatggaatcaacgtgcccgtattgttcaacggagccgttgtggcagtcgttggaatgaccggcgagctggacgaggtcagctcctttggcaccatcatcggaaggatgacagaaatactcattcgtgagaaccacgatcaggtagtccgattcgacgcaatggagcgcttctcaaaccttgtgaacctgctggttctaaagcaccacgatcacagtctcgtagactaccttgcctcggtgctgaacatcgacttttcgattcctcgcaaagccgttgtgggaagacgtgccgacaacgagcggatggacaaaattggcgacgtctaccccatcctctacgcgcggttatcccaggaacccggctgcttcttctccacaaccgaaaaggaggtgagaatattcgccaacagggagggaagcaagctctccacctttgttcgtaacatccataaggacctcgagaaccatctggacgcggaattctatttcggcgtaggcgacactgcgatgtccgaggaagagtattggagaagctacgagagggccagcagggcattgagttggtcgctgttcaagcatgaggggaacgtccggttttttgagagcatggacgagggcatcgtctttacggccatcccaaaggacgagtccgccagcttcgtgaatcacgtgttcggagatctctccgacaaagaaatcgatgacttccaagtggtgttcgattcgtacacccgacacaacggaagcattacccacagcgcagacgagctctttctgcacaagaacacgctccagaacaggctgaacaagattgcacgcatgaccggttataacccccgagacctgtcagactacgctgtgctctccatggcgttcaaactcaggagctatctacgccaaagataagtgcttcgctggtaaaaaagttcgccctatacagaaaaggtccgcgcagctcaaaatgaactgcgcgggccccctcttctgcttttcgatgtctcgctatacaagacctagggcatgaacacgccggtcacgatgccaaacagaacgacgacgacgttaatagcccaaagcttgaggaacgagaacttaatgtgctcgtcgatcgtgattccggtaaggtctgtcgcaatgtagagctgcggctgcgccacaaccgagatcatcgagccaaagttcatgtagagcgctgcaatgacaacctgcgcaggcacaccatactgagccgagaaggcaataatcaggggcataagcgcatagaaccaggtatcgttcgtgaacaccagcatgagcggtgtgctgcacagggcaatgatgagatacaggtaggggcccatgacagaaggaacgatggccatcagcaactggaccatggcatcgagcatgccgctgtcctgcatcacgccgacaacgacacccgatagaagcactgcgggaaggacggggaacaaggagctggcgtacttcttgagcagcttgttctgctgcttcaaatccctatagttaacttgcaggctaataaccaggccaaatgcgaatacgtagtactggggaatgctgctgaatgcgatgaggcaaaacaccaggaaagcagtgaacagcaggttaaaggcaaagcgattatgcctcgtgagctccgtgtccttgaactgagctaaaagctcctcgttcgagatctcgatgccctccttctggttcttgcgctccttggcaccaaagtagagggcaataccaatgaccaggacaaacatgaaaatctgaatcgggacaatcttgataaacaggtcggtgccggtgataccctgatcggcaaccaaggaagctgcacgcagaatcttcgggttccagggcgtattgcacatgatgagaatggcaacacaagtcaagaaaggcaggatcttcttgtcgacaccaaacttctcgtagaggggaagcatcagcggaactgttatcagaaacaccgacgtgatggacccatcaagctcgcaaatgcacgcgacgattaccgtcagcacacagatgaccggagcggataccttaatgcgcctcatgaggaacttgacaatgtcgtcaaacatgcctgtgtccgccaccatcatgaaatatggaagcgagaagagcatcatcaaggagatggacgtcgtctttgagaagccgtccttgagccaggtgccaaacgtaccgggaagactagtgatgtccaccgccgtgaagctgcccgccgccacataaacggcaatcagccccgcaaccaacggaaacaccgtgaaggcaagcagcgtgctcaccttattcttcagcagcacgaccgtgatcacaatcatggtcgcgaatccaagcaatgccaatcccaagttcacgtagacccctccaatcgacagttcctcaccccgcgaagcccgacggagtatgacgagactaacgaatgttgagctgtattcatacagttcccttacctgccacatatcgaattctacggtgactatcgtttgccaaaaagtctgcttggaacaaaagagtggcttccgagcaacttaaatcatgttctgcataacaatgcctctgaaatggcaccgcgtgatactactttcacgaaggtcctgtatcagaagtagctggagaggaggagaacacgatgggacagaaaatcttctacgcacccgtgaaccacccacacctgggcgacgagctcaacctactcttcaaacatgccatcgatgcatactgcgttgcaccgcacgtttggaacatgggcggaaacgacgacgtctgcgcctacttgatggacacaggcgacggactcgtgcttctggatacgggatatagagcgtccgtatacctcatggtcgaccacatctggagactgaggttcgatcccgcggacatccataaggtgctcttgtcgcactggcattgggaccatgcgaacggtgcatcctacattcagggtctctcggattgcgaaatctggctgtctcagcaagacaaggttcttcaccagaagtggagggatgacaccagcgaacttccgatggttccttatgacgtggcaaacttctacgacttccagaagcccatagaggttggaagtatgtccatccacgtgcagctgacgcccggacgcacccccggggcggttgtattcttctttgatgacaccgacgaaagcactggcaagacctactgctgcgcaatgcacggaggtttggagatcccgattatgaaacccaagagcctccagaagtgggacatcaccgaagtcatcgtgcgacagttcattcgcgactgtgatgagctggaacaactagatatagacatcgcctttccaagccacctaaacatgggcaacgtattggccaacatgccagccaataaaagcgactacagcacctgggttgccccgtacacatggaagcacatcgtcgaaagtcgcaagaggctcgtgcagacctactacacaaagagcttctttgagggcaaaggcaaacaagccgatcactaaggagggaagcatgggcaacaagctggtagtaaaggtcaacgaacacgacaacgtcgccattgccatacgcgaccttgctgctggcgaggaggtggcgcccggcgtctttacccgcgaacccatacctcaggcacacaaggtgacgctcgtagacatcccaaagggtggcaaggtcattcgctacggcgtcgtgctgggaaccgtgttcgaggactcccccgccggcacctggatcaacgaggactcactgaagctgcccatcccaccgccgctggaccatatgcagtggggcaccaacgtggactggaatccgccaacgcctcccatcaccacctgggagggatacaagagtcccgacggtttctatgcgggcactcgcaactacctggggattcaaaccaccgtgcagtgcgtcactggtgtgctgaacgtagcaatagaaaagattcgtcgtgagatactaccgaagtatcccaacgtggacggcgtcgtgcccataaaccatgcatatggttgcggcgttgccatcaacgcgacggacgcttacattccacagcgcatcctgcgcaacatcgccaggcatccgaacttcggcggagagttcatgctcgtgagcctggggtgcgagaagttcacgccacagatgttctgcgaggaccgtcccgaggacaacaaccccgataacgtcatcgtcctccaggagtgccacggcttcgaggatcaggtcaaccaaatctgtgccatggctaagcgcaagctggcgcacctgaaccagagacatcgcgagacgctgcctctttccgacctcctgctgggcgtgcagtgcggtggctctgacgcattctctggcgtggcgtcgaaccccgccatcggctactgcgtggacctgctggttgctggcggaggaactgccatgttctccgaggtcaccgaggtgcgcgacggagtctaccttatagcataccgctgcaaggacgaggtgaccaagaagaagctcgcaaacgagatgcgttggtacgacaactacctcgcgcgcggcggcgcagaccgtagcgccaacccctccccaggaaacaagaagggcggcctctcgaacatcgtggagaaagctatgggctccatcgcgaagtcgggctcctcgcccgtggtcgaggtcctgtccccgggcgagcgtccgaccaagcacggcctcatctatgcagccacgcctgccagcgacatggtctgtgggccatgccagcttgccagcggcatcggagcccagctgttcaccacaggccgcggaaccccgtacggtctggcagagattccaattctgaagatttgctcgcgcagcgaggtaaagcagatgtggcccgacctcatcgacatcaacgctggtcccatctccagcggtaagcgtagtatacaagatgtgggcacggaacttttcaagctactgattgacgtggtcagcggccgtaagcagtctctggcagaagcgtacggcctcgcaaatgacctgtgcatctttaaccctgcacccatcacgtaaacaggcgcccaccagtcatccatcagacggacaaaagaaggtaaccatggtacgttatgcaacatcatccgaccttaccgccatctacaacctcatcagcacgaccatcatggatgggcaccagctgaacaagggacagtttgcccatacctttgtggatcagctgaacgaggagcgccacaagctgggcgtttacgagaccgaagacggcaaaatcgtgggcttcgtcggtgtcaactgcacctggcagctccatgacggtgcacgcattgccgaagtcagcgagcttactgtcgcagaggagtatcgcaatggtgacattcgcttcaaactgctagagtgggccgtcgaggtggcctgcgaggcggggtgcgagaccatgacactcaacagcaggttgggccatgacgagagccataagttctacgagtcctatggcttcaagaagacccactatcgcttcgacaggactctgtagctgcgacatccataacagttagaagacagaagcaagccgattgatttcccagccggcttgctcttcttgcaagcaaactcttaacacgcgcccgccctagtacccgcgcagcacggcgtcgaagtagcgatgctccaccagaaggtcagcccacgccagacagataagcacggcagccagggggatcaacgcgctcagcagcgacgtgtacgagaagaacccgcacatcacggtcgagacgatcgcaccggccgtgaagcacaggaacagcaagacgtgcgccttcagtttgcgacgcaggtcgtgactctcggggtaacagatcagcatagccagagtggcgacaatctggcggatgtggttcgtgacgaaggtcgtggcaacaagcaggccctccatctggcagtaggtgttgaactgcatggcgcacacgaagttcagcgtcacctggcagatctggtcgagccagtcagcgggcatcagcgccaggaacacgaccacgcacatctccagcgccaccagcagcgtgtcccagcgcaagaagtgcagatgcttcatgcccttccctatccactccgagaggaacgagccaaacagatacgcgctgatgagcaacagcaggtacgccgccgagagccacttctgcctggccaggtacatagccagaaatactacgtttgcggtctgggcattgcagaacacgccgctgcgcagggcagaagtgtaggcaccgtaacgcccgctacgaagatcaagaagccaaaagatccatcgtcactcgtactccagagatactcgaccccatatcccgctccttgccacatttggttgcatctccatcgcgcgcaccatcgacgcgctactaagcgcactacgcaaatcactgtagttttggacaaaaccgacgctcctatagatgtcaagagcctgggcttcgacatctatcggcatgctctcgagtacccaggtggaataccctctcgcgaacatccaactctcgcaccttccggactcaaatccgctcacgtggaaggcgacacctcgagggcctgcgcgactggcctggttcaggccggcactctgcgcgcctcgagcgagaacctgtcgacccgctcgacccctgagtgcatagcgtatggtagaccctcgcgcgcgatgatctctcgacgcacctgattgcctcaagcttcgagaggggtgtggctccgacatgcgccgcttaacgtagcctttggtccttggggtcgtattcatgcactcatcgcgacggtgtgcaaggccttgttggcacgccggtcagcgcccctgttgaggtgtatgcaacccaagtcttgccagacgacgccggatgggcgatgttaagcggcgcatgtcggagccacacgccctctcgaagcttgaggcatcaggtgcgtcaagagagacatgcgcgcgaggtctaccatacgcttcatgcactcaggggtcgagcgggtcgcgaaggttctcgctcagggaggcgcgcaagagtgccggcctgaaccaggccaaggtcgcgccgcctcgaggtgtcgccttccacggttgagcggatttgagtccggaaggtgcggaggggatgttcgcggagaggtattccacctgggtactcgagagcatgccgatagatgtcgaaggcccagctcttgacatctataggagcgtcggttttgtcccaaacacagtgatttgcgtagtgcgcttagtagcgcgtcgagtgaggtgcgcgcgatggagatgcaacaaatggaccaaaggagcgggatatggggtcagagtatctggagtacgagtgacgatggatcttttggcttctgatttcgtggcaggctggtacggtgccttacacttctgccctgcgcagcgggtgtgttctgcaatgcccagaccgcaaacgagtatttctggctatgtaccggccaggcagaagtggctctcggcggcggacgtacctgctgttgctcatcagcgcgtatctgtttggctcgttcctctcggagtggatagggaagggcatgaagcatctgcacttcttgcgcgtgggacacgctgctgggcggtggagatgtggtggtcgtgtcctggcgcgtgatgcccgctgactggctcgaccagatctgccaggtgacgctgaacttcgtgtgcgccatgcagttcaacacctactgccagatggagggcctgcttgttgccacgaccttcgtcacgaaccacatccgccagatgtcgccatctggctatgctgatctgtaccccggagtcacgacctgcgtcgccactgaaggcgcacgtcttgctgttcctgtgcttcacggcggtgcgatcgtctcgaccgtgatgtgcgggttcttctcgtacacgtcgctgctgagcgcgttgatccccctggctgccgtgctttctgtctggcgtgggctgaccttctggggagcatcgctactcgacccgcggcgtgcgggggtactaggggggcgcgtgttaagagttgcttgcaagaagagcaagccggctggggaaccaatcggcttgcttctgtcttcttaactgttatggatgtcgcagctctacagagtcctgtcgaagcgatagtgggtctcttgaagccataggactcgtagaacttgtgactctcgtcatggcccaactgctgttgagtgtcatggtctcgcaccgcctcgcaggccacctcgacggcccactctagcagtttgaagcgaatgtcaccatgcgatactcctctgcgacagtaagctcgctgacttcggcaagcgtgcaccgtcatggagctgccaggtgcagttgacacgacgaagcccagatttttgccgtcttcggtctcgtaaacgcccagcttgtggcgctcctcgttcagctgatccacaaaggtatgggcaaactttccttgttcagctggtgcccatcctgatggtcgtgctgatgaggttgtagatggcgagaggtcggatgatgttgcataagtaccatgggtacctcttttgtcgtctgatggatgactggtgggcgcctgtttcgtgatggggcagggttaaagatgcacaggtcatttgcgaggccgtacgttctgccgaggactgcttacggccgctgaccacgtcaatcagtagcttgaaaa

SEQ ID NO: 280 - DNA, 5963 bp, Unknown
  Metagenome-assembled genome
acagcaaggcgctcaaggcagtggcccgcaagaggctccgcgtcatctatgcaatgatgcgcgatgagatgccatatgtggagccgccggcaagcgatgtagaaaagtcgcctgctgtggcttgacaattagaagggcatcatagggacaccccagttaccagctgccttatcatatggtgcagaagtagtttaaatccgcggtagagcacgtaaaaagatactctgaccaccttatatgtgagatgatagaagcgtttttgagcaagcagcgctgcaaacctgtatatagctcagagacctatcagaccccatacaaagcacctcgaggggtcgtgtgcacacaacgcatcgtgaggaaggagcaccacacccgtgaaagcctccccatcatccgacacttttatcgagacactcaggcgaaataaggcgtatatcttcgcactgatagcactcatgatcctcttcgcaatcctcgaagacctctttaccgggaacatcctccatatggatggaatagcctacaacctctttgtcgtgaaactgcgccgcagatggctcactccttacatggaacagttttccgatcttgcctcccctgtcatcctgggagtgttctgtttgattgtcatttccctcacttccggggaaagactgggacgctgcattctgatcaacctggtctgcgccgtagcgttgaatttcattctcaaagatatcatccagcgtccgcgcccggaaggtttccgcctgatcagcgaggtcggctttagtttcccctcaggccattcaatggtggcgatggcattctttggattgattgtctggataatttgggtctatcagaaaaatagggcactcaagtatatctcatgtgccctgctgtgttttgtaatcgcaatggtcggtatcagtcgtatctatcttggtgttcactatgcctctgatgtggtatcgggcttttgcatctcactgctctggctcgtgttctatactcacacgatcgctccatactacatgggtacgcacgtaacccatgctttcaacaaggaggcacaaccgaagcatatgaaagcgtaaacaggctgctccaaccaaagcgcgatgaatcaagaaagagtggcctcaccatgagaagccgatagaagcaggatccaagtggataatctttgcatcctgcacttctccgctatccacgacaatccatcccatagtcgggccatcttcagcgcgcgggaaggttggagaaccaggattcatcaccaaaaggcgcttcttggattggtcgataaagggtttgtgcgtatgaccgcagatctcgataccgccgagctggggcatcaaacgctcccgatagtggcagacctgccacagcaatcccccatagatgaagtgaagattcttcttcacctgaggggcaaaggaaaagccgtaatcattgttaccgagacagagcttcaatagggcaatgttttccagtgttttgatatcctcagaggaacagatgtctccagcatgcacgatcaggtcggcatgctggagatgcttaagcaaatctttactgagaaagccgtgtgtatcggatacgaccgcgacctgttttgccacaatggtcccttagagtccgagtgcgtgtttcaactgcacaacacgtctgcgtgaaacagagatcttcttgtcggtgatgccattgactccgagctgcagaataccgctcggcagcacctcaacgtcctccacgtactggaggttcacgatataacctctgtggacacggaagaatccgtgcgggataagctccttctctaagcgggcaagggagattgtagagagatagcgatcggtgtccgtgtatatacaggagtaatcgtccttggcctcaatgtagcggatgcggtcaattggcacgaggactttacgcccacctttttcgaccgggatgcgctcaatggaggctcgcttctgctgctccggcttgatgtgcgcctgcaccttgtcgagcgcctgattgaggcggtcggtctcgaccggcttcatcagatagtccaccgcgttcacatcaaaagcttcaagtgcatactcgctgtaagctgtgacaaagacaaccgcggggggatttctcagtttatgcagggcttctgccaattgcatgccagaggttttcggcattgagatgtccatgaacatgacgtccggacgtccctccatcagcttctcaacagcctcccgggcactgccagcttcagtgatttggtcaacgcgaccggtctgtcgaagaagatatctaagctccgagcgtgcaggtacctcgtcgtccacaatcatagcgcgcaacattggtgaaaagacctccttgatactttgaacgccctatcaagtttacctatatttttaaaggtttaacggcctgtaggtgaaagccttcatcacacagcatcataaccgctactgctttgataaatcaagcgtcttggcaacccctgcaaggcgcagcgctacctgtgtgcccctgttgacctggctcacgacctctaatccggaaccaggaccgaagaaccgcttcacgcgctcccccacattgtgcagggccatcccacttccgtgctcacctgatctgtgctccatggggtggtattcgacgaggcacttcctcgtctcctcatccataccgacaccgtcatccgtcacggcgatcagtacgtcgtccccgtcaaccaccgcatggatatcgatgcggatcggtccctcgtcgcgcattccgtggcgcaccgcgttctcgacgatcggctggatgatgaagccgggaaccattaggttctcaaggccgggctggatatgctcagtctccacgatccggtcttttccgaagcgcgcatattcaaaggtgagatagcgccgggtctgctcaagctcccgggaaagcgggatgagctgttgtgagctctccagggtctgccggtagaaggaagcgaactcacggagcagttcgcgtgcctgcatcgggtcagtgcggatcagcgccgcaatcgtattgagcgtattgaacaggaagtgcgggttaatctgcgcctgcagcgccttgacctccgcgcgggccgtgagctctgcctgcaggtccagctcataggaggtgagctgtgtagagagcagattggcaagaccgcgggcaatcgcgatctgcgtccggtcgatgtctgagccatgcttgaagtagaagatgatagcgccgacgctcttcttttggaccgttagcggagcgatgatgcccgtcgtcataatctcatgcttggtattcgaatcagtccttttgttttggagctgcagtatctcaggacgggaatactggaacgtctgcaatttattggtctgcagcacgttcttcgtatactccccgatcggtgatcctgaggtcactgaccccgcattctcccccacataggccaagaccctcttggtgtcggtcatggagatcgcatcagcgtgggtctcggggagcaggagcttgcagaccgcaaggcagctgtcaggcgtcaggccgttacgcatatggtcaagggtgctcgaagcgatccgtaaggttcgctcggtcgcccgtgactgcagcgtctcagggtagaccaaggagaagctgcctacgacgataacgacagcaagggcggcaccgatgatgccagtgatgatgctgctttcggaagcgatgccccatcccagcacgatcatcaacgtgacgctcactaacagcagcacaaggagactgaagatcgcaacagtattatttctctgatcctccatgcacctattcgtcgcccccagtaaggttttggctctgcatgatcatctgctcaatgtctgttctgctccacagcgatgccatgatcctcggccagaaagtctggaactgcaggtagctttgcgcatgccttcgagcccaacggcgtgcctcaaagcgtccggacgcccaaatggtgaaataagtaaagtgctcacggtccacgagcgcatgtctgaaggaagtcttcttgatgcgctcaaacacctcttgggacagccagggcgccggataaggctccagcgattgacgggtgataatatgcaggtcacgttgggtgttggagaatctcaccttctcatattcatagctccaccgatagacgtcctggaggaaccgtgaggccgcagaggtcgtctcaggtggattgtgcttcacataccactggttgtcgaaccacacctcacgcccgtgcatccgcatgttgatcagatagtccatatcctcaccgcgggtgatgtagggatcgaatgcgatacgggaaaaggcgttggcgtgcagcgcgaagcagcctccacacacatactgggagtgtgaaatcctcgtagattcctgcgcgatgtgcatccactcattgaactccgagcgcttagcccaatatttatcggcccaccggggatgctccacatccgcatagcaggaaccattcgtatcaaggaaatagcccgacttggcatcaatcggcagatcctgccgatttacattcccaagaccgtagactgcgtcaatcagaaagttctcgtcgaccgccgtctcatcgtcgtccataaagaccgcgatgtcgtaccccagcactgcggcgaccaccaatcccatattgcggatagcgccgtaaccgcgcagggagaccggttctccactcacatcaggggcaatatcactgacagcatctttaatatagcgtccctccgctgaccctatgaccagtgggctgaggttgggatgctcccggcagatagcgtcaacccgtgcccgcgcctgcttctcatagtcccgatccacgacgagcaggataatgaccctcagaaccccacgcacctgttcaagtgagacgagacaggtttccagatcagggttttgggcgtcgagtggggttgtatggtcgtaagcacccactttccgtttcgcctgcttttcgcgtgcctgagcccaatacgttggaataatgattgcaggtttcaagcttttgggcccctttctgcacctgtaggggttgaacgcaatcgatcagaaagcgatgtctttgcaagagcatggtagagcggcatccctaaggcatacatcacaactgcctcgccgatgcctacagtcatagcaccaaacagatagaccaggatataggattcgctcagtgagattgaagtgaaagggatcgtcgtgaatcccagagcagtcagcatcagcggtaaatacgccggtacgatcaacgcattgaacaagaccggtcccaccagtgccagtttcggtttatcgtggaaatgccaggtaaaggtagcccctaacaacgtggcaagcgacccgaagaccacatcgagcagccccaaggtgccagttcctgacaacgcgatatttacaatgttggcaagtgcgcaccccagtgtgagtccggggatagcgtcaggagtaaagagcgcgagcacgcacagcgcctcagagagcctgaattggatcggcccccacgcaaggccacttaaaaagagtgtaacaatcagagtgagtgcggcataggtagccgctatcatcccaacgcgtgagatgtgttgagtacgcgctggtatgtgttgcgatgtagcgttgcgtccagtcacgccaggacctcctccgtgcttaagttcatagtttagtgtaccgtatctgcatctatcagatagtagcaggcattaatctgtatcattccctaacattttggttcaatcctaaaagctgtgggccgatgcccgaagcgcagtgcgcgcaaagacagagaggcgcggccctcctctagacgatatgacccgaacccacagagcagggaggatctgccgcctgagttgaagcagggcctctcaaggcccagaatgattgctgctgcagcaacgagaaccggaaggcccctatggacaagactaccatcaacaaggcagacatggggacgg

SEQ ID NO: 281 - DNA, 48065 bp, Unknown
  Metagenome-assembled genome
acccttggagaaatcgtcatgcgaatagaaggaccctacggcatgctctacattacgcgataagattagcagccgagcttaaagattcaaacatggttgcgtcgcaagcacaggattatctcacatcctgaaaggaggagggcaatatttggtggcttaagtgtaagaagcacgaaggaagaacaagtcttgcaacttcctgtgcagggctaagatatcagacacccgacagttgtagtgaagcaaggactttcagggcggcctctgacccaacttcctggggctcactggcttcttgcagtttgaagatattagcgacaagcccgattgaactttatccttacaactgtcttaatgggcccccactaccgcagatagacaaattagtgctgtgcttgcctgctatcgtcgtgcgtaagcaaggtaagcgaaaagcactcgcaaccccgcagccgacgaagggccgccactgctgttggccgcaggagtggatatgattcttttccgaggaagggtatcaccacagcgtatgccacctaagtggctgccttgccaacaaccagaaggggttaaggcctttttgggagaggactcaagacagagagtttttgcaagccgccaagtgggacggggactccagttcgactaaccttaggaacggtttgaaaggagggcatcgatcctgtatgtctagggacaaccacgcaaggcatcaagcgttcgcttaaggcgtgagcccaatggagttcaggaaggctttgggcttggccagtggaacgctttaggatatagcgatggaaatggtagggattacgttaccaccctcatatgtcggttatctgcaccaataattgacagcatttagtacataagcgggacacacctggtagatatgcttaaagaggatgtaaggtgacctaaaaacaggctttctgtggaatcaggtgtttcatcttatagaccaacgattgcagggtatacgcccgatcttcgggcccgtgataggagtttgtctgtcgtcgaaataggggcttgcccctgatcggggactcggcgggtttaacggctatgttgcgattgtgtgagggacagcaaccccaagtgtctcatcgtgtcatcgaccgtgcgaagatagtcaatagtgggtcaatcctgaagacttccaatgcaggacagcgccggccgctcaagagctgcgccggtcgtaccatcctactgtctctgcgataatgacaacgactagataccctagatgtgctgttgtagtaggacgaccgcgcttgtcctcttttaataggagactatttttgggaagccgaccgttctgttagtcagctactctcaaatagagctgcgtgggccccagttagcaagcttcgccttggtgacaacagtcaggcggtcggagaacagcggaaaaatgcatagactgcatgccatttcttctctgcatacgtgataggcctgctcgatcttccttatcggagatcggatgatctttcgcagctcctttggtccaggtcagcttcaccgttattggtgaagtttggaaagcgagaagtactgccatagagctgcgtgcgcattccagaccgtaaggcaagggggaacagctgaccaacgggagaacaggcagacatcccagttgccggaggcaaggacctttgagaagtcagaggatggatgagagtcgatctcgacatccatgccagcatccttagccatcttctgaatagctgcagagcgattcttgaccgtgttagagtcgccgaaggtggtgaagccgaaggtgaccggctggccatccttctcgtagatgccactgtcgttctgcgtgtagcccgcatcctcaagcgtctgctttgcggcgttggttctatcctcagcggagttcagattcttgatgtcgtcaggtctgttgtcctcatagccgtctgcccaatacgggaccaacagtgagcccggggtatcctcgtcccagttgacgccctgccagatgactgaacggatggttgccggatcgatgcactgccagaaggccttacggacattgatatcctgcagcataccgtgctcagtattgacctcgatgcaggcaatacccagagagttgccacgacggatggtcgtatcgtccataccttcaaagttagagagcatctcctgtgagccagaggcggcaaagccggtggtgtcaacctcgccgttcttgaaggcattgtaggttgcctgagcgtccatctgcttgtactggacagtgtcgagcatcggagcatcgccccaccactctgggttcggcttgaaggtaacctgtgtgttatccacggagtcgaccgtgaacgggccggcgccccactcggggtgcggattgttattccagctgttccaagcatccggatttgcggcatcaggatgcagcagtgagctgacaatcggttcgtacggatagaccggatcggagaaggtgaggatggcctctttgtcagaagagcctggctcgatagactcaaccttatcataaccgtcggttgaagccggtgtatatgcgtcattggtaccgttgcagacggtccagactgcctgcagtgcacggtagtcgatcggggtaccatcgttgaaatgagcattctcgttgaagtcaaccgtgacgacctctttgccggagtccatagatgagctcagtgacgtgatgaaattcggatccggggtataggcggtgatggttgcatcggtcgtgatcgtggagggcatataccagctccagagctcctgcatcgttgcggtgttgccctcggtggagaatacattccagttcgggccgacctcacctgccggaagcgtcagcgtgccaccctgctgaatattgtcacggggctgcgggttgttgtaggtcttgtccttctcaggcagcggcagctgatccagcggagtcgttgccggagaacctgactgtggctcagcacctgtgttttgagcaccgttgttattcccggagccactgttggagttgccgcaaccggctaatcccaagccggcagctactgctgcggctccacctgaaagctcaagaaatgagcggcgtgttacgttcaccatgattttgtttcctctcctacactgtgaggttcccctattgcgcccactttagcgcgatagactatatgtacacaagtatactaaatctttgagttttgtagcattttttcttttcaacaaaggtctgtagacccctaattttctggcatatagctgtcttcattcagtatggctgtatctatacaagcaagggcacgccactcacgcgacgtgccccggacatgtcgttgaggttttatccctacagcttgatcttgagcaggctttctgctggaatcagccttccgtccttgtagaccaaacgcttgcgagtacgctcgatcttcgggtccggaatcggaattgcagagagcagcgcctgcgtgtacgggtccttcggatgcgtaaagacctcttcggtgtcaccgtactccacgatcttacccaggtgcataacggcaaccgagtcggagatgtggcggataaccgccaggtcgtgtgcgacgaacagataggagatcttaagctctgcctgcaggtcctcgagcagattgatgataccggcctgaatggagacgtccagtgaggcgatcggctcatcgagcagcaggatcttcgggttggtcgcaagggcgcgcgcgattgcgatacgctgacgctgacccccggagaactgtgacgggaagcggtccacatagtcggggttgataccgaccagatacatcagctcgccgatacgcttgttaatatcagcgtcactccacttctgtgcacgcataggctctgccaacacatcgtagatcggcatacgcggatccagggagctcatcgggtcctgaaagatgatctgtacgttctggcgcatctttctgcggtccgtagactttttgatatcagagacatcttgtcctaagaccttgatggtgccgctctcaggcttctggagctcgatgatctgagtcagggtcgtggacttaccggagccagactcaccgaccagcgccaaggtctcaccctcatggatctggaaggagacatggtcgacggcggtcatggttcccttattgcggcggatcagacctttgccctgaatcgggaaggtcttcaccaaatctttgacctcgagcacgaccggacgctggtcacggggaacatccgcccactttgcgggcaggggctccatctcgggatagacgtccttgaacgtcatgttcttagtcttgatctcctgccatctgtgacatgcgaccaaatgtccttcagatgtgtcatagggctccaggtgtggctcaatctcgtggcatatcttgagcgccatcgggcaacgcggcgaaaaggggcagccggacggaattgccgccattgaaggcggattgcccttgatcgggaccagacggtgatccgcagccatatgcggctgtgggacagcgccaagtaagcccatcgtgtacggctgtgatgggtgatcaaacagtgagtcaactgaggcgcgttcaatcgcggcaccggcgtacataaccataatgtcatccgcgatacccgcgacgacgcccaggtcgtgtgtgatcagaacaaccgcagcgcccgtcttcttctgggcgactttcaggacgtccagaatctgcgcctgaatcgtcacgtcgagagccgtagtcggctcgtcagcgataatgatatcagggttgttagcgatagcgatagcgataacgacacgctggcgcataccgccggagaactcgtgcggataggcatccaggcgctcttcaggcctgtcgataccgacggtctcaagaagctcgatacagcgctggtgtacctcatctttcggcatatctggattgtgcaccagaagcgcctctgccagttgctcgccgatcgtaaacattggggtcagagcggacagcgggtcctggaagatcatggagatctctgagccgcgcagcggcgccatctcctcatcggtcttccccaagagctcctcgccacgcaactttacggagccctcgacgtgtgcgttgtcgtccagaagtccgatcagtgccagcgcggtgacggacttaccggaaccggactcaccgacgataccgagggtacgtccaccccacaggtcaaagttcacgccacggactgcgtcaacacggcctgcttcagtcgcgaaggacacacgcagatcgcgggctgacaggaccggctcacccttcgggcagcctttcggtccgttgccttccaacatctcatagcgcagaacctcatcgtagtgcaccgactcgtttttatcatcagccatatacaagctctcctgatctagcgtctcatactgatggttgaagcagctgcatcagcggtatccttgctgtcttcatctttctggtcaccgacggaaccggcagcacgtgaatacggatcgaaggcgtcacgcaacccgtcaccgatcagctgcatgctcacacacaggacaatcaggactgcagacgggatcagaacgatccacggcgcggacagcattgctgaagagccctggctcagcagatagcccagtgaagtatcaggtgccttgatgccgaggcccaagaaggagtaggcggtctcggaattaataccggaaatgacgcccaacaccgtatcgatgatgaggattgagcccaggttcgggatcaggtggcgcatgatgatcttgaacggggcgacgcccatgtactttgcggcacgcacgtagtcgcgctcacgcagagacagcgccatcgttctcagcgtacgggcgtagccgatccagccgaaggccgtcagtcctatgatcaggatgatccatccttgggtgccggaagccgcacgtacgatgattgcgacgagcaggaaggaaggaatgaccatcagcatatccagaagccacatgcagatcttctcggggatgccgcgcacataggcaataccggtaccgacaatagctgcgatgatggtcgtaagtactgagtagatgatgccgatcgtgagcgaacggcccaagccgtggaccacgcaggcaaacagatcgaatccgccaccgtcggtgccgaaccaatgcttggcgttcggtgccatattcagtgcggtgaagtcaggctcagtgtagttatactggcacatgaagggaccaaagatcgcgatcaagatcatcacgatcaaaatgatgagccctacaacagcggaaggctgcctcataaagcggcgaccgatcaaacgccagtaggaaatacgcttgacctcagtagggccttgggaatccgctttcagctcaagttcggcattggtgagctttctctcttcttgtctgttgtcttgattctgctcttccatcgccatctcctcagctcatctgaatacgcggatcgagggctgctgcaaagaggtctgcgagcagtgcgccgattaaggtgcacgcgcctgagaaggcggcgacggcaaccgcgccattgatattgttggtattgatgcagttgatgaagtactcaccgagtccgtggattgcgaagatcttctcggtcataacagcgccggtgaagatggaagcgatggaaaatgccacggaaactgcagtcgggatgagcgatgcgcgcagtgcatgctttctgatggcctgacgcttggtgaggcccttagcacgggcggtacgcacatagtccgcgtgcatttcatcgagcaggtaggtacgctggctcaggtggtagcccacagcggagatgatcgtgagaaccaccgtcggcaggaaaatgtgctgcaggaaatcaaagaacgctatgaacacattgccgcctgaatagcttgaaagcccggtgacatagaagattcgtgtccccgccgcctggtttatctcaatagcgaagaacacgatcagaatcgccaagacgaccgtaggtatgaccatgaatacagaggcgataccactccagaacctatcctgccactggtactgtcgctgtgcggtatagacacccagggagacaccgataacgatggaaagcacggttgccagcaacatcagctcgacggaagcaccgatacggtttgagacctcagcgttgacagagtcgccctccggagacatgccccagtcccacgtggtcacgatatcacccagccaacgctgatagcgctgaaagaccggcgtcttatcgttcatattcgtacggtcgagggaggcctcaatggattcctgaggaggacgaggcgtcctggactcgaagttagagcgtgggttcatgaatgcgcacgccaggaaatacgtcagcgacgttgcgacgaagatcatcacaatgtaggccaatatcctttttatgatgtactggataaatcgtgccattgacctctccttaatttccagccttgttttatatgagcaaggattacggtatggcaaaccggacaaaacctgatagtgctcgcacatgacgcgcactacgttgtgcacataaattattattttaccatgataaaaacctggaaaaggatgtataggcccttcactcgagaccctacacccgctgcttcccacccttacagcagagagcagacatactacctgctatggacttttctcatagcgacacatgatatgtttccatggctctgttaaattcttgttacatcccctaaatggtgccaagggggaaggtaagcgccataatcagaatggttacaacaaagataatcgaggtgatgaccgtgagatggtcgaggttcttttcccaaacaccagaacctgcggatgcgttatacatcgaagaagcaatgagctcagagacaccggttccctttcctgagtgcatcaggatcagaatgacggtgaaaatacctgatagagcccagataatcaacaagacggtattaagtacacccacgctttaacaccttccgcgtatggtaggacacacattgttaacagatacagctattcatagtaacacataatgcgctcccccaccttaacggcagaggagcgcatcaaaaacttatgtatacagcattcggcatacagaactagttcattgcggctttaaccatagcggcaaaggaatcagccttcagcgatgccccgccgaccagcgcaccgtcgacatcctcctcggtgaggaagcccacgatgttgtccggctttgcggagccgccatacaggacacggatagtgtctgcaagatccttgccgaagagggaagccagggtctcacgaattgctccgcagacttcctgtgcgtcatcagcggttgcagtcttgccggtgccgatagcccagatcggctcataggcgatcacgtactgattaggatccttgagctcgatgccgtcggtatccttcttgatctgctcgactacgaaggagacgtgctttccagcttcgcgtacctcaagagactcaccacagcagttgatcgggatgatgttgtgagccagcagagccttagccttgcggttgacatcctcatccgtctcgtggaaatagccacgacgctcagagtgtccgatgatgcagtacttggcaccgatattcgtcagcatattcggagcggtttcgccagtgtaggcaccagactcctcccaatacacatcctgagcacccagggcgaaaggagccttcttctgctcaataacctcagctacgcctttgagatctacggcaggcgggcatacgacaacgtcaactgaaccagtgccatctttgagctcgtcagccagacccgttgccagctcgacggcctcatcgtaagtcttgttcattttccagttgccagcgatcattctgttacgcatcgagaagcgcctccactcccgggagtttcttgccttcgacgagctccatggatgcaccaccgccggtggagatccagctcatcttgtcagcaagcttgaacttgttgatcgccgccacggagtcgccgccaccgatgatggaggtgccgccgttagccttgacctcaccgactgcacgggcaactgcctcggtaccgtgagagaactgatcaaactcgaagacgcccataggtccgttccagaagacggtcttcgcgcccttgattgcgtcagcaaagagcttctcggtctttggaccgatgtccatacccatacggtcatcgggaatattgtcggagtcaacaacctctcccgttgcgtcctcaccgaagtgatcggcgaggacattgtcgatcgggagcaggactttaacacccttcttccgtgccttgtcgagcatctcacgagcacggtcaacccagtcctcttccttgagggaggtgcccacggtgtggccctgtgccaggaagaaggtgtatgccatgccgccaccgataatcagggtgtcagcggagtcaatcaggtgatcgaggacaccgatcttagaggagactttggagccgccgacgattgcgacgaatggacgcttcgggtctgcaaagatcgaagtcagggtgtcgacctctttctcaagcaggaaacctgctactgctggaatgtaggcagccggtcccacgacggagccctgtgaacggtgtgcggtgccgaaggcatcgagtacgaagatgtcaccgtaggaagcgagtttctttgcgatctcaggatcattcttcttctcacgcttgtcgaagcggacattctcaaggaccaagatgtcgcccggcttgacagcctgaacagccttggttgccttctcgccgtaggtgtcgtcgacgaacttgacgtcgtaaccagtcaactccgccaaacgctcagcagccggcttcagagagagctcaggctccggtccgtctcccttaggacggccgaggtgtgacatcaaaacgatgcccgcgccgtgctcttttagatacttgatcgtcgggattgcagcgcgaatacgcgtatcgtctgcaaccttgccatccttcagaggtacgttgaagtcaacgcgctcgaggacacgcttgcccttcacatcaatatcgcgaaccgtcttcttcgtaaaagccatgttcactcctaacaatctcgtgtaaaaaatgagacacggccgcggctcgaaagctgcaaccgcgcctcaacgctcatctaagctatgtgactttaagcgacgaacttctcgaagtacttaatcgtacggaccatctgggaggtgtaggagttctcgttgtcgtaccaagagactacctggaccagatactcgtcgccgctgaccggcagaactgcggtctgggttgcgtcgaagagtgagccataggtcatgccgatgatgtcgctagagacgatctgctcgtcgttgtagccgaaggtctcaggatcagaagcagccttcattgcagcgttgatggaatcaacactgacaggatccttggaggtaacgaccgcatagagcagggtcgtggagccatcaggtacaggaacacgctgtgctgcgccgatcagcttgccgtcgagctcaggcagaaccagtccaatagcctttgctgcgccagaggaggtcgggacgatgtttgctgaagaggtgcggctacgacggaagttgcccttgcgctgcggaccatcaagtgccatctggtcgccggtgaaggcgtgaatggtctgcatgatgccggacttaataggataagcatcattcagtgccttagccatcggtgccaggcagttggtggtgcaggaagcagcagagatgatgtcgtcttctgcggtcagcgtctcatggttgacgttgtagacgatggtcttgaggtccttgcctgcaggagcagagataacgaccttcttggcgccagcgttgatgtgcgccatagcctttgccttggaggtatagaagcccgtgcactcgagtactacgtctacgcccagcttgccccaaggaagcttgcttgcatccggctccttgtagatcttgatggtcttgccgtcgacggtgatggaatcctcgcctgcgctaacctcgtgatcacgagcatagtttccgtgaaccgtgtcgtacttcagaagatatgcgagcatatcagggctggtaagatcgttgatcgcaacgacctcagagccctcgtgcgcgaacatctggcggaatgccaaacgaccaatacgcccaaagccgttaatagcaaccttaactgccatcttttctcctttcgcgaggccgtaccgaggcgaatccccggaactaacctgtatcgtctccttgaatcttaccgcgaatctgcgcatttatgcacattatcttctcagcgcaccaatttttggatcagtgagctggcccctgtctagcgatcagcggtcgttgatcgcgcaaaaacgcgcattacatgcatgttcccgcaggttggaacacttgtgtacactccatgaagacacagggtagaggctctgaaaactgtggagccgctcacccgttcaccgaattctctcattctcgtttttctcacttttggctgcgcttgcttgttcttgcgcttctttgaccaaattctgcaatctgagaacccggtggaagagtgcggacttcgaagcggtgggattgcagtgctccccaagcgccgaaagtgagagttccgggtactttcggcgcagccgacagaactcccggagcgccggaggcagattttcaaccccgatcagacgctgcgctttcccgatcaggatgagctgctggaccgcggcatcagaagagcggttagagttggcgatctccgcattcactttgcggtttacgtcattcttaaccgatttcatcttccggattgtctcaacagtgtgagccgaacgcgtcgcccccattgccttgagcagctgcacgatatcctcgtagctcttgagatagatcgcaaagagcccccgccgatggttgagccgcgcagtcaccccttggtccttcatcaaccgaaggatgccctgggccagaccttcgccggtgaccgcaatctcaaggtggaagtcaccccgcgggtcagcgatgaagcctccagccataaaggccccgcgcaggaaggcacgctgcgcctcgtcggtcttcagcagctgttcggggatgcctgaagccaaccctttgcccggcaccaggatccccaattggatgagatcctcggcaagcttggcctggttcgggatctcgatcagatagtttctcgtcttgtgcagtactgagtgacgtgtcgtcagcgtcgtctcgaggttaaggagctcatgggtatacttcagcacaatacgggccactgatccagtctcagtcgaaacgcggatggaatagtgaccgctgcctgaaaatgaaagcgacccacagatacggatcagcgcagcaagctgcgccacctccgcgattgcgggtccatgctttcttgaaagttcgtctttgacttctgcagtaaatgacatgctttacgctggcttcactgtgttggcgcggggaagatcacggtgcgtgatgctcacctgatatcccttacctttgaggtagtgggcggtcgcctcagcgatcgcgaccgagcggtgttggccgccggtgcagccgatcccgattgaaagctgcggcttcccttctttgacgtagccgggcatcaccacatcgagcagctgttcccaagcctgcataaactgtttggtcttcgggttgtccatcacgtaatcccaaacgtctttgtccagccccgtctgatagcgcatcttcggatcatagaagggattcggcaaaaagcggacatcgatcatcagatccgactcgggcgataggccatacttgtacccaaaggagaagacacgcacatccatcagctgctgctcggagagctcggaatagttcgcctgcagcgtggacttcaaaagcgaggtgcgcatgtgggacgtgtcgatcacgagatcggagatcgccttgatcggcgccaactgtttgcgctcccgctcgatcgagtggcgggggctctcccccggaagggcaatcggatggcgacggcggttctccttaaagcggcagatcagcacctcatcgctgcagtccaagaacaggatgctgtaggtgagctcgtgatccgtcagatccttcagcgtgctcttcagctcatcgaagagcccctggctcctcagatcgcaggcgaccaccaggtggcggttgacgccggtgttgatgccgaccaggtgggcgagctgcaggatcaggctgggcggcaggttatcgatgcagaagtaacccatgtcctcaaacgcatggagcgcctgcgttttgcccgatccgctcattccggtgatgatcacgatatcaggaatgtggtgctttgcctgttgggagccattctctgccacgtcaataccctctcatccttgggccgctctctgtacacgtacttgttatagtaccccatgcacccgacctgatggggtctcgcacatatcgaactgaaaaagagaccccacatctgtgtgaggtctccagtctcaaagtcgaggtgttttctatcggttgaggcccatcgcggcacagaaccactcggtcaggctcgtggggtgcgtgatgccggttcccacaaccaccgaccaggctcccgcatcgcgggcagccttcgcgtctgccggcgtgtggacatggccctcacagatgatcgggaatcccgggaactcctggacggcctgcttgagcagcgccaggtccggcccctcacccatcgtcgtctggatcgccggcttattgtggctgagcgtcgtcgaggcgatgtcacagccacacgccacagcgtgcctgatgtcctcgatcgtcatgcagtccgccatcaccagggtgccggtccgtcccttgagttccttcacggtcccctcaacgctcaacccatccggacgcggacggtccgtcgcgtcgagcgccacgatgtcggcgcccgcgtagacacaggcgagggcgtgacgcaacgtcggggtgatgtagaccccttcactcccttccttccagataccgatcaccgggatctggacgcggcctttgatcgccgcaatatcggagaggccctggcagcggatcgcggcggcgccaccttgctccacagcttcagccatctgtgccatggtctcgggatgacgaaggggctctcccggatacgcttgaaccgaaacgatcagcttaccctttaaagactggatcagcggtgctatctccatggtggtatcccctctctctttgtcactggatatcgatgtaggcgctgcgcagaacattctgagccgcaccgatcagcggtgcgttatcgcccaaagtcccctgcataatcggggtgtttgccaccggcggcatcacggtctccgcccagccctccttcagggcgtcgtgccacactctcccgctcttagccacagaacccgagaggatcacgcagttggggtcgaacatgttcacctgcgatcccagcacttctcccagtgcatggccggaacggtgctctgcctcaatggctgcctggtcacctctgtcagccgcttcagagatcgtcttaccatccgcgtttggcatcgctttgtcacctgcgagttcctcatagtaggagatgatccccgggccacaggcgatcggctctaggtgccctatcgccccacagttacagggggtacccttcgcatccgtgcaggcgacatgcccgatatggcccgcctgtgaatgggccccgagcagaatgtgtccgtggtccacgaatgcgccgccgatgccggtacccacggcacacacgaggctgtactctttgccggatccggcaccccacatcgcttcgccgaaggcgtgggcatggacgtcgttcatgacccgtacaggcaggttgaacctgtttcgcagctcctgccccaggtgggtaccaccccaaccgggcatcatctcgttggcgtaggtgacgtccccagtcttggggtcgatcacgccgccggaggaaaccccgatgcccgcgatctggtcggatgcagcatcgatcacgcgctgggcactgtcgagcgcgacctgcagggtgtgcttaccgccctgctccgccccggtcgggaccttctcatagaggctcacctgcggcttcttgccttcctcaaagctcaccagtgcagaggcgatctttgtgcctccgatatcaagcgcgaccacctgtgtgatgtctgccataggatcgctcccttctcgttttgcaaaatgctttacaggaccttgttctcgacgaggaccttcttgatcgcctcacggttcgcaccctgcagcgacctgaccggatgcggcatcgtgtcgtggtcgaagatacccatcaggttcaaagcagtcttgaaggcgccgacacctcccgcatagcccacgacacctttggtcacgtcgaagatgtgtgagacctcgttgatctggtcctggagctccttgaccttcacccagtcgccggcctggtacgccttccactgcgccacatagagctcagggataacattggccaggcccggcaccgagccatcggcaccggagaggtacgccccgtcgaccacaatctcgtggccagtcagaaggctcatcgggtgcccgatcttgttgttggcctccaccaggtaacgaaagcctatatcgtcaccggaggaatccttcacgccggcgatggtgccttcctgtccaagctcgatcgcgaccttccaggggatcttcgtgtggacgcacgcggggatatcgtaggcaaagatcggcaggtcgatctcagcatagatgatgcggaagtgctccttgagctcgtcgatcccgcccaacgcatagaacggcgcggtgacgacgatgccgtccgcgccgagctcctgggcacggcgcgcatgcttgatcacacggtcggtctccgtatcgatgcagccgaccagtaccggcacacgcccatcgacaatgcggatgccctccgtcacaatctgctcacggtgtctgtcatccgagaaggcaacctccccggttgaccccagaaggaagagcccgctgacgcctgcatcgatcagacggttgatcaggcgctcatacgatgggatgtccaccgtatgatcgggcagatctggggtaacgacgggagggacaacgcccctcagcttgaattgattggacatgtgcttgtgcctttctctgtaaaccagatagatataagacaactaggaacaatagggttggaagaattcgagtgtcgcatcctcaaaatcattgatccgctcatggcaccacttgggatacgtgatgcgttggcagtgcgggatcacttgagctaaccgatcctgcgtctcaggcagcgcgatcgtatccatctcagaggttccgaattgaaccggcggtgtcagcagattgtcgaccagatttgccggatcagcgtagttgagtgtctcaaagagcttggtggcctgtttgccgcggggatcctgatccctgaagaagcgggtcaggctctcgtagagcccctcacagcggtcctgctcccacacgtagtcagcgtcagtcggataggggttgagcacagagactgccttcagcctggtcccgagcatctcggcgatcgaggcggcggagagtccgattcctcccccaaacccttccccgtagagcagaagcctgttgtatttcacttcagggaggcgctctgcgagcagtaccgcagagactccgtcctcaacgagctgatttaaaacgagggtatccgagccaccttcccaacctgcagtgaggtcctctggccaggggcgataaaccggctgcagcacgcagcagcccagcgcgatccagcgcgtcaggtggtgccacccacggggaccgcgttctccatcgtagaaatcgatcacacagggggcatgcgggatgcgccgcggtgaaatgagacgtgccttgagctcatatccatcgcttcccgcgaaggtcagcacttggtagtgggctacctcagtttgatagggagcatcctcagcggagaggagctttggagcttcaaggtccgcacagcgcaaggtccagtagatgtccacatccaagctcgccttcttcgtcgtgcctgctgcaaaactactcatcattattcgcctcctggaagaagctcagaagttcatcatcgaaagcctgtatctcctcgtgtccgtagtccggatagagtagatgcttcttgggacaggtgaggttgttgtagaccccgaactgcgtgatcgggggacacacggtgtccgctaatcccgtgccgaacagcaccgggcacgcaacgaggtgggcaaaggacagcgtgtcgatgtagcccagcttgtagaagttctcctgttcgtgcgccccggtagcatcaaaccaccgcgagtagtagcgcagcgagtcataagccacaatgtccgcatcgagctcaaacacctcttggaagtcagagaggaagggatagaggatccccgccttatcgatcgctttcggattcagcgcgcaggtggcaatcccaacgcccccgccttggctgtccccgtagatgtaggtcttggagtggttgagcgcctcactcgccgcgatcgtgcgaaataggatccggatgtcctgatagagcctcacgtagtagaggttcttaggatctccacccaaccccaaaatcggatgaccggcaaccgtggtgcccgtaaaccctccgacatcctcggagcggccgccctgaccggggttgtccatcgagaccaagatgcaacccatcccgacccaggaggcgttctcaagccagctgcgggtgcggccgggatagccgtggaacctcatcaccatgggccacggcccaggacctgcgagcttctcggtcggcatgaacaccttcgcgtagagcttggctgcccccataccccgaaaccagagatcgaaagcacgggaggtggggcaaggtgggatcacatcggagggcaccagcttggctttgagcggctctcggtcggcctcgctcatgcgctctttccagaaatcctcaaagtcatccgggatcggattggtgccgcggtagcgtttcatttcggtcatcgcatctggagaatgtttcataccatcatctgcctcactcagagagattgggatggagcagcgacggggccgctccaagcagggtcttggtataggggtctttcgggcgctcaaagatctgctttgcgggaccgcgctccatgatttggccgtggttcataacgataatacggtcggagatgtagcggacggtctggatatcgtgggagatgaacaccatcgacagctcgaattcgtgcttcaggtccatcaacaggttcaggatctgcgcacggacggagacgtccagcgcggaggtgggctcatccgcaatgatcgcggaggggttaagtgacatggcgcgtgcgattgcgacacgctggcgctgaccgccggaaagctgtccgggcagagctctgagtgcggacttcggaagccccaccagtgaaatcagctcacggatacgcttctcctgctccgcttcgctccccacgtggtggaccaaaagcgggtcctgcagctgatcgtgcacgatcatgcgagggttcagcgcagtggcaggatcctggaagaccacggagaccacacggccgatcttcatacgcatgtcagcggtgcgcttcgtgacgtcagcgcctttgaaatagacccagccggacgtcgggacctgcaggccgcacatcacgttggcgatcgtggacttgccgcagccggattcgccgacgataccgatggtctcccctttcgccagctccaggctgacgtgctgcacggcgtgcaccagattggggtgaaagagcgaaccggtcctcgtcttgaaggtgacagagatgtcatccagtttgatgatagggacatcgcttttgagctgcaccgtatcctccatggtcacttcacctcctgggcggccagtttcacgagatagggcgtgaggccattctgcttcagatagtcatcgggcagctccgcaaagctgtggtgcttcgagacatccggcagcttcttgatgaccggatggacatcgtaaccgagcgtcggatggctggagcgcggcgcgaaccggtcacctctcgggaagtcttccggtgaaggcacggagcccgggatctggtgcaggcgggtgccgttcttggcgccttcctcaatcgagaggacggagcccagaaggccgcgggtgtattcgtggatcgggttctccatgagctcgctcgtcggagcctgttcaaccacctggcctgcatacataacggcgatctcagaggcgacctcggcgaccagcgccaggtcgtggctcacaaagatcattgcgaagccgagcttggccttaaggtcgttcaggagcttgatgacctgcttctggacggtgacatccagcgcggtcgtcggctcatcgcagataaccagcgacgggtcacgcgtcagggccatagcgatcaacacacgctgacgctggccaccggagagctcgtgcggataggactcgagcgtccgctttggatccaagcctaccagctcaagcagttcttcagcggagcgggtaccgccgcgatcggtcagctgtttcatctgggcagagatcagcatggaggggttcagcgaggacagggcgtcctggtagaccatcgcgatctcagtgccgagcagctgacggtgctgctctctggtgagtttcaagaggtcctgaccctcatagaggatctgaccgctgatagtctcgttgggggcggtcaagcccatgatcgccttgacggtgatggatttgccgcagccggactcgccgacgagcgccatgcactgtcccggtctgacgtcgaaggatatgttgtcgacgacgtggacggggccgtgggacttaaaggcgatgctcaggttcttgacctgcagcagcggttcgacgctgaagtcagggacgtgacggtcgtgacgccctaactcgacctcacgcagggcagccagacggcgacgcagcgccggctcctgctctttgtaagcgcgcagcgggtcagaggcgaggatgtcgtctctgcgacgggactcggagttctcctggtcaaccggagcacccggggctgcggccagagcgtcagtcaagccctcagcgaggatgttcagcgccaggcaggtgatcatgatcgccaggcctgggaacaccgcctgccaccagcggcctgccaacacgccttggcgggcgttagagaggatgttgccccaggtcggggtcggctcagtgatgccggcgccaatgaaggtcaatgacgcctcgaagatgattgcgtcagccacgagcgtgaccgtgaagaccatgatcggggcaatgcagtttctcaacacgtggcgccacaggatccagggtgagcgggcaccggaggcgacgactgcgcgcacgtagtcttcgccgtactcgctcatcacgttagcgcgcacaatacgggcgatctgcgggatgtacatgaagccaatggagaagatgatagccggcaccgagttgcccaggatagtcacaaagaccgcagcgagggcgatgcccgggatggacatgatgatatcgaggatgcgcatgatgatctcgcagatccacgtgcgcgtcacggaagccagcgcaccgataatggagcccaagactagggccataccggtagcgccgaagccgatgatcagcgaatagcggccgccgtagagcatgcgggcgaagatgtcacgccccttatcgtcggttccgaagatgaagccactgccgggagcctgacgggccaggaagatctccgtggggttgtgcggtgccagaagcggggcaaccaccgaggcgagcacgacgacgagcaggatgatgagggaaaccttggaggaggtcctcatcttgctccagcccgcgaagcgcttgcccttcgcggcggcttcctccagtttctccgtttgcttctcgtgtaccttgaccatggctacaccgccctaattcttgggttgatcaggagatacagcatgtcaaccacgatgttgataatgatgaaggtgagggcgacgacgataacgacgccttggaccagcatggtctcgttgccttggatgccctcctggatcgccatgcccatgcccggcaggttgaagatgacttcgatgacgaccgcaccacccatgaggtagccgatcttgaggccgagcgtggtgagcggggtgatgagggcgttgcgcaggacattgtgtccgataacgacgcgctcaggcaggccggcaccgcgggcagtctggacgtagtctttgtccagttcctcaaccatagcggtacgcacgatacgggtcatctggccggtcagcgggaaggccaaagcgatggcgggcatcgccatacgtgccagatagccgcccggattcccgaggaagttcggcagggcgccggacgccggcagccagtgcaggtaggtcgagaacagcaggatcagcagcactgccatccagaacgaaggtgtagctaagccgccgatggacaagacacggatcagttggtcaggccatcggtctcggtacagagctgcaatgacaccgagcaggaatgagacaaccgcgccgataatcaagcctatgaaggtcagctgcatcgtgactggcagtgcctcagagatgcgctgtcccactgagtagtttgcggcgccgtaggtgccgaggtccccgtggaacagaccgcccatgtagttgacgtagcggaccggccaagggtcatcgagcccgtgctcttcgtgatactgagccactgcctttggggtcgctgactcacccaacgcgttgtaggcggggtcgaccggtgagaacgacatgaggaaaaataccagaatagttacaccgaataccatgatcggcagcgcgatcaggcgtctaccgataaggcgcaagagattattcactcatcgctccttccctgataaaacgagccaaggagaccaccggagaaggttccgggcctccttggctatcacaaaactattggattggccgcgactgaaagaatctctgcgctacgcggataccgtggtggaatccaggaagtagaggccggtcgtgccgatgccactgaagttcttgatgcccacaccgttcggtgcctgcgtcggatcttgccaagaagctgtgacggtctggacctgcagcaccgggtagaggacaacgttgtccgccaggatatcaaagcactggttccaggtgttctgctgctcagagccgctctgtccgagcgcctgctgcatcagttggttgagctgcttccactcatcgctgccctcccacgggcaacgggtcttcatccacaggttgtcgccgaaccaccagttcatcagcaagtccgggtccgcgccgaagcaggacggatcacccggtgcgagcagcagatcgtagctgttgtcgccctgatcgatcgccgcataggtagcggcggaagtatcggtcctgatcgtggtgttgaagcccaaggtgtcgaggttctccttgacctgcgttgccatcgccacgacctgctcgttgtcggtcgttctaagctcaatgtcgcctggggtgatgccagcctcctggatcagctgctttgccttgtcctcatcgtgcgtatagaccgtggaggcgcggtggtagttcgggaagttctctggcagataggacgtcggagcgcaggcgaggcccgcgaaggcattattgatcatcgcgtcatagtcgagcgaatacataactgcctgacgggcgcgcttgtcgttccagggcgcctttgcgacgtcgaacatcaggaagcgggtgccgaagccctggactttgtcgatcgtggcgttcaggccctgcagggtgtcaacggcgtctgcggtgaccatctccataacgatcgtagagccttcctgctctgcggtcaggcgggcggtggcatccttcaggacgtcataatggatcttgttgtccttggcggggtgatcgccgttgtagttcgggttcggaacgagctcaagagagttgtcggagatcgtatcgtacatccagggaccggacccgatcggctttgaagtcatctcctgcttcgtggagcttgccggcacaacacggatgatcgcgaggcgctcctttacgagggagaagttcgggatcgtcgtggtgatcgttacggtcttgtcacccttcttctcgatcgactcgaatggcgaaagcatcgaggtgtagatattgccctcccaatcggccgctttgccactcgcgcggttgaaggactcaacaacatcctctggggtgatagggttgccgtcagagaactgggcgccgtcacgcagagttacctcaaagtgggtatcatcgatctgctgcggatcccccgttgccagctcgttgaacgtgctgtagtcgtggaagtcaatcccgtagaggccttcgcagacctgccagttgacgccacaggccagtgcagatgaggtggaggaaggatcgtagttctgggtgctgtaggcggtacccgcgctgatcgtgccgccaccctcggtaccagttgaagaagaactgttgggtgatgaggaattcgaggagctcccaccgcatgccgcaaggcctacagctgccgctgagacacctgctgcaccgatgaagttcctccgtgtgagattgttcatagctgctctccttctccgctgcgcggatcaaactgtttggaaaacttttttaccactctttccgactctcagtttgagcctttcaaaagtgttttgggagctcaacccctaaatctcagtatttggtctgcccaacggaaaagtgcataatgtcagcggtaatatagcctgatcagacgtattgcacatttataccacatatgcctgctacacatttcgtgtgagagtcacctttaccaggtcttttaatgatttattcagcttcttattcatctcagagaaaatatttcggcctgtaccttgaattacacctcaagtggtgctttgtcactccctgaagacgggccgccattcgccgcacgctgctcatcttcgcgctcttcgtcccaagcgcgcagtgtctgccacacgccttcggccacctcacgcgggatacctttcaccgaggcgatctcatcaaccgaggcttgtctcagtttcttgagcgatccgaagtggcgcatcagagctttctttctggtggggccgatgccatccacctcatccagcacgcttttcgtcatcgccttccctctgagctcacggtggaaggtgatcgcaaagcggtgcgactcatcgcggacccgtttgatcagataaagggagggggatccggaaggtaagacaatcggggtgtcatcccaggggacgaatatctcctcatctgactttgccagaccacagcaggggatatcgaggcctaatttactcagctgctctatcgcagcggtcagctgcggtttgccgccatcgagcaccagcaggtccggcttcgagccgaaccgtctgtccgccatcgtctttggcccatagcgccgtgaaagcacctcactcatcgagacaaagtcgtttgcctctttcaaaggtgtctgaatcttgaagcgccggtactgcgacttatccggtttgccgttcgtgaacaccaccatcgaggctaccgtgaagtgcccgtggatcgtagagacgtcgaagcactcgatcctcatcggtggcttattcaaggctagggccgactccaactccatcagcgcccggttagtccgctcatcgtcgtagcccgtgcgcaccatgtagcgcttgagcgcgtgcatcgcattttcttttgccatgcccagcagcttgaacttctcgccgcgctgtggacggtgcaggcgggtgacctttccgtgttcctcggttagccactcccccaagacctcggcgtcctgcaggtcgatcgcgatatcgacctcagaggggatgtccgcagtctcctcgtagtagcgcttgataaagctgtcggtcagctcctcctctgagacgtccagtcctttgttcaggatgaactgcgcagagcggatagttctcccctcgcgcaccacgaagacacaggctgcggagattgtctcctcacggtagaagccgatgagatcgatatccacgtccgaggagaagatgacctgctggcgcacgttgagggagctcagcgcttccagacgcttcttcaggcgtgcggcacgctcgaagtccagatcatcggctgcctcgtgcatctggtctttgatctcgtccatgatgtcgtgacggcgaccttggagaaaacgctcaacctggctcacgttcttcgcgtagtccaccgtgttgatcgccccgatgcaggcgccgggtccgatccctacgtgatagtcaaagcagggtctgccctcattggctaaaaagagggttgcgacgtcctcctggtcgggatgggccgccaacatgcgcttcgtgcgcttccactcgacgcagttggcggagcagatcggcacgactttacgcaggatatcgatagtcttacgggcagctttggcgtccgtgtagggcccaaagtagcgcgtacccctcttgtgatgctcacgggtgaatttgatcgcagggaacacgtcagattccgtgatcgcgatataggggtaggacttgtcgtctttaaagtcgacgttgtagtaagggtggtactgagcgatcaggttgcgctccaataccagggcttcatgctcgttttccaccacgatgtagtcgaacgatctgacttcgttcatcatcatcggtatcttctcacggtcatccgtgagcttgatgtactgccgcatccggctgcggaggttcttggctttccctacatagatgacggtccctgactcattcttccagagatagcagccagggtccgtcggtacttgctcaacctgttcagctaaggaaggctgtccgtcgcggctaacctcccagggtaatggagcatgagacataaaaacggtgcaccttacttattgttgtcgcgccgcgcatcgtcctctttgagtttctcgttctggtgcgcactgattgaggcacgtctttgttctagtttctgatcccgtaccttctccgcatcgctccctttgcacgcgcgcagtttcacgacgcccttgcgggcggtgacgagcatgctatagaagcgggggtgaaccggaaggtcgcgctgaggggcgacttcaaaggtctcttttgagaacttgcatttgaactcgttgaggcccatcagctggggtgataacgctgatcctatacccatcatatcgtaggatgtaacacctttgttggcgccgaggtcacattcctcgaagtagacgagcttatcagtcacatgcatgcgggcaaagccggtcgcggaagcgccgtagtagcgcactgcgcgcttccctgagatcgtgacgatcgaccagctggcgatcttgccgtcgacgcgtgccgcatacacgcggcagtgctcaggccccaggatacggatcatgttctcgtagtcggagagcgggctcgggataaagtcatcgcgcttgccggtctcttccatcaccgcatagtattctttgaaggacttcgtagcctgctcggtctcatccgcgcactccgcgggactctcacgcagtgactttctcacatcgcggcggccgcggggcttcatacgcttcaagatctcgtcgtctccgccggtcacgtccaggatcaccgtgtggtcatagggtgtgatagagagtgcccgctttgccatcgggatatcgttcttgatgcccatacgcacaaagacaaccttcttgtccgccttgtgtaggtaatccacgagcgactgtgaaagctccatctcctctttctcagaggggtcatgcagccacaccggtccatggatggagctcaagtagtggtatccatgcgtgaggtagtcgataaagagagcataggcgacatctttgccatccttagcaaaggcaagggtaccccagtctgtgcggccttcgatcgtgttttgatacttcgaccactccgcagtctgctcaatagggagattgagaccctgtttagtgacactgtcggcgagctcactcagcgaaattgtacggatatccaatggttggtcctccctcaggaagcgatgttgaacttaaacgctcactgcatcccgatacctcggtgtcagcagtccaaatacatacgctagtctaccgcacacggcacaggcgagaaaccttgctccgttcgcgctgacagccatctgatcgggccggcactactctcttccgccggcaatcagccctcaaccaacctatactactccctattcgaggcacgccacctaccaggacatttcactcaaaaactatcacagagcctcacatatctgatatctctctaatcactgagattcatctcacggtagaagcagcttctatgtccggtgtggcacgccggaccgggagagtccacgagatagagcagcgcatccgcatcacagtcgataaggatctgtttcatctgttggatattgcctgaggtagcacccttgttccagagttcctgccgagagcgggaccaaaaccaggaggtcttcgtgtcgatcgtgcgtttgagtgcctctttatttgcccaggcaaccatcaacacctcaccggtgtcgaactgctggaccacaaccgggataagtcccctgctgtcatatttcagagcgtccagatcagcggataccagctccaggggctcccgcgcatatgtcttgtgtgccatgtgtaaccgtcgcattctttagaaatcgagcctcaccgggataccctggcaggccaggtactctttgacctgccgcaccgtataggtcccaaagtggaagacgctcgctgccaataccgcatccgcttcgccgtcgataatgccttgcgcgaagtcctctagtttccctactccaccggaagcgatcaccggaatcggtaccgcacgcgctatggcacgtgtaagcgggatatcaaagccgtctttcgtgccatcacgatccatgctggtcagcaggatctctccggcgccacgagcagccacttcctcagcccaggataccgcatcgtagccggtcggtatcctgccgcctgcggaatagacttcccacttgtctcccacccccacgtgctttgcgtcgatcgcgcagacgatcgcctgcgagccaaagatctgcgcggcacgggtgatgagggaaggatccttgatcgccgcagagttgatcgaaatcttgtcagcccctgccgcaaacatctggcgcaggccggcgatagtgtgaaaaccaccgccgacagtgtaggggattctcaactcttctgaagcatgggaagcaagcgagaccgctgttgaacggttatcggaggtcgcggtaatatccaggaagatcacctcgtcagcaccctgcctatcgtaggcgcgtgcaagctcaaccggatctcccgcatccttcagccctttgaaattgacccctttcaccacacggccatgggtcacgtccatgcaggggatcacgcgcttacacagcatcgctcttacctccttgtgcagcttcgagtgcttccttcagcgtaaagttcttctcgtagagcgcccgccccacgatcgcggcttcaatcacctgaggcccaagtgccgcaagcgcgcggatgtcttcgagggttgcgatgccaccggaagccacaatcgggaatccggcgagctcagcgatgtgtttcatcaccgaggtatcgatgccggtctgcattccgtcacgggcgatatcggtaaagaccaaatggcaaaagcccaaggataccaagcgcttgacaacctcatcgacgttgaggcgtttctgcgtcctccaggcattgacccgcacgagcccatcctttgccgcgacgtcagccacgattgcatcgggatactgtttggctgcttcctgcgcaaactttggatccgcaatcagggcagtgccgatcgagacacgctcgacgcccaggccgagcagttcctcgatatccttcaggctccgtacaccaccgccggtatcgacgcagagccccggcacctggcagatcgccttcagggcagctcgattagcctggcaggcttgcttgtcctccccaaacgcgcgggagagatcgacgacgtggacccaggaggagccctgtgccacaaagtcttgagccacggcgagcgggtcatgggaatagacgttgacccgatcgcgtctcccctctctgaggcgcacgacgtcgccgaagattaaatcgatagcgggaaacaggagcatctatgcctcaccctccacgatgtgtacgaagtttttgagcatggtgagcccccaggtcgaggacttttcgggatggaactgtaccccgtagatgttgttggcccagacagccgaggcgaacggttccccgtagaaggtctttgccgcaacctgctcgggatcgatgtcccccatcaccgcatagctgtgggtgaagtagacgttggcaccctccggaatccccgcaaagagcgggcatgcctttccctgctcagccagatgcagctggtcccagccgacatgggggatcttcagacgatctgaatggagccgatcgacgctgcccttcaggaggcccaaccctttgacccacgtgccccccttagctgcctgtgcctcacgctcagagccgcggccgcagagcacctgtaagccgaggcagattccaaggatcggtctgttgtcttgggctgcagcgcggattgcttcagtctcctttctcttctttagggagatcatcgcatcctcaaagcttccgacgccgggaatcactaaggcatccgcctgcataagctcttggggatcatcggagatggtcacggtgccacccacagcgctcagcgagcgagcaacagagcttaagtttcccttgtgatagtcaacaacagctatggtctttgccatatggacaagcctctctacagttcgcctttcgtggaggggacccccttcactcgggggtcaggctcgacggcctgtctcaaagctcgagcgcaggccttaaaggtagcctcgataatgtgatgggcattggtgccggaaagttccttcaggtgaagggtgatgcccgcctgacgcgcaaagccgataaagaactcctgtgcaagctccgtatcaaaggtccctaccttatccggtccgatcggcacatcccaatagagctcccctctgccggagatatcgaccgaggccagggtcagcgcctcatccaaaggtatagcgatcgagccgaagcgtctgatacctgctttgtcaccgagcgcttgccctaaggcttggcccactacgataccggtgtcctccaccgtatggtggtcgtccacccaggtatcccccttgaccttgatatccatatcgatcagggagtgacgggagagggctgagagcatatggtcaaaaaagcctacgcccgtatcgatcgaataggtgccggtgccatcgagatcgaggttgacctcgatgtcggtttccccggttttgcgcgctacttccgccgttcttgccatactcatcccacaatctctctgagcgccgcaacgagcgcttcatcctcctcgtgtgtgcctaccgagatacgcaggcagtcctgcaaccctggagcagcgctgaagtcacgcaccagaatcgaataggtgtcgtgcagcgtctcccagacctgatgagcccgaacagtacgcagacagaagaagtttgcttggctcggccaggtgcggataccctcaatgtcgttcagggtctcaatcagctggtcccgttcacccttgatatcctcgatagcgggttggaaagcctcccggttctccacgacggtcaaagccgccgcttggctgaaagcgttgaccgaatagggttgccgtacggcttcaagcgcttcgaggatctgttcattggccaacaggtatccaacgcgccctccggccaggcagtaggccttcgagagggtgtgcaggatgatcaggttgtcatagtcctccagcaacggctgtgcgctgacgcctgcatccgcaaactcgatatatgcctcatcgaccagcaccagaccgggacaggcctcacagacccgtgcgacgtctgcctgcctgatcgtattgcccgttgggttgttcggtgagcagaggatcaccagggaggcatcctttgctgcctgggcaacttgatcgacctcgacatcaaaggtctccggatcacgctcaatgttcacgaccggacactccaccatacgggcatagagctcgtagactgagaaggtcggtgagacgtttacggtgagatggtctgctcccccataggcgagaaccagattgaagagcgactcatcaccaccgttggagaccagaacctcctccggcttgacgccctgccatccgacaatgcggttctgagttattcgacaacgattggatagcggttcgtcggaaccatgagcgattgcatcaatcacctctgatggactcgactgggcatcccgtggggtattctcggttggcggaactcaatcacgatctgtgacggtacaaacccggatagtaagcatagaggtgttcgactgagggctcaccgcaatgcttgcggactcagggatcagtacacgccagccatttcctcacccccgtttcagaagctttctcggctattgcagctccatcaggcaacgaaagtggggacagagacagaagactacgggcgagtccttgcgaattgtctgtggaaatacatgacacacttcctttggcacgtatcctcctattggtgaagtaaacagtacccaccacccaaatattacatcacctccaaaaacctgctttgacaaggctcctcagcctctccacagcctgacgcgcatcccgccaggagaggtgcgcccacagacccgccttgtgccatgatctgtcgcctcggatccttcatcagcctttctcgcgcgtatataatgatcgagtggcgcttctggaagtcaaactgcccagtgggttgctggaagagctcagtgcccgccgcgtcggcagcgtatggtcggtcctgccacgtagtcacacaaagctctgaagctccacggggtcgacaaagatcgcgccggtcttgttggaatcttcccagaaatcgagaaggcctacaggaaggtgctgcactccaggtgcgcgggcaaccacattgctgccgtcgcgcgcggcatccatatcggtagtgcagactgcgacgccgtggtccaggctcttgcgggtgatctcctcccgcgggctctggacaagcagcttttcaagctctgcgttaacgctgtcagcgagctctgcgctgtccgtcaccaggtagcaggtcgccatcgggtcatgctccgcctgcgccatcagatctgcagcgatgacggtaggatctgccgcgccatcggccagcacacagacctcagagggaccggcgaccatatcgataccaacatcaccactcactgagcgcttggcagcggccacgaaggcgttgcccgggcctacgatcttgtcgaccttcgggatgctctcagtgccgtaggccacggcggcgatagcctgtgcgccgccgacagcgtacacctcatccacgcctgcgattgccgcggcagcaagggtataggaggagatcgtgccatccttctgcggcggggtcaacatagtgacgcgcttcacgccggcgaccttggcagggatcacgtccatcagcacggtggagggatactgggcacgtccgcccggaacgtagactgcaaccgtggcgagcggcaccatcttgacgcccaggatcgttccgtcgtcggtcgtagtaaaccaggaatcctcacgctcccgctcgtggaagtcacggatctgcttatacgctttcttgatggcagccaagaacttggggtcgaccttgttgggggcgtcctgtacgacctcgtcgggcacacggaactgcttcgggcatactccgtcgaacttgagacagtagtcccgaactgctttatctcccccttcgcgcaccgtgtttacgatgtcctgggcaaaggcgacgacttcaggagcgagcgctccgcagcgtttcaggtccttgtctgtcagttgctctcctcgggcaagttgcaccagtctcatgctttctccttttcaacacaggcgcgcaggcgctcctcaagtttctgaatcctggtgtcgcaacgataggccgccggccccgcaaagaagcgggctgagcagttcagtacatcgtccaccacaaccagatcgttttcccgcaaggtcgtgccagtagcggtgatatccacgatgcggtcagccatacctacgatcgggccgagctcgatattgccgtgcaggggcaggatctctacctgtctgccgatccgatcatagtagccctgggtgatgtgtggatacttcgtggcgacccgctcataacccctccaggcgtaggcccagtcggtctttcccttgtttgcggcaggctccgccaccacaaagcggcaggccccgtacttcaggttcactaattgcagcagatcaacttcagattcaatgatcgagtcgttgccacagatgccacagtccgccccgccatagcccacaaaatagggggcatcctgggcacggacgatgatgtaatcgacgccgtcctcatggatgataagatggcgaccgggatccttcagcttgtcggtcggcatccccgctgctttcagcagcttgaccgtatccgggaacagggatcctttcgggattgcgatgcgcagcggccggttctcagaggaatccgccggcgtcacgacaccggtatctcccatctcacccagcacctcttgcaggcgctccaacgagagcgcgaagccacaggcgcaggtatcaggcatgccgaagtgtgtaagcaccgcatcatagcgacccccggaggctaatgaagccgtgatgtcctcggaataggccttgaagatgatacccgtgtagtagtcgaaggaattgacgatcgagaagtcaaagaggagctttcgttggtcaaccagcggcttcaattcgtttgcaagctcacggagctcctgaacgccccgtttgtctgtgtccacccctgcggcatccagtacctggtcaagttggtcgagtgcttcgatcccaccggtcaagcggggaaatccgtgcagcgcctgggcgacttcctggggaaaccccacgcagtcgatcagttcgtctaagcccaccaggtcagaggcgtggaccaactgcaatacccgatcagtgaatgcttgggtaggtgcgcacgtttcaagtaaggctttgagcggcatcacggagcccaacacgatgtgccaggccggcacatgcagggcatccagggtctccgccagaagcgagaccacttcaggttcggctctgccgtcttccccaccgatcagctccacacccaactgggtgaactgccgaggttggcctttcaggtccgcctgctcacgcatcaccggtgcggtatagcggaggcggagcgggaaatccctgcggctcttgtgggtcgccaccatacgggcgatcggcagtgtcagatccggtcgcagcgcgaggatctgagagttctctgcgtcaaagagctgaaagggcaggttgtcaatgtggcccgcctgctcaaaagtggagcgcatctccaaaagcggggtctccaccggcaggtagtgatgggcggcaaaggtcgttttcacgcgatctgaaatacgctccctcgcctgtgcctcttccggcaagatatctctaaacccaggcggtgtctttggtgtcacaatcactcccctgcttgtaatcatatggtagggtcactttatcacgctaaagtaccgccccgacctatctgtaacatgcgcgcaataaccggacacgctacttgcgaagtgccgggataaagcgggcacagaccctgcggatgatgccggcctcaggcatcttgagcgccaccgccccaccgtaggtgacgatgagcgccggaatgccgcctaccaggcaatacaggaaagctctgcccatcgaggtcgtacagggggccacaaaggtattgagggcggtcaggatcagaaagccgacgagggcgccagctaaaccaaggaccaaagagcgcaggctctcagcgatgatgcggcggatacccaaacctcccaggttgtgccacagttgggcgacgccgataccatcgacgatcacatagaagatcgtgttgctccaggccggaatcatcaggccgtacatcggggtgcacactgccatgaacaccgcgcacacggcgccggcgatcacgctcgcacccgcaaacaggttcatgtggcgcatggaggagaagatcttctgcaggaagatgtagacgccgtagaccggcagcgacaccgcgagcacgcagaggaactccgcggtcagattgatctcatcgagcgagaagctccggccggacatcacggtgatcagaggctgtgagaagacgatcaggaagagcatcatcgggatcagcatgaagaggatctgggaaatgccctttgagacactgcggcggtagcccttgatatcgtgcttggcaaagaggtcggagatctcagtgaagagcgccgtggtcagcggcactgccaaaattgagtacggcagcgtgtaccagatacgggcatagtaggcgatcgaggagccggagactgaggactgcatctcgtaggaggtctcgaaggaggttgtgacaaacatcacgatcgtgcagataaaggacgggataccgatcgagagggtctctttgatctcaggatcgtgccaatcgatgtggaaagtgagcctgaccccttgcttgtgcagggccggcagctgaacgagcagctggaccagcacgcctaaaggattaccgaggcctaagatcaccaacgctaagccgggatttgacatctcaaagacgatatagaggacaaaggaagcgatcgtcacaaagttgttgaagatcggggctgcggtgctccagaagtactcgcgctccgcattcaggatgcccgagaccaccatcgagagcgagtagagcatgatctcgatcgcgaagaacctgaagaagtagaccgacaggtcgaagtcaacgttggtcgccgagaagagctgcgtccatacgatcggagccgcgaagatcaccgaggcgagtgagaggcctcccatgatgaggagggtaaaggagaagaggttcgaggcgtaggcattggcacccttacgcccaagccgatgcttgacgctcatgtaaaccggcaaaaacgcggtcacgagcatgccgcccatcacgagctcatagagcaggttcgggaggttgttcgcgatcgtatagcaggaggcgagcatcgtgacgccgaccgcgtaggcctgcgcccaggtcctgaagaagccggtgatcctggaaacgataatcagcccgctcatcatcgccgaggatctgccgactgactcacgggtcttggcttcttcctcagcactttgggtcgtctcttcctcattcacaggggactgcgttgaggtctggttgttgtctgccatgctcacccctcttgcacgatatcgacgaacttcgctcccaaaaagttggcgagctccatcggattgagcctaaggcctaagccgcggcggccaccggagatgccaataatgtcgaacagttgcgccgtttcgtcaatcagcgtcggaaatttctttctcatgccgactggtgtgcagccaccccgcacgtatccggtgactgcctccagtttcttccaggattccaactcgagcgatttctcattggccgctgccgccgctttcttcagatcgagctcttcggcgaccgggatgcagcacaccacgtggtcgtggttgggcgccacgcacacgagtgtcttgaactgagagtccatatccgctccggtctgctttgccaggcgtacgcctaagccccgggagatgtcctcttcctccccttcgacctcacggaccgtgtatctgatatgtgcctgatcaagctcgcgcatcgcgttggtcttcgcaaccttatgctttgccatcgctctacgcctccctcagcgcggccatacgcttccggtcacgctcgagcaggggctttaagtacttgccggtgtagctttccctgacctctgcgacctcttcgggcgtgccataggctacaatctggccgccggcgtcaccaccctccggtcccatatcgaggatacggtccgcaactttgatcacatcgaggttgtgctcgatcacaagcaccgtgttcccggcatcgacgagacgctgcagcacgttcacgagctgccgcacatcctcaaagtgcagaccggtcgtcggctcatccaggatatagaaggtcttaccggtctggatgcgctccagctctttggcgagctttacgcgctgcgcctcaccgccggaaagggtggttgcgggctgccccagatgcacgtaacctaagcccacatcgtagagggtctcgagcttccgtttgatcttggggatgttcgcgaagaaagcgagcgcttccgtcacggtcatgtccaacacatctgcaatggatctgccgttgtatttgacttccaacgtctcacggttgtagcgcttgccgtggcagacgtcgcagggcacatagatgtccggcaggaagttcatctcgatcttgatctgcccgtcacccttgcaggcttcacagcgccctccgggtacgttgaagctgaagcgccccgggctgtagccgcgcgccctgctttcaggggtggaggcaaagagccggcgcaggtcatcccacagcccgatgtaggtggcggggttggagcgcggggttctaccgatcgggctctggtcgatatcgatcaccttgtcgatcttgggcctaccctctctgtcagtaagccccttcagcgcgcgataggaccctacctcacgcttggagcgctggatgatgttggtgagggcgggggccaaagtatcggtgatcagtgaggacttcccagagcctgagacgccagtcacgaccgtaaaagttccgtactcgatggaggcggagatacccttcaggttgttcgccttgcagcccgtgatcgtgagcttgcccctgcggggatagcgacgagtatccggcagtgggatcatgcgcttgccggtgaggtaggctccggtgagcgagtcctcgttcgccatgatctcctgcggcgtaccttcagccaccacatggccgcccatctcgcccgcgccgggacccatatcgatcacatagtccgcagcacggatcgtatcctcgtcgtgttcgacgacgatcacggtattcccctggtcacgcaggttcttgagcgtcgcaatcagccggtcattgtcccgctggtgcaatccgattgagggctcatccagaatgtagagaacacccatcaatccggagccgatctgggtcgccaggcgaatgcgctgcgcttcaccgccagagagggtggcggaggcacgactcaaggtcaggtagtccaggccgacattcacgaggaactgcaagcgggcacggatctccttgacgatcgggccgccgatcgcctggtgcttctcgtctaacttgaggttctcaaagaatttcagggcatccttgcaggagagattgcacagctcatagatgctgagacccccgacggtcactgccaggtactccggcttcaggcgggcgccgtggcaagttgggcacgccacctcacggatgtacttctcgaggtgcttgcgcatcgtggcagatgtcgtctcctggtacttctcaaagaggatattgcgtactcctgagaacttggtgagccaagtggtattgcgtccatcgagggtgtggtagtgcacttcgatcttcttgtcgcccaaaccatccaggagggagctctgtgcgtttttcggcagatcttcccagggggtatctgcgctgactcccaagtagtcacagaccgcctgtaggatctgtgggtagtagttggaacgcccgaagaggtttccgaagaccccctgattgatgctcagatgtgggttatcgatcaaagcctgggcatccacgacgcgcttggagccaagaccgtcacagtccgggcaggcaccgtaaggggcgttgaaggagaagtcccggggctgcaggtcgtcaattgagtgcccatggatcgggcaggccagtgccagggagtaggtcaaaagttcttccggcatgtgctccggatccttccgatccgccaagagcagcaccgcgcatctgcttgaagccagcttcgtcgcctgttccaccgcctcggcgatacgccccagcgaggattccttgataacaatacggtcgacgacgacctcaatcgtgtgtttaatcttcttatttaaggtgatcttctcagagagttcccgcacctcaccgtcaactctgacgcgactgaagccctctctctgcagatcctggaagagtttttgatattctcccttacggcccaggatgaccggggccagcaccagggcacgtctcccctgcccggctgccatcaccttatccgccacctggtcggtagtctgccgctcaatcacgcggccgcactccgggcagtgcgggataccgacgcgggcatagagcaggcgcaggtagtcatagatctctgtgaccgtacctaccgtagagcgcgggttctttgaagtcgtcttctggtcaatggagaccgccggggatagcccctcaatggagtcgacgtcgggcttgtccatctgccccaagaactgccttgcataggaggacagagattcaacgtagcgccgctgcccttcggcgtagatcgtgtcaaacgctaagctcgatttgcctgaaccggagagtccggtgataacaacgagcttccctctcggaatgctaacattcacattctgcagattgtgctggcgggcgcccttgataactatatagtctgatgccatgctaccctcttcagaaaaaactacggatccgaccgcccagtcggtatccgatctcacatgtttctatctcagttatctatcttctctatcctaccaaggaacactcgttcccgaaaacaattcacgacactaaccaaaccccatgtgcggattttccatcgcgtatctgcagcaagcatacagacctgaatgcgacagaagcacccaacggccgctcagcacctcagctgaacgacagcggcaaaacccaccccgaggcgggtatagtaaccatgtttttgtagtaccgataagagaggaaagcaagtcgtgccactttctaaagaggaacaggaccaaatcaagcaggagatggacaccgctatgcacggtgataaacagcagcagtctccgcttttcccgttgaatgagcattcccacatcaagcatgtgatcggcgtcatgtccggcaagggaggcgtgggcaagtcactcgtgaccggcatcttagcgacgcagctctcccgccacgacgcaaaggtcggcatcatggatgccgatatcaccggcccctctatccccaaaatgttcggcctcgatgatatgctcgcgggtgccaaggacaacaacttagtgccggtcaccactcaaggcggcatcaaagtgatgtccactaacctgatcctgcagcacaacgatgacccggtgctctggagaggcccgatcctcgccggagccttaagacagttctggggacagtgcgactggggtgatattgacttcctgctcgtggatatgccgccgggaaccggtgacgtcgcgctgaccgtcttccagtccctcccgattgagggtgtcatcatcgtctcctccccccaggacctcgtccagatggtcgtgggcaaagccgtgaggatggcgaagatgatgagaatagcagtgctcgggctcgtcgagaacatggcctacatcgaatgcccgcactgcggcgagaagattgagcccttcggcccgagccgcgctaaggaaaccgccaatcactacgatatggatttcctaggtcagctcccgatcaaccccgacttctctgagatgtgcgatgaggggacgatcgaagagaagctgcctcgaaatctccttcctgacggtatcgccgccatcctcacctccgcagaactgatgggagagcgctgatcctatgggcaggcccaagagacgcaaaaaagagcagcaaaaagacgagatcatggcagccgtgaaggtcgtggtccctgattcggccgacatcgtagttatcggtggcggcgctgcggggcttgcagcggcaatcaccgcggcacacgcaggggccaaggtcgtcgtacttgagatggctcctagaatagggaggaccatcctcgctaccggcaacggccgctgcaacttctccaaccgcgacctcgcgcccgaatactacaaccacccagactttgtacagcaggttatgggaccgaatcccaccgataaggtgctcagtttcttctcggatttggggcttgcctgggctgaagaggagggccggctctatcccctctcacgacaggcagaaagtgtcagacaggtcctcctcgcacgtgcccggcgcgaaggagtgatcttagcttccgcccatcgatgcctctccttcaattggaccaacgacgagtggcatctcgacttttatggactcaagagtgcatctgatgttgaacatacatctgcccacactattatttacgcagcgggtggtgaggtgccgcccgaagcggttccaaaagaagtagagttcatacccccaacaccggccctgtgcccgcttgcctgtgagggcttgcccttcaagcagctcaacggacgacgcttgcacgcacaggcacagctgatacgcgacacaaaggttatcgacgaggagtcaggagaattcctctttcgcagctatggcctctccggcatcgcgaccttcaatctgtcccgtaaagcacagccccatgaccgaatcgttctcgatgccgcgccggcctatacacagcagcaggtgatgcatctcattagccttgcgggaagctctcagggagtctgtgatcccgtcttggccgaatacatcgatcaaaaagcccgctacaaaaccgccaaagcggctcatctgattaaacatctcacgatggagatcaccggcaaggctgatacagaccatgcacagatccatcgcggaggcttcgcagtgtcttcgttctctgctgaaaccctcgaagcaacaggggcaccccgcttctacgcagcaggagaagccctcgacgtcgatggggattgtggaggctataacctgagctgggcctggttgagcggtatccgcgcggggcaggctggcgcagaagcgatcaagaaggagcacccggatgcttgaggcacaagggatatcgatagcgatccatcgtctcgatggaacacgcaagaccgaagtcgtactgtgtcagcagatcctgtgtaagaagttccatctgatacaggcggatctcaccggctttacgatgaggcggcgctcgatcgacgcccgcaagaaaaacgatattcacctcacctatacggtccggttcaacctcgcgggaggcagccatgcagaggaagcgctgctgaagcgcgtctcccccaagcgtggccgtatcaccctcaaactcgttgacgagaaggagccacagtttcccaccaaccttgggatcgcgcttcctaaacgtccctgtgtgatcggcgccggttgtgccggactcttctgtgcattgacccttgccgaagcagggctctctcctctcttgattgagcgcggcgacgatgcggcacgccgtacagagagcgtcgagaccttcaacgagaccggaacccttaatcccgaaagcaatatccagttcgggttgggcggtgccgggaccttctccgatggaaagctcaacaccgggacaaagaacccactccaccgtttaattctgcagactttcgtggaagccggggcccctaaagatatcctctatgatgcgaaaccgcacatcgggtcagacatcctgcccaccgtcgtcacacacctagcagagcgtattgaagatgctggaggcacggtcctcttcaataccaagctacttgatatcgagctcacccaaaaccgcagtctctgcggcgtcagcgtgagacgaggcaatggacacaaggagacgatccacacctcgcacactatcctcgcatgcggacactctgcacgcgacgtcttttcgctgcttgcggagaaaggggtctttctcgaacgcaagacttttgcgatgggcgtgcgtatcgagcatctgcagtccacaattgacagggcccagtacggcccggaagccggaaacccggtcttgggtgccgctccctataagctcgtggcacatccaaaagagggccgaagtgctttcagcttctgcatgtgccccggtgggtcggtggtcgccgcctcaagtgagatgggtggtgtctgcaccaatgggcagagcctcgcggcacgttccggtaccaacgcaaactcaggattgctcgtcaatgtcttccccgacgatctcgtcggaaatgatccgctcgccgctattgagctacagcgctcctgcgaacggaaagcctatgagctgggcggcggcgcttatcgagcacctgcgcagttggtcggtgactttttggcagccaaaccttcttcaggccccggaagcgtcaagccgacctatccgcgtggggtcgcctggggcgagattgacggctgtctcccctcctacatcaccgataccctacgtctcgcaatccctctcttggggcaccgactgcacaggttcgatgaatatgatgcagtcctcaccgcgccggaaacgagatcgagctccccggtgcgggtcgtgcggacaaaagagggccagtcggccaacacatctggcctctggccctgtggagaaggagcaggctatgcgggtggcatcatgagcgccgcaactgacggaatccgcattgcgcagcgactcatcgacaccctcgctcactgatcaatgtttgcggcgccgatactttctgcgcgtcgcatggtcggagcctcggcgagctccctgcttgagacgcttcataacgtcagcttcggtggtgtggtcgatgatcgccttcagctggacaaactggtcacgcagctgtgcggcttcctcgtagtccatcgcgtctgaggctgccgccatctcttcctgcacggtagagagcatcgtttcgatctcagagcgcggcactgcctgcaggtcgttctgcaactgctcctcggtgataccggatccaccgccctcagagtgcgcgggcgtatagaacacgccgttcttccgctcacgcttatcgacgttctcgtgggcctctgcgatgaagctcgagatatcgttgatcgctttgcgaactgtatgcggctcgatgtggtacttgtcgttgtattcctcttgaatccgacggcgccgcctcgtctcgccaatagccacccgcatggagtcggtgagctcatcggcgtacatgatgacctcaccggagacgttacgtgcggcacgccccatcgtctgaatcagggagcgacggttcctcagaaagccttccttgtccgcatccaagatggcgaccagggagacttcagggatatcgaggccctcacgtaagaggttgataccgaccaggacatcgatcttgccttcgcgcagatcacggatgatccggacacggtcgagcgtctcggtgtcggagtgcatgtagttgaccttgatcccctcatcgagcagatggtccgtcaggtcttccgccatgcgtttggttaaggtggtgaccagcacccgctcatgcttcgcggaacgctgcttgatctcgtcgatcagatcgtcgatctgtccgcggatcggacgcacctcgatcttcgggtccagaaggccagtcggacggatgatctgctctacggtccgctgggaaaccttctcctcgtagtcacccggcgttgcggagacatagatgaactgcgggatgcgctcctcaaactcgtcgaagcgcaacggccggttatccaaggcagagggcagtctgaacccgtgctcgatcagcgtgatcttgcgtgagcggtccccttcgagcatgcctctgatctgcggtacggtcacgtgggactcgtcgatcatgcacagcatgtctggggggaagtagtcgatcagtgtatagggcggctcgcccggctttctgccatccaggtggcgcgagtagttctcgataccgttgcagtagcccatattctcgagcatctcgagatcataggaggtgcgctccttcaggcgctgcgcctgaaggaggcgattgtccgccttgagttcggccacacgcttggtcagttcttcgttgatcgtcttgagggcgtgattgatcttcggacgctcagtcacgtaatgcgaggcaggccagatcgggattgcatcgaattcgcgtaccacttccccgctcaccttatcgatctccgcgatgagctccacctcatccccgaagaagctgatgcggatcgggttgtctgagtaaggcggccacacatcgacggtgtcgcctctgacccgaaaggtaccgatcgaaagatcgaggtcgttgcggtcatattgaatattgatcagggagtggattaaatcatcgcgctcaaggggctttgacttgtccacattcggagccaagcccgcatagtcctgcggggagccgataccgtagatgcagctcacggaggcgacgacgataacgtcacggcggctcagcagcgaggaggtcgtctggtggcgcagcttctccacctcctcgttgatcgaggcatccttttcgatgtaggtatccgtctgcgggacataggcctctggctggtagtaatcgtagtagctgacgaagtaggtcaccgcgttgttcgggaacatctccttcatctcacccgcgacctgcgccgccaaggtcttgttcggctccatgatgagggtcggcttgttgaccgcctcaatcactttagccatcgtgtaggtcttgccggagcctgtgacacccacgagcgtctggtacctaagcccctctttgaccccttgggccagcttttcgatcgcctgcggctgatcgcccgccggctcatagggggagatgacctgcagctttgagtcatctgcgccgagcccgaaacgctttaactctgcgccgaagcgctcatgcgcttcggcgcttccggccctcggttctgtatctgttgcaactgtattgtcttgagccacagttagcccttcttcatacctaggatttagaacgtttgttcctaatatatacccttgttagctcacggctaaaaggtctgcggtatagagtttttgatagtgcgtgagggcccgatccaccctctggatataggaggcggtctccggatattcctgagccatctcagtgatggagccttccccagagctgtcccattccaaggtcttcgcgatgcccgcattgtaggaagcgattacctcattgcgtgaggagaaatgctgctgtgcaagatccagaaagccacagccgaactcgatattcgtctgagggtcgctcaggtcatcgaccgcatagaggtttccatccacatacccctcacggatcagctcctgggccgttgccggcatgagctgcatcaatccctgtgcccctgcgcaggaggaagcgtcagggtcccaattgctctcggtcttgatgatcgcgcagaccagcatggggtctacatcgtggcgcttagcggaatcaaggatataggacctataggagacgggataccacgcgcgctcaacgcggttgacgatcgcagtaccggtatccgtctcttcaaagagccaccagagcgtaaaggcgacaagcgcaaagcagagcaggcgcacgatatgcccgcaacagccccgtcttctcatcgcttccccctccagccttcggcttcgtgctttgcccaccagctatctacctgatgaagcaggttctcccgtgtcccgttattgtcaaacaccgtgtccgcatgcgcttcgagatattcccggctcggctgctgagcaatccggcgctcaaagtctttctcgtccatgccgcgcgcaatcgcacgcttgcgcctcaagtccatcggggcaactaccaccgccacctcatccgcttccggtatcaggttctccactcgatcgagcagcgggatctccaccacaacgaccgtggcgtcagcgtgggccagatagtcctgcagcttctgctcaattgccgggatctcgatattctcaagttgttgtgtcgttgccgcattcgcaaacgcacgctcagctaagagatggcggttcagcacgccgctgctgtctacgagatccgctccgaagacgcgagcgatcttagaaacacaaggctcccccggtgccaaaacgacacgagagagccggtcaagatcgcaacgcttagccccttttgaggcgaggtgctcagccaccgtcgacttgccagaggcgcaccctccggcaagaaacagtgtatacatcgagggtgctcctatgagttggaattgaacttggtatggcagcgcgggcaggtgacacggatagcacccttaccgcgcggtactcggaccatctgtccacagttaggacactggatatgcttgtagttcttgagttcctttgctgctgcgcttgggtttctgagccacggggcaaccggccccataatgttgacaaagtgctcgttctggtcccgcagggtctgggaaacgggggcgaagaggcggaagagcgcataggcgaccagggcgatgataatgatcgtgatccaaagctggttcgcaaagaggttgatgatcaggaagatgacggcaagcacgagggatgccaccgccatctcatcgatgccatttctgttctgcataaagttgttcgcgtttccactttgcattggtggagttcctttcgttgtgcctcactaggtacatcatatgctatatctctttaatgatgccaaataacatcacctttgatgcaggcatttaaagaaactgaagaaaagaccatgcttgcaagcaaaccatcaattgttgtact

SEQ ID NO: 282 - DNA, 16702 bp, Unknown
  Metagenome-assembled genome
ttgtgtgagagggatccctagagtagttcacatcacgaccaagtggagggtacaaagttgcaactacggcttaggacagcccccgacgtatctgatattggcattgttgctcgaaaactccgccagatccttgctcgacgagaaaatcggtgtcctccaagaaaggagtgccagcgctcctcgataaacggagccgagatacgacatgagggtatccgggaagaaggcggtcagcgtgagcggcaagccggcgcataatatcgaatctgcgccatcgtttcctgcacatgagggcgttggatcttgtattgcggaacatcctcgacgggtgattcaggcgtcgcgcccgggtgtactgggccgatggaagccgatcccaggggcacgtccgtcgattgagttcggaagaaggtcctcaatcgggatcgcatactctgcacccatgaggattgagaggacggtctcgcgatccatcgggatccgttcgcttgcagcttcgactattgacagaaaggttccggcaggatctctgagcgccattcgagaggatctgtccggcccttcacaaaggtaggaggcccagctctcgagatccgacgcagcgtcaccggcgtcatcacgtgcatataattgtcgtactgcgccaccaccgagaagatctcatgcatacgtttaggcggccctgccaggcaccggtccgataggtggttatagcggcccacccctcaggccgatgttttttttctgagtcgtactctcgttctcgacgcctgaacacatgttgtcatagcgtccgtctccttccttgaagtcaccggacgccgtgatgttcgtatctggttgtccgaagagttcgcttcgtccacgcccctactccgctttgtcctgatccttatcggaagcatattctacgtctttgacgtctacggttgactggtgacacggttggccgcatctcgtgcatcgtctcgaccttcttaacgaagtccttgagctcatcgtcctcatggtcccggcataaggtcttgagagcgatctcgagtaaggtgtgcgccgggcagagcgttttgaggtcgtgttgctttggctcatcattaagattctggccctgatcactgctgtctggcccacgctggacaggttgtcaaacacgcctccgagctctggtcggcccaaccgttgccattgccccgaagctgccaaaaacattcttctctgccgagtcgacggatttttaagtcagccatactgccctcctatattccacgagttgcatttatgggctcaaatcggatgcttttagagcaatagaggaatctcggtggcaggaatgtctcataatgcctgaaggcgctatgcggcggtaaaggagattggtatcctgttcacatatggtagatcgcagattagcggtgaaggcaagctttggcttgggtcttcgcatctcttttaagaagcgtgcagatataaaatggctatagcggggagtctgccagacggcttgtaaggagatacacctatgctcttgcaggtggtggaacgcaaaggtatagaccacctaatcggaaccatcgacaacaaaaggggaagataggtgcctaatctctttcagaagttaccagcggaaggtttggataggtgctccgctgggctagaaagtctggcaaacacagaatggatgcggcattgacatcgtatcttgtggaaaagggataggcagtgtgtgtccgtgattctgtacatgttgtagaggctctacgcaaactcagggctcgcaggggtcaaaaatttgatacagccgacagctctatcatcgcaaagaccctgcagtgtaggtgagacaaagagccaacggaaggccttgcagatgatactcataggctctgcttgatttcttaatgcgttgtctgccagtacctaaaaagagggtgcaggattatctgccttttggattctcattgccgaagcgcgagccgctttcactaacatcgtaaggtccacttcttggacctcttgcagatggcccgctgcccacaaagaacggggggcgcttggtgaggctaaagaaaaataacagcgaaggccgccaaaaactcctgtggggcgcaccttgaggaagaggcttgtggtgttttttaagatcaagcactgtatctttgagatccgaatatttggaaggcgacatcaaaacacaccggcaaacgatgtgatagagagctgcatgtaaggtggagccctcatcatcaacatcctgaagtctctacccgtttttttttctttcttattctttgcccacttgtcacctaggcaggggttcaagcacagtacaagaaaggtgatgtgtctcggcctaagggcagctctgatcgtaaactacgacgaaatgacccacagagcgatcgatccggaagatgagggctaaagggttgctatcaccaacgcaaggggcttcctgacctggaacgcgtcatatgtggcttgctgcagcagctatgttcataaaaaaaggcctcaaagagttctgtaggaaagaagcgatactgaggcaaaaaacacccctatagtggttggctgtagctgccgtggcaagaaagctcctgttctcatcatctttgtgtgatgagagacaaggtggctacaaccctaatgatttgtacaatcaaaaaaactgcatacttgtgtttgctgctgtgattagggttcaagctgcttcatctattgcgccggaagcattcgatattagatgtcaaacacagtgcaaactatcacaacacatacaaaaacaatctttagacatctcttcaacagattcatggttttttacgtgacttcctatagctggctccttaaataagaggggcctctcccccctaatacaccacattacctatatagcaattctcaaaatgagtaaaactgttaacgcaaaaaaggtaagtattacccctagaaaaggcgcttcgctacttatggtgtggtagcactactgcatccccttgagcacgtggtacccgggacaagccaagatttggcgacggatgcggccctaaggtgcggtatggatgcttaaggtaaggcatgtgctgacaaggctcttaagaagcccaatggggccttctagggggcgaaggagccttcgtgtctgatttaagaagctcgatgggtgctcaggacatcctgcatgtgagggttcgaatttactgggagggcaggtaaaagtggtgtgaagccatgctgaccaaaaggtcgcattgcagccacctgtgacaggacgcgagaggaacctttgtggcatctcctgacatcggcaattacgagacgattgtacacggcgcaaggttttaaattgagggcccaaaggacagcgtgcatgctgaaaggatgttgccctgggaggtgtgcacgaagacgcacaaggcgctcttgaggcagatgatcgtttgtcatgagagttgtggcataagcctgcacgagacaagcccacgtgcatatagagatgcattggaaggagacatcgaagggagggttttggtgcagcagaactattccggagtcgtgcgttgagtaacaggcaaacaccgcccaaaggtgcaaccaaagctacattaacatcaggccgaccctcgaccggcctgcgccgcctcacggaaagcagaggacaagggagcagcggttgttgaagctttgagatgagcttagggaggcacacagggaccagacgaaggggcttagaggccatagcgccatggcaaagacaaactccttggggtcaccacagcgatgccccagcaagcacttattcccagattcgcgtctacaggaaaagagcgcggcactgcgcgagtaagtgggcaggaaagaataagaatatatgagggagagcctcacagagtaccagcttgaacaaagagaggagccgcgattccgtgaagacacatctagggaggcgcgcgccgtcagatggcagagggcgatgtggcgacgtgtatgttgtaccgacagggaaatcggctgctgcaagaacacaggaccgcttctgattgtaggtgatgcacttgccatggactaagggaagagggtggaaggtaccctcggaaggagcgtaggggatcttggaaactggtggagtgaagaggctcgaccgagtcgtttcttcggaatggctcaactccctcgtcaggtcgtccggaacactgccaggggcttacaggaacatcgcctgcttgaaggcaatggtattcctccaaacggggaaactcaaaatttctcggcccagagagggcagtggctgtgtacccactagagacgtcgcaaagagttaaaacaagcgtcgggacccatcgtcggtcttcagatcaatgccctcagctgttattgtgacgtactagtcgcgcttctcgcctgcgctcggatcgagcttgcgaccacccataatatggatgtggaagtggtggactgtctgccccgcatcgtcaccggtattggtgatgagcctgaatccggtcttgtcaatgccggtctgctttacgatgacgctcacagcgtggaccatggcctcaagtacctcagacgggacatcgtcgagaatgttctcgtagtgcttcttcggtaccaccaaaatatggaccggcgtcagtggattggcatcttgaaaggcggcaaccaggtcgtcctggtagaccatcttgctcggaaccttgccggcagcgatcttgcagaaaatacaattctcactcatgtgtgacctccttgagcgcaacgatgtgtggatacccctaattttactcgtccagataggcggtagagggtgccgaggtggtatccggcgcctgctcatccttcgtatcgtcgaggagcacctgtaccttctgctctgcgtgcgccaggcgctcgcgaaggctcttaatcagcgcgactccgcgctcgtagcacttgagggaatcctcgagctccagatctccactctccagggagcggacaatcttctccagctcgatagaagcctctttgaagctcatgtcttcaatctttttctgctctgattcttctgccatgatcttttactcctcattctcttccgcctggacgctctcaacctgagccgtcaggccaccgtggcctaatcgtatcttgatctggtcgttgacactgacatcgcttgcctggctcaccacatgacccttgctgtcctgcacaatcgcatagccgcgcttgacaacattaagcggagacagcgcagtgagcgcctgcccaagcctgtcagtcaactgtgtgtagggattcaatagcctgcccccgatactgaccaaccgctcggaatcgttttccaaattccgcttgcgcgtatcgatcgagcgcggaatcgcatcctgcagtcgctgttccgtcattgccaactgactcttgcggtcctcaatcatcgagcgtggctcctgcatgcagcgatggttcgctaagctctccacaagcactgactcacgctggatctgattttccagcgagcgtgttatgatcttccccgcatcctcaacctgctgcgcgctgcgcttaaggattgcggagaaggcttgtcccaagcgcacctgccggccgttgatcgtctgcacgatctcatcaagcgccggggcgactgactctgccgcggcggtcggggtcgagcagcggcggtccgccaccatatcgcagattgaggtatcgggctcatggccaatgccggtgatcaccggaaccgagcaggcggctacagcacgggcgagtgcctcatcgttgaatgccatcagatcctcaaaggatccgccgccacgcaccagcaggatcgcgtccggctttgctgctgcggcgactttgagggccctgatcatcgaagtgggtgcctcagtgccctgcaccgaggcacccacttcctggatcgcaaccaagggattgcggcgtctcaaggtccgcttcacgtcctcgatgaccgaaccggaaagtgaagtcaccacggccacacgagtgcagaaccgcgggatctcccgcttacgctccggggccatgaggccttcccgctccagctttttggctaactgagccacctgttggcgcagcagaccctcgcctgagacatagaccttacaggcgataaaagagagccgtcctgagcccggatagacgtcgaacttgccctgcataatgagcttcaggccgtctttgagctggatgccggaggaagcatagatcgatctccacacgatcacggacatcgaggattgctcgtccttcacctgaaaatagcagtgaccagacctagcattggggccacggaagcctgagacctcccctgtcaccaccaggttgccgatgccggctgcggcattcttcgccagcagcactgcatcggatacgcttataggggttgcttccattggcatgacttacctctcatcattcgtcgttccggtaaggtagagcaactgcaggatcgagacgagcgccgctgccacgtaggtgagcgccgctgcagtcaagacctgacgagctccccgctcgtcgatggccccgccattctgggaaagataggttacagcacgttgagaagcgttgatctcaacgggcagggttaccaactcaaagataaccgaaatcgcgaacaaaagaatagcaaattggactaggccggtgacgtccatgaagacgccgaggaagaaaagcaccatccaggcgttggacgcgaagttcaccaccggcgtgagtgcgcttctcaccttcatcggcgcataaccctgggcgcgctggaccgcgtggcctgcctcgtggcaggcgaccgctactgacgccacggagccttgcgtaaaattctcgttggagaggtgcaacatattgtcacggggatcatagtagtcggtaagcgtaccgtcaacgcgggtgatccctacatcgccggcaccaccggctcgcagcatctcttccgcaacgtctgccccggtcttgccagtacgggaatcaactttcgaccattttctgtaagtgtgtctgatatagccctgtgtggccaaacccaacacaagggagatcaaaaccaagagccaatagttcatatcggccccatagccgtagtaaaaccaaaaggacatagaatcctcctttgtacggtttcaatagtgattatttctaccctaagtctgacagtttaaaagacctttagagaatctcaatatgcccatctttgaccgtgagaccgatctctccgaccagcaaacggtgcaggtaggaaccgatcacatcctcccgccaggtggcgtgcaggggtgaccccttctcgtggttcaaaaactgcgacaggtcattatgcgtcgcaatcatctgtggggcaacgttaactttctccgcctgtacacgcagcagcgcattcatcaggtccacaacgctttccgcctcaggcgaagggcgggagtggcggtggatctccggatactgcgcaggtggacaatccttaccctctttgattgcggtaaggagcccttcgagcatcggctgctttaagtgctcggtcccccggatctgcagcagcttctccacagtcgtgggagcgcgcttgcagcactcaacaatcacctcgtcggcaaggacccagcgcttcgggatatctcgctttgaggcgattgtctccctccaggcacagacattgcgcgctaccgccaactgccgtcggctcagggagttagagcgtctaaggtgcaggtaggctgactccggggaatccttgaagcgtgaaggatcgctcagcttgtccatctccggtttcacccacatgagcctgttttgctctgtgaactttttcatcatcgttctataaattccgggcagatacgccacgtcctcctcggcgtagcgcagctgctcttcgcgcagcgggcgctttgaccagtcagtgagtgactccaccttcgccagatgcacaccggtgtaggcttccacgagattcccgtagccaatctgcatcttttgtcccaaaaaggcggcaccgatctgcgtgtcgaagattggggtcacgacgaccccacccaaggcatggtagagcacttccagatcctgcccacaggcgtggaggatcttcgtgacatcggggtcgccgagtatgcccgctaaaggtgagaggtcctcaatcaagatcgggtctaccaccgcagagacactatcagtggctaattggatcagacagagcttgggatagtaactgcgttcccgtaaaaattcggtgtcgaccgccaaaagcgaggtatcggcaatcgagccaagaaatgttttgagttggtcggtatctgttatgtacacggaatcccttcagcgctcagatatagtgtttaatagtatatgaaagagcgattgtatagacgacctgattcccatctatcatagctgcaattcgaaaatgtcagccggtctggaggtaaaatgcggagtcttatcatccataacctgaaatcgggattcggctcggactctatttttgaattcgagcggaacctcgtccgtgaaggggatgagtgcacgatgcacgtaatgtccgaggatgatacggcagaatcgctggtcaagaatgccgaccactacgacgtggtggtgatctcaggcggcgacggcaccgcgacaagcttgctctatgcgctgcgctaccgcaatatcccgacctgcatcttcccgtccggcactgccaacctcctctttgccaatatcggcaacgcgaatgagcctgcagggctcgcgcgtgcctgcagagtcggccataccgccgccaccgatatcggaaacgtcacctggaccaacgagcagggagaaaaacatgtccgcggcttcggcctcatgtgcggcatgggtttcgatgcgcagctcatgatcacggcgctgcccaacaagcggtcaatgggagagatggcgtacttcaccgcggtgctgcagaaccccaaccccatcgtctcccacttcacgatcgatgtggacggtgagattcacgagtgtgatggaatcacctgtatggttgcgaataacgcaatgatgcagggggacattgaggttgtcccggactgccggatggatgacgggttgctcaacgtgattgtgcttgcagtgaatcagccgattgaggcgttacggccgctctttgcgggcatattcgataagacaggcaaaaatatcggccgcccccagattgagactttcaagggcaagcacatccacatcacctcctcagaggcgatcccgctcgagatcgacggggagacaacggaggggacgattatgtcctatgcggcgcaagtcttccccaaggcaaacctgatgatcgtcgacgagatgtcgcgctaccacaaggacggcgataaaaccccgcgcttctccggcaccgatgagatcgcctatccggaatagcaaccaagaaagcactggaatgtattcatttacaagccgtatccgatacagtgagatcgataaggacgcccatctctctttgttgggctgcatgaactatctgcaggactgtgggacctttcaggcggaacacctaggcatcggcctcgaccatatgcacaagttccactacggctggatcgtcgggacctggcacatcgagattgaccagaccccgctcttcggggaaccgatcacgatctccacgtgggcctatggggtcaaaggcttctccggtaagcgtaacttcacgattgaagacaaggacgggcacgccttcctcaaagcggattccctatggttccccttcgatctgaaggctcagaaggtcatccgtgtccccaagtcggatctcgcctacctggatcctgagacgccccgcctcgatctgccgcccctaccccgcaccatcaagccaaagggcatcccaacccagggcagaccgatcgtcgtgagcgaggcgctgctcgacacgaatgaccatatgaacaatgcctactacatcagcttggcacaggctgcgctgccgaaccgcctcccccatgtgattgaggtgcagtatcggcgggccgccacgctcgacgatacgatggtgccggatatctataacaccccgcagggaggccacatcgtcgatctcagagatccgtatgggactacctacgctgttatccatttcgaacgagaggaagcgctctaactatggcaaataccgtgcatgttgcagcagcgatcatctacaacaacgataaaatatttgtggtacagcgcgccgaaggctccatgacaggtgggtgggagttccccggtggcaaagtcgaagagggcgaaaccgctgagcaggcctgccgtagggagatcaaggaagagctcggcatcgatctgcagaccatgtggtttatggacactgtgacctatgactacgaagacttcacgctctcgatggactgctttgtggcgcccctgcccaaaggacagacgccgacgctcaatgttcacatctgctctgacagcaaatggctgggcagagcagatctgatgtccgtcgattggctgcctgccgatatcacgcttgcccaaaacctcgggcaatattggagcgacttatttatgattcaggatgaattttaggagttcagatggaagagaccacaaagcaggaactggcaccgacccctcactatatagaggggtttgcctcgaccaacgatccccacaatgaaaaatcagggccagctgcaatcgtaatcacggtcgtctcactggcggcgctcatggcgctggcgggggcgatcataacaggagtactcgcactggcgacagcgatgagctattcctcaccttactccccggtgatgccgccctcgctcaatagcccctacgatgactattacggccagcagaacccctttgatcaacataaccagggactgccaggcagtaattcaggacaggactatgagtactggacgccgatccactaaatcagattctatgagaggaatttcatgagcaaagctgatgagctgtttatcgcgctctgcaagcgcatcctagagcatggcaccacgaccgaagggcagaaggtccgtccccactgggaggacggtacccccgcttatacgatcaagaccttcggtgtctgtgaccgctacgatctctccaaagagtttccggcgatcaccctgcgacgcactgcattgaagtcctgcatggacgaggccctgtggatctaccagagaaagtcgaacaacgtccacgatctgcactctcacatctgggattcctgggcggatgcaaccggctccatcggcaaagcctacggctaccaggtcgcacaggtctcccactaccccgagggtgacttcgaccagatggataaggtgctctacgacttaaagcacaacccctattccagaaggatcatgacacaactgtacaacgtacacgatctcaatgagatgcacctctacccctgcgcctacaatgcgatctacaacgtgacgcaggatcctaacagagacaagccaactctcaacataatgcttgtacagcgcagccaggatatgcttgctgctaacaattggaatgtgtgccagtacgcgatactactcatgatggtggcacaggtcagcgacatgtatgtaggcgagttagtccatgtgatcgcggatgctcacatctacgatcgccatgtccccatcatcaaagagctcatctctcgcccgacctatccggcgccgaaggtccatctcaacccggatatccacaatttctatgacttcacgaccgatgacctgatcgtcgaagactatcagtacggcccgaaagtcacacacatcccgatcgcgatttaggatcacccatgaaagcaatcgttgcagtatgtcaggactggggtatcggctatcagggaaaactcctcgtcaaaaaccgtgaggacatgcaccactttgtgcagtgcaccaaaccgggtaccgtcattatgggaagaaagacgctcctcaccttcccaggtggacgtcctctaaagggccgccgcaacattgtgctgacccatggagacagagtagatctgcaaagcggcattgagatcgtccactccgtgaaagaagcgcttcaagctgtacagggggacgatccggagcatgtctgggtcattggtggagcctcagtctatcaggagctgctcccctactgcagcgaagccgtagttaccaaggacgaatgtgtccgtccagcagatacgtactttctgaatctcgatgaggatccaggctggatcctcatacagtgtgagccgggcggcatgactcccgaagatatcgcattctcattcgctacgtacagaaacctgcagatcaaaaccctctagggaaacgatgattaattcccaatgatgtgccagaaagggccagctacgtggcctttcgcggctggcataggcattaatcatcatttccctagcatattttcccgtcgagacaatttgaggggcgcagttcatagtgaaccacgcccctctctctaccaatgtagcattagtacttcgtgattactcgaagtcagtcgtcgtattgatcgtgttgcgcaggaagtcctggttctccttacggttacgggagagctcagcagctgcgacaaccggcacccagtacatgatgacctgcttggcgatatctgccttcttggagaaaacatccagatactgctttgccatgtcccgattgtcgattgacatcaacagataggtcgttgcagcatcaacctctggcagacctgcggtgacatgtgcccagtcgcagatagccggatcagagccgtcatccggaagaataacgttagacgggttgaagtcgccgtggcagatcatgaagcccggtctcataccatgaatacgcatctcgaggtcataacgggcagacggatcgatgtccttcgcggctctgaccatgcgctgcagtttatccttctggcggttaagtgccggagccttaacgtgttgaaccttgatctgcaggtctacgaactcagagagatactccttgttgttaccaggatcattcttcatgatcgttgcaagatcggtacccggaatgaacgcagtggcgagcgcccaactgcccttccactctccgtcctcaacctgtgagacttccttgatgccggggacgcgaacgccagtctcctcgacacgagctacgttgagtgcctcattgaagacatcagagcccggcttctcagagttgaagaccttgacgagactatttccatcttgatagacaaccttattgtgccggcgaacgatctcaaccttactatcggatagcttcatacaaccactccttaatataggttatgtacgaacgtccttacttgtgaaggaaggaggatgttgctcccccattccctattgtttcaagcgatacgcgctactcagcctcataggcactagctggacggccatagtaggcatccaggtacaggttcttgatctcgctcatgagcggataacgcggattggtaccggtgcactggtcgtcgaatgcctgctcagtcatatcatccagcgtatcgaggaagtacttctcgtcgactccgtactcagcgatcgtgtgcttgacgcccacgtaatcaaagagcttggtgatcttcgccaggaagttctcgaatacctcatcgtcgtccttgccagtgacgccgcagaagcgggctgcctgagcatagcgggccttggtgtgaggatacgcgtactgcgggaaggtgcccatacgggtcggcttctcagcagcgttgtaacgcatgacacgcgtcaggatgactgcgtttgcaaggccgtgcgggatgtggtggaacgcgccgagcttgtgcgccattgagtggttgaggcccaggaatgcatttgcgaaggcgagaccgcccagagtggaagcattggccatgtggtcacgtgcctcaacatcagttccgtcatcgtatgcacgcggcagatacttgaagacgagcttcataccctcgagtgcgaaggaatcagtgaagtcggactggtacatggagacataggcttccaggcagtgggtcagcacatcgacgccggatgcggaggtcaggcccttcggctgcgtcatcatgttgtcggtatccacgattgccatgtttggcatcagctgatagtcagtgacaggccacttgatgccggtctccatatcggtgatgattgcgaacggggtaacctcggagccggtgccagaagaggtcgggattgcgacgaagtaggccttcttgcccatcttcgggaagcgataaatacgctttctgatatccatgaagtccatggacatatcggagaagtcctcatccgggttctcatacatgaaccacatgatcttgccggcgtccattgcggagccgccaccgattgcgatgaccacgtcaggcttgaaggcattgagctgctcaaggcccttctcagcatcctgcagcttcgggtcaggtgagatattccagaagctggagtggacgatacccatttgatcgagcttatcctcaatccttctggtgaagccggactcatacaggaacttatcggtgacgatgaaagcgcgcttcttgtgcatgaccgtgccaagctcgtcgagggctgtcggcatgcagcccttcttgaagtagatcttctcaggagtacgaagccacagcatattttcacgcctttcagcaaccaacttgatgttcagcagtttgtcaatggttaagttgccactgaaggagtttccgccccaggagccgcaacccaacgtcagtgacggcgtgagcctgaagttatagaggtcgccgatgccaccttgtgaagaaggagtgttgatcaggatacggcaggtcttcatacggttctcgtactcatcgagcttcttggtctcacgggtgtcgatgaagatcgagctcgtgtggccatagccgccgtcgtggatcaggcgctcagcctttgcaagggcatcctcaaagtccctggcgcgatacataccgaggatcgggcacagtttctcgtgagcccacggctcggaaggatcaacagactcaacctcagccaagagaaccttggtgttagcgggaaccgtgacgccagccatctttgcgatggtggcagccggcttaccgacgacctttgcgttgacggagccactgacgatgacagtgtggccgaccttctccttatcgtcgccctcgaggaagtagcatccacggcggatgaactcctctttgaccttgtcatagaccttatcgaggacgattacgttgttctcagtggcacagatcataccgtagtcaaagatctttgagtggatgatcgagttgacagccacattgatatctgcggtgtcgtcgatgatagcggggttgttgcccgggccgacgcccagagccggtttgccggagctgtaggctgcggtaaccataccaggaccgccggttgcgaggatgcagtctgcggagtgcatcagctcgttagtaaggtcgatggtcgggctcgggacccagtcgataatgtgcttagggagtcctgccttctccgcagcatcacggacaatgcgtgccgcctcgattgtgcacttacgcgcacgcggatgcggggagatgatgattgcgtttctggtcttcagacagatcagggacttgaagattgcagtcgaggtcgggttcgtggtcggaatgaccgccgtgatgatgcccaacggctcggcgatcttcttcataccgccggccttgtcctcctctatgacaccacaggtcttggtgtgacgataggcgttatagatgtactctgaggcaaagtggttcttgatcaccttgtcctcaacaagacccattcccgtctcttcgactgcgagtttcgccagtggaatacgggctttattcgcagccaacgcagcctgataaaagatcttgtccacttgctcctgagagaaggttgcaaactctgcttgtgccttccgcatcacagcaatgtgttcctttaggctatcgacactgtcgataggctcaagtttatcggccatgtattacctcctgcttccgctagaacttacgtacacatgacgtgtttatcatacctgatacatgtctaaaaacctatatggaacaagagataattttgcgaaagtaggccgatgacctgcgattgtatagaaaactatggtcaactcaacagctcgagcgcctcgattaacgcatcgatttttccgtgtccacaggtgagtcgaaaccaagttttatccccatgaacagtgtcgattctgaaaccgattcctaaaggcaaccaactatttgatgggctggccagaatgcggtggatgctatgcaccgcaggcggttccatcacaaagtctacacatggaccgaatccatgctgcaaggttgttgcggccacctggaaactgggatccgtctttatccccggatacctgacttcgcggactttgggatggcagaccagataggcggcgagcgcttgggtgttgtcccaacacgcctgtctccgctcatcaaaacgatctatccctgcgctcagatctgtcacaacccgcttgggcagcgccgcctcacgatcgagaaacgcaagatacggctttacaatctcagggagtgcacgccccacgctgacagcaaagaagccacatcccggccaactcacaaccgcatcgagcggctcgatggtgagggtggcacccagctgtgcagcagggcacccaaatgaggttgc

SEQ ID NO: 283 - DNA, 9724 bp, Unknown
  Metagenome-assembled genome
tcatcatagccttcgcgattgttccggatggtaaagaccgggaacagttcttcagcgtccggaccaagaatgcagcagtcgtgcttgtccttggcgacatcgattccaacgtagatcatctttaagacctccttcaaagaagcggttgattgttctgatgctgtcgtcagaccacagggctttctgccaatcgtatcctcgttctacataaaccgtcatgcggtatctaactgatcaacaatgcagcaaagaggctgtggctgaagcctctctaaaaccgtcgagcggtaggggagcaagaccactccacagcatctgatgacaatgtagctgtttaccaggaacaggtaaaggaaagctaccacttaataatacgaggggatcctggcgtatcggatacaaggcgcatatcggcgtggatgccgcaggtggccttgtgcatggtgtaaagacgaccgcctagaatgtgtctgacatatcctgtggcacacacactcgtaagggaagatgacaggttttgctatgcagactttaggctatagaggtatagcgaagcgcccttaaggacgcataaagacccacacctctcatctatacgctaaagcgttgctaaggaagccttcgactagagagggccttgcctgtgcactcttgtccgaaaagggcatcgagtccaggaaggcatccggccgctcaaaagcagaagcacccttccttatcatgaagcggcgcttcgaccccttaaggaagcgctacagaaggatagagaagatgcctgtacactctagtctttctcgcccttgcaaaccttacccatgtatcttttgccggcaggctgcacctcccggctcccagagtcgcttgatccgtcttggagccttcttgcggtgcatggggcaggacaaatgtaaggatagcggcttctgcacgtgctggatgagtatctttccctgcctttcctgcatgccggcctagaaaagtcgtgtggccgggcctctctggcacatcatagggcagtaatcagcgtttccctagcatcaggatctgcggcatccatcggctcttctgccagatatcgttttcttcaaccatatatggtagtttcaccgataccatatttgcgtgtagcatgtgcctcttgccaaagcacagcttaaagggtctcccatcccatatgttgagggtatcttgtatggacagagtggtcatatagcataagattttatactcgtctgcacatccaaccatagagggtagagccacacaccgaatcaggcggctcgtcctttgctggcgcaccatcgcgtatgtagtctagaaccctttcgatagattcctgtgagtatgccacaccccatcctttggggtgatagccctccgggatcatgggtgcacctcctccttcaactctgggaactcgtttgtgtataggtttcctttgcaggctactcctgacctctcagcagaaggcagacgctttccacgtggtagctctgggggaacagatcgatcggttggatctgtgctgcatagaaggtgccctgctctttgaaccaagccaggtcccttgctaaggtcgtcggatcacaggagacatagacgattgcacgggcaggctgccctgagagctggcatacgacgtcttccgtcagtcctgcgcgcgggggatcgacgacgataatatcagcatcctcttgggggaactcacggcctgtgtcgccgccctgcggatcaacgttgtcgacgtgatgcagcttgaggttgcgtctgagatccctaaccgccgggccgtaggcttcgactgcatagacgtaggagactttctgggcgagaggaatggtgaacgttccgacaccacagtagaggtccattgccacatcgttcggccgcggctttagatagtgcaggacggtctgaatgagggtctccgcacccttggtattaacttggaagaaagagggggcgctgatatacatggtgttgtcactgagacgctcactccagtatccatcaccagcaagacactcgacaccggctatcttgcgggcctttgcggtacctttggtcatgacacgcaccactgaggtgatcggtcctgcctcggagagaatcttaccgacacgggcacgcgggaaggaagagggggatccccacagggcaacctcgacggaatgtgtacgctcagaggtacggatcccgatacgatacaggttcagcggatctccgtgtgaagcataggacagggctccggttactgacttcacaaactttgcagcttcttttgccatgagcgggcacgtatccactttgatcagcttgttgttaccgcgcgcatgcattccgatggtgaccttgccgttttctacacgatatcccaactcaaccttattgcggtagccccagggatcgctcggtgtcaagcatggctgcacgagtgcccctgcccggtcttcattcatgtgagcaatgcgtacgagggagtcgataacctgtgtgcgtttctgtgctcgctgaatggggtagacgatatggccccaggggcaacctccacagacatcgacaaaggggcagggcgcctcaacgcgggcagctgagggttggacaatgtttacgatatgcccttttgagtagcgcttctccacatcggtgattgctacctcagcagtatctcccggaacacccccgttcacaaagactgttttgccttcctgatcctgagcgattgcgtcaggaccgtagctgagacgacgtatgtgcatagtttccatatagagttctgcaggagacataaatacatattcctttccggaatgggattaaattcaatataaaataaaaagagaaatgagtttcctagcaacctttgtagtgtattgctttttagagagcttggcagacatgatagtgaaatatgtcaggtagatcgtctttttagagggttgccgctgaatacatgtgttacaggtttgtgcatgaaagctacctcacaagtatttctgtataatggctgagtacctccagcatagttaggctccctgaactgtaagcggcttaaggcaagatcgaaggcatcttcggctggaccgtcgcggtggctgcgatgccaaagagcaagacatggatgaggcacatctcgtgcagcagctccatgcagccatcccttgcatccctgtggctgtatctttagctgaacgagtccgcaaggagtgcatgtgggccttgggaaggccatggaaggcgccctcaacgtaggccttgaagttggatatcaccctgtggaccatgggaagggatgcatccccgtccgctctgtcgtactccctttagacgagcccgcaaaacgaggagaggccggcaagctttgccgctccagccatccgcccttatcttcgatgtatggcagagctggtcatgccccacctggcgccagcaatctttcgagcacccctttgcgcagcgcagggggcaggagccctgcctgccgctgtaagcatcggctgctgctttgtgccgcgcccgcttttgcctggtgccttggcgccgatatagaagtcgtccacctcgtgtgtgtcagctgcaaggacactgaacgcactgcgatctgacccaggcgagtatatccttaaaaggacccgccctgccgtctttaagctgcagcctatctgccttctgcagggcgcaggcgctgatccttgccttctgggcggacatgagccatatcgcccacgaaccacttcctgagctcgaggtgggtcccctccatcaatagtccctgcgctcacgctcacctggtgcgagcacttcgtgcactgccacttgtgtgcgtggcctcagaccttcgagcaggacgtattggcgcacaccgggcagacaaagccgccggagaccttctcctcgagcagcctcccctcgcacgactcctcgtctgagaacctctccaaaaggcccatcaatgtctctttgctctcgcattcgcgcctactcagagcgactgcatgcccctttaccatctctttctttgccctctcggatgcatcaaccttgcatcctcattgtacggtttggaagcgacaggaactcctgcggtcatgctggaggtcctcagtcatttttctgtattcctcaagcgcatgagccagatgtatcagtcgacatctgtattgttaattcaaccatacaaatagcgacctgatttacgtggagaaatacgtctgatgatcagctgaaaggtagacaggttcttgcagattgctgaggatactagctgtgtacagagcaggtaaatgaatgaatcacagtaaagtatatgtcatttttgagatagtgcctgctgtagagatgaggtgtcgagttgattttccgctgaagaactttaccacaccaatcaggcggtgcatcggtgtatatgagcaagttctatgcgaaactaagaaatgatatacaggatcttttctggatgattaacagttcataaaacgtatgcatgattgaaatggagggtcaccatgagaaacttatctcgtagagattttctcggaacttcagctgcagcactcacaacgctcggcctcgccgcgtgctcccagggctctgattccgggggcaacaataccgacacaagctcaagcgcaggctctgacgatctgtcccgtattgcagatcaagatatgatcgatgcggctaagcaggatggccagttagttatctacgggtcttgcgaagaacagcatgttgctgcatgtgcccagcatttccaggatctctttggcattgacacttcatatcagcgcctctcgaccggtgaggtagagtcaaagatcgaagaggaaaacggtcacccctccgcagatgtgtggttcggcggaacgacagatccttacaacgtcgcagccaagaagggacttttgcagccgtacgaagcacacaatgcctcgcaccttatctcggatacgttcagggatgccgatggcaattggtacggcatctataagggcatcctcggtttcttctacaacagggatgagcttgaccgtcagaatattgatccaccgcaggactggccagatctgattgatccaaagtataagggtatgatctggacctccaactacaacactgcaggtaccgcaaagcttgtcctcaacacagttatccagaaatatggacatgaccaaggcatccagtacctcgtagatctggacaagaacgttcaggtctatacgaagagcggctctggcccctctaagaacgttggcactggcgaatgcacggtcggcattggctttctgcatgacgcaatctatcaaatcgtcgacaacggctatgagaacatcggcctcgtgatcccttcctcaggtgcatcctatgagatcggctcaaccgcaatcttcaatggtgcacagcatcagaatgccgcaaagctttggattgagtacgccctgtcaccacagtgtgtcgagcgcgctcaagaggttggcgcgtaccagttcctcgttatcgatgacgcgaagcagccttccgtcgtggatcagtatggcctcgatcccaacaatgtaatggactatgacttcgaggacgctaagaacaatactgagcaatatgtcgccgacattatgaatgccctgggcggcggcgacagccgtttcaagactgatgattccaattagtctcattttgtagatgtgtccctcgatggaatgcgggggacacatttctgtatgttgcctgttgagagggggattcatggcaacaagccaaagtgctgagcttgaccgcaagaagatgatgggtgaccccatcctcgtcactaccatcattgtgctgattgctttcttaacgctctttattctgtatcctttggcaatactgctggtcgacagtatcgtaactgatgatgggatatccctttcagtctttcaacgtgttctggcaatgccctcctttgagacggccattacgaacacattgtcacttggtttattcgtcggtgtgtttgccgcgctgatcggcttgcttttcgcgtatgtggaagtgtatgtcaacctggagtcacgatttatgaagtggctctatagcctcgtctcaatgcttccggtggtgtcaccacccttcgtgttgtccctgtctgtgatcttgctcttcggtaagtccggaataattacacgaggacttctggggatctacgacaacgacgtctatggatttagcggcatcgctcttgttcagatcctgacgttctttccggtctgctacatgatgttcaggggactgcttaagaacatcgacccttcactggaagaggcggcccgcgatatgggagctacccggtggcacgtcttcacgaccgtaaccctgccactgatccttccaggcatcggcaatgcgttcctggtctcgttcatcgaatccatcgcagattttgcgaaccctatgatcatcggtggttcctacgatacgcttgcaacctcgatttacttgcagatcaccggagcctacgataaacaaggcgcctccgcaatgtctgtcgtcttgctctccatcacgatggtcatgttcatcattcagaagtacgtcttggagcggaagagcgccgctacccttacgggcaaagcttcccgccagcgtatgctgatcactgacaattccgtgcgtatcccgctctccctgctttgcggcgtcatcgcagtctttgttgtagtcatgtatgtctgcgttgtcttcggcgctctgttcaagacgtggggctatgactactcactgacctttaagtggttcgagcaagtgttcacattgcatcatggtgcgaaagcgttctgggactccttctcactctcactcattgcggctcctatcactgcaatcctctccatgatcatctcctatctggttgtaaagaggcgcttccacggtcgtggctttatcgagaccgtttctatgctcgctatggcagtgcctggcactgttttgggcgtcggctacatccgtggtttctcaagcggtgtgtttcacaccggatttttgcaggggctctacggaacctctgcgattttggtcattgtcttcatcgtccgctcactgccgaccggtacgcgttcaggcatctccgcgttgcgccagattgacccgcccattgaggagtcagcctacgatatgggcgccaacagcttccacgtcttcatgaccgtgacgctgcccctgatcaaagattctttcctctcaggactcgtcaccgccttcgtccgctccatcacggcaatctccgcagtcatcctgctagttacgccgcagacgctgatgatcacggtacagatcaacgagtacgcagagaagggcgcttacggtatcgcgtgcgcctttgcaacgatcctgatcattatcacgtacggttcagtgctcatcatgaacgcaatcatcaaacatttcggtaccagcgctaagatcgcctctgccgaagaggaggagtagatatggccaaagaaaagaaaggggtgcgcctcgagcagctctcgaagatctatcaggaccccaaaacgaaaaaggagttctatgcggttcacgatgcgaatgtcgatatctcccctggcgagtttgtaacgcttctcggaccttccggctgcggtaagaccacgatcttgcgtatgatcgcgggcttcgagagcccgaacgaaggacagatctatctaggcgacgagccgatcaacgagttgacgccgaacaagcgcgatacagcgatggtgttccagagctatgccttgttgccgcactacaacatcttcgacaacgtggcctatggcttgaagatcagaaagcttcccaaagacgtgatcaaaaagaaggtcagagacatccttgcgatggtcggcttggagggtatggaagaccgtatgaccaaccagctctccggtggtcagcagcagcgtgttgcgctggcgcgtgcactggtccttgagcccagcgtcttgttgttcgatgagccgctttccaacctggacgctaagctgcgtgtggacatgagaaacgagatccgtaagatacagcagcaggcggggatcacggccatctatgtgacccacgaccagtcagaggctatggcgctgtcagatcgcatcatcattatgaagagaggtgagatccagcagatcggtgagccccatgaggtgtactatcatccgatcaatgagtttgtcgcggactttatcggtgagtcaaactttctgcgcggtaccgtcagcaagaaagatggagagggtggcgtcgtaagcttcgagaaccacgagatcgactgtgagaatgttggtgggcacaccgtgggagaaaaggttgtgttggtgctgcgccctgagtcagcaaagctcgcagacgagggaatcctgcgctgcacggtagagctctcacgcttcatgggaagctaccaaaactatcaggtacgcgtgggcgataccctagtgaagctgcaggactacaacccgaagaaccacaagatctaccatgtgggggatcacgcatgggtgaacttcacgccaagtgatgtacatgcgctgtaggtcgatcaaccatttaaaacgttgatgtgaggcaggagccatactggttgacagtgtggctcctgctaaatcatggcggtaagccccgacagtctccctgtcatgtatcggtaacgtagttgcgctactgtattcttagggaggcgaattctcattgctagtgcaacggcgaggatatatcctgtaccacgctctacagagccatcagtgagcgcacacttaaagatagcttgaccttgtgcacaacatgcacagtcactacagacaagcctcgacaccactgcagaaggcggcgctgtgagacaagagaggcgcgacacgtatcgagttccccacgatatcgctgacagacccgataaagcagatgagtatttagggatcaaagactgagaaggcaggtagcgctgtgggaaagcacagagatgtcacacagacactgaaagctgagttcctcttctgtctgccttatcacctgtggcaaaaagtgagcgttgaaagacagctatggccctatctaagagtacctcccaacgtgtacaagctttcctgatgccaccttatctgaagtcagacagctctatacgaatgctatcaacctaagaccgaatagatgcctcgctaacaagacaccctgagaagtctttcactttcagacattgcagttggtaggggagttcaaggacgtatacacatctcaatgaattattggaggcttatatgagtgtcaatctctcaggtaggagcttcttaaagctcctcgatttcactcctgaagaaatctactatctgttgtcgctcgcccatgacctgaagaagaaaaagaaagcaggggagtcgacctgctatcttgagggtaagaacattgccctgatctttgagaagacctcgacaagaacccgctgctcctttgaggtcggcggccatgacctcggcatgggcgtgacgtacctggctccaggtacctcacagctcggcgacaaggagtcccttaaggacaccgcacgggtgcttggccgtatgtttgatggaatcgaataccgcggcttcggtcagaatcgggtagagactttagcgaagtactccggagtgccggtgtggaatggcctcacgactgagttccatcccacccagatgcttgccgacgttatgaccatgcaggagaatttcggcgaggatctgag

SEQ ID NO: 284 - DNA, 6531 bp, Unknown
  Metagenome-assembled genome
gatgggtgttggtaggtgggtatctggacagagcaatctgtgttagtccctgaatcccactgtccaccaaaagattacagctcacgcgcccccgcatgagcaccgccgtcgcgaagctgagcgtcagactcagggcggggagaccccgaccgcccgcgagcggcgcttgatcatcgcggttgaggcgctcgaggtagttcgacgtgcgggtgcagcggcgcatgtcgccggcgggcagcgcccatcacagtatcgcgtcgtcgaagccttcgagcagccgctcgacgccctcggggccctctcgcagtagtatcggcggcgatctcgtcgcgccccgcgctcggacgacgccctgtcgggcagttgaaacatctcgcgagcttaatgcgcagcccggcctgagccccttggggggccttggcccacgtgcgcgagaagtggccccgggcaggccgagtggacgggcccccaccagccacctcgcagggtcggaggtgaccacgcgcatgcccgccaggccgcgcgcgacgagcgaggacaggaagctcgaccaggccccttaagtctcgccgtcggcgagctcgacgccgagccctccttgcgcccgtcggcgtcgcccggcgtccacgagaagcgccttcggcctgacgcggccgccttgcgcgccttgaggtaggtcgcgtcgaacataacgaaggggggcgccctctatggggcggttgcgaaacctctcgagcaacctcgtcgagctcggagcaggcctgcaagacggctgcttggagaagccctgcctcgcgcagatctcctccatcacgcggccgaccttggctatcgagcgccgccgacgaccatctcggccatcgtgaggaccacggcggcctcggtgcgcctgtagtgtcgaacacgagcgtcttaaacgagatttgctgcggtggcgggcgagacgggagcttcgaccgtgccgaccctggtgactagggacctcttgcgggtgccgttgtggaagtcggtcgctcctgcgtttgctcgtagggctcggcgcgcaagctgtcggcggagtttgaccgacaggatagcgttgagaagaagaagaaatgctgcaagaggagccgaaaggcgtcccctcctggaatccgcgagatgcggcctatcttcgctttcgagggtaatattgattcgagccatgctaagcctccgattctctgtgccttttggtgattgcaagtttacttggaagacgggcctctggctcgctcccgtttttacaccactttacggacgtaaccatctcgaggcagtatggcacagcaaagctcctgaaccccttggggcgtccttcaggctctcaccagattcgtgcaaacaaggcaattgcccgcgaggcagcaaagcatgtccaggacggcgactgcatcttcatcaacacgagctcgacggcgctctccatcatcgagaacatcacggcccaggacgtcacaatcattacgaacaacggcaaggcacttctgctcaaggagctgccgaacgtctccctcatccttaccggcggcgagatccgccctccgaaggcatcaatgacgggagagttcgcgatcaactgtatccggcgcgttgcagcaacaaagtcattcctcggcctcacagggctctctgttgagtatggcctgacctctgccacggctcccgagcccgccgtcaacgctatgatgctcgagcgctcccgtacccacatcatcgtcgccgactcctcaaagatcgggaagacctcgagcttccagttcggcaccaccgacgaggtcaatctcctcatcaccgacaacggcgccaccgacgagcaggtcgaggagctcagacatgctggcatctcgcagataatcagggtcgatccggcccttggcatcggaccggccgacagcagtaccgctgccggcacgcaggaccagatcgtctagcccgggcagctccgcctgccatcgtgcagggtctcagatagtgcatggtctagaataggaacagatgtgcggttcatgcccacgcatccctgtcatctgcgtcatctccgaaaggtgcgccatgtacttcaccgagtgccatacacctctggtcggcaccctcacgctcctgagcgatgggtccgagctctgcggctgctgcttcagcaatggccgccatgtctcaaaggatatggaaggcgagcttatacgcagagatgaccttgctgtgctccaggaggcaagagcctggctcgaccgctatttcgaaggcctgcatcccgacccctcagagctccccctcaaagaccagggcacagcattccagaagcttgtacgttccgccatgctcgagattccctacggcgaggccgtgacctacagcgacattgcgcactccatagaggccaagaccggcaggcgccagtcaccgcgtgctgtcggaggagccgtcagtcgcaatatctacggcgtgatcgtcccctgccaccgcgtcgtcggatccaatggcagcctcacgggatttggcggcggcatcgacaagaagattgctctcctcgaattcgaaggcgccatgaagccttccttcaagcgcccaaagaagggcatggcactcacaggcattccgaattctgtccgcatgggacgcggtgccgcctatgccttctctgacctcacccctgaagatatgcatgagatcctcgaagcgcacgacagctcatttgcccaggccttcgtcgtcgcagacacagcatccggctgcttctggaggcccggcgcatccgaactggtgccaccccaggagcgctgccgctactttgcgacggcagaagatgccgaaacagcaggattccatgcactgaaggagcaggcagagtagcatgacgcgctacttcgagtacggcgatgaggaggtcgcctacctcaaacgtcacgacaggaagctgggagaagccatagacgccgtgggacacatctatcgcgaaatggatgagggaggcctcttttccggcatcgtccatcacatcatcggccagcaggtctcaagcgcagcccaggcaacgatctgggctcgcctccaaggcatgcccggcgacgtgacgcctgaggccatcgcctctgccacagccgaggagctccagtcctgcagcacgacatgcaagaaggtcgactacatcaggggcatagccgacaagatcctctcaggcgccttcgacatcgaagctgtcgagcacatgtccgacgaagaagcgatagaggcattgagttcgcttcccggcgtcgggcgctggaccgcagagatgctcctgctattcaatctcgggcgtcctgatatcctgtccttcggagaccttgccatccagcgcggcatgcgcatggcctaccatcaccgcactatcacacgcgagatgttcgagcgctaccggaagcgctactccccttacggaagcacggcaagcctctatctctgggccatatcccgcatggatgtgccgggctactacagagactatgcaccgaagaagaaaacgaagaggaagcctgccccagacaagcatcctgcgaagtaaagggaacatctctctccggcgtctgtccaattcgcgacgcaatgtgtcgcgaatctcagctcatgcaggagaagccggagcacctgctaatgcgccagatgctttgccgcctgaccttccgtgcgctttccatccatgtgccgccagagaaagactgcgagcacaagcgaaggcaggaacccagcgagaccaagaggcgaggggcccatgatagtcgaagtgccggagctgaagagaagccccagccccgctgtcgcattcatcgcgccatgggcgagcgctggtgcccagacgcttcccgtgcggctgcggaggaaggcaagaagcatgccgaaggcagtgcatcctgccaccatcatcaagatgcctgtaacaggaaatcctgcatagtccgtaccgtagttgtagccttcggcaatgagcggcgcatgccagagaccccagatggcacccgtcaagagcgcagccttgcgctcaggaatgtagtgtcccagcgccggaaagaggaatcctcgccagcctgcctcctcgccgattgcgacaagcatgttgatgagaggcgctacgacaacggcataggcaatctgcacagcaagcatcagaggcaccttgtcagaagagatgccgagctgggcctgcgctgctgcagagaagcgccctacctccgcatcgaactctcccgggaaggccaggaaatagagggctgcgccaagcacggacagggcagcaggagcaaaccaggcaagaagatagaccctcacgtgcccgcgaatcttcggacgccagccacgctctatatcctctcccggaacagctcggacgataagggcagccaccatgggcccgaacattgcaagcggcatgacaagagaccagaggccggcgcctcccgtgaccggaccagacgctatcgtcgtagcaatccacagaatccagtcaatcgcaaaggccaggataatgaacagaacgatcttcctcttcatggatgccttctttcagctgcttggcagaaatgatagcattatgagagatagcgatatctcgcattccgcatagagctgaaggtccgcgtctatagcggagcctgactttcgagacatctcgtcgccgcatgcatcgccgctttcgcagccctcttcatccgtctcgccagacgcagaatcatatccagatgcttctgcaagccctcccccacgtcagccagcctcctggatttgctacatggcgctcacggctgcctgcccagcctcctttgagggcgttgcatgttatgcctgcgcttgagttcgtcgagcgcatcagcatcgttctggcacacaagctcgacaacagcctcaagcaaaccgagatctacatgccgcttggcaagcctcttcacatcacgcgaaaacgccgggagggcaatccggctcaagcctgcccctatacctaatctttcagtgctgcatcgagcatttcatgcgcactgcgatatccatggccacctttcgccaagatttcctcagcatcttttacgctctgcaggctttcctcgttgggctcgccgtaggagagattcaggggaatccgcctctcgcggacaatctgccggtagaaggcccttgtaactgatgagaggtcaaagccgaaatcctcgacaattgcggttgcctcggctttcgtctcttcatccactcgcactgtcacagatgccataattctctccttatgtaagacgtatatattattgccttacattgtctgagttaatcatgtcaatgtaggccgatagccatcagtacattcgcagcgaggaaagccctttccgcaaaaaagatgctgattccgagactctgcagaaggcagacatgccttgccgcgctgagcggaagagcacctctatcacctgctcccactgctttggccggctgtatcagcaagatcctgcacattcagagcatccggtacagggcatcaccaacgtgccggagcttcccctatcgctcttggatcttctttccgctcatatgctcgatatcgatcacgaacatctgtacagccctgcctgaagcctggatttcctcctccaccagctctgcgctgggatagtacttcagagcgaactggcgcacgtaacggatattgtcttcgaggctgtcgacgagatggcatcggccaaagacgacagcactctcgagatagggtgcccaggactcatccttgatggtcccgtttccatagacggtaaagtagaccttgtcgctcttcttcagtgcgtcgaccttgtgccctttcttcgacccatggaagatgatccgattcgattcctcgtcgtacaggaagttgatagggatggcatacggatagccaccatccccattgacagccaggacgcctctccttgcgtgaatcaggagctccttggcagcttcaatgccaatctcgttcttcctctttcttatcttgcggaattccatgttggccctttcccgaaatgctcccccgttcccttcagacaacccggataggcgtgccgcatccgcctctctgcttatcggctgcagcaggcaggagacgcacatacagcagcatcttgcttaagtctgccccggagctcatcggtcatcaatagcagcgtcccaaactgcagccatgccttcatggctgtcgtccttccaattcatggagatgccccagatggatgccgacatggccgatagcgaggatgatggcagatatcactgctataggcgactcgtgccatattcccagaaggatgaaggccgcaaccggcaggcttgctatgggcacggggataggccccagagaccgatacatcccatcaagcctcgctccatccctgaaatagcgggcccaggcaatctcgtagagaaccacgagaaagacgcagcaacaagcactaagatccagggaaacgaagcgccttcgggacagacgaatatgagcgaagtacaggtggtgagcgcctg

SEQ ID NO: 285 - DNA, 21441 bp, Unknown
  Metagenome-assembled genome
tgggcatcatgaaactcctcgatcgcattaaccgtgccggcacgacggtggttatggccacccacgaccgtgagatggttgactcgatgcgtcggcgcgttatcgcccttgaggaaggccatgttgtccgcgatcaggagagaggaggttatggtaactatggcaccatctaatatcggctatgcacttcgtgaagcggggcaccattttcgccgtaacttcggcactacctttggagctgtagctactattttcctgtccctctttattatcggcacgtttatcttcctgtccgttctcgtcgacaatttagtcggcagcgttgaggaccgcgtcacgattcaggcatatatctccgacgacgcgtcgcaggatgcggtggatgcgctccagcagaagatcgaaggctgggacaacgtcgagtcggtgacttataagaccaaagacgaggccttggaggagtacaaggcgacgatgtccaaaaagaatgcccaggacgcggtagccgcccttgacggtaccaatccagttccggcttccttggtgatccgcctgtacgatccgcagcaagtcgagggcgtagccaatgagttgatcgatgactcagacttcgctcaagtggctgacggaggggacccagcctcttcggtccagtatgggcgtgagacggttgagcggctctttacggtgacgtcctacatccgtgtcgcggcaatcgtcctggtgatcttgctcaccttcgtagcctttgtcttcatcaataacacgatccgcctatccatcgcggcgcgacgccgtgagatcggcattgagcgtctggttggcgcatccaacggtttcatccgagggccgtttgtggccgagggtgctatcgaggctttgatcggtgcaattcttgcgatcatcgcgctgcaggttacaatctccaatctgttgccgagaatgcgggagagcatccagtttttgaacttcgaactttccgaccagatcatctggcagacctatggcctcctgatcctgatcggcgtggcgatcggtctcttcggttctgcgatcgcaatgcgcagatacctgaaggtgtagacgacatctttgcgcacaatggtgttaaatggtgagggtggcgctgaacacaagcgctgccctttttctgtcttgaaggaatgagccatgggccggaagaaaagaaaatatccgcgtcacaagcgtcggagaaaccatccgaccctgagcggtacacttagggtcgagggcaatggtaccgcggtcgtctctacccaggaaggcagcttcacggtagcccgtaaggggctccgggaggctatgagcggggatacggtagcgatctcgctcatccacacgcatgtcggacaggcactcgcagtggtgcagagcgtcgttgaacgtgcgactaagacctttttggcccgctacgagaaggcgggccccttaggggtgctggtgccgctcgatacccgccttcgccacgatttctttatcgtgcctgaggatacctcggctgagagataccacgtgcaggaagacgatgtagtcgaggggcgcatcctcgagtatcctactcgccttaactctggcactgccacgattgagcgtcgcatcggagctgcagaagatctcgatatgggtatcgaaggcatcttagcctcctacgatctgccccatgagttccctgagcgtgttctgcaggcagctgagaagctggccgacgacacaaccgaggcgactcaagaaccggatcggaaagatctcagggaggtcaccttcgtgacgatcgacccactccacgcgcgcgacttcgacgacgcaatctttggacgtatgcgtgagaacgggggctatgaggtcctcgttgcaatcgccgatgttacacactacgtgaagtgggactcaccgatcgatctcgaagccaggcggcgcacctgctcggtctatctggcggaccgggtgatcccgatgctgcctgaaaagctgagcaatgatctctgttcgctcatgcccaacacaccccggctcgcaatggcggtcaagctggagttggacgcccacggccatgtccggagtgcagagcctacaaaagcagtcatcacgagcaaggctaggctcaactacgatgaggtggatgagttccttgcaggggagagacctgcagagaagctcaactgccgtcctgagtatgtggacaccgttgcagagagcctgagggtgctacatcacgtggcagagaagcgcgcagtgatccgtgcccagcggggcgccctcgactttccttcacgggaagcgcgggtgcaactcgatcaggatggacacccgaccggagtgctcatccgctccaagacaccggctacttcgctagtggaagaggcgatgctcttagcgaatgaaacggtggcacgcctgttggcggggatcgaagccccggcggcgttccgtgtacacccccaaccgacccagaaggatctgaaggagctcgtcccgatctttacggaattagggttgctcaaggggcataagcagattgatgccttctgctccgggcaacctgaagcgcaggcgcggattcttaaggcagcggagaagacgccgaacacctacctggtgtccacgctgctgcttagggctcagtcgcgtgcgatctatctgccgcacaatgagggacactacgcgttgggcacctctgcctactgccatttcacctcaccgatccgtcgctatgcagatgacacggtgcaccgggctttgaaggcataccttgcacacaagcggaatacccgtgagcagcatgcaattgctgcagtgctcccacagctgtgcgcggattgctcgagccaggagcgcgtggcggatgctgctgcgtatgactccgaagaggtgaagatggcggagctgtacgctgcgcatatcggggaagtctttcccggtatcatcgacggatgcaagcgcttcggggtctttgttatgctcaaccagacttgtgcggagggcatgatcccagtgaggagcttaggcgaagagtactttgaatacgacgagaagcatatgcgtctgatcgggagagagaccggtacgatctaccagatcggtcaaccgatcatggttgaggtagccgcctgcgacacgctcagaggtcgtatcgagtttaggcgggccaagcagccgcatattcgcatcaaagggtacaatcgtgggtaggatctctcggcaaagcattagtgattacgcgatcaaacgatacgattgacagataggttaagagaagcatggcaaattcaaatctgaatgacgagctgctgtatgcggaatccctgatggcaggagggcagttcgaagaagcacagcagaaactttccgatctggctgaggatgcggaagagtacgtcgcggacaattgccacacgacagaggatacccagtggttcgcctttccgacgatctttgagcggttggcataccgccgggtcgaaaaggatcctcggaccctgaaggacgtgggtgagccttttgagcggctctactctgactatgcgatagcctcactcaaggtaggggacaacgacgccgcagaggcagcgctcaagcaggcaatccgctgggatccgatgaactgtggggctcggctcgatttggcagagctcaacaaggagaagggcaacatgcaagagtacctcgcgctgagctactccgtcttttcccggggcagcgatgcccggcacttggcgcgggcctttgccaacttctctgagtactttgcagccgaaaagaagcccaaggcccaggcagcagcgctgcgtgcggcccgtcggctcgatatgggcgacgacgagaaactggccgatatgctcacggaagttaagggaaccgaccacgatccggattcggtggacgatcagcagaccgaagagctcttgggcaaagaaggtattccggcaggtgccaatgcggatattgcagtgtgcctgctcatgtgcgcatcggatgtggcccagatggggaataagagtttggcaactgaattgactatccgcgcgcgtgatctgatcggaacgaagaactgtgaagcattgctcgacttgatccacgcaaatgacaaagagtggaaagagggtgaggcgcgtggcaaagccaaagaaggataagaacgatacgatccagatcatctcgagaaaccgcgccgcccgtcacaattactttatcgatgaaaccttcgaggcaggcatcgtgctgaccggagcagaggtgtgcagcctgcgtgagcgccccgcacagctgacggatacctttattgtggttcgcaacggtgaggtctggctcaatgggatgcacatccacccctacctcagaggaggggtctggaatcctgatcctgaccggcgcagaaagctgttgctccacaagcggcagatccgctatttggatcagaagctgcgggtcaagggcgctgcgattgttccgctgcagatgtatttcgacgagcataaccgcgtcaagctgacgatcgccttaggcaaaggcaagaagctctacgacaagcgtgcggatatggctaagcgtgacagtgaccgtgagatccagcgcgcgatgaagcagcggagccgcagagttcgcctgtagaccagaaaggaacacaaccatgatcgataccaaggcattcagaaccttctcttcaggactctccgtcgtgtcctcaagcgatggaatgcatcaaagcggctgcgtgatcaatacggggctgcagctgacctcaagcccgtttcagataatggcatgcgtcaacaaggagaactacaccgagcagatcatggaggcctcggggcactttgcgctagcgaccctgacccaggaagctgatatgccctacatcgggcgcttcggctttcacacagggaagaccttcgacaagtatggtgggtctgatactcactgcaccgagcttggagacccctatgtgacggagtgcgtggcagggctctttagttgcgcaatcgtgaagaaaattgatgtgggaacccacatgctttttgtgggtgaggtcaaggatacccaggtgatcagtgatgcgccgcttctcacatacgagtattaccactccactctgaagggaaagacaccgtccaaagcttcctccttcctacctgacgacaaataggttacagtatagattgcaatggcgaggcattgctgaaacaaagaagatagagaggaacccatcatggcagaagagaagaagacctataagtttcgttgcaccgtctgtggctatgaagtagaggttgacaccccggaactcccggctgactttgtatgcccggtctgcggcgcaggccccgacaagtttgagcgtgttgacgactagtagctgccacaacggtaaacaacgcagtatcgctacacctgaggaaggcggatcgggttgtgcccggtccgccttctgatttcgtgtgtacggactagtcgcacactcggaaacgcttgtccgtgagggtacgggcgataatgagacccaaaggcaaagcaaggacgataaagagggcattgaagagccaggtggctcccacggcattgctgccgatcgccagatcatagactgcccgatacatgtagaggccggggaccataataacgatcgaggggacggataccacaattcttggatagtgcatccggcggtgaacccgagaagctagaagccccgcgcagagggcgccgatgaaggctgccacagcaggtgcggcgccggcgagatccacgagctccagccgtaaggtgttagcgatcatccccacaactcctgaggttgccgccatcctcggtgtactgttgaacatctgggagaatccaaagaccccaacaaagctgcagatcaggcgcaatactatgcgtgccatagggtcgaggtcgaccccgataaagtccgcaggatggaagttcaaaaactgtgccacgatccagccggtgaaggtggcgacggtgataataaggagggcgtaggcgaggcgttccaacccggagcgcatgtttgacttgaccaagtcgataccgccggtgatgaggggaaagccggggataacgaaaagcatcgcgcagaggtagcctgcctcgtggcctgcagcaatacccaggaactgctctgctgccatatagcacaggatgctgacgacacaggcggctgctacgcttgccgtcacattagggaccaaggaaagcttccagtcgatcaggtgacgtcggaaccagttacccacaaaagccccgataaaggcaatagccatctcgatgggacctgcaccgagcagaaatgtaaagcctgcgcaggcggctcccgacgataagcctgcttcgagcggtgtgtagcccgccttggtatgttggattgagtcaagggagctgtggatctcctgcagagtcatatcctgcccatgaaccgcaaaatcgtcgacaaaatgttcaaggcgacgcaatttctcggtattgacgccagtagccggtatggagaacgctgcggtatggctttgggtaccactcatgcaggtgaagctgatggaggttagacctacgtctgcgacgcaatccatcgagagggtacgggcaattgtgtccatcgagtcgattacgcgccaagcgccggtgccgactgacagcatcatggttcctacgcggcccacaatgtcggagcgttcctcaagggttgcgtcactggcacgagtggtgccctcttttacagtttcgtgccatttcacaggcatgtagtgtggttgctggtgttgtgtattactcggtgttgtaggtgcagtgatgttgttttctgccacagaatctctcccctgtatatgaatcggtaccgaagttaggttatagaccatcactcgcgcgcatgaaaagcctcgatgcgatgctgtagacaatctacaggtaactgatttacatacagaggagtgaacgcagtgatactgatgtctctcgcttcagcagtatttgtcttaggtaactgtgtggaggcggatgccaagatcaaccggccaggtgggcttgagcactggagcgacgtgcttcgtaaagagattggagctcaagtattccttggcatgctcaagcgagtcaaagccatggatgacctgtacatcctcgttgtgggtgagcaactctttggtgagtgcgccttcgatcttgcccaagaagggttgaagatagttgaagaagacttttgctgcggctggcctcttgtctgcatcgataaacatcgtgatctgtagatacgctttcggatccattgtggtgtcctttctgttgggggatggtctctccacccgttgatggctgcactgtactgtctgtgatatcaaataggaagatatggggaaaattatggagacttcgggcatgattgtgggtaacacacctcgcctctgactacaactacatattgcaaaagccaccctggcttctgtaaagtatcagcgtcaaaactgcaacaaacagaagaacaagatggccttctctgatacttcatgtaagaaactgctcaacatcaaaaatactgctgtagaggctcacgacatctacaatgaccaggatggggcacaatccacatccgcatggatgagtgttcatagtgcgacaggcactgatctggctatgatagcgcatcggtaaatcccaaagtctggcgtgctctggactggggcgccatcctggcagagtttgaatgtcctacccacaggcttttctgtccgaaacacaatgtggtaactgctggcgtgcctctgggcttacccagaaagatgctctaccaaggaagtttgaccttaccgtcagctggcttgcagaatagctgcccagaagtggcgtggcaacatccatgcgcatcggctggcagacggttaaactgcatattcaaaaagcctgaacgaccttgtttgcatcggtatcgataagacaagctagcgcaaggaccacaaaatacatcatggttgtcgcaaaccataacaccaacaccgctgtataggtggctgacggccatggcaaatctgtcctggagcagttctacaaaggtctcagtaaggagcagcttgccagcatccggactgtcagcggcgacgctacacgctggatcacagagtgcgcaaacgagcctgcgcactctgcaagcgctgtgtcgatcctttccatgtcgctgagtgggccacagatgtgctggatgaagtccgcaaagactgctggcgtgctgctttgtgatagagccaaacagcttgttgcagagaacccgcagaagcacgctcgccccaaggcaaatgatcaggctttctccagggtacaggcagctcgcaagaaagccacagcgatcagtctatttttctggcaaagtgccaaatcccctgacgcagaacaaaaagatccgtctggatatgatttaggcaaatgatttgaagctgtagcgagcatagtgtctgaaagaatctttgcatctgcttttgaaatcaaccgatatcacgcagattgaagccgagtctgaaaatactggctcaggtgggagagctacagcagaatagcggcactctacgacctgtatgagaagatcaggcgccacaaggatcatatcctgaatacgatccgactggggctgagcagtgcgaggattgaggcaaccaacaacaagatcaagctgattgttcgcaaggcatatggattccggaatatacagaaacatgatggatatggtatatctcgtatgttctgatatccgtgttccacttcctaaccgaaaacctataccagcgaaagcggcttagctactggagaaaatggcgtctctcacccacaggggtgcctgaagagtcaaattacgagttactgttctgaagtgaccgttatcaagagatcattttagaaaattttcttctcctgacaagccacatttgtcttcctctgacagcctctggaaagagctctgattttgatttaacagttcccggcatgcggtcactctgttatacgtggattggttataacaggctaatggttccgccgtgagtcctgcgatcttagtgcgtggatcactgttgccagtgccaacaaagcaacggcgcagatgactcgaaccttacagtgatcacagcttcctccagatgttgtcagagatttacctgtaattcttgctgcataaatctgcagatccctgcggattcatgtaccgctgccaactaacctcatggccagatgtctgtcacagggcctgccgcgcagcggtgcgaagcacccttgacaaaacagtaagactcgcagatgccagatgcttcgctatccgacgggatgtgcgagtctggtgggggacgtgcccccagcgccttgacccatgacaaaaccgacttgatcggtgtcgcttttgtgatctgtcggatgcccggggcgcaaatccactagggccttcgccctgacggctcccgtgaccgaagagaggcctgatgccgacaagcgtccccctactgttctgatcgagaggcaaatggcagaggcgatcgttcggccgtaggcagttgaaggtcgcccatgcaacaaggacaggtggaaagggtcatctacgttggcgtcgccgtcgacgagacggaggtcgagcgtgccttcttcccgacgagcaggcgggggtgcgccgagatgctcgcgtgggcccactcgaggcggtgaggtggcccgcttcggcgtggagtgcacagggacctacggtgccggagctgctttaagcacctctcgcgcgagcacgtgcaggtcgttgaggtgagcacccccgaccgcacggtcgggggcaggagggacaaggacgacgccgcgatggcgcataaggccgcaatcgagcagatccgctccctgatcgtctcggcccccgatactgtgtgcgaccagtagtgcgcgatgacaaccgcccgcctcgtccccaggtcacgctgcgtcaaggacgggcgcgtccggctagtgcgaccctgtgctcacccacgcgcatcgccctcaagtcactcgtcggtcgctaccaggacctcgacgataaggtggacgagctcgatgcagccatcggggccatcctcgaggagaagtgcgtcagctcgcagggcgctgtccagctgatgatcagagtgggggacaatccggagaggctcaagcagcgagtcgtcgttctgctgtgcggggtagcagcgcgtcctgcgtcgtcggggctcacgacactctacaggctcaacaggggcgctggcagggcagcgaacagcgcaatacacatcgctgcgccaggaaggctgcagatagacgacaggactcgcgcttaggtgccccacaagatgtctaaggggcactccaagctcgaggcgatacgatgtgtcaagcgatacatagtgcgcgagctgtactacgacatcattgcccagaaccgcatgctcaaaacgacttgacaattagaagggcatcatagggacaagatgttgatcacgctgccttcttttctgcgtctctgggagcaatattattggctctctctgttagaccactgtggatatagggaagcgaaaagatgtcacgggatcgtcctacaatcgggttcgactaagaaaccgacctgaagaaggccccgcatgctcgatatgatacgacaactaacaaagtagctgacccgcaaggagaaggtcgcacttaccgccgatctcaagcagatgataggcgagaagctggcagcgcaggccggcaagtccgccacatgtccgcactgcggatgtcctgagtccaccaggcgcaggtgcgacggtgtctaccagaccaccagaagaggctatgtgggcatgccgattgcgttccctaagtactgggagcaggcgacatgacctcatatccacagtggtctaacagagtcttttttttggatcttttggacatgccacatcagcttctttttgcagcgtggaaacggaccggcctctacggcccccacgtcacaggttttactacccatccgaacatgtacagctgtcttccggaactgttcgcttgaagcctgaaatccagtatacagccacaatccatgaaataacccagctcaggagtgcatttttttctattttgggtatactacatatgtgtttctggtgggcgttgccaatacgaggtagttgtctcaccaatctcaactatgggggtgactggattcgacagggtagacctgagatgagcagcaggccgtggtctcctctccacgttaatctggggtaattcaaattgaattgacagcaacaattcatatgagggctcttatgccctcgctgcttaacttaaataagtagccgtcaatccaccgatttccctcgttggtggtgcggcgtcgactcagagggatgctgcatgaggcttctgctcgttttcctcatgcctaagcttaaacgggcttgggcgttaaccgtcggtcgctgaacgcgatacgcctcagatctaatcagtgactgagcctgaagatacacatcaggggtctattttggaccggagttcgattctccgcacctccaccatagtcaatacgacgaaccccccccggcatacgtgtttaggcagtatgccgggggctcgttttgtctgttataaggagggactagggagtcttgtccttcacctttctgattgcttaaacaatgatctgaagtgggtagtgatgacacaagccttgtgaaggcatggccattatccagaagttattttgcttcgcgctgttttgtggttagtcggctgatattgacctgccataccgcgacgcgcttcactacctcatccttaaactcaactggaacacccggtgccatgtggttcatcaagcaggtgaggccgtgacgttttttgtcgggatcaggcacctcgtggatagtgccccacgccatgatgctttcatagtccaacgaataggcacaggcaaagttcccagtggtaataccgatcggtctgtcgagttcaagcgcgaccttgggattggagtgccaagcatcgactttgcggccttgggttgcggaatgcagccagagggtagggagggttgttggatgtcccttagtggtgtcccattcatatccgaagttgaggggaacaataaaagggccatcggcatctgttgaggcgatgcggacgacatgcatctcatcaagcatctgatggatttcggtaggatccgtaacctcacgctctgcacggcgcatcgggcggtgtgaagtgcccgctccattgatgctggtattgtcatttacagccataggatctcctatccggttgtgatatctgttcgcttttgagactacaacaagtaagcggacctaaaaaggtggagaacctaggccgctagacctagtgacaggctgtattccaaaggtctcatccatccgaatgattcctttgatcttttgttgcaatactacgtgatgtagtcattatgttggaactcggttcatccactaagaccttggtgattgggccttcggcgacgctttccgatgcgctgcttgagcacggcgcctgggggtttgtgggatcggtagttgataactcccatgagctgctcgatcgggggatctgtcgtacgataagcgggcttgcgctcatatatgatgacaacggccctggcactgtgtatgagcggtgctctgtatgggcattcgtgtctaagcggttaatcgtgagtaaagcactcaagagaagcgggtacaaaaactttcaggacgattgaccattcagggaggctattggtgtgaagcaaaatgttgcgcttgtactggaaggcggcggtttccgtgatatgttcaccgctggcgtcaccgatgtgatgatggaagagggcatctggggcttctcttctatctggggtgtgtcggcaggtgctatgagtgccgcatcgtacaagagtcggcagatcgggcgtacaatgcgcatcatgttggcctttagggatgatcccaggctcatgtcaatgtggtcctatatcacgacaggcaacatcgctcgggcggatttcctctacgacaaagtgcagtccacatttgatccgttcaacggagagctcttcaaccgaaacccgctgcagatgtactgtgtggcgtcagatgtgaccttcggtacaccggcctacctgcacgtaaaaagcctgccggaggatgtggagtcgatccgggcctcttcctccttacccctgttctcaaagatggtcgatgtaaactcccatcactatctcgacggcggcacgaccgactcaattccgtttacacaggcgatggggttgggagggtccaaaccccttgaaggctatacacctgcgaccaaggcagtcgtagtgctcacgcgggaccgtaactatatcaaggatctgggcaatgatggactcgtcctccgctctcaccgctatgactcctatccctatttcattgcagctctcgaagaccgctatgagcgctacaataagtgcagaaagcaactttgggatttgggaaaggaaggcagctgcctggtgattgcaccagcaaaagtggttgaggtcggcgtcgacgaatcaagtggagagaagctcttgaacctgtatcttgaaggtaggcagcaggcctttaaggcgatcaaacaactgagggagttcgttcctgagccggattgggtgcctgacgaatcgatgatgcattattgattcccagcacgggtgcagtttcattttttgtcttgtgaagctgggggtccttcatcggccctattaggcgaatgacagtaatagacaagaaccgtataggtgtgagataagaataaaatgtgatgacagagtgactgctctatacctgtatcgagtgtacctgtgcaaaattctctgtcagaccaccattggcctcagcccttgtcttccagcagtcccagagagactggggcatatcgacgagggcgtgcctcgtgtgtacatagctgccttctgcaagctgtcctgagagcatctccttgctgtcctgcttcgaatactttgtctgctttgtccacaggaagcaggcgaggcagtggccgagccactttgtcgacaccccatagaggggaagcaagaacttgcctgagccttcgctgtattgcattgacgaggccgcttctcactgtccctggactccttcaccacgcttggtgtgtactcaacaacgccgagtaaggaaggaatacgcgctatatcttgcatggttgtctgttgcgacccaagagctgtcggcgatgcctgaaagggtaacctttagcttcgactcggtgggcctcccgcgaagtgttgcatattcgtctcattacagtgggagagccagcccctggggacttcttagagctttggggttttcgacaatgaagtgcctgcggattccctaaccttgtagatggccctgaaaggggctgctggctaaccttccccggatagccgtatgtccctgtctcttacgaaggcccggggggtgttgctgctaagggatggtggtctgtctgagaacggctgatagggatgtgccacacgataagcagggtagtgtggatgtcgtccctcagacacgctgacctaccagcaaaagaggaaagtaccaccatggaacacaagcagaaagactggttcgggccacagcgcttctatctcggcatagatgtcgggagaccattcctctgggcagtgaacctgaaactgggtggcaccatcgcgatcagctacaggcaggacaggtgccaggagaacatcgacgcgctgctcgacgaggcggaatcgggcgccctggtcaattgtggaccagaagaacaacatcggcttgcttatcgtgtacaggtggtgcgcgaaaaggattaatgttagataccttcccggggaaggcgatgaagtacgcccgggagatgtttcccggaacggccaagaacgaccgaacagataccgaagccatcgcgcaggcggggatcgggatcaggacggccatcaggccgatagccgagaccgacgacctcagcacctgcgtctcgctagtgtccttacagctctcatatgccacgaggcgcgccggcctgcaacaggctccatgcggtgctgcttaagtccgatcctgccgccgagcccgcaggggatctctcgagcgcatggcagctcggggccatggccgaatgcggaggggcaacagggcttgccgctacaggcaggaggtactactgcacgctgtgcgcgaggcatggcgcctgcgcccaggcaagggatgccttctggaagctgtcccacgctcttctcctccccatccttccatcccgatgcaaaggacatgctggcaagcagccttgccagggagatccttgcggccagctccgagaggggcggagctctccgcggagctggggcgcctgctccaggacgataagacctaccgctgcctgctcaccatcttgggcatagggcccaagagcgcctcggtgctcgccgcctcgctcttcctaagagacagcaagctcgccgcatactgcggccttactcccgcagaccatgattccgggtcgtccataaggtcgcagaagagcgcccataaaggcaacaagatcctcaagaaccttctcatattcagctgcaactcgctcgtggggacgaagaagcgcttcgggaagcaccacgatgcttggccccgcaaggggcatgaggtacagcaaggcgctcaaggcagtggcccgcaagaggctttgcgtgatctatgcagtgatgcgcgatggagtgccgtatgtggagccgccggcggacgatgcagaaaagtcacctgctgtggcttgacaggactatagggacactccctgggccttcgtaagaggcaggagcacacggctgtccggggaaggttagccggcagccccgttccggggccatttacaaggttagggaatccgcaggcagttcattgtcgaaaaccccaaagctcgcggaagcctcaggggagatctctcactgtaatgggatgagttgcggctgttgtgctcatggtggtaccaggggcatctgggagcgggcttgtgggcgttagctgcttcgtcgaacgtccagaagccgacctcctcacggcatcttctcgcggctagtgcgcaggaaagatcggcgaactgggcggctgacagcccctccaccatggcgccgtaggggttcttgtggtgcggcataatcactcaacatgtccgccagcgggcccatccgcccaggatgtcgccaaacacgaagacaggtgggcccgttggcgatttcgtgtttggcgatgcgatcataccatcaggagtgcctggcggccaggccggtcgggccgtctccatccgcacactggttgactattcaaaatcaaatattcgggtagaatatagcgtacgtaaatacgtacgcgttcgttaatcgaggagggaaacatgacttcaataagtgctaccgctctgaggaagaacctttataaggttatcgctcaagcgaatgaggactgcgtaccagtggcaataacgaacaaccgggggaaaggagctgtgctcatcggagaggatgagtgggcttcaattgaagagacgcttcacctaatggagatacccggcatggcggagtcccttattgctggaatgaatgagccggatagtgagtgtgtgcctgagtctgaattggattggtaaaccatgtggtatgtggagtttaccaagcaagcagcaaaagatgcttcaaaattaaaatctgcagggctagccatcaagacaaaacagcttgttgaagtggtgagaaaggatcccttcgggagaccgccgtcatatgaggccttggtgggtaacctgatgggattgtattctcgacgaataaatctacagcacagatttgtatatatggtgacacctgggacgtttcagaaggacagtattacgtacgaaggcatcgtaaaggttgtcagaatgtggacgcactacaacggcgttcgctgatactgctagttgtagtgggaagctcaatatgtgcatccgcggcaggccagagaattaacctttggcctgccgttttctttatttctgctgtgtggcgatcctagggaaacgatgatcaattcggctcgatgaggtcgctggggccacatgctgtatgccgtcggcttaaaatgtctcgaaccgcgcagtgcccatacccacataaatgcctatctgcctgcggatatgttataattacagcaacgtattccagcatatccaaaaggaagatatgggcagcctgatgagctttggggaccttaaatcctaaggtaaaaggagaaagacccggcgagaggcattcctggagcggatggatgcgatcgttgtgtgggatagctggattgcactggtagataccagctaccacggacaggcgcgtgtcaggcatgtgcgtgctgcaaagacgaagcataaggctgtatcctgctttaggtcatgtttgctctcttaagatgagggaacttaaagatgctatcctgggttgccactcctggcagcgcttctgtgcacgtagacctcatgcaggcgcaggtgccagatgcgacgacacttgcgaagatgcgccatagccttaaagcgagaggagttcggtaaagcttgtgcttcacgacctgaacttagagctcgaaaaggcagggatcacggtgcggggtagctccatggtggatgcgaccttcatcgaggctccgagctccacaaagaacaaggaccatgcgcgcgacccttaaagcgcaccagtccaagaaagggaagaactggcatttcggatacaaggcgcatatcggcgtggataccgcaggcggccttgtgcatggtgtggagacgatcgcttagaatgtatccgacatatcctgtggcacacgtacccgtaagggagtatgacaggttctgctgcgcagactttaggctatataggtatagcgaagcgcccttaaggacgcataaagacccacacctctcatctatgcgctaaagcgttgctaaggaagccttcgactagagagggccttgcctgtgcactcttggccgagaagggcatcgagtccaggaaggcatccggccgctcaaaggcagaagcacccttccttatcgtgaagcggcacttcgatccccttaaggaagcgttactaggggatagagaagacctcctgtatgctcgagtctgcctcgcccttgcaaaccttatccatgtgcatcttttgccggcaggctgcacttcccggctcccagagtcgcttgatccgtcttggagccttattgcggtgcatgcggcaggacaaatgtaaggatagcggctcctgcacgtactggatgagcaaccttttctgcctttcccacattccggcctagaaaggccgtgtgatcggtcccctctggtacgtcatggggcattaatcatcgtttccctaggtgccttcctctgcagggcatagatggaattgtccatgttgaagagatacgctatcacgcacatgacgaagaagtacggcaggtaggcaaagctgaacaccttagcgtcgatgaacatgggcgccagcagcgtgttcgtggcgatgccgaagactgcggcgcagcccagcatggcggccagctccgtgggcatgcccagcgccgacttcagcaccacgctcaggctggcgccgatggcaaacagcggggttacctcttctccctgggtcaagtccgaattcgtgtgtaaaatcgctgccgcattccctgccttacgccttcgccatatccctctggttgcgcgctatctttgcgagctcgtcttccacctgcaggagctgcgcgtaagtcctatccgtagtagctcttcctctgcgtcgagctgcactcgttctcctcggtaaggaccgacccgatcagcctgatcgctagcgccttactcgggaagaccccgacagagcaggcgtgcctctctatctccctgttcagcctcttcaagtagttggacgtcctcatgtacaggcgcatcgcggcgatcagcacccttgccgcccttagggcgacgtcgcgcaagtgcgccagtatctcgtcgcacctgcgcctcgcctccggcgcgctgcgtcgttgagcctctcgaccagcttcccccttaaggccggcgcgcacgcccttgggggtggccttacacacgttgcacgagaagtgggcctggcagcgctgccaggcggcgccgggcagcacctcccttacggccgccacgagcccctctctggcgtccgcgagggagcgcaggaagtccgcccaggagcgtcccgtgtgcgactcggcaagcgagaccccgataacctagcagcgccttggacctcacgcggtggtcgaccctgaccttgaggtaggtggcgtttgccatcacgaacggctactcgcccttaaggggccaatcgcaagacgccctgatagcggggtccagctcggcgcaggcctcaaagacggagtgcttggagaacgacctttcgcagacctcctctatgaccctgcccaccttcactgtaaagacgcccgcgacgaccacctcggtcataagggcggcctcgcttgcgcttgtagttgtcgaacacgaggatctcaaacggggtggtgcgctgccttgacaccttcagctcgatggtggcgaccctggtcgtgaggggccttaccttcgtctcgttttggctgtcggtgcgctcctgcgtttgctcgtagggctgggcgcacagctgctcggctgacttctccctcagtaccccgttgagcgtctcctggagcagcagcctgaaggcgtccccgcccccgtcggtaagcagccccagtacctcgtcttggtccagtgcaagattgattcgagccatatctatcctcccgggtgtcctcgttgtttgtcgactgcgagtacaccttggcggtgggcctctggctcgcccgccttttacaccactttacggatgcggcctcgagtccctcatgaggggcgtggtcgagaagcactgcccgtcgctgcttacaatctagtgccttaagaccctgggcgcctccgagcccgctgtcgccgcagacgacaacccagaaaggcttaaggagcaaggccacattcgcgatgctgtgtaaaacgtcgcccatcccggcatcgtctggcaagacatcgggctgcatatacctcaacaggggcgctgaccggcgtgccaacaaggcgctgcacaccgtcgcgatgaggtgcatgagatacgaccccaaggacaaaaggctacgttaagcggcgcatgtcggagccacacgccctctcgaagcttgaggcaatcaggtgcgtcaagagatacatcgcgcgcgaggtctaccatacgctcatgcactcagggacggaggtcgagcgggtcgacaggttctcgctcagggaggcgcacaagagtgccggcctgaaccaggccaaggtcgcgcatgccctcgaggtgtcgccttccacggtgagcggatttgagtccggaaggtgcgagagccagatgttcgcggagaggtattcaacctgggtgctcgagagcatgccgatagatgtcgaaggcccaggaagcggctcttgacatctataggagtgtcggttttgtccaaaactacagtgatttgcgtagtgcgcgcttagtagcgcgtcgagtggtgcgcgcgatggagacgcaaccaaatgggacaaaggagcgggatatggggtcagagtatctggagtacgagcgacgatggatcttctggcttctgatcttcgtggcaggctggtatggtgcctacacttctgccctgcgcagcggcgtgttctgcaatgcccagaccgcaaacgtagtatttctggctatgtacctggccaggcagaagtggctctcggcggcgtacctgctgttgctcatcagcaactcttacacgccgcccgccctagtacccgcgcagcacgggtcgaagtatgcgaggctccaacagaaggtcagcccacgccagacagataagcacggcagccagggggatcaacgcgctcagcagcgagtgacgagagaaaccgcacatcacggtcgtggacgatcgcaccgcagtgaagaacaggaacagcagacgtgcgccttccagttgcgacgcaggtcgtgcttctaggttgggtggaacagatcagcatagccagagtggcgaccatctggaggaatgtgtagtgacgaaggtcgtaggcacaagcaggccatccattctggcagtaggtgttgaaactgcctggcgcacacgtaagttcagatcacatggcagactggccgagccagtcagcgggcatcaagcgacaggaacacgaccacgcacatctcagcgccaccagcaggtgtccccggcacgaagtgcagaagcttcaatgccctccctattccactgcgagagggaacgagccaaaaagattacgcg

SEQ ID NO: 286 - DNA, 9483 bp, Unknown
  Metagenome-assembled genome
ccaccagcgcgaagggtttttcaaagtaaggcgcagccaacatgtttaatttcttaatttatcatcatatgaatcatcgagcatggcagagaaaaccgccgtgtcctgaatcggtcaccggcggtgtggggaggtcgatgaaaatcctaccgttttggttattcgtcggatttctgggcgttcataaaatactccacactcaggtctgactacctccctccgttgttgttgttgagaggagtgattctctctacccaaaattacaccacgagtccgcgctcgcaaggccaaccctattaaacgccaaagggccactggtgtcagccgatccggagagctcggcgatttgggagaagaagttagcttaaaggggggggtcttccattttatttagtacgagctatcggggggacgtgtcttctaggatttttgcggttgattctccctgggtgtgggtgtattgaggtggatgtacaggtctctgatactgtggctggcaggtgatatttggcagcttccacggacggtggggtgtccttttggtcctgtggccaacctgcaatcgtcaatttgctcttcccggtactactcttactatcttgagcgtaccttgttcaattgagctttagtttgttctgatgcttctcgtctcaggcagggcgctgccactgttgataacgacctgagcgccggtcagatagctagactcatcactgcccaggaaggcaaagagctcaccccctcggtcagcttagccagtctgcccatcgggacgccgaccgcgatactgtcaatggtgctctcaggatcatccgggttgaactcacgagccattttctcgaccatcggcgtgcaggtatagccgagctgcgtgcagttgacgcgaatgcagcagctcgcgtactcaaccgctaaatacttgattaaacctacgagcgctgctttgggcatcgcgcaggcaacttcaccggcatcagccacaatgtcacccgtaactgaagaggcgatcacaatgctgccatcgccttgcttcagcatataagggatcgccacctggcagcagttccaggtgcccttgatgtttatgtcgatgtgcaggttaccacatctcatccggtattctctcaaagggagcgagcctgcagacgcctgcgttgcagcagaggatattgatctcaccgaactcccccacagtatgagccacggcatccttcatctactccttgtcggagacgttcacgacatgggtgataatcttagacgatatgacccgaacccacagaacagggaggacctgccgcctgagttgaagcagggcctctcaaggcccagaatgattgctgctgcagcaacgagaaccggaaggcccctatggacaagactaccatcaacaaggcagacatggggacggcatttaggatcgacagccattcgaggacgacgatgctgtgcgccctcatccttaagacggaagagactgcgctccttccgcagcgacccgtattctgacatcggggcatggatggcgcatgagtgcttctgaaagcctgccatcggcgtcttgcgaggcaggttgcacgggctttgtccctgcacgcatgctcaacgaccaaggatgtaaaggtcgtgagcatagcgccctcgaggatgtccaccgtctgccgactcccgcacgaggaaaaacgacagggacgactccatgaggctcacaagacatggcagatgcaggctccacagagtgcgggtgcccaccaaggagatagcagagctaaaaggacgcggtgtgtgcccttaaggacctcaaagaacagcagacgagggcgcaccagcgcgtgctcgacctgcttgccgccacgggatcgtctgggaggagaggatgcccgcaggcagacaaaaagaagctttagggcaatgactttctgggcatagctgcgcccttatcaatccaggcttacagacgacagagtcagcagatgcccgctgcgatgctggaaagggtgcattcccttgcatccacgtgcacgcttgcctctgcctgcaaggtgctcctatgcctttcgggcatcggcttcaggtacgcctttaccttctgcgcaaagatgtgtgacttctccaggttctgttcggggaggagggtcacatcctggctggggctcgctcccgtcgcagtcgtcaagcgccgcctcccacaggatggcaggcatatcgaagcggccccaggctgctgagggcgctccttatgggatgtgcctgggcgtgcgcaagggcaaggcctactttttcgaagagctgccctgcgtcggtggatctacacatcagggagcgtgcacggctgctctcggaggaggcagctgctcgagaggggcgtcttaccctgcaaggcgaatgtcaccacagcagccgagctgggaaggttcatgctcttccttagtcagtaggcgcaggagcgggcctcaacccaggctgcatagtgccacgccgccatccacccactccctctattgccttttgctgccaatctccatgaaagccctgaatgccgctgtgtgcgcgagactcaagacggcagggacgcccgattctatgtgcaccggccatgccaacacgcacgcgcttagagcgtcccttagccgccaagccgaaacatcgatgttgggaccgtgcatatgcacgctatctaaggatatgagaatgggcaaggatgcccgcatgtctcatgttgcaggacgcgtccgcagcggtattcgtcgaatatccttcatccctgcagttcaggaaagccttgtgggcgcctgtttcgcgatagcattgccacttgacaggggtttgagtcatatgagcattgtattgtttgcgaagcttgtcagcagtcttctcaacatccttcgacatatcaaccaagcagagcttggcaccatatttggcatacaccatagcgataccttcgcccagtcccattgcggcaccggtgatcaacagtaaagcccttttacgagggtctacgaattgggtgatggtcgaaggccatccgcagatgtatctatgatatgattgcccccgccaaacaaagtcgcctgaaaggctatcttctactttgtttggcgacatcttaggaagatggccgaccaggcaaaaccaagatgtcggagggcgcatggactgcgcagccaacgaccttgtgctcctttgtcgacagcctcgcagataaggacctcgccgagctcaggggcgcactcaccgtgcggctatgccgtaagaactacggtgcaaacacgctggagggcctgcttgccaaatgggggtggaagccttcgtgcccggaatgcgggtgcctggctggacggaacttccagcaccgagcgcacacagatgcccaaagtgcccatctgagatatggagcactcgccgggacggtctttacgaatgtgaagctgacgctctacaagatcataaagatcgtcgaggtgatgtggcacagcgcatcgcccaggctcatcgagctgacctgtaaggtcagccattcgacaaccttccttctggccccacaagatcttttgcgccgtcagcgactggaaggactgggtgatcctttcgggacgtgtatggatagacgagatgtagttcttcaacaccagggtcgagcacgaggaaggcggggtctgtcccaaggacaaggtctgcatcattgtggctatcgactcgtggggctgtagaacggcaagccaccggccaagcgcatcagcaaggctcgcccatatcgaggagggctcggcgctagtccacgactgtaggaaggcgcacaatgccctcgtgagggatctgaagctcgcagatgagcgttacaaggccaacccgggctcctgggtccaaagatatgccgagcgcttcgtctgcatgaagtcggagaacctccaggcctactatctcgagtggttcaactatctccaccgggtgtacagggacgagaagcgctggtctgtccgggaaagggtcgtacgctatctcgccctctcaagcggaacctacctgcggcgctggtgaaaattcatcacccgactcatagcccttcgtataaaagcgcttatcccaacgcgacgtcaagtgccatcatgatagtgaaaccgagggcaaacatcagcactccctcatcagagtgctttccctcgctcatctccggaatcaactcctccaccaccacgtacatcattgctcctgccgcaaagctcaagaggtagggcaagatcgtcgtgacctgtgatgccgctatcagcgtgatgatcgcgccgaccggctccacagcaccggagagaaaccctcccaggaatgatttcccacggcttaccccctgagcatggagcggcatggagacaatagcaccctcaggaaaattctgaatcgcgataccgagggagagagcgagtgcacctgcggcagagataccgacattaccggccagccaaccggcccataccacaccgaccgccatcccctcaggaatgttgtgaatggtcacagcaagaaccatgagcgtcgtacggtccagattggagtgtgggccttccggtttggtgtcctcctctcccaaatggaggtgcggcaccgcgtggtccagaatgagcagaaaagcaatgccgatccaaaaaccaatgaacgccggcacaaacgcaaactgccccaaggaggaagactggtcaatcgagggaataatcaggctccagatagaggctgcgaccattacccccgcggcaaacccggttaggcaacgttggaccatacggttgagctcgtttttcataaagaagaccaagcaggcgcccagcgtagtgcctgcaaatggtatcgcaatgccctgtataacttgattcactggcattttcctttcatccaaccgctacaccaatcgttcttggtgcagcggtgcgctctatcgaagttttaggcagtcaggctgaaccacgctctttcataggtacagtccataggtaaaatccgataggcgtcctgtctaaatgttaaccataggtgactatacagttctattacgttcaatgtagtcctatcgcaggtttgacagagaaagcacgaacaacaaattctacgacgcccagaattaacgcggtgtttgcggtagcctgggcctactgacatttttccgtacatgttagacagctagcccaaggtgagccctgccaatataatggatagggctcgcttcgacttcgacctggactttgccttttctatcccgcttgcacccactgacatctcatagcttaaatccgctggtagtgttggatgggcgtctgggcaaagaatacttgctaccagttactagcgtccacctgtccatcgcagcgagcatgggctgctgctttgtaccttttgccctggcttctatataggagccgtccacttcgagtgtgtcagctaagaggacatcgagtacacttcaatctcgctatggcacagcagcaaggacgctgtcctgtagctgtggcctatctggcgcttgagcacatgtgctcgtgctcaacctttttggtatgccatgaggcagaaggccacaaaccacgtcctgaaggcaggtgggtgttttccatcatcgtgtctgcagtgaggctaaagccggtgttaaatatctcgtgcactaccataggtgtgtgcatgcccgtgcaccttctgagcagctggcccctttgcaggccggacaggcaaagcttcaggggggacttctttcccaagagcctttttcgcacgactcctctccttgatacctctctgtgaggtccataagcatttcttcctgcgcttgcattccttcaggctcaagcccgcctgtatgccctttggctatgtctttctctgctttgacggatgtatcactttacatccatatcgtacagtgcaggggtgacaggaagtgttgggagtgtgccggaagtgcttagccattagcccaatttgcatagctgtgctggctgcatgacctacaagctggtcttcttttgcaaagaagtcttagtatctgagattttttagcagcgcatggcacgccccagcacccaggcgagcttatcctctattgagtctttggtgttgcacaagacgctgtgcgaacagactcttgagcgggttgcactcctagctgactatgtcttagggatcgtcactgcccggcagcatgccttagtaccgtgcaccttactcctaaggcccagggtgtcgtacacgagcacggacccttttgcgctatgacctcaagaaggtatcctatgtccttttccggctcgtcttgttgcacccctccttctgtgaccctgtgcacgtctgcggtagcacctatgcagatctttgtttttggagaaccgacacgctcggtaggatcgagcggacagtgaggtctcgtcgagccacaccttctgtgagagcatggtgccctctactacaaaggggtctggtgtcacaggtgcatgccgccttgctcttactgcttaaggatcttcgacagaaacaacgctcattctacgacaggcagttgccttgaatagaagacagtgcctaactgcaggggtaaagattctgccgccggcaagacagagctatcttcgggcgccgtcgcggttgcacctgtcacacctgaagcgcacagatttgcaccataggcagacctttggcggatacgtagcgaggtcccaggacagaaaaggacggtatccggcaggtgctaagctgcacgtatcccctgctagcctcaaggtggcagccataaagctgtcggcgtatgtcatgtggtagttcactatcacctcggtaggtcgtgtcggcgggaaactaccacaacgtaaggaacgcaacgcctcgccgggagaagatctttcaggtgtgtttagctgtcagctatacctcaatgggatgccctacagtgggcctgtcgagcacagctatgtagattgggcttgttactatatacagaaggaatgcactcaacattgggatatatgtcacctcatgattacgagcgtaataacgctcaagagtacttaactcggagtccggaatagggtcgccattccaacctcctcgagtgataactctctaggagtatgggtgcacccccatcaggtactccaatctttacgtctgatgtacggatatttgtcagcagcgccccttcagaaacaagtgcgcgcggtacacatcagacctgatgcacactgcgcgttgtgacaatatatccgtagcaatatgaaagttagctaattgtctgtcaatacttcagaagatgcactcttctctattggacagcttcctccggttgcaattgaatactgccaagttctacaatgtcccccacgctaatctgaacgctgtctttgatcggtcgtccttccagggtcgccggattggtagaatggcgatcctcgacctccaacatctcgcctgctggcacgatgtgtagatggtgccgtgagacggaacgttgatggatcaccacatcgttgtctggggcacggccaatatccaacccgtcctccggaattggcacatgggtatcgaaggcatctccgtgaatcctcaggtaatactttttttgctcttcttcctcccgcagcgccttctgtgcagctgaaagatcgagggtcgtatccgtctcatcgtcttctttcggttcaggagtaggagcagcctgttcatgaaccgtgttaaccatagcttgcggcaagggtgcggtggggtgtgtttcctccagcctcttttcctcctcttcttgcagcggcggtaagtttccgctgtcggatggctgcgtatgactaaagtcatacaggcacccgtagcagacgttcatatcggtaaagagggtcgccccacaacgcggacagactttcgcaaaggttgcgctaaacgcttcctgtgtatgtgacatgttcatacatcctttccaaacgtgatactcaactgttccaattcctgaggccatgcatcgggagatgccggcctctcaaggacaaacagggagcctttgcttgaaaccagatgattcggaaacatcgacttcttcgaaagcaggacagtccccgaagcatccgcaaaggcaatatcgatgggatagtgcataccgaaggtgtggatggaggcacagggccacaagagtaccgacggggcatcgctcttactgccaagtaaccctttaaaccgttgagacaaggtccacaacagatggaaggtcccgtatggtgcaatggtcagatacagaaaagttcccgtagctacctcaccaccccaggtcgtacgtaatccgtcacaacctccacactgtgatccaacactaccggcgtctgtagtgatacaccggcgatagagagtgccgaaggccagggatgatatgagagcgtgcagtgaaagtagacgtagtgaggattcaggctcagcaccgcatcactcgcatccccctcgtcgtagtccgcgctgacgctgacctcgcagctcttccaatcggcaaagacacactgcagggcactttgaacttcatccacccgccgcagctgcgtctgatctccggagggtgccacaccctgagcaagcacaatatctcgcgcgctacggtcaaagagtgtgcaggcactgatgaaacgccccaggttccacaccagaaaccccatcacgatcaccacgggcaacacaacagccaactcaacactcatctgccctgaacttcccctcatagcaggcctcccagatcgatcgtgagcgggatctccttaccggagccgggtaccgtaaagcgggcaagctcaaacgggacatccgaaactgcggcgccaatcacaattccaaaggcatctgcaacaccttccggcgtttccatgccggactgagccagctcaataagccgatcccggaaccctgagcgttcgatgcctgcctgggtcaacacgttgccactctgtgtcagcaccggttttctcatcctggtatctgcgggttggaggtccaggtcgcgcagcagtgaggttagctgatccttgagccactgggcgctatcgttccccagaacaccgccaatcccatcgaagaggttatctgcaacggaggtgagatcgttatagccactccagtagctaccaagcaggctgtcccaaagcgacaaggttgtctgggtgaaggagccagtttccccgaaggtctccagccacccatcggcaaagtgcgtcagcactgacccatgtttctcgtcgttatcctctgccagcactgcagcagatatcgcgatccccggcggcaattcgtgcacttcacccaccgtgaatgggagtttggttgcttggggtcgctgcgcaaacgccacacatccccaggctcccggcgggcagagacttgctttcgaagtcttgagtatctgcagcgcttgatcaaaccgatcggagccttcttctgccagattccgtacctcagaatcagcctgctcttcctcttcacatgcct

SEQ ID NO: 287 - DNA, 21719 bp, Unknown
  Metagenome-assembled genome
cgctccagaagatattgaagacatagccgataccgagttgtttgagcgcggtgtagaggcgttggatgtctgtctgctcatgggtaagcccctaaggactctccccaggcggtatggacggcgggggtaacctggactacgacggtgttggtgtggacggccatacccctcaatgtgatgttgtcgcaagcggcaactaactggttgtagccttccatctctaccaggcagatgtggcaggtaccgatctcattgatatctttcagatagcagagggtggggacgtaggccccggcggctttgcaggtatcagggatggtggcgccgtcaggggtggtggcctgtttgttatcgactgtgagtttaatcggtttcttcgtggcttgagccatctgtgttttgagtgctcttgccattggttgattcccctctgcggaatgcgccgtagccgaagtgattacaacgcaggcagcgggcgactttctggcgtacttcctcctcagcgagtctcttctcgatcaggttgaagtcgtgaatacgcttagacgtttccctctccatcatctcgcaccgcatggttgtagctgaagcagttgttgatgttgcctgtgacaaccttgcctgcattgatcgcgcgaatcaccgtggcaggaccgctgtaacagttgccgccggcaaagacgccggggaatcccatcgattgagccatcttcatcggctcgaatacggccacgcttggtgaggataccctgtttggcaaagcccccactctggatagtctggccgattgcaaccacgacgacgtcgcaggggacgagctcttcgtccgcctgtgccgaacggggcgccgggtgtcctcgcttgggtcagtcaataatctggatctgcacgacgacgcctctgacggtattatcctcgttggtggcgatgtgtaccggagtatggagctccaggagctcacagccttcagcggcggtaccgatgatctcttcgttctgcgcgatcatgtccgcgacacggcggtggtagatggtcgtgacttttgtcggcactcagctgcacggaagagcgtgcggtgtttattgtgacgttaccgctgccgataattgcaacacgcttgccggtgaagtccggcccttcgtcgcctccgatgtcacgcagcatcttgattgcagaaaggacgccgttagtgtcttagccttcgagcttcagagcgttgttgctctgggcgccgattgcaatgtagaccacgttgtactccctgcgcagcttatcgagatctcccacaggggtattgcggtggactttgatgccgcagtccaggatccactggatctctttctcaagcagatcgttaggcagccgatagttggggatgccataccggagcatgctgcctaagtgcttacgggtttcgaagatcgtcgcgtcgtgatccatgatcgccaagcggtaggctgcgaagaggtctgtcaggccaccaccgatgattgcaatcctcttgtggatagcctttgcaatccagggacggtagtccttctcctggtgatcggccgcatagcgcttgaggtctctgatgttcatcgggtcgtcgaccatgccatggtggcagtatatctcgccgggatgctcgcagaccaacggtagcggattgtccttgcgggtcaggtgcaccgcgtcggtgtagcagccggcttccaccagtgagatgtagccggggatatcgacaccggcagggcggccggaggcacagaagacgcgctgggactgcttgaatccgcaggtgtggtgcaggaggtggctctcagaatcatcccggaaggcccggatcgtcgttaatgccgtggctgccgtttcatagccgattgcgcaatctgcggacaggtagatattctctgcggtcttttctatcagatcgatcgtgtcgagggttgcatggccttcgaggatatcatcgaagagccctttgaggtcgttgagcccgattctgtgcgggggtgcatttttcacaactctgggtcgcatacatcgtggtttgggctgaggtgaactctacggggcagggggtcagtaagctcaccgctaagcggtttccagtgccctgtagaggttgtccatcacggtctgaacttcgctgcgctccataacatgaggggcgtaccatattgttcctctccacatgagcaataatcctgaaataaatgttacaggtcgttaaacaatgccgactgtgctgtattacgttctccttgaatccctatgatgcttataaattgaatagtggataaaccgatgaagcggagataacgtaccagaaggaacttcgagagagccggcggcggtgtgattccggcagtaacaccctgatgcaaatggaccgctgagggcacagtcaaagtggcagcaggtgccgcaagtattctgtgacggggagggcatcgtaatcgcccggggatgtggttgcatgccgatgagatcacgaagtgaggaaactcattttcgtgaagcaaggtggtaccgcgctgaatagcaatattcatcgcccttgcagtagaacttctgttctgctgttggggcgattttttattacctcgggcagaaccgttggaacagaacgtggcacatcagcgaggaagagaggcaaaagccaccatggagatcagaccaagcctagagaaggtaaggagccttgcagacacgggtgagtaccgtcgggtaccggtcagctgtgagattccctcaggcgaccttgagcccttacaggtgctcaaacgcctgaaacgtgtctccaaccattgctatctgcttgagagcgctgaggcccagaagaagtggggccgctacacctttttgggatatgacccgacgctgttgatcaactgccgtgcaggaaagatgcacgtgggatccttggaattcacgacggacaatccggcgaagtacatccgtcaggtattggccaactacaaggcgccacatttcgattatctgccgccctttgctggtggcctcatgggttacttctcttacgactatatccagtatgcggaaccgacacttcggctggatgcacaggatactgaaggcttccaggatgtcgacttgatgctgttcgataaggtaatcgcctttgacaacgcccgccacactgtggtcctaatcgtcgatgctccactctcagaaggggagcacgcctatcggttagccgagcgtgagctggcagagatgcaggacctagtgttcaacggagaatacgaggaggagccggcagggaagctgacctctgagatcaaaccttattttgaccacgacagctatatcgcaatggtcaagaaggcgaagcgccacattcgggaaggggacatcttccagatcgtcctctccaaccgcttgtctgccacctacgagggaagcctgctcaatacctatcaggtcctgcgtaagctcaatccctccccctacatgttctatctctccggcaccgatgtggaagtcgctggcgcctcaccggagacgttagtcaggttggagaacggtgtgctccataccttccccttggcgggaacccgtcccagaggcaagacccctgaggaggatgcagagcttgagcggggactgctgaaagatgagaaggagctggcggagcacaacatgctcgtcgacctcggccgtaacgatatcggccgtgtcgcagagttcggcagcgtcagggtagaaaagtaccaccaggtcctcaagttctcccatgtgatgcacatcggttccaccgtgcgcggagagctcagagagggactcgacgccctcggcgtaatcgcctccctgctgcccgccggaaccctctccggtgccccgaagatccgtgcctgccagctgatcaatgacctggaagataacaaacaaggcatctatggcggcgcaatcggctacctcgacttcactggcaacatggatacctgcattgggatccgtatcgcctacaagaagaacgggaccgtctttgtccgtagcggtgccggcatcgtggcagacagcaacccggaacacgagtaccaggaatgcatcaacaaagccgccgcggtcgtggaagcacttgaagagtcctctgagacgactgagaaggaggacgtatgatcctgctgattgataactacgacagcttttcctacaacctctaccagttggtgggaagcctcaatcctgatatccaggtcaggcgcaatgacgcaaagacgaccgaggagatcgcggctatgtaccctgaaggtatcatcatctctcccggtccgggcaggcctagggatgcaggcatctgtgaggatgtggtgaaagagctcggaaccaagatcccgcttctgggtgtatgtctcggtgagcaggcgatctgtgaggccttcggtgccacaatcagttacgcgaagaccctgatgcacgggaagagctcgatcgccacgctcgacaccacaagcccactctttaagggattgcccaagcagatcgaggttgcccgttaccattcccttgccgtcgaggcggataccattccggattgcctcaaggtcactgcggtggcagacgatggggaggtcatggcggtggaacacagggagcttccgatctacggggtgcagttccatccggagtcgatcatgacaccgaggggcgaagagatactcaagaacttcttggacataacgaggcaagcgaaacgggcgactgctaaagattaaggagaacacaatgattaaagaagcaatcatgaagatcgtcgacaaagaggacttaacttacgacgaggcgtacaccgtgatgagcgagatcatggaaggtaagaccaccccgacgcagaacgcggcattcctggcggccctctccaccaagtcgaccaaggctgagacgatcgacgagatctccggctgtgcagaggccatgcgatccctcgcgaccccggtaccgcatcccggcatggaagtcctcgagatcgtgggcaccggtggcgatggcgcgcactccttcaatatctccaccacctctgcctttgtaatcgcttcaagcggcgtgaaggtcgcaaagcacggcaaccgtgcggcatcctcgctgtccggcactgcagactgtctggaggcgctgggcgtcaatatcaacatggatccggacaaggctctcgatatgctcaagaagacgaacttctgcttcctgtttgcccagaagtaccatgcggcaatgaagtacgtcgggccgatccgtaaggaactcggcttcagaacagtcttcaatatcctgggacccttgactaaccctgcaaagccggagatgttcgtgctcggcgtctacgacgagtacctggtagagccgctcgtaaaggtacttgactccctcggcgtgaagcgcgcgatggtcgtctatggtatggagaagctcgacgagatcagttcctgtggtccgaccacggtttgcgagctgcgcgacggctactaccgtacctccaagatcaagccggaagatttcggcatgacgcccggtaagaagggagacctcgcgggtgacaccccccaagagaatgcacagattacccgcgatattctctccgggaagatccagggacccaagcggaactctgtcctgctcaatgccggagctgggctctttgtagcgagaaagacccagaacatggcagatggtgtcaagatggccgctgatctgatcgattccggcaaggcattgaagactatggagaacgtaatcgaggaatcgaaccgctagatgtactgaaatctgtgaatcaataaccagacacgcgaggaggagagcattggtgaacatcttggatcagctggcaggacacgcccgtgagcgtgtagcgcaggccaagcgggaaaagccgctcgatcagctacaagacgaagcgctggcgctgcctcgtgacaccgactttcctttcgagcgtgccctgaaggcagagggtatgagtttcatctgcgagtgcaagaaagcttccccctccaaaggcctcatcgcaccagagtttccgtatctggatattgcgaaagcctatgagaaggcaggggctgcggctatctccgtgttaaccgaaccaaagtggttccagggctcagaccagtatctgaacgagattgccagtacggtgtccatcccagtactccgcaaagacttcacagtggatccgtacatgatctatcaggcgaagctgttgggtgcttcggcagtcctgctgatcgttgccctgatggatcaagaggagctcgcctctggtatcaaactctgcaataagcttgggctctccgcgttggttgaggctcacgacggggaacagctgaagatggcgatcgcggcaggagcccgtatcatcggctgcaacaatcgggatctcagggacttcagcgtggacattcacaacagcatgcgcctgagagcgttgacccctgacaatgtaatcttcgtcgcagagagtggaatccacacgcctgaggatgtgaaagagttgcaggatgccggtgtagacgcgctactcgtgggagagcagctgatgcgtgcggcggatcccggagcggagctgaggcggctcaaaggtcagacagcatcgcaatacagagggaggagagagccatgacaaggatcaagctgtgcggcatgagaaggcttgaggacatcgaggtcgtcaatgaactgaagccggactatgtgggctttatctttgcgcagaagagccgtcgctatgtcagacccgatcaggcaaagcagctgattcaacgtctcgctcctagcatcaaagcggtcggcgtctttgtgaacgatatggatgctcaggctgtggttgatatcgcccgctcctgtggcttgggtgcggcgcagcttcacaaagacaagggtgacgcacgtgtcgatgcgatccataccctcattgtgaaagactctaaaccgctaacgatcattcgtgcattctcgatcgcctcggctgaggatgttgacccggtcgagaagagccacgccgatctggtcctcgtcgaccacggaggtggagggaccggggagtccttcgattggagcctcatccagaacctcaagcgcgatttcttcttggcaggaggactgacgccggagaatgtcggagaggctatacgcttaacgaagccccttgcagtggatgcgagctcttcgcttgagaccgacggcttcaaggatccgcagaagatgcgtgcgtttgtacaggcggttcacgatacggaccgtgagcttgcacgggggtgagcggagcaagtacatatagatagcaacaagcgcttacacgcttgagcaatagcttaaatatgaaagggagatcatgacaaacaaaaaggggcgtttcggtatacacggtgggcagtatatccctgaaacgctgatgaatgccgtcatcgaactcgaagaagcctacaacaaatacaaggacgatcctgagttcaatgcagagctgcagacgctctatcatgactatgcaaaccgtccaagccggttatactacgctaagaaaatgaccgaggatctgggtggcgccaagatctacctcaaacgtgaggatctgaaccacaccggcgcccacaagatcaacaattgcttagggcaggcattgctggcaaagaagatggggaagacccgtctgatcgcggagaccggcgccggacagcacggcgttgcgaccgctaccgtcgctgcactcatgggtatggagtgtgtcgtgtttatgggcaaagtggactgcgagcgccaggcactcaacgtctacaagatgaagctcttgggtgccaatgttgtaccggtcaccaccggcacgggcaccctcaaggacgccgtctcacaggcgatgcgtgagtggacctcacgtatctcggacacccattactgcctgggatccgttatgggaccgcaccccttcccgacgatggtgcgtgacttccagtcggtcatctcaaaagagatcaaggctcagctctatgagaaggagggacggctgccggacgcggtgatcgcctgcgttggtggcggctccaatgcaatcggttccttctatcacttcattcacgataaggacgtacagcttatcggctgcgaggctgcaggacgtggcatccacaccaaggagacagcggccacgattaacaccggtcggctcggcatcttccacggtatgaagtcctacttctgccaggatgagtacggccagatcgctccggtctactccatctctgcaggcctcgactatccaggcgtcggccctgagcacgcctacctccacgatatcggccgcgcacagtatgtcgcaatcaccgataacgaggcagtgaatgcttttgaatacctgagccgtaccgagggcatcatcccggcaattgagagtgcgcacgctctcgcctatgcgatgaagctcgcgccgacgatgtcagaagacaagatcatcgtggtcacgctctctggcagaggagacaaggactgcgcctccgttgcccgctatcgcggtatcgacattcatgagtgagggggagaccaatgagcaatatccataaggcatttgagaatcataaagcgtttataccgttcatcacagtcggagaccctgacctgcagacaactaaaaaggttgtgcaggctgcggtcgacaacggtgcggatcttgtagagttgggcattccattctctgatccgactgcagaaggcccagtcattatggaggcggacaaccgcgcgctttcagcgggtacgacgactgacaaggtctttgcgctcacccatgaattacgtaagacgatcacggtaccgatggtatatatgacctatgcaaacgtggtcttctcctatgggaccgagaagtttgcacagaaggcccaagaggctggtatcgacggactgatcctaccggatgtaccgtacgaggagaaagcggacttcgatggagcctttgccgagcgcggtatggatctgatctccatgattgctccgacttcacaggaccgtattacgatgatcgcaaaggaagccaacggcttcgtctacatggtgtcctcattgggtgtcaccggtaccagaagcgcgatcaccaccgatatcgcagcgatgacaaaactggtgaagtctgcaacggacattccctgtgcagtcggcttcggtatctccagcccgcagcaggcggcgaagatgacatcactgtccgacggcgccatcgtcggcagcgcgatcgtcaagatcattgcgaagtacggcgaggatgcagcaggcccggtcggggagttcgtgaagtccatggcggacgcggtacacgcagtatagaagcgagcaaaggctcgaagcattgcactgagtcctgcaattataagtaaacacgtttgaaagcatgagggaaggctaagaagtttttcctccatgctttttcaatatgcgccacaaggtcgttcggctgataccgagctttttggcagcctcagtctgattgccattgctgtatctgatagcgaggcaggcggcatcgtatcccatctgcgcaagcgagccaaagggtatcgaaaggctgttaccttccttatttgaaggtgcctgatcgtcacggtacaggcttccatacgtgttgacagtagaggtccgattgagaaaagttgggcgttcgagggctaaggcagagcgaacgctggcctgatcgatcacgtgatcgttggccgacaggtaaagctgccggatgatccgcccgaactgtatgtagttaccgggccaggcataggcgctcaagagatccatcgctttgtgatcgatacgcaggacctcaccagttaattcgctattcagttggctcaaatagagattggcgatggtcggaatctgttcatggatttcacgtagcgggatgagttcgacctccatgcagagaaacttgtctttgatgtaagagatgtagcgctgcacagtatgccccaatggattgcaggaaaagataacgcgcatgttctgataggtgcctgcctgcgcgatagtcgaaaacagattgtgcaggaactggttgcttgaactgtcgaagttcttgatgtgtatggtctcattctgcgcaaagaggggagagtgggaactgttcaggagaaagtcctgcgagctttcagtgagcatgccacagtcaacctcagtgaagggacgcgaagagaagggagaggtcgcataggtctcgagggctaccgccgttcggcctgtgccatactcgcctgtgatcaggagtggctggcggacttcgttggcattctctatggcagactgtatccggtcatagtttccggataggttgtagagcgatccctcgaagcatcgctgtgcctcatggcttgtgtaataggtgatgccgctgcggcggcgctttgaggttgtatgccccgcatggatatagaagacaatcgcagcgatgtctttatcgtcccgcttaaaggagacggtgttgtcgatgagcgcattatcgaagttgagatcattgatggttggttccggaatgatatcagctcccggtgtgccgttctcgtacagtacggcacaggacacgtggtacaaaatgccgttcatggcttttctcagattctgtactgatccgtttttcacataggggatctgtatgcgaaggtaatcgaccagcccctgggggagttttgacatatgggaaacaaacagaatagagcccttgggtgagaaggcaagtgtcgtattatcctcacgatagagtgtttcctgcaggaggcgattgtcatgatttgcctgccggaggtaatcagccagtgtcaatgcgctgttgaaagcttggcggatcgaattggcgccggaggtaattagtactgcatcgagccctgccgcacgtgccgcggagccggaaaccacgtcacacagaacggtctgatagtgtttcttgaccagcagctgtacgacctctgaaatatcgtctgcttcactcagggtgtagatatcgagattgagctgcagaatctcattgatcgtagcggcggtgttggtgatggcgggaaagccaacgatagcctttttacccttgatctcctgagcaagtttgattgccttcaggatatcgaagctgccgatagggatgtccagcaccggaatattgagctcctggcgcaaaagacccgcggtgccaccgcgggacagcacgatatcgaagttctgcatgttgaacatccgcgccgctctcagtccatagttgaggttgccggtgatacaacttaactggatattttggtactcattcgcgacccgtctgacactgttggcaagccccgcataaggggccaccaccaatatccgacacggttgtacggcccttgaaacagacccttgcggttgcgtcatagcctcacacttttctcagtagtggttttctttattctactggtgagtcgtatcaatatgaaacagaacgaccgagattgctagaacaagctgaaaattgtttcaaagtgaaactttatgtcgctttgcttgctttgtgcgtaatgaaaaagcttccatactgcaagacagaacagatgaaaacagcctgagacagcatgcctaaggaggcgtcagacgtgcttgaacttttggtcatagcagatgatctcacgggtgcgcttgacgcgagtgtgcagttgtccctgaaagggtatcgggttgccgtaacgcaggattgtaccgtaccagctcagttggcacaggactacgatgtcctcaccatcgacactgagacccgccatgttagcagcagggacgcatacacctgtgtgtacaatgtggcaaaacgtgcccaggaacacagtgtcgcccacttttataagaaatgtgacagcggtttacgtggtaacgtgggatcagaactcactgcgctgctcgatgcaaccggagctgcaaagctcaattttgtgccggcgtatcctgcacttgggagagtgacacgcgacggcgtgcaatacgttgatgagaaaccccttgcggagagcgtcttcgcgtacgatccgctcaatgcagttaccgcgagcaaagtagcggatatcatcgcacaggaaagccagatggcaacctatgactcacatgcagcagaccgccatgggatcatgatctatgattgcgcggatactgaagagcttcgctcaatcggatcttccctcgaaaaaaacgatggattccgtgttgccgcaggttgcgcagggcttttgggaacctatccagcaccccagatgaaacatgaatcagtattagtcccgcagctgaatcctaaccttgcagtcgtgtcaggctcagtaaacagcgtaacggtctcacagcttgattacgcacagcaacaaggtttccctcgtctacatgtcccgctcgatcagattatgcaggttaactggaacgacactcagatcaattgttttactgaccgctgtattgaggcagtcaacaacactcacagtgtcttagtcgacagcctgggagatcgtcccgaccaggtgaccaccgttgaaaaatcatccacggctatcacggatgcgatgggccagcttgccgcgatccttgaagcgcggcgttccgccacgctcatggtggttgggggtgacaccctcgcatcatttttctcccattctaagatccgagtccttgagccaatgagagagattgtcgagggtgtcgtcttaacacgcttccgaggacaggatggttggcagtatgtgattaccaaatccggcgctttcagcgggcgcgatgttttctgcaaaattctatcgcttttacaaacccagagagagggtatgcacgatggtattagatcaatatagcctcaagctgccgcatgcagtgtacagcggtaaagattccttgaatcggatcccagaggtcctcaagaatgcggacactcacaaagtgacagcatttacggacaagtcgatccgctcgcacggtctctttgacctagttgagaaacaaatcaaggcaacgggcgttgaattggaggtcttcgatgacctgacaccggagccgacctacatggcggcacaggaaacggtcgacgagttcaagaagactggcgccgacttcattattgcctgcggaggcggctccgtgatggacgctgccaagctcgcaagtgtgctgtgcaccgatgagtacggcgtcaaggatctcttgagcgatccgggccgtgcgcgcaaatgtgcccatctcctcgcgatcccgacgaccgccggtaccggtgctgaatgcaccccgaacgctatcgtggctgtgcctgagaaggaaacaaagatcggtatcgtcaacgacaacatggtgcctgacgacgtgatcctggatgcagaaatgatccacaatctcccgcggaagatcgcggcttccaccggtatcgacgcaatggcgcactgcattgagtgttacacctccaagaaggccaaccccttcagcgatactttcgcgcttgagggcttcgatatcgttatgaacaacatcgtagaggcctgcaacaaccccgatgcgctggacgcaaagaacaagatgcagatcgcagctttctacggtggtatcgcaatcaccgcttccggcactacctcggttcacggtcttgcctatccgctcggtggcaagtaccacatggcccatggcgtctccatcgcaatgatgctcgccccgtgcatggagttcaatgagccggcctgccgctccagattcgcgcaggcatgggaccgcgcctatcatggtgataaggttctgaagaccgaggaggagaagtccaaggcactcgtcaagtggatggacgacatcgttaaggatctcgatatcccgactgatctgaaagagtttggtgtcaagcctgaggatctcgatgggcttgtgaaagcaggaatggagcagcagcggctgctgatcaacaatatgcgtgaggtcaccgctgaggatgcgcgtgccatctatgagaggttgctgagctaaatgacagatatcaaaggaatcgtagtcccaatcgtcaccccgatgaatgaggacgagtcactgaacttgaagcagctcgacgcgcagatcgatcgcatgatcaacgagggcatcgacggcatcttcgtcttcggcaccaacggtgagggcttcatcctgaacagtgaagagaagaaggccgtccttgaggaggctatcaagtacgttgcaggacgcgttccagtctatgcgggtaccggctgtatctccaccaaggagaccatcgagcagtcaaaaatggcacaggacctgggtgctgacgtcctttccatcatcactccaagcttcgcaaaggcgagccaggaagagctctatcgccactacaaggcagttgctgaggctgtttcgaacatgccaatcctgctctacaacatcccagcccgtaccggcaacgcacttgagccggcaactgtcgagcgcctggcggctatcgacaatatcgtgggcgccaaggactcctccggcaactgggataacctcaaggcctacatcgcagtctccaagaagtatccagacttcgcagtactttctggcagcgacggcctgattctaaaggccctcaaagagggtgcaaagggcgcgatcgccggctgcgcaaacgtgtatccgcacactctggcttccatctacgacaacttcgtggcaggagacatgggcgcggcgcagaaggcacaggacagcatcgcttcttttcgcgccaccttcaaatacggcaacaacaacacgattgtcaagattgctgttaacgagctcggtattccggttggtttgtgtaaggcaccgttcaactggctgagcgatgagggaatggctgcactgcgtagggtactcattgagaacaagcagaagggtatgcactaatggctgagtacaagcctaccgtcggtatcactatgggcgatcctgcgggtaacggccctgagatcaccgtgaaggcgctttcccacccagacatctatgaccattgtcgtccgattgtggttggggatgctaagatgatcgagcaggcgactcactttgtgcatcatgaggagatcaagatcaacttggtggacgaggtgagcgacgctaagttcacctatggcacgattgacgtctatcacctcgatctgatcaaggatgtcaagtccttcaagattgcgcaggtctccgccgaaggcggcatggcggcgtttaggagtgtcaagaaagtcattgagcttgcccttgcgggcgaggttgatgcaacgatcaccaacgccctcaacaaagaggctatgaacatggcattgaagccatatggcatgcattttgacggacatacggaaatctatgcgtactatacacacaccaagaagtacgcgatgatgctcgcattgcacgacttccgcgtggtgcacgtatcaacccatgtcagcctgcgtcaagcctgtgacttggttaagaaggaccgtgtcctcgacgtaatcgagctcggttacaacgcgctcaaggatctcgggatcaagaagccgcggatcgcggtggcagggctgaaccctcatgccagcgaagatggcctcttcggcactgaggagatcgctgagatcaagccggctattgaggctgcacaagctgaggggatcaatgcaatcggtccctgcccgccggatacagtgttttcgcagatgcacggtggctggtatgacatgaccgtgtgtatgtatcacgatcagggtcatatccccacgaaggtgttgggctttgtgtatgatcgcaagggccagcagtggaaggctgtcaaaggtgtcaacgtgaccttgggcctgccgatcatccgcacctccgtggatcatggcactggcttcgcagtagcgggaaacggtgaggctaacgagctttcactggtcaacgcaattgatctcgcactgcgcatggcaaaagggagacaaacccgtaaacagagccggcaatagtttctgaagtgtataggccaggtatcccatctgaacctgaatagatgcccggccgtttgaatgatcagttttggtatagaaccgcattatgggtgcggttagggagagcctgtgcctgttacaggcaaacaggtacaaaagggaaggaggagcacacgatgactacatcgatgattcttgctctcgttgttctcgttgccatgatcttgatgatcatgtttgacgtgcttccgtttggtctgccgccccttgcggcatgtctgttgatcgtgattttcggtctcggtggtgacgatccgatcgcatatgcattcgctgggtttaccaactcaaccgtgtggatgcttgccttctttatggtcattctggcagcggtccagaagacctccgtcatcaacaaggttcgagacgctatgacgaaactggtggaaaagggcggctatagaagttatgtcctgctcctccttctggttatgcttggcgcctccattgtcggtatgggctcaaccgctttctatgtgctgatcttctcccttgtcgtctctatgccgtacaacgaaaaacttccaggctcaaaactggtgcttccgttgggcatcgcttcaaaccaccctctgatcccgatcaatgttgctcttcagtacggcgttgcagttgcagttctcggtgcttccggactcagcagcgaaaacctttctatggtccagttcggtatggtctccttcattctgtccatgggctttctgctctgggcactgatcggctacaaggtgctaccgtcccacccggttgccgagccgaccgttgagaacaggaaggccttggaagaaggcggtaccgtgctgtctcgtggacaggaagtcgtcaccgacatttcattcatcgtcgcaatcgtcgctatgatgctcgtcaacgttattggccctctttccattatcatccccggtgtctgtgccttcgtgatggttcttgcgaaggttattgacttcaaagaattccgcgacaacctcttctcaccgatcatcctgatgaccgcaggtgttattccggttgctaactgcctggctgacacgggtctctccatcctcgtcggcaacgccgttgcaggcgtgctcggctcgagcgttcctccgttcctggttgtttttatcttcgtcctgctttgctccacctttgcctgcctcaccggcgctcaggtcggtattgttatgatctttgctccgctggcgatctctgtgtgccagagtatgggcatcaaccccatggctgctgccgttgccgttaccctcgctggctggtgcggacactatatgccgatcgatggtttgccggctatggcatatggcatgggcaactatacgatgcaggagttctggaagtttacggttcctttatacttcatccgtctcctcttcctgactgcaggagcactgctcgtgttcccggcatagtatgcattaggcaacaactgcagatgtgactttcccgtagccgatacattatggtgtgggataaggcacgtttgccataaaagaaggtgataggcatggcaattaaaacacttgatagactcaccccggatggccagatctggtatgacagcgagatgaaacttagggaggcctttatcaatccgggaccgtggaccacggcacacggaccgggactcctggagaccccaaaaggcacgattctctgctgctggtttgccggcacctatgagggagacaccgatatcaacattgtggtatcctgcctcgaaaagggctccgataagtggagcgagccgacctatatctcacatgacaatgaccgttctgaccagaacccatcactgttcctagcacccaacggtgagatctggtgcatgtatacctcacaggaggggagaaaacccggcaaggacaacatgcagtacaccgcagtggtgaaaaagcaggtgtcccttgacgatgggaaaacctggtcagagcctgaggtgatgttcaatgagccgggtacctttgcccgtcaggctatccaaattctctccaacggacgttggatctacggcaactggctgtgctccgattccgcctccgggcttgcgaaggacccttcagcgttccagatctcagatgacggagggaagacctggcgccaggtgatggtccccaactcctctggcagagtgcatccgaccgtagtggagctggaggatgggaatctcgttgctttcttccgttcccgccaagccgactggatctatcacagcgagtcgaccgattatggagatctctggactgagccagttcctaccgtacttcctaacaacaactcaggtatctgcgcactaaagctaaagagtggtcggttggcgattgtctacaaccactcccaggcaccgcagacctttgggaagaaaggtgcctggcctggactgcgctgtccagtcaccattgcgctctcagaggacggcggcaagaccttcccgctgatccgccacattgaacgtggtcaaggctttgtcggggaggaaaactgcgccaataacatgcagtatgagtatcccacgatcatccaaggaaaagatgggataatccatatagcctatgcgtacgaaacacgaaaaggtatcaaatgggtttgtttgaccgaacaggatatcatagggcaagttcgcggcaatagcacctataaccccacctcagggtatgtcggtgcacattagaatggaggacaaaccatgatttacgatggaatgtcagcgcttgagcgctatcgcggtctgtacaaaggactcgatatcctgatcgattggctcaggcagaacgactacaagacgctcgatcttggcaagcatgagatcttgggtgacaaggtctttgttaatgtgcagaaccccaagacccgtacttataagaatgcccactatgaggtccaccatcgctatctcgaccttcagattgatgttgaggggaacgaagccttctatatcacctcaggccccgttgatccgattgagccctttaacgaggaaaaagacaagcaatacgtcgatgcggcaaaggataatggagatgagacctacgggacgcttgagaaggatcacttcgcgatctttgttccgggcgagccccatatgcccaatgtcgtctgcgtaacagcagagcccatcaccatcaaaaagatctgctttaagattctcgacgataagtattggaatgactgatgtgacctgtatcattttttcggacagtgcggcttgaggaattatgaggctcctcttaactgcaagacaagccgaccgaaaagactacaggtaacaaacaatcttgctaccaaatacagcgatgagtagcgcctgaaaacagctgactgtgctatcttcaccggcaagccggaaagccacctcgccaccgagattgtgtcgagttttgtggtgtaagagtagggccgcgccagtctcgatatcggcagcctcctgtgttggcgtaactttatgccgctctctcgtacttatcaatcaccagcttcatgatcaccctcgcttcggagtgcgcctcctcgccctcctccagctccttgatgcgcatctttgccctcttaagggagaaaacgggctctggtgactccttcgacatgaacagccttctgcactcccactcggcgttaagcttgccgataatgccagcgagcagccgcatgaccgaccccgttgacgggaacacctgcacgacccggccctgcgcttgagcttaccgttcatgcgcttcatcacgttgttggtgcagatcttcaggtggtgctgtctggggaaggacagatacgcgagggtatcgagctcggtgtcctcgaccaccctggccaccgacggggtgaacgtccttagctcgtcgatggcgcgccgtcaggcccctgagctgtaatcttttggtggacagtgggattcagggactggcaacagatatgctctgtccagatacccacctaccaacaccagcagattgaagagatgagatgtcgctaagcgcaagcgagatagagaaggcaaagtcccgcacgaagccggaaacacccaaacactacactgaagaagtattgccttaaggctgtcgactactacaggaaggcacgtaaggccaacccgaagaagagcatcagaggatgcgccgcgaagcttgaggccaacgacaagaccttaaacgactggatcatcaagcactcaaagaccaaaagggtgacccaggaaaggaccgacgagcacaagcagctcgacgcagtgaacaggcgcatacacgagctcgagagcgagaataagttcctaaaaagtggcagccttcttcgccggaagcctctgttgaaggacaggttttagctcatgctggagaagagggcaacctacagcgtctcgatgatggagcgcgtactggaggtgagcagggctcacttctacagatggctcaaggccaaaggcggtgaggacctatggggtcccctcaaggaagccatctgcgcgatatgggaggaaagcgacaggcgctttagcttttgctaggtctgatccaagctcacaggagatccaaagttacgcaaaatttacaggcacgacccgctaccgcgtgcgcaggtgcatggctaagcttgggcatctgcggcatctgatccaatgcctccaagaggacgacgctgcccgcacctgatacccccgagcgtcccgacctcacccggcgcggcttctcgtgtcttgtgccgacagccaagctcgtgggcgatataacctatcgcaagaccacggcaggctttatatatctcgccgtcgcacacgatctgtgcacacacatggtggtgggctgaagcatacaggacaacatgagggcaggccttgtcgtctttgccctgaagatggcatattcgcgcggatacgtggctggaggggccatattccacagcgaccgtggcagccagtatacgagtgcagagttcgccgcctgctcaaccgcgcacgacgtgaggctctccgtcgggagaaccggaagctgccacgacaatgcgctcgctgaatcgtttttcgccacgctcaagaacgaatggtactaccacaagcgcctctcggacgcatccacgaccaagcacaaggcacacgagtttaatcgagtcgtactacaaccgcttccgcccgcataagtccataggagatcgcgtgcccgcagaggtgatgcaggagttcttcgagcgcttcgagagaggccttgcatacgatccaaaggtgatgcagaccgcataaaaaatctgagaaatgactgaggacctccagcataaccgcagggattcctgtcgcctccaaaccgtacaatgaggatgcaaggttgatgcatccgagagggcaaagaaagagatggcgaaggggcactcaggtgctctgaacaggcgcgaatgcgagagcaaagagacattgatgggccttctggagaggttctcagacgaggagtcgtgcgaggggaggctgctcgaggagaaggtctccagcggctttgtctgcccggtgtgcgccaatacgtcctgctcgaaggtctgaggccgcgcgcacaagtagcagtgcacgaagtgctcgcaccaggtgagcgtgagcgcagggactattgatggagggcacgcatctcgagcttaggaagtggttcgtaggcgatatggctcatgtccgcccagaaggcaaggatcagcgcctgcgccctgcagaaggcagataggctgcagcttaaagacggcagggcgggtccttttaaggatatactc

SEQ ID NO: 288 - DNA, 25664 bp, Unknown
  Metagenome-assembled genome
ctgtgcgttactgcaggatatggatggcctcattgtacggtggtgcgggcaaacttcgaggtggccacatggcgcaggcgtgtcagcagtgcctgtatccacaaagcggttgagcatgttgagctatcagggcaaaggtcaaggacggcctgggtaatcatgaacttgagcatcgccttcagcgacatccatatccccttttcgagggtcgccagacgcccatctccggctcgatccgatccgtggcagaactctgcagcatgccggcgagtgtttgccgaattcctcagcctgaaaagtagggccaaaagtgtaaacgtccccaaggtcatcgcgaagttctctgctctgcagctgccctggacggtcaagattagtcgtctttgccgaagaaagaaaatctggtgactcagtccacggagcatgttctgttgaagcttcggcacgttcgtccattggtcaaacgttcgcaatggaaatcctgccttgcaccctccgaagatcacggaaaggcggggaggcgagtgatgatcgggtgcttgggttcacggtagacgagaaggttacgctcctggaagaaaatgtggatcgcgtaggcagcgatgggcggatacggaaggacgcacggaacggcttggtccgcttccgcagatgttgagggtacgcacagaaatgtacgcccgggtcgcattgcttctgagctgcataggatagtccggcggcacaagaagcgccctcgacgacgacatttagtggcctgcatctcaaagggttgcggaccgctcggggtggtggtaagcgcgtagtgctgtggacaactgagcttcggcatgcaccgacgttctgggagacgatagggtacgtaggtacctccccccgctatctccttatgcggacacccctgcaggtccttcttaaaggcaaggatccgtcgttcaggacgataaatccgagttctttcaatcgcggatggatgcgaacccatccggacaggtaaactattttctacctggagaactcctctttaatcctttagagctcaaatagatccttcagtacgcttcaaggagaacccgactcacagcaaagacgggggaggggggggggaccccgatcctcctgtttagtcattggaaaacagaaaaaatgtcaaggttgaggtagagcaaaaactcaatcacgtttggcaccatcgggagaaagactcatatagaaaaaagaaaaacaggattaggccatcgctgaagagcccggatgctgaggtgtggctcgcaaggcgtagtcgcagtttgcgcaaaacctttcgagttcaaattcctcaggatggtgaggggtattttagagcgatctccggatgccactgcaccaccccacacgcacgtcctccccggcaataggacgcctcgacagcccatcgtgggcaatacccctgccgatttggagtaccggactcagctcccggagtgcctgatgtggcagggttcactaaaaggaccgccgcttcccttaccgcctttgaaatcgggggtatccccagaaagcgtcacctggtgaacgttttctcaggctaatcgtagatggagtgcttgaggtcagtgccccctgctcattcacatcctgccagagggggaccccccgagcaggacattgagcacctggacaccgcgaccaaataccgaggaccggatttatcgtcggtcgaagcgctatccgcagcagctccaaactccgcgttgtcacgctcccgcgcgggaggagaatccgcgttcggaagggtctgcccatagaggccagggtcaatatcgaaaccgcggtcaggataaggccatgaacacgatcaaaagctactcaccgctcactggggtcgttcgttcgtaatcacacaggataggaagcatcccccactgctttcatcaggatcgtatgtacttcatatggagagctgtgttctttatccggcccccgagatcgataggggtgatgctgatgcaaaccgatcggcttcactggtatcctcctcacaaaactccctgcatcagggggccggggggggggccaaaaagttggggaaacctaggttcgctagacccagtgacaggggtattccaaaggactcatcccagcacagatgattccgttggtcgttcgctcctgtatgttggtaatactctacatgatgttgtagccgtttagactgatcccataaattcgattgcggctatggtgtgggctccaatcatgaagtaaaagaattcattgcttgagcctaccgaagagtatcctctgcggcgtgtttgtgtacggttgtgcaaggacgattagcatttgaaagaccccacatattttatgtgttcccctcttttcgcatttagagccctgcgaccctttttgtcaggatttgagaggataacttgcaacaccttctagcttctgtttgatgtgtagcagcgatcccttcatagaatcacctccattcactcctcatcttttctgtatggcagctttgaaatccttgttacttatcgggggtgtcttgctgtgggatgtagcaccgacgtaaggtgcaaaggacggagatattgactcccgcaggggcttggtacaaaaaatcaagattgaggaagacactctggagcgcttgtttgttatgttccgaccgggaggctctttgctactttcggcgtcgtttaaaaataacctctgtcatcgtctcttccagcactgcaccccaagggctaacccatatacatacataggctttaagctcgcaaaggcaagcttttctcgcttcacccgcatactgtcgctagcatcaggatctgcggcatccatcggctcttctgccagatatcgttttcttcaaccatatatggtagtttcaccgataccatatttgcgtgtagcatgtgcctcttgccaaagcacagcttaaagggtctcccatcccatatgttgagggtatcttgtatggacagagtggtcatatagcataagattttatactcgtctgcacatccaaccatagagggcagagccacacacaccgaatcaggcgactcgtcctttgctggcccaccatcgcgtatgtagtctagaaccctttcgatagattcctgtgagtatgccacaccccatcctttggggtgatagccctccgggatcatgggtgcacctcctcctatcaaatctgtaaccgtatgtaagtttatacacagcaattgcaacatctctgaaacagccttcaacatctatttggtgcctattcatagtaaggtaaggacgtcgtgtacgaacgaaggagacacactataggaaacgtgtgcatagagcacgattcactcggagaggtcccggtacctgtgggtgccctgtagagaacccagaccgaacggtcccatcagaactttgcgatcggtactgagcatatgccccaagcgatcatccgcgccttgattcagattaaggaagcggcagcccaggcaaacaacaagctcggtgtctttccgcacaagcagataaccctgatcgagaagaccgccgatgagatcttggacggccagcacgacggcgagttcccgctcaaggtgtggcagactggctctggcacgcagagcaatataaatgtgaacgaagtcatcgccaaccgtggcaaccagatcacgggtaagaaggtccttcacccccatagctcagtcaaccattcccagtctcccaacgataccttccccagtgctctgcacatcgcagcaaccaccgagctcacccaggagttgatcccccgaagcacaggatctgatcgcctgttttacgaaacttgacgaaacttgagcagaaaaaccgggtcttccacatttctagtgggtagcagatgccaggacatttgctccgtgaagtcgagcttcccgagcctgagcaagatcatcgtctcgaagtaggatgtgttcttaaatccccttgcagctctcttgatggattggatgagcgagttgaggccctccaggatcgcgttggtcgacctcgaaccccaccagctgaggatgccgtcccactccttcctgagagtcctcgccattagtcttcatcctcgagacgttggagtgcatcatccaggagcaaagcctgcggagcacctcggagacggacttacagtcggagcagctgtagttgtcgcgcatggcctcgctcatcgcgcaggccctcgcagccctcagctgtgacatctttgagtcgagctctcgcgcttgagccagacgtaggcgcctggcgcttctcgcacctcagctggtctgtggccttggcgaaaagctgcatcgcgtggaagcgctctacgctctgggcggcctgcggcatctcgaaggcgacgccgaaagagtacgccttaagccatgtcacaggtgagctcggcgacggcaccgcggacagcgaggtgctccttaagctggtcgcagagcctgcagagcgcctccttgtccttgccctgcgtgacggcaaggacccttctgaccgtcgaggtctgccatcgagctgatgtaggcctggttgcacctgcggggcgtgtcgtcgatccccacgcagctgacacccgagtagtcggcggcacccttggccttaaagacggccctgttacaagatctcccagacgcgtaaagtcggacttacggacctgtagcgctatcgtgcttgctctgccacagagggcctagagcagcaccttggtcttaaagagcgccgtgaagtgggagttcgggtacacctcccagggtatcctgcacgtgtggacaccgcccttcggggcagcccgccctggggacggcgcagtgcacgaccgtgtcgtgctgccagatgtcgaggtgccataaggtcctctcgcgggtgtcgtaggtgccgcagcacccgctggcatgccgggcactcgacagccctgccgcggacgtggagctcgtcgggggagccgtcgtgctccttaaaccagacgttacaagaccctccactcgtcgctaagccccatgggacctttcaaagagctgtgccagcatgctcgcgtgtgcgcccatccaaacctgcccatcgcgttgccaccctctgtgagaattctacctttcggacgagacgcgctcaatgcggggaggctatgctacccaccagaagtttcgaagagccgaaaaaccaagacatcgtgaagtccggccgtacacacctccaggatgcgatccccatcgcctccagccgggaaatttcaggctgacgcaacctcatcgaggtgggcgtagaggatatccggataagcctgcctagactctacaagctggtgctcggcggtaccgctgtggaagccggcctcaacgccccgaaaggctttgataccttaatagcccagaaattgcaggagatcgattaccgatctccccttcgcgagcgatcccaacaagttccatgccctgaccggtaagaacgcgatcgtcttcagtcacgacgccgtgaaagcacttgcgacaaacatgacgaagatcgcaaacgatgtccgagggctggtgtcaggaccgcgcgacagcataggcgagatcacgatccccgccaatgagcccggcagtttcatcatgcgcggcaaggtcaaccccgcccagtgtaaggcggtcgcgatggtcgccgtccaggttatgggcaacgacaccgcgattggtatcgacgcaagccaaggcgactttgagctcaatgtctttatgccggtgatcgcatacaattatctgcagccggtgagattgctcttagatgcgatctgcttcttcaccaagcactgtgcgagcggtatcaaggctaacaagcagaagatgcactacaacttgcaccgatcactgatagtcgtgacgattctgagtcgccacatcggctatgagcatgccgccaaggtggtacaatacacatttgcgcacaatacttcgctttggaaagcttgtgtatcattaggctatctgagcgaagagaagttcgattcagtctttaaacccgaggagatggtttagcagtggacgaaaccagcagaaagagccttgagctccacgagaagctgcacggcaagatcgaagtgatcgcccgcgccaaagcagagaccaacgaggatttggctctgctctacaccccaggcgtcgcagagccctgccgtcagatccagaaagattattcaaagcagtgggacctcacccgcaaaggacacctcgttgccgtaatcaccgacggttccgcagtcctcggcctgggcaacatcggcccggctgccggcatgccagttatggagggcaagtgtctcctgttcaaggagttcggcgacgtcgatgcaatcccactgtgcgttgatacccacgatgtggacaagttcgtcgagaccgtctatctgatttcgaagtccttcggaggcatcaacctcgaggacatcgcagctccgcgctgtttcgagattgagcagaagcttaaggagcgctgcgacatcccggtcttccacgacgaccagcacggcaccgcaatcgtcaccgcggcaggcttactcaacgctaccaaggtcaccggcaagaagatgggcgatctcaagatcgttatgtccggcgctggcgcagcaggccttgcaatcgcgacgctgctcgagcacatgggtttcggcgacgtgatcctctgcgaccacgtgggctcaatctacgatggccgcgacggcctcaacccctacaagcagaaagtcgcaaagtacaccaacaaaaacaaggagcagggctcacttgctgacgtaatcaagggtgccgacgccttcatcggtgtctccaagccgcacctggttacccgggacatgatcaagtccatgaacgacagtgcaatcgtctttgcgtgtgcgaacccgacgccagagatcatgccggacgaggctaaggctgcaggcgctgccgttatcgcaaccggccgctctgacttcccgaaccagatcaacaacgtcctggtcttcccaggcatcttcaagggcgctctcagggcccatgcccacgcaatcaccgaggatatggagattgcagctgctgaggcaatcgccggtctggtccccgaggatcagctctccccgaccaagatcatcccctctgcgcttgataagacggtcgcagatgtcgtggcaaaagctgtagctgagcgagcataaggagctcatcgcaaaacgcggtataaccaagggtggtgcgcatacacgtgccatcctttttgtataccgagcttgtatggggagttgatcacatcatgaaattgctcaatcagaccattatgacaaaactggggagcgccacactcatcggctacatcttggataactacgagcgggtcgacccaaaccgcagacgccccgcgattatcttctgcccgggcggtggcttcaaccatctctccgaccgtgaaggagaacccttagcggtccgcatgctcacccacggctttcaggccttcgtgttgaagtacagcctcaagccgaagtgcttccccgctgcgctgtctgaattagccgagagcgtgaagtgtctacgcgaccacgctgaggaactccacatcgccccggatgcgatcttcgccgcgggagcctccgccggcgcgcatgtcgcggcaagcctcggggtctatgcccacagccagctgatccgcgatctgggctatcaaccagaggacgttgaacccaacgggatgctcctcgcctatccggtgatcaccgccgggaagtttgcccacaccgagtcgatcaaggctctgttgggcgacaagtacaacgaccaggctgcccgcgatcaggtctcacttgagaggtatgccgacgaacacgtctgcccgaccttcatttggacgactgcaaccgacacctcagtcccaccggagaatgccttgctcttcgcagaggcactgcaggcgcaccactgtcgctaccaactgatcgtctatccggaaggcaaacacggctctgccctcggcaaccgtgaaaccgcaaagcctgacggcacctaccttgccagcgacattctggattggccggagcgcttcgcggactttgcccgcccgatcggccacaccttcaaaaattgtgagctgtagccagaaaaatatctctctgttagaccacgattgacctcgaccctgtccttccaccagtcccagcccctttgggactggtggaaggcaaggacttaagccaatcgtggtctaacagagagtttttcattccgacaaaggtgccaaatacacctcttaggcttgtctgctctatgagcccagaacaacgatgtgaggctcttctgcagccgttgtgacacctgccacgatagtgccgtagcgaagtctttctttgccactggcagattagcattctgagtgcaacagaatagcgccaggcaaaggtcatggcgcacctccgaaggctacgatgttggttgtctcaatcaacgtcgcaagtcaaagagtaatgcgccactacacacatcttagcgctgaggagcgcgacaggatagccgagctacacgccgagggcaaggcggtcagcgacatcggcagggacagctccgcgctcagctgtaagctgaaaaggaacggcaggcacacaaggtgcaaaccgcacaagaggctctcgaggcccagcgttggccgaggaggtgagggagcatggacgagcggtggttgcccgagcagatagacgaaaggctttgtcttgagcacggcggctcgtctatctagcgcgccgtcggctcaggcgagctcgatatccccgatgcgcccccacaggaccagctccgccaccatctgtgcgggaaggggaaacaaacgcacagggaacacaaggagaggaggggcaagatcaagctctcctgcggcatctcagagaggcccaagcaggcacacgagcgcttaaggctcggtgagtgggagaacgacacgctcgtcggcaagccgggagggccctgcctggtgataatcgcagattgctgagtcgcggctacttgacctgtgtcaatatttcgggtggcggattagcattctgagtgcaacaggatggcccgctgaatgcaagcgtggcacactccggaaggctacgatgttggttgtctcgtcaacgtcgaaagctggaaggaatgtgccactacaagtatcttaaaccctcaggagagggactgcatagccaagctgtgtggcacaagggaagctccatcggctatatcgcggcagagatcggcagggacagctccagcgtctgccacaagctcaagaggaacgcacggcacggacgctttagggcatgtgctgcccaaaaggagggcggatgagcgccgcaggagatgcagggcgaaaaggcggctttcagaccctgcgcttacgcagaaggtgcgcttgctcatcatggacagacgctggtccctggaggagatagactatatctcaggctcgagggtggcggcaggtgcgtcgttgagcctgccaactactctgcaggcaggtccatagccgccgccctcgacctgccgggatccggccccgaaggccaggtgcagcgccacctgcgcagcaagaggcctaagatcaggggtaagatcgagatcttacacaccgtaaaggagaggcccaagcaggccgatgcgagatctcgcctcggagagtgggcagacgacacgctcgtggcagcgggacccgtgtgcctgcttgtgcttgtcgacagggcagtgaggctccttctcgcagaagagatgccaccacgacagcgggagcgtctctaaggccgaagtcgggctgctgcagggacgtccccttaagacgctcacttcggatagagacaagcagctcgcagggcatacagggctcacagatgccctttgaggcgtgcagttctgcttctgcgacccccaccatctatggcagaagctaacagttaagaacaccaacgggctcctgcgcaagttcttcccctaagggcagcgactttgtaaaggtcacaaacgaggaggtgcagcatgcggtggagctgatctgcgacagggcgaggaaggtccttggatacaggacagccaacgaggtctttaggaagatgttgtactcagcttgacaatctgtcgcccgaaaggaggacacggcatgccgagtaaacaaaagcgatcatgcagatatcctggctgcccgaacctctgcgagggcagaaaacagtattgcgaacagcacgacaaattcatggaacaacactacgagaagttccagcgcggctactcccccagcaagcgttatggtaggatctggaaacgaatccgtgaccggtatgaccacaagcagccgctatgtgagatatgccttaaggaagaccgctatgtcgccgtggaggaagtccactacattgtgccgctctccgagggtggctcgaacggcgaatcgaatttgatgagcctatgtcgctcccgccacgagaagattcataaagaacgcagtgacagataaaaagagccgttccacaacggaacggcttagagttagagattcagcaggtcagaatgacttcctgtatccacaagcgttaaagtgcggatgtcattctctatcaaatagatcaaaagccagtccggctggatatgacattcccgaaagcctttgagatttcctttgagttcatggtcgcagaatctttcatccaacactttaccctgacgtaaagcgtcaactacctcttccagaagagaaaggttctctccacgtttcttcatcagcttatagcttttcttataagctgtggtgaacttgaccgtcagcatttactcttcgagcgctttcctgagatcgtccatgtttgtatatcccgacacgtcaggatcacgggaaatacgtctggcttcactcatggcatccaaaactttctgagagtactgcggaacctctacggtaaacggaagaccgcctcttaagatacactgccggagaaaaatgtttactgcgctggacatgtccatgccaagttcaccgaagagttcgttggcctgcttcttaacgtttgcgtctatacgaatctgagtaggaactgtagacatatacaatcatcttctttcatggatattctaatacattgggtttacattgtcaatcaaacataatggctgagtacctccagcatagttaggctccctgaactgtaagcggcttaggcaagatcgaaggcatcttcggctggaccgtcgcggtggctgcgatgccgaagagcggaacatggataaggcacatctcgtggggcagctccatgcagccatcccttacatccctgtggctgtatctttagctgagtgagtccgcaaggagtgcatgtgggccttgggaaggccatggaaggcgccctcaacgtaggccttgaagttggatatcaccctgtggaccatgggaagggatgcatccccgtccgctctgtcgtactttctttagacgagcccgcaaaacgaagagaggccggcagctttgccgctccagccatccgcccttatcttcgatgtatggcagagctggtcatgtcccacctggcgccaggaatctttcgagtaccccttttgtgcagcgcagggggcaggagccctgcctgccgctgttaagcatcggctgctgctttgtgccgcggcccgcttttgcctggtgccttggcgccgatatagaagtcgtccacctcgtgtgtgtcagctgcaaggacactgaacgcactgcgatctggcccaggcgagcgtatccttaaaaggacccgccctgccgtctttaagctgcagcctatctgccttctgcagggcgcaggcgctgatccttgccttctgggcggacatgagccatatcgcccacgaaccacttcctgagctcgaggtgggtcccctccatcaatagtccctgcgctcacgctcacctggtgcgagcacttcgtgcactgccacttgtgcgcgcggcctcagaccttcgagcaggacgtattggcgcacaccgggcagacaaagccgccggagaccttctcctcgagcagcctcccctcgcacgactcctcgtctgagaacctctccaaaaggcccatcaatgtctctttgctctcgcattcgcgcctgctcagagcgcctgcatgcccctttaccatctctttctttgccctctcggatgcatcaaccttgcatcctcattgtacggtttggaggcgacaggaactcctgcggttatgctggaggtcctcagttatttcaaacattttgaagtggggcggtcaaaatctctacggcctgctccggtggaaaacggcgcagggtcttctgtacgaaaaaagcgaaaacaaacgagccatctgcacaatgtgtgaaccgatatgtgagctttaggccctccccagcagcggtaccttcacccccgagcatatgagcatcaccatcgcgaagaggttgtcgaggctgcagaagctataggccatcctcacggtcagcttgatcttgttgttgacggcctccacgcgtgcgttggacaggccgctctccaaggtggcgacgatggcatccagatgccttctgatcttcttttagagctctacgaacttgggggatcctcgagcgccaggccctgcccctccacttcccgatgccctccctgatctcgttagcaggcagcttcagggcaagccttatcccttccctcagcagatatgccctgtggagctgcagctgcaagatcgcggtgagctgaagcgccgccttctgcctttcggtcaggctctctgggttcttgaaggagcgggtcccttgggcccttcacggatgttgcggccttcctttcgggggctcgcctcctctcccctcctggggcgggcgcgcctgcccttcggtgctgccttggccttctgcacagcctttctccataactggtggcgcagctcgtcgagcagctccgttgcccactggacgatgtggaaggtgtctgtgcagcgcatgcaccacccactccttcatcgcatcgtccacccaacgcgcgacgtccgcgctcacaaagtcgatgggttcccttcccttaacggcgatctgcttgaagaaggcgtcgaagaccttgcggctatgcccgtcatgtagctgtggcccttcttgtacgatgtctcatccacacctatccgcctaaggcctgccgtcgcgtggcggctgtccctgttcgagccttaccagcacgcgcgagcatatcgcgcccacccacctccacaagatgcgcagaagcttttgacaggcaagcttgctcatcgacagcacaagctagcagcagctgtccttaaaggcacgggttgtcagcttctgtggtctgcccagggcagcttccgcaccgcagtaccgcattttgggcatctcaccttgaatgcatccgcctgcatatacaccttcgtcccgacgacatcgggacatctccagtgcctggttcccctgcctgcatcgtagcagggggccttctgcccgcacttgccgcatctgcaagagtggggcctgtagggccttatcgcctgtgcgccctcgtcgaaagacacatcctttacgacgatattctcgacgctgatcataatcttggctaagcttgaaatgcgcacggtgcgctccttctgccgggtctttacttcacacctaaaacctacaggagaatgtgccatgccatctgcgcattcgcatattcttcattcacacatcgtgtcgaagagccaaaaagagacgcctttcgaccgcctgaagctcgtgctcggtgaagagagccttgcacatctccagaagtctacagtcatggtgctgagactcggcagcgtcggctcggactacacggaagcccttgcctgcagcggcattggacacctcatcctcatcgaccgggatactaccatcgaacatcagccgtcaggccattgtcttccattcgacggtcggccttcccaaatgtcaggtcatggagaagatggttctggctatcaatccaggctgcgatgtgacgacgcttcaggctttcatcccgaaagacagcctcggcgagatgctctcccagttcccccgtcctgactacatcgtcgatgcgatcgacatcgtcccacagaagctcgtgcttgccaaatggtgccggaagcagaggattccgctcttgagctccatgggtggcaccgacaagctggacccgagctgtctccagtttgcacggatcaagaagacttcaggcaaccgccttgccaaggctatgcgcaaagaatgccgaaagcgtggtatcgaggagctcgaggtactctactcgacagagaagggcgtggatctcaagcctccgaagacggaggatgggaagagacctgagaagggtcagactttgggcaccatgagctacataccgctgatcatggaccagatgattgccggcaaggtcatctatcggcttgccggattcgagcccatgccctacacagaagaggaagatccgcaatgctaggcccagagcagaacagcctgcaagcagcgaaatactacgacatgcacttctatatcgacttcctccaggaagatccagcaggcttcctcgatgcgtcagatacgcttggtctggccttcctttcctgcactgcggcacccaactcagagctggaaagaccggcagaatgcgactctgagccttggtgcgcatccctggtgggtggcagacagcagaatggacacaggcgcccttgatgagctcgtctcgcttgtgcccgatgctctcctcataggagagatcggcatcgatctctcgcccaagcatgtcaagctttcctcgaaagacagacagaggcattccagaccatcgtgaaagttgcagccgcttcaggcggcaaggtgctctccatccactcctgaagtcagtagatctcgtgttcgacatcctcaaagaaaccggctgcactcctgctgctgcgggctctattcctatcctgcactagttctcgggctcgacgcccgagctctggcgtaccattcatctcggctgcctcttcagcgtcggcaagccgttcctccatacccggccatgcaaaggaatacctaaagctcattccgcacgagaagctcctcttcgagactgactattctcccgagcatgcagggcttgtacccaaaggctacgagcgtgcccttgctgactctgcagccctcatagctgcatcctggaatgtctctgtgaataaagctgtcgagactcttgctgccgcgagcgaagccatcttccgccagaccagaggagaagcctgattacgccgtactggcagcccgtcacacgacgcaagccatacttccctacagcatcgattccatatccatatgcctaagcagcttacctttcgcctgcctgcgcattctcttccctgctgaggcgctatcatggaagtaaacgtctgcttatccatgcagcagctgtcttctgtgagcgtttccccaaggaggaggaaaaatggcaacaagaaagtcaagaagctccaagccacgcaacacatccatgaggtcgagatcttctcgctccatcgcaaagccgaaggctcagaaggaggcaggagagagcaaagcgaaagagcctgctgccgcaaagccggcagcaaaggctgtacctgctccgaaggccacagagcctgccaagaaggcacctgcagaggctgtaaaggtagaagcagctgcaaagcctgcagccggagcaaagaagactgagctaaagaagaagcctactacaaaggcagcagcttccaaggtggaggctccgaagcctgaggcaccgaaggctacagccactcccaaggtcgaaccgaagaagactgccgaagcagcaaagacccctgcaaaggcagaggctcctgtgaagactgagaagaagcttgagcctgcaactgcgaaggtagctcctgctgcgaaggctgcactgactgccaaagaggcgccgaaagagacaactcctgctgcaaagtccgaaccgaagcctgctgccaagaaggaggagccgaagcttacacctgccataaaggaagctccgaaagcagctgcccctgcagccaagcctgagccgaagccagcagcagaaaagaaggccgctcccgcgccggcaccgaaagaagagccgaaggcagctgcaaagcccaagcctgctacaaaggcagccacgcctgagcctgcagcaaagcccacagctgccaagagggaagagcacaccaagaagacggaggctctgaagcctgcagttgcgaaggtagaagaagccccggctgcaaagccggccgtgaagtcagctcctgccaatgcgtctgaggcagaaaggcttacaccgaaagctgtccccgaagcaaagaaggcagaggagcctaagaaggaagcagagcctgcaaagttcgagaaggcagcttccgagaaacccaccaaggtcgaagggaagcccaggacagccgctgaggcacctgctgctgagccggcacctgccacggcaaaggagattcccgcagagaagacggctgagcctgaggcagcaccggagcctgaacccgagccactcccccagccgaggcgctccatcgccttcatcggatccgagtgctatcccttcgtcaagaccggtggtctcggcgatgtcatgtatgcacttccaaaagctctcgtgaagcagaattgcgacgtaaaggtcatccttccgcgctatgcctgcatcaagcaggagtggcaggagaagatggtctacaagggcgccttccagatggatctctgctctgacggcaggcagttctatgtcggcatcatggaatacatctcccctgacggtgtagtctataacttcatcgacaatcaggacttcttcacaaacggcaacccgtacacgaacctcgtggatgacatcccgcgctactgctacttcggaaaggcagcgctctctgccctgctcttcctcaactggattcctgacatcatccactgccatgactggcaggcagcgcttgtcccggtctatctgcgcacgctcttccagagcacagagctcgcacgctcaaagaccgtactcacaatccacaacctgcgcttccagggcaagtacaacatcccgacgatcaagtactggtccggacttcccgactatgtcttcaacaaggatgccatgcaggaagactggaccgaggccaacatgctcaagggtggccttacctacgccgatatgatcacaacggtctccggcacctatgcagaagagatccagacgccggaatacggcgagggtctcgatgcccatctgcactaccactccggcaagcttcgcggcatcgtgaacggcatcgactacgacatctggaacccggcaacggacaagctcctcgaggctccctatgacaccaagaacgtgattgatgctaagaaggaaaataagaaggcgctccaggaagaactcggcctcgaacaggacgacggcaagatggtcatcggcctcatctcccgcctcacgagccagaagggcctcgacctcgtcacgaccgtcatggagcagctcatcgacggcaatacgcaggttgttgtcctcggcaccggcgagccccagtatgaggaatccttccgctggttcgagaatgcccacaagggcaccgtctgctcgagcatcatgtacgacgaggcacgttcgcaccacatctatgctggtgccgatgcgctcctcgtaccttcccgcttcgagccctgtggtctcacccagctcattgccatgcactatggcacgattcctgtcgtccgtgagaccggcggcctcaaggatacggttgagccgtacaacatgttcgaagactccggcaacggcttcacattcgaccgctatgagccgggcctgttgctcgaagcaatcaaccgcgccaagatgctctacttcacgagtcgcgagtcctgggacaagatggtcaagcgcgacatggagaagaatatctcctggagcaaatctgcatcccagtaccgcgacctctatctccaactgacacagtagtaggatctgcgctgattctaagcattgacatggacgggcactgcaaaggcgcccgcccatttttctgatgaatcgtcctctaaacaagaagtaggctggactctgcattcggcctgcttgcaagtctagctatgcctcgttgtcatggcgcctgcggcaaatccatgcccgtgtcagtagcagaagtactgccccacctgtggcaatcaatccgtcgaagccggaggcatcggaaagcggcattgcagccacagacgtacagtgataggttgtgctgctctcgccatagttgtcctggttgccaactttgtcgattgtcgctgtattgaagtgatcggttttcccagttacaggattcttgcggactactgggatagtggcgtctaccctaccgccagacgacagcgtgctcacatcgaactcaagagtgttgtcatcaatctgatatgagacataggattgactgctaatcttgatccccgatttaattccaagcgaatcagacgatacagtcatgacagatggatcatcgagcgacaaactatcaggcaggcaatcagtcacgtgcatgtctctcacattgggaagcgaagtgtcggtagctttgttctcaaaagtgaacgtgtaagtaagctacttgtttgcatcattgccaatctctgtaggatggtcctgcgtaccggaattgggatcacaggtcttggtgatatccaaatttgcagccagaagcgtaactctcctgttcgcgatctatgtcgtaatggcatcgctcgctgcaggagcgttacctacaaacatgcgcttgcttatagcggcctcatttgtttcgatcgtgtcagcataggtggaatcagccgtagccttcagccgaatataagcgacaagcgtccccttcttgtccaggacaaaatcatggccggtatctgttttgcggcaatcgatagctatagctttaacagcagagaggtcatcggagattttcgcggtccataagccactgtccaaagaccatgtctgacccgttggcgtctgcatcatgtagtaaatgactggtttgcatgtgtcggtcgtcttcgaactgttagcatcataagcgactttgccactggcggattagcattctgagtacaacagaatagctccaggcaaaggtcatgacgcacgtccgaaggctacgatgttggttgtctcaatcaacgtcgcaagtcagggagcaatgcgccactacacacatcttagcgcttaagagcgcgacaggatagccgagctacacgccgagggcaaggcggtcagcgacatcggcagggacagctccacgctcagccgtaagctcaaggggaacggcaggcacgcaaggtgcaaaccgcacaagaggctctcgagacccagcgttggccgaggaggtgagagagcacatcgcaaacgagcggtggtcgcccgagcagatagacaaaaggctttgtcttgagcacagcggctcgtctatctagcgcgccgtcgactcaggcgagctcgatatccccggtgcgccccacaggaccagctccgccgccatctgtgcgggaaggggaagtgcacgcacagggggcacaaggagaggaggggcaagatcaaggtctcctgcggcatctcagaaaggcccaagcaggcacacgagcgcttaaggctcggtgacggggcagacgacacgctcgtcggcaagccggaagggccctgcctggtgacaatcgcgaatcgctgagtcgcggctactcgtaggcggcaaggctcacgcgcacatgaggtcgaaatcacggctctgttaggccgtgaccgcaagaccaccacccctgagtgcggcaagcagatcgccacctgcgcggaggtgagcgacaggctcggcgatgtctagttctacttctgccatccccaccacctatggcagaagcccactgctaagaacaccgatgtcctcatctgcgagttcttcccctaagggcacggacttctccaagctcaccgatgatgaggtacagcgcgtattcggcatgatcaacgacaggctaaggaaggtccttggatacaggatggccagcgaggtctttagggagatgttgcactcagcttgacaatccgcccatcgatagatgagacatctacgctctctagggaaacgatgattaatttccaatgatgtgccagaaaggaccagtcacgtggcctttcgcggccaacataggcattaatcatcgtttccccaggctgccgacggtattgttctggtcagaactgaacatgtcatacagcacaatatcgtctgttcgggcacttgcatcggcagtgtattggaggcgatcggtatattcatcactcaggaaaactgtgccgctggactgatatgaagggtcattggccgttgcaactcattcaacaaaccctgcctgcagggctgtcacatttccaaagtcaataactgtctgatcggtagcggcttcatacttcttcggccagccatcctgcgccgtgctctcatagtacttccgatcatcaaagcccttttcggatctctcggtaagaccaccattgacatcgacccttgtcttccaccagtcccagagaggctggggcatgtcgacaagtgcgcctcgtgtgtacatagctgccttctgtgagctgtcctgagagcatcaccctgctgtcctgcttcgaatgcctcgcctgctttgtccacaggaagcaggcgaggcagtggtcgagccactttgtcgccaccccatagaagaaaagcaagaacttgcctgagctttcgctgcatcgcattgacaaggccgcttctcaccgtccctggacttcttcaccacgcttggcgtgtactcaacgacgccaagtaaggaaaggatgcacgcataccctgcatggttgtctgttgcgacccaagagctgtcggcgatgcctgaaagggcaacctttagcttcgactcggtgggccccctgaagtgttgcatattcgctctcccgactcgcgtagtgctctttgcaaaccttgagacttgatatgctgcttgagtgcacggtatggccgtggcctgtgtgctatcgcgcatctgcacatccgaccttgccctgctgcccacaagcgactcgtcgagggagagcccctctgcctgacagcagactgtgcctgggagacttcagggcagatcccactacctcaaagagcctcatgcgcatggaacccacgaggtccttaaggctcgcatggcagctcttcgtaagctggtttaagtgacatgcccacaagcgtgtcttttgcatactttgtccctgcggtagcgaaaagcttcgatatcgctgtgaccgatcccatcttcgccgagaaggtcctgccgcagaagcgacacttccctctgtgacggccttgtgcagagtgccccttacagaagaagtctgcagatgtgcaccttaagcatctcttgggtttacctgcgagagcagatcctgctatctccttagcgatgcccatcttctcgattcgctgcagtatcattgagtccggcccttccgtttctcaatgtttttgttggttcaatcctaaaagctgtgggcagatgcctgcggtatagcatctgtacagacagggaagcggccatcctctagaatcttgcatcgcaacatgtagactccgaagaaggatggagcgcgctgacaagtgtagcatccacggcagcccagctgtccgccatttcccatgccggtaggattgccgcccccggcttcctttcgatcccctcgcatctcgaaggatttgtgcagacaggggaaccatgcgggggcgtccgtacagaggagttcgggacgtcgaccaaaagatgcggcaagccggtgcgcatcctcacggtcccgggcaggcttgatgcgcaggaagctccatcatgcccctgctgcggaaaggcgatggagaaaaacgggaaggcccccattgcgcttcggcacctctccctggggatgggaagggcaaggatagaggtcttgcggccaagatgagcatgcagggagtgcgggagcaccctcacggaagaggtgcccttcagggccccaggccaccgaatcacactgccgccgctcgccttcgcgcaggacctccttgccctggggcagaccttcaaagcggtatcgctcacggcagggctccacaagaatatggtcaaggccatcgaccgggcaaggctttctgggctctacatggaaggagaaggcagcgaaaggacgctccggaagccggagcggcaggcccgctatctgggcgcagataagttcaagctgcacaatggccgccgctgcaccaccgtgatcatcgaccttaagacgggccatgtgctgtggcttatgcattccaagaggaagcaggtcgtatacgacttctgcgacttcgtgctcgctgagtggatgtttgcatgtggaggccatagcctgcgacatgaacgcagacttcgagtgtgcattccttaagcgccatccgtacctggacatcgtctacgagtacttccatctcgtgaagaacttcaacgagaaggtgatctgtaaggtcaggaaggacgagcaggcaagacttaaggaggagggcgacgtcgaggctgccagggccctcaagcattccaagtacatccttaagtccagtgcggacaccagggagaggaaggagcgcgatgcacgtgccggcaaggtcgtctccaggggaagcgcccttttcggcaagcaggaggttgtgcagaggggaggcgccaggaaggctacgaggagctcatatcccaaaacgagctgccctttgcctgcgacatcgtagatgagatgctcgccagggcctatgcctaccggcaggagaagcgcatgtgcgatgccatggagaggatagtcgaggtctgccgcggcaccggcgacaggcacttcgagtggttcgccaggctcgttgagagccacatggacggcatcgtggcccatgcacgccaccatatcagcagcggaaaggtcgaaggcaccaaccagatgatcaagacgctcaggagggcaggctagggataccccgacgacgaatacttcttcctcaagatattcgattgccagcaggcgctattcgaaggcttccagggctggtgcgtgatggggccacacacaggtttcaggactgagcctagaatattttaatttggtgtgaaaacaggatatctgagctgcccttttgttgataacaaattaaatcgctacaataagagcgtacacgatatgttgtgtaatgaggaggatatggcccgtccgacaccacataaacgtcagactccacacccacgggtgcagacgcagactcgcaacactcagcgcccgcgggtacacaccataactcattcctcaaccagacacacaaccagcaggcaaagaagctccgaacaggaggttccgcgtacatggaaacagagtatctcggcatatcaactcgctccctctgaggccaggcgtcacgcagccagtaagcgcaggccggttaacgctacctacacggtgcgcagacctagatccgatcaacgcgtttcccaccaacggccgagacctgtgccgcgatcatctactgctacgcgacgaccatatacaagaacctatcagagccagacgcgacgacatccggtgcagagaccgattcgccccaacaataccctctttatcgttgtcgcaatcctcattgtcggtatcgcactgatcattaacatcggtgctcactcagcacagcccgaagcgcaagaacaggtccaaagcgatgaccaagatgaaatgacggatatgtcgggcgtcaagcaaggtagtggtgacaactcctttccaatcaccgacgatgtgagcttcgcagtcgacagccgcgacgtatactccaatccctatgactggagaaacctcgagtggaacaaatacaataatctcgcctatgagaaagacggcaagaccctatcccgagagggcatcgatgtctcgcagcacaacggcgagatcgactggaatgctgtcaaaaaggaaggaatcgacttcgcgatggtccgtgtaggtgcacgcgccaaagatgcagatgtgatcatcgaagactctgtcttagagcggaatttggaaggcgcaaaacgaaataatatcgccgtcggagcctatttctattcacaggcaaccaacgccgatgaagcgcgaaatgaggccgagtttgtgctcagcaagttatcgggtgaggaacttgattacccaatagtcttcgactttgagccggaaaaaggagacagagcctacaccctttcaaccgagcaacgcaccgatatcgcaaaggcgttctgctcgaccatcaagggtgccgggtacaactcggcaatctacagcagttcctctgacttaacctgtctctacaatcttgatgagctggcaccctatggtttctggttggcagagtataattacaagcctaccgccgacatcgccttcgccgtgtggcagtacaccaaccaaggcacacttaagggcatcgacggagcagtcgacctcaacattgatttaactcctgctttacaggcaggtaaaggagataattcatgagcgaaatgatggatctgtacctaaaggacgggattaaagccggcaaggtgattgaacgccacgatattcgtccactcggctgctatatcctctatgtcttagccatcctcgagaaccaggatggtcgttttctgatcaccaaacgtgcagagggcaagcagtgggccgcaggtcagtgggaaatccctggtggtggtgtcagagccggagaaggctcagagcaggcactgcgccgcgaagtctttgaagagacctcgctcacgctcgatcgcaaccagtcactcaccccggtctatcactacctcaatactgatgaggaacaccacgacaactaccaggtggacatctaccacctgcgtctgagtctcaatctctccgatatcaaaatcgcccaccgtgaggcaaccgatgtacggcttgccacgaaagaagagatcagccggctcaatgcacaggggcaattccttcactatcagcgcatccaggaagccttgcagcacgagcaggagagcaaataagtctcagcgtcctctacgatgatatgaaaaggagactgcctgtcattccggtatacgaagatggcaggtagcactcatcaaggtattagataagcaatcagtccatatcagtagcatattcgccattcatgtagtcagcaatttctgccgaatcattacacttagtaacgaatgcctgaaaatggctgagtacctccagcatagttaggctccctgaactgtaagcggcttaaggcaagatcgaaggcatcttcggctggaccgtcgcggtggctgcgatgccggagagcaagacatggatgaggcacatctcgtgcagcagctccatgcagccatcccttacatccctgtggctgtatctttagctgaacgagtccgcaaggagtgcatgtgggccttgggaaggccatggaaggcgccctcaacgtaggccttgaagttggatatcaccctgtggaccatgggaagggatgcatccccgtccgctctgtcgtactttctcgtccttcccggcaactcgagcagaaggaa

SEQ ID NO: 289 - DNA, 3885 bp, Unknown
  Metagenome-assembled genome
ctccgcttcgcctagctgttcttaacgccacctacgtgagctggcgcgtggcgcgagggagaccttcatcgtggcgatcgacgtcggcgatgacgatcagcgccactcgtgggattcacgtgtgcgaatagctacgcctcctggcgcgggttcctgcaggagcgcggggtgcacaacgtgcgcctggtcacctcagacgccctgggcgggcggcgccgccaaggtctttgaggtctactcgcaggcggcctggcagcgcggcctcgcgtacatcaagtgcgacgtgcgcgccaggatcgactccggggagggcctctgacggcgcgccctctaccaccgcgccgtcgacgagctaagggaggacgccccgtcggcggccagggtggtcaaagacaccgagctcgataccctcgcgtatctgtccttctccaggcagcagcgcctgaagatctgcaccaacaacgtgatgcagcgcatgaacggcaagctcaagcgcaggggccgggccgtacaggtgttcccgtcgacggggtcgatcatgcggctgctcgccggcattatcggcaagctcaacgccgagtgggagtgcgggaggctgttcatgtcgaaagagtccttagagcccgttttctcccttaagagggcaaagatgcgcatcaaggagctggaggagggcgaggaggcgcactccgatgcgagggtgatcatgaagttgacgattgataagtacgagagagcggtataaagttacgccaacgcaggaggctgccgatatcgagactggcgcggccctactcttacaccacaaaactcgacacaatcgtatcaactgtgacttcaattgtgatgaaacgtgaaaaatttttaaatttgagtagaaatttttgaaaatcgcaagatttttgaaccagattcaattatagtattcaatcgataacggaaacgatgatgcatggtgttcaagtgcatccagtctagttataaggagaggacgatactacatgcaatcaaagattgcccatgcagctgagcgtaaagctttcggcttcgctctggatcgtgctattaacggtgtaagaaacggagatcatcctgaggaggcactcgagaagttccttgatatgggtgtgaagcttctttctgacaccgcacctgacatggctctgtcactccgtaatgcattttaccctggctccaagtgggagaccttcctgctcaacctcgtcaacagagttgaccccaatattctgaagactgcgaccttgaacggtgcctatgaggcagcatttcgtggccttcgtgagactactcagtccgctgagaggtatcagtgcaacgtgccttggatcatcatcttcgacccgacgagcgcatgcaacatgcactgcatcggttgctgggccgccgactactccaagtccctgaatctgagcttcgacgatatggacagtatcgtcagccaggcaaagaatctcggttgccactccttcatgatgaccggcggtgagccgatggttcgttggaaggacattgcaaagctggctgagaagcacaatgactgtctcttcagcctctttaccaacggcaccttggtcaaccagaaggtctgcgacgactgcaagcgactcggcaacatcgtgttctccatctcccttgagggctttaaggacgcaaacgatggccgtcgtggcgagggctgcttcgataaggttatggctgctatggaccttatgcgtgataatggcctcgcatttggcacctcaactgcctatacccgcaacaatgtcgagtccgtcacctctgatgagtactacgatctgattatcaagaagggcgctctgtgggcttggtacttccactatatgcccgtcggtgaaggcgcaaacgctgacctgatgccaaccgttgagcagcgtcagtacatgatcaagcgcatccgtaaggtccgtgactatgagggtggtaagccgatcatgacgatggacttccagaatgatggcgagtttgtcggtgggtgcatcgctggtggccgtgtcttctgccacatcaccgctcgtggcgatgtcgagccatgcgtcttcatccactatgcaaacgccaacatccatgacaaacccctgatcgagtgcctgcagcagcctatgttccaagcttaccgtgctcactggccgtggaatgataacatgctccgtccgtgcccgatgcttgaaaatcctgagatcttacctgaaatggttcacgaggctcatgcagagtccactgagtatgtcacacctgagaatgttgaccacctctgcgctcgtacttccaggtacgcgaaagagtgggctcctgtcgctgacaagatctggaaagaggagcatccaaccggaaagaagatctacgaggataatatctcgatgatgccggttgaccagaaggctgagatgctaaagaagaaggataaggagctcgacgaggagatcgaggatgagatggacgtaaaggagcttgccactaaataagtaggtagttctctctaaccacgatcctttgtgagattacctcgctgactgctgaattgtagttggcgaggtttcctcttaccttgattcttaggtccaatttttagggctcttcggtagttaatgtgagcgccgatccagcaaagcgtcagctagggaaacgatgattaattcggctcgatgaggtcgctggggccgcacgctgtatgccgccggcttaaaatgtctcgaaccacacagtgcccatacccacataaatgcctatctgcctgcggatatgttataattacagcaacgtattccagcatatccaaaaggaagatatgggcagccagatgagctttggggaccttaaatcctaaggtcagaggaagaagacccagcgagaggcattcctggagcgaatgaacgcgatcgttgtgtgggatagctggaaatggctgacgactttaagcataagcccaacacttcctgtcggtttcgagctgcatactatgggtgaagggttgatgcattcaaaagatcgggaaaagacatggctaaggggcatgcaggcgcacttaagcatgaaggaatgtgagagtaaagggaccttgatggagcttctggagaggttctcagacgagtaagtcctgcgagtaaaggcttatcgaggagatgttcccgcaagggttcgtatgccttatctgcggccccacgagctgctcacaccagctcagcgtgagcgcaggaacgatgatggagggtacccatcttgccctgagggagtggttcgtcgcgatgtggttcatgtccagccagaaaggcagggatcagcgccaggcaggatacagctacaagacggccgggtacgtgccgcgatgcctgcagcggatggtatgaggcacatccctgtggagggaatcggacacaagcagcaaagaagcccgggctgtatcgtgagccggaacgagtcggcatatacgacttgtataggggccttcggagctggtggaacgcccttcgacatatgccttgatattcggatgagcctgtgggccccggaagcgaggtgtctcgtctggctgtgtactttttctggtatggcccggcagaagcaatccagcccggcaggatatctcgcttccatgcatcggcacagatcttgacctctattaccagtgtcggttccgcctgttacccaggaatccacgcgcgccagagcggcaaagcctgtcccagcgcttaacactaggcctgctgctttgtgccgcatccctctgccgttgatctgcttcatgtataagatcgtcgactgctgccgcatattcaggcataaaggactctgtaggcacttcaatcgtgctatggcgcatgaaggatccttaccagcacgtgtccg

SEQ ID NO: 290 - DNA, 4726 bp, Unknown
  Metagenome-assembled genome
cctcgtccatgctcagcaggacatcattggcagcattcacgacggcatcgtcgtatttcgccttcaccttagccccgtagcaccattcgttctcttctatcgttgcttccttgaggctcgagaacctctcttatgtacctatctcccttcctttcttcaacgccccaaacgtgcgctcggcacacttacgcgcctcatgctgtgcctgttcgcgctcttcgaacatcgctatctgttcctcaagcgcttccttttcatccataccattctcgtcgaggagctctcccatgcgcacaagcggcatcccgcaggcccgccaaagcaggatctcctgcaggcgctcggcatcctcctccgtatagatgcggtagccattctctgctcgcttcggcatgagaagccaccactcatcgtagagccgaagggtacgcacgctcacgccagcaagcgtgctcatctcctagggaaacgatgatcaatgccccataacgtgtcagaggggaccgaccacacgacttttcgcggccggtatgtgggaaaggcagggaaggatgctcatccagcacgtgcagaagccgccatccttacatccgtcctgccccatgcaccgcaagaaggctccaagacagatcaagcgacgctgggagccgggaggtgcagcctgccggcagagatacacatggcaaggtttgcaaggacgaggcagacatcgagtgtgcaggcatcttctctatcctcctgtagcgcttccttaaggggccgaagcgccgcttcacgataaagaagggtgcttctgcctttgagcgaacggatgccttcctggattcgatgcctttctcggacaagagtgcacaggcaaggccctctctagtcgaaggctttcttagcaacgctttagcgcatagatgagaggtgtgggtctttatgcgtccttaagggcgcttcgctataccggtataaccggagtctgcatagcagaacctgtcatcttcccttacgagtgcatgtgccacaggatatgtcagacacattctaagtgcttgtctccacaccatgcacaaggccgctaccagcgtctacaccaatatgcgccttgtatccgatacgccaggctccccctttcttggactggtgcgctttaagggttacgcgtacggtcttggctcttcgtgaagcttaagggctcaggtgaaggtcgcatccaccatggagccgccccgcgccgtgatccctgccctcttcaagttctaagttcaggtcgtgaagcacaactttgccgagtccctctcgctttaagggtatggcgcatcttcgcgcttatcgttgcgtccggtacctgctcagacatgaggtctatgtgcacagaagcgctgccaggagtgacaatccaggatagcatccttaagttccctcgtcttaagagagcaaacataacctaaagcaggatacatcctaaagctttgtctttgcagcgcgcacatgcctgacaagagcctgtcagtggtagctggtatctaccagtgcaatccagctgtgccacacaacgattgtatccatttgctccaggaatgcctctcgccgggtctttctcctctggccctgggatttaaggttacagtttcgctctcacggaatagcatactctgctttagtatgatcaggaacttatcggatcaaatcatagcaatcatatcatgcatagcgacatgatatgatgcgttttcgatacgatagtgatgcgattctgatgtgatttatgaatatacaggatgattcgtacgtccactcccctaagccattatgttgtaattgtatccatacgaaagcgtcccactgctcccctcttcaggaaacaacggaacgctcattccaacgcattaccttgtcgcatcgttctgcaggttgatcaaatctctatttctcaagctctcggcgcccaagctccagggagccgaggatgccttggtctccgccacagccagcaggcacgatgtagttgtcgatatcgtccaactcaggggttaccaggtagccgccgagcagcttcaaggtcttctgacggacctgcgggaacatctgctcctgtttcatcacaccgccgccgagtacgatcttctgcggtgagtagcacaggatataggttgcaacgccctgcgcgatgtaagagctctcgatatcccacaccttatcgttgccagcgagctcataccccttcttgccccagcgcttctcgattgcagggcctgccgccatgccttccaaacagcagtcatggtagggacagttgcacttgaagtcatcgcctggaacacgctcaacatggatgtgtccagcctcagcatggagcataccgtggagaaggttgccttcgatcatcacgccggcaccgatgccagttccgatcgtaacgtaaatgacattcgagaggcccttcgcggcaccgaagaccgcctcacctaagcaggcaacattgacgtcggtgtcatagcccaccgggacattcagctcacgtaggaacggcccacgcagatcgcagttgatccaagccgtcttaggagtgatgaggatgtggccgaaccggggatcctttgggtttaccgcagtcggtccaaaggcgccaatacccagtgcatcgatattgcgcaaacggaaccactctaccatcttcggaatacactcctttggctcagtggtaggaatctcttcgcgctcagaaatattgcttttctcgtcgccgatggccatgaccatctttgtaccaccggcttcaatagcacctatcttcgccatttgagcgtccctccttacttgggatagttatgggtgaaacagcttcgccagccttttgccggcggagccctttaaatggccttgttttacgccctgtctctgccacacgtcacctatgcatatgtgtagcacctcgttcttgctgccaaaacgaggtactgctttgacctatcatttcgctaattctatacaaagattattatcttttttaacagttctgtataggctcctaacgatgagcgtgatatagcgctaagcccacaagtatttcggctcagacctaaaacttgtgtgtagccccatcacgcaccagccccggctgccttcgggtagcacctgctggtaatcgaatatcttgaggaagaagtagccgtcgttagggtatccctagcctgccctcctgagcgtcttgatcatgcagttggtgccttctgagctgtaatcttttagtggacagtgggattcagggactaacaacagatatgctctgtccagatacccacctaccaacaccagcagattgaagagatgagatgtcgctaagcgcaagcgagatagagaaggcaaagtcccgcacgaagccggaaacacccaaacactacactgaagaagtattgccttgaggctatcgactactacaggaaggcacgtaaggccaacccgaagaagagcatcagaggatgcgccgcgaagcttaaggatcaacgacaagaccttaaacgactggatcatcaagcactcaaagaccaaaagggtgacccaggcaaggaccgacgagcacaagcagctcgacagggccaacaggcgcatacacgagctcgagagcgaaaatgagttcctaaaaagtggcagccttcttcgccggaagcctctgttgaaggacaggttttagctcatgctggagaagagggcaacctacagcgtctcgatgatggcgcgcgtactggaggtgagcagggctcacttctacagatggctcaaggccaaaggcggtgaggacctatggggtcccctcaaggaagccatctgcgcgatatgggaggaaagcgacaggcgctttagctttcgcaaggtctgatccaagctcacaggagatccgaagttacgcaaaatttacaggcacgacccgctaccgcgtgcgcaggtgcatggctaagcttgggcatctgcggcatctgatccaatgcctccaagagaacgacgctgcccgcacctgatacccccgagcgccccgacctcacccggcgcggcttttcgtgtcccgttccgacagccaagctcgtgggcgatacaacctatcttaagaccacggcaggtttcatatatctcgccgtcgcacacgatctgtgcacacacatggtggtgggctgaagcatacaggacaacatgagggcaggccttgtcgtctttgccctgaagatggcatattcgcgcggatacgtggctggaggggccatattctaagcagcccaggcagccagtacataagctcaaagctggccgcctgctcagccgtacccgacgtgaggctctccgtggggagaaccggaagctgccacgacaatgcggtcgccaaatccttcttcgccacgctcaagaacgaatggtactaccataagcgcctcttcgatgtatccacgaccaagcacaaggcacacgagtttaatcgagtcgtactacaaccgcttccgcccgcataagtccataggagatcgcgtgccggcagaggtgatgcaggagttcttcgagcgcttcgagagaggccttgcatacgatcctgaggcgatgcagaccgcatagaaaatctgagattcctctgtccattatattgacagggctcattccaccttccccgaggatatctggtgcctggcgtgcacgacgatccctcccctgtgcccttcgacgaggcaggcgaaccactcgaagtgcctgt

SEQ ID NO: 291 - DNA, 23960 bp, Unknown
  Metagenome-assembled genome
aagctcgccgctggcacctctatgatggcagacaccgcgcaatcgtagatgaggcgtatgccggggaatatcgtagggctctccgacccgcactctctcaatcggcggacaccatctgcgctggcaagacccggtcaatacccaccgattccgacctttgcccccgagcattgcccgcataacgcaggtggataccttaaacgcaacagttcgtcaagggtatgtccgagctctcacaggaaggccgctaatcgatcttccacgggtgcgcaggcgcttggagtctgatcgtcgggtgctgtcggcgtcctcagtttcgactcctcgaacacaggttcagagtgagaccatttcgaagtgcgccgctcacccctcccctacaccctgatcgcctggatccagacagccccgagaagctcgataccaagaccttgaacccacccgtacgaccgcccttgttccttgatatgcagggcagcaatctgctgctctcacgatgagtgaaacctcaacctgggtcgtcgagaaacaacccgagctcgctctccgatttcggcaacatcacctcacctcctgatagacagaagtaccacaccgcaactaaaccggcgtcccttaggctctgagacacctggcttcatcgtgaacgtatatcgttgagtgatatcgtttcagcccatatcctctgttttgcccgcatccaggatccaggagtagcctgactcagaagcgcttgcggtaggtcagagcatccatcacaatcgccagcgttgtcgccgctgacatcattagcagcaccacgatctggtacttagcctcatcaccgacgatccaccagatctccgctcatcatgcccggatctgtacgatacccgccgcggactccccgcgatcgtcggcataatgcctcgcccacagcggagcgaatagagggcatcgcggcctcctgcggtcgcccccaacgccaaagcgcaaaaatctcgtcggagcttgattccaggtccgcgaacaatctgctgatcgcaaggcggactgcggagagccgttttccccattgccatccccctatatcgggatcagctgccgagctgtaccagggtcgcgtggagatgccttcgacaacgatcaaggcgataacgactgaggagcagggtttatggattcaacacgtcttgccacacccatcgaggtgcagcttgatacggtcacaggcgatgcgcgcggcaaagaggctcatgcagaacatcaccaatagaacaccaccaactctgggtactgggaagatgttagatgatgatgaatcgccagcgcacagctgtaaaagacccgcactgtcgcgatcgcaatgccttttcctgacctgcttcctccaccaggcagacatagcggccacgacctgaaacccccgccaaaataagctccaaatatccgaatatcgatcacccggcttgctgctagcacagatcctccacgcatatccctttgtgtggcctatcttcaccttatgcatctccggaataggtcaactttccgcctctatgatgggtgcctttggccagcccatcattggggcgatggcggatacgcagcgcacaagccttgtttccacaaagcgcaagatctgttccctactggcgtgcggactcaatcgtcagcgacgcatccacccgtcgagcagcatacttgcggcttcgttacaaggacacctcaaaagtgccacacgggcagcctgcccgccggagactgcgcggcattgcgcgaaagtcccacccatcactttgcatcctcgaggcactgctctaagaatcatcccttcggacgtggggcgctctcatcacgccggtaagcgtccaaggtagcagcagattgtcccgtacggttccgggtatgagcgtcgcctctgcgcaccagagcgactctttgccgccactccgtcggctcaaaggtagaagtcctgacctccatgatcatcgttgcccccgcagggcagcagcgggcacaggcgcaaaagcgtgtcttacgagcctacctgagggccccggtcacggtcatagatgcaccctgctcgagcgccagtggagacatcattcacaggcacaccgaagactgttgggaagctctgctcggccttcgatacatctcaatcccttgatgtggcccatctgattgggggctcaggagatcgctgtaagataccgtaacgtcacaaagctcaaagagtgccataccacttcttcgctaaaaacaacctgtagaaaagcaatagtgagactctgaaatcatgtattctcgcctcacaaatcacgccaaatgcccgcccccatacaggctcatttggtacagcagtcagtgcttgatcagtcgtatagatcagtctcttaaacaaggactataggatcttacccgctcgcttaggtttcttctcctttgggaaaccggcttggcggtttccaaaaggacgatcgtacggatgtcttgccttcggaaacatgcagcaacttcgcgagctttgcgctcatatcacctgaagcgaaccatgccgcatcccagaccccgcctagccacaggcggtgatcgcgagcatgaggtttccattcgcagcgccgtagtccaccatctcaaagttcagcagccatgatcattaggctcactggctacgaccaggataaccggcgcgtctggtggctggagtcggcagaagctcagcaatctgttgcctgacttgtgcatcccggacggcgatgaacgagacggttttgaccgttatatccggaaggtgccctgacactggcatcaagaatagccttgagaatcccatccggtacctcgacaggaagaatcattcgcggtaaactcccacgctgttttacaacatcaaagaaatccatatgggcatggactcctttatcacgcatacaaacaaagcaataccctaagcaaaccacctcgacgcagagtgattggcttacttcacactccccagaatcgggcgattcctgctgcacggctgtactctttattggttccgacatcacggcgctcagcaatctgttgcacacgcatagagggcgttgcccatcacgtgggtgcccacatagcgaatcagcgcgtaatcgttcatagattctccgaaggcgtacgacttcgtcacgctcgatagccgtagtactggcatcagctgagctaacccagtcgccttgtttatgcccgggcaacgtatcgatccaggatcgcggaaggcaagacaaactcatccgcgagctcccgctcgagactaggtcatatccatgcaatccttgggacggtcacagcacactgcggctttgatgatgctgacatccggggcggtggatcatcgactcgctgggcggttcggcaaatccttatcaagttcgcgcacaagtgtgggacacggtcatccaggatatagtatgcgcatcgtcatataaaaccatagcgacaatcaaattgctcacgtcctggtagtaagttttctgaatacctaggtacgaaaaatcttcccgatccaaagctttccatctgctaacttgacagccccagcgaggcgacaatccatctgtgtccgctacggtttgaagaaccaacgcagcgtgtcatagcggcgaccactcttttcgaacaatctcagaggaatcgttggcagagcacacttagcgcgaccgatatggacggtacgcttctctataaccgcgcagtaccgccgggaagacatatggattagtagaagcgcttcgagagaagggcatcatatttgtggcaagtagtggtcgccgctatgacacgctgcgttggttcttcaaacccgtagcggacaagatggatttcgtagcctcgctgggctgtcaagtctacgcagatggaaagcttttggatcgggaagatttttcgtacctaggtattcagaaactctaccaaacgtgtgagcaatttgattgcctgcatatggttttatatgacgatgcgcatacctatatcctggatgacctgtcccactatgtgcgcgaacttgataaggatttgccgaacgcccagcgagtcgatgatccacctgccccggatgtcagcatcatcaaagccgcagtgtgctgtgaccgtcccaaggattgcatggatatgacctacgtcctcgagcgggagctcggcgatgagtttgtctttatgccttccggcgatacctggatcgatacgttgccccgcggcataaacaaggcgactggattagctcagctgatgcagtactacggtatcgaacgtgacgaagtcgtagccttcggagactctatgaacgattacgcgatgcttcgctatgttgggcacccactggtgatgggcaacgccctctatgcggtgcaacagattgctgagcgcgtgatcggaaccaataaagagtacgccgtgcagcaggaaatacgcaagattctggggagtgtgaagtaagccaatcaccttctgcgtcgagcgtggtttgcttagggtattgctttgtttgtatgcgtgataaaggagtcaatgccatatggatttctttgatgttgtaaaacagcgtgggagttaccgcgatgaatttcttcctgtcgaggtaccggatgaggatctcaaggctattcttgatgcaggtgtcagggcaccttccggatataacggtcaaaccgtctcgttcatcgccgtccgggatgcaaagctcaggcaacagattgctgagcttctgccgactccagccaccaagactgcgccggttatcctggtcgtagccagtgagcctaatgatcatggctgcatgaactttgagatggtggactacggcgctgcgactgagaacctcatgctcgcgatcaccgcctgtggctatgccggggtctggatggacggcatggttcgttcaggtgatatgagcgcaaagctcgcgaagttgctgcatgtttccgaaggcaagacgatccgtacgatcgtcccttttggaaaacctgccaagccggtttcccaaaaggagaagaagcctttaagcgagcgggtaaagatcctatagtccttgtttacagagacctgatctatacgcctgatcaagcctgactgctgtaccaaatgagcctgatagcgggccatttggcgctgatttgtgaggcgagaatacatgattcagagtctcactattgctgtttctacaggtctgttttatgcgaagaagctggtatggcactctttgagctttgtgacgttacggtatcttacagcgatctcctgagcccccaatcagatgggcccacatcaaggggtgaggatgtatcgaaggcagacagagcttcccaacagtcttcggtgccgcccgtgaatgatgtctcactggcgctcgacgcagggtgcatctatgacttgacggggccctcaggctccggtaagaccacgcttttgcgcgcctgtgcccgcctgctgcccctgcagggcggcacgatgctcctggacggtcaggactttcgtacctttgagccgacggagtggcggcaaagagtcgctctggtgccgcagaaggcgacgctcatacccggaaccgtacgggacaatctgctgctaccttggacgcttacagtgcgtgagagcgccccacgtccgaaggatgattacttagagcagtgcctcgaggatgcaaaacttgaggtgggactttcgcgcaatgccgcgcagctctccggcgggcaggctgcccgtgtggcacttttgagggtccttgtaacgaagccgcaagtactgctgctcgacgaggtggatgcgtcgctcgacgatgagtccgcacgcgcagtagggaacatgatcgtgcgctttgtaggaaacaaggcctgtgcgctgcgtatccgccatcgccccaatgatgggctggccaaaggcacccatcacttagaagcgggaaagttgacctattcggagaatgcataaggtgacgatttaggcaccacaaagggatatgcgtgagaggatctgtgctatgcagcaagcaggcgtgatcgatatcggatatttggagcttattttggcggcgggtttcatgctcgtggccgcctatgtctcctggcggatgaagctaggtcaggaaaagagcattgcgatcgcgacagtgcgggtctttttacagctgctcgcgatgggcttcatcctcatctacatcttccagtaccagagttggtggctcgttctattggtgatgttctgcatgagcctctttgccgcgcgcatcgcctgtgaccgtatcaagctgcacctcgatgggttgtggatcgacgtgtatgcctccatcaccctctcctcagtcgttatcgctttgatcgttgtcgaaggcatcatccacgcgacaccctggtacagcgcccggcagctgatcccgattacggggatggcaatggggaacacgctctccgcagtcgcccttgcgatcagcagattgttcgcggacctggactcacgctccgacgagatctttgcgcttgtggcgttgggggcgaccccgcaggaggccgcgatgccctctattcgctccgctgtgggcgcaggcattatgccgacgatcgcggggatgtccgcggcgggtatcgtacagatcccgggcatgatgagcgggcagatcctggctggcgccgatccggtgactgcggctaagtaccagatcgtggtgctgctcatgatgtcagcggcgacaacgctggcgattgtgatggcatgcttcttgacctaccgcaagcgcttctctgagtcaggctactacctggatcctggcatgcgggcaaaacagagctgatatgggctgaaacgatatcactcaacgatatacgttcacgatgaagccaggcgtctcagagcctcagggacgcctggtttagttgatcggtgtggtacttactgttctatcaggaggtgatgttgccgaactcggagagcttgagcttcgggttgttctcgaccgcccagttgaggttccactcactcgtgaagagcagcagatgcttgccctgcatatcaaggacacgggcggtgtcacgggtgaggttcaaggtcttggtatcgagcttctcggggctgttctggatccagcggatcagggtgtaggggaggggtgagcggcgcacttcgacatggtactcactctgtaacctgtgttcgaggacgtcgaactgcaggacgccgacagcaccgacgatcacggactccaagccgctgccctcctcgtgaaagatctggatagcgccttcctgtgagagctcggacatacccttgacgaactgcttgcgctttaaggtatccacctgcgtgatgcgggcaaagtgctcgggggcaaaggtcggaatcggtgggtatttgaccggggtcttgccagcgcagatcgtgtcgccgatcgagaagatgcccgggtcgaagagccctacgatatccccggcatacgcctcatctacgattgcgcggtcgtctgccatcatcgaggtgccagcggcgagcttcatatgcttgtcgccctgcacgtggtaggcgctcataccgcgctcaaacttgccggagcatacgcgcagaaacgcgatgcggtcccggtggtgggggtccatattggcttggatcttgaagacgaagccactgaaggggttcctgaccggatcgaccggctttttggtgagggtgtcggtgtagaagaggggctccggggccagacgcaggaaatcctgcaggaagggttcgacgccgaagttggtgagggcggagccaaagaagaccggggtgacctcgccggtacggaaggactcgaagtcgaagtcgttgcccgcgccgtccagaagctcgatatcctcctgcagcttctcgtgctcctcatggccgataatctcgccgagcttggggtcaccgagctcaacctctacctctctgaccttcttggtggcattggcggtctcagtcctctcaaagagcaggacgtggtgggaattgcggtcgtagacgcccttgaagcccttgccgctcccgatcggccacgttaccggatacgtcgcgatccctaatacgttctcgatctcctccatcagctcgaaggggtcacggatatcgtggtcgagcttgttgacgaaggtgaagatcgggatgtgcctgagcgtgcagaccttgaagagcttgatggtctgtgcctcaacgccgcgggcgccgtcgatcaccatgactgccgagtccgccgccataagcgttctgtatgtgtcctcggagaagtcctggtggcccggggtgtccagaatattgatgcacttgccctggtaggtgaactgcaggaccgaggaggtgacggagatgccgcgctccttctcgatatccatccagtctgacacggcatgcttggcagagctcttccctttgacggagcccgcagtttgaattgagccggtatagagcaagagtttttcggtcagggtcgtctttccggcatccggatgcgagatgattgcgaaagtacgacgccgggaaatctgatccgacagatatgacatggaattcctttgcgtgtatagatgggggagtatccctgctcttagttgtatgaacttatctattgtagcggggttgcttggcgttgtgaaacaggtgcacgggatgcaaaaaagcgctagaaaccgagcagtaagaggactgcgacgtaggcagtgctggcagcgagagcgccccaatcgcctgcatgcatcttaagggggtgccagtggctgcgcccagctcctccctcataggagtgggcgtcgagggcgcgccccacgttgtgggcgtgacgcacacagcttgcgagcagcgcgatcgtgaccgggccgatcgcctgaaggcgtttggtgggggagttggagtcccaaccaccgccacgtgcggtctgcgcgtcgacgattgcggaggcttcgtcggcgattgtcgggataaaccgcagcatcagtgagaacaccatcgccaactcatgccccggaagcccgatagaggaaagtggggagagcagtgcgtcgaaggcatcggtgagctgggttggagtggtagtgagaagcagcagggcccccatcaggattgcgatcgagaagcgcagcgggtagcagatggcgtcccagaccccgaggttcgtgatgcgcaggatgccccactggatgagcggggtgccaccctgcacaaagaaaaggttgaagatagagagggcgcacaggatcaccacgagcggtttgattgactgcatcactttatgcggtgggatgtggctgattcgtacgatcataaaggcgcaggctaagccatagatcaactgcaacggggtgtgaataaagaagacggtgatcatccagacgagggcgacgccgatctttgcgcggggatccatcctgtggaggggagaggtagccggatagtactggccgatcgaaatacgcagcgccatctctctctcatctcctttccgaggatctagtgcaaagctgtcgcaagcgcctcgagcgtgagtggggcgccgagaaacgtatcgagggaagtatccaccgggaggatatcctgctttttcagagtttcgcctaaggcaagcgcaaagcgcagggcatggggcaatcccaggccgcagttgcgcagcagcgcctgatgcttgggagtgaagatctcccgtgggcttccctgggcgatcacgcgtgactcgttgagtacgacgacctgttcgaagcgggctgcgtcttccatcgagtgggtgatctcaatcagggtcacgccttcctcgcaggcccgcttgagcgctaaggtaagctccgctctgcctgcagggtcgagccctgccgtcggctcatcgagtacgaggataggtggattcatcgcaagtactcctgcaagggcacacaagcgcttctgacccccggataattcaaagggtgagtactgagccttatcctgcattccgacggtctcaagagcctgagagaccctcttgttgacttcctcttcggaaaggcccatgttgtgcggaccgtaagcgacgtcttcggcgaccgtctgggcgaagagctgccgctcggggtgctgcatcacatacccgatgtggccatgcagtttccgacgctgtctcttttcatcggtgcggatgccttcgacagtgatggtcccgctatcggggacctcgagtgcacataacagacgtgccagcgttgacttgcccgagccggtctgcccgatgatggcggtcgtcgatcctttgtcaaaggtgaggttgagatcctgaagagctgggtgtctgcgcgaggaggtatcgaagtagcggtaggagacgtcatccaccgtaatctgtggcgcatcggaggttttgactttcgtaggagtcgtaggcgcttcgaagcagaaggtctccggagaagccggttgtattcgctgcgtcagtgcgtggatcaggtcagattcagaggcggtccaggcgataccggagtcagtgagctgggccgacagacgtgcggcaaagggctctgtaagccctacggagcggatctggtcggtgtgggagaagacctcttccggtgtcccatcgaggatgatggagccgtgggagaggacgatcacacggtctgctgcgagggcttcctccataaagtgggtgatgtggactaaggtgatgccctcatcgtgcaactgatccatcactttcatgatggagtggcgaccacgaacgtccaacaaggcccccggctcgtcgaataccaacagcttgggatgcatcgccagcgccgaggcgattgccacacgctgctgctggccaccggagagcctcgtcgggtcagcctgggcatagggttccattgcgacacgatgcagctcttctctaacccgttttccgatctcctcagaggggagccctaagttctccggtccgaaggcgacttcgtcggcgacgacggtcgtgacgatctgatcgcccgggttctgaaagacaagcccgaggtcacagcgcgccttgcggtaggcctcgaagtcaacaccttgatcgtcgagtaccttgtagccgatgagctcaacggttccctcgtcgggagctaacagcccacagaggactgaggctaaggttgacttgccggagccgttagccccgagaatgcagaggcgttggccctcggggatttcgagtgacaagtcatctaaggcccgtatcttatcgaaggtcagcgtcacatggtcaagtttcgctgccagtgcatgctctgccatagggaatttctcaatacccagctactcgttgtcgaccagtgccttggagaccggcttgtagataagagcagtgaccacgcagttgatagcgaccttgagagcgttgaaaggcaaaaggaacgggacgatcatattgacgacagcgctcatatccataccggcgtagatcggggtcacgacgatgttcgccaggatgcagcagatgatagagacgatagagccgacgatcataccgatactggagccacggcgggtggtgtcatgctgatagataaggcttgcgggccacacgagtgacagcgttgcgatgatcgccatcagcatcccccagaagccggatgtcgttgcgatatggggaaggtaggaaatgatggagaccgcgacgccggtggcagggccgaaggcaaagcccgcgatcaagcagatgatgccggaggggtcatagtgcagccaggggactgccggaagcagcgggacctcgataaagagggtgcagactgcagcgagggcgcagaagagcgccgtgattgcgatgcggcgggtgctccagtttccctgcgcggtcgttgagtggatatcatgttgagaagtaggttgagccatagtggcttcctccgtttctttcatccggactctaaccgttggttttggattttcaccaaatcagccgctcatctgcggcgcgcggacttaaaggcctcgatgtgtcttcttaccaccagtgaggaattgcacctcgccctgaaacttacagctgcactctagcatgttctgtgtccaataccaaggctgcggtagcaaagcgagacatattcacagatctgtaataaatcagattacatgaggatacttttgatggatactttttgaaaaaaaagggggggggggcgcaggcgccgcgctgtgcgcaagcggtgtgcgatcttgagggatcaaatccaaagagagctctggtattctactatgagctcaaacaacgagtagaacccgggtgtaccggatatagagggggatgtcctatgagcacagcagaacacagtgggttggtatgtcggctccgcactcttgtaggggataccaatgtcgtgactgatgagccgatggtcgaagcacacgaccttcgtatcgggggccctgccgagtctttgtgacccgggaacgggggacaaggagcagatccaggctacgatgaatggcctggctcagcgtcgtcgggagaaacagccgcttgagtatccgagcgccggctccaccttcaagcgcccgaaagggtattttgccggcaagctgattaccgatgcggggctcaagggataccgcgtgggaaatgcctgtgtcagcgagaaacatgccggatttgtggttaatctcggcggggcgaccgctaaagatatccatgcggtcatcgaacatgtgcaggatgaggtgcagcgccaatttggggtccacttggagcctgaagtgcgctttttaggctaatttgatacctgagtctgattttaagggtctgggtgtttctgtggatatgcttctgttacatccgatgtggctttatagtaattagattgaacgagtcctattcgcagaaatgatccgtgaggagtgaacagagcattgccggaatcagagaatcaggaaaggaagcatcaatcctcgctgacgcgccgaagtgcccttaaattgtttacaggtatgttgggtttggctgccatcctgcaccacccgatacccgctttggcagacgatgtgacggatgcgaccaatgccgccaatgatgctgccggtaagcttgctgatacgcagaagcagttggctgatgcgcaggcgcagtacaacgatattcagaatcagctgaaccagatccaatccgactatgaggacatggcacgacagcagtcccagacgctcgatcagatcgaggatgtacagcgtcagatcgatgcgacgcaggaagcggtcgatcagaagcaggcggagctggacgagaagcgcggaattctgtcaaaacgcatgtcttccgattataaagcgggaaaagataatttcctgtctgtcatattgaattctgagagctttgaagacctgttccagaacgtgtactacatggataagatctcggctcaggacagccaaatcattgcggagaccaaggctgccaaagaggccttggatcagcagcgggcccatctgatcgaagagaagtctcagctcgatgagctcaacagccagcagctcgatcagatgaaccagatgagcgcaaagcgcgatgaggtctctcagctgctcggccaggccaattcaagcgtacaggatctgctcaaacagcaggattccgatctgatggcgtacaaccaggcagaagaggcgcgcctgaaagcggaggcgcaggcacaggcgcaggcgcaggcccgctcacagggaggaacgccggtggcaggcgccgcagctaatgttgtgaccggctcaggctctttggcagatgtcctcaattcgtgcaactctaccccgtttgcaggcgtcggctactgcgcgacctgggtgaccaatgtctttgtcaacgcaggcgtcggtcgctacggcggcaacgcgaacgacatgtacgcgcgctggtgcggcagctccaacaggggtggcctacagccgggtatgatcatcgcggtgtcttcctgcgatggagacgcggcaggccgtatctacggtcacgtgggcatctatgtgggtaacaacaccgtgatggacaactacaacacgatccgtcacgttaatctcgacgactggatcaacgcaatgagccacatcgtgaccccgcgctggggctggatgggcggcgttgcgctctcctaagtcagctgctttcacatgataattgtttgaacagcaggcgcgcctgccgtctctatagctgcggcggctagttcttaagcgaattgaggggagcggggaagcgtccgccacggtgggcgaagatcgagcctgcatacttgttgaccggcatgaccggagcggagccgaagagcccgccgaactgaagcacatcgccttccttcttaccaattgcggggatgaggcgtacggcagtcgtcttggtgttgatcacgccgatcgccatctcgtcggcgatgatgccgcagatggtctcaggcgaggtgtcacccgggatcgcgatcatatcgagaccgacggaacacactgaggtcatcgcctcgagcttctcgatggagagcgcgcctttctctgcagcttcgatcatgcccgcgtcctcggagaccgggatgaaggcgccggagaggccgcccaccgagcttgacgccatgaccccgccctttttgacgcagtcgtttaagagcgccagagcgcaggtggtgccggggccaccgcaggtgtcgacgccgatgatctccaagatcttggctactgagtcgccggctgctggggttggggcgagcgagaggtccacaatgcccttctgtacgccgagccgctttgaagccttccggcttatcagctcgccggcgcgggtgatcttgaaggcggtgcgcttggtcgtctcggcgacggtcatgagatccgcatccttgggcagctgctcaagtgcggcagccataacgcctgggccggagacgccgacgttgatcaccgcatccgcctcaccggtgccgtgcaccgctcccgccatgaacggagaatcctcgaccatgttgcagaaggtgacgaacttcgcggcgccgtagcagtcgctatcttgggtcgccctggcacactcgataatcgtgttggccgccaggagcgctgcatccatgttgatgccggcacgagtggaggcgatattgagtgaggagcagacccgctcagtggtggagagggccttggggatggaagcgatgagatgcttgtccgcgtcgcccatgcctttctgcaccaaggcggagaagccgcccataaagtcgatgcctagggtctgcgcggccttgtccatcgcctgggcgagcggggataggtccttattcgggcaggcggaggcgatcattgcgatcggagtgaccgagacgcgcttgttggcgatggggatgccgtactcgcgctcgaggtcctccgcggtttccaccaggtgttctgcctgggtggtgatgcggtcatagaccttggtgcacatgcgcttcatgtcctcgtcagcgcaggggaagagcgagatccccatcgtgatggtcctcagatcgaggttttgctctgccaccattgacaaagtctcattgacctcattgggggttatgtccatagcttcacttttctgtcgatgtctgctgtgccgtaaagtataggggcacgagtcgtgagcagtgtctgctcaatacacacttgaaacctttctggttcctacacctgcttcatctcctcgagctcttcggtgtagtgcttggctttggccttgttgccccggttttggtactgcagtgagatgagggacagaagctccgcgcgctccatacccttcgctttcggcagctccttgagcatccgctccaggtactcagagctcttgcgagcgataatgttgtacatcatacggtcgtgctgggcggtctgcttcgcgtcgctcgcctcgattgcgtcgagcatcttgccggcgcgcttgtaggctccggtgtccaggtagagctcaaaggcgcgctggtttgcgatatcgcgctgccgtttaccgaggtgtttgctggtctggatctggcggatcagctcgatcgcctccttgttgcggtcgagcgcgacataggcgtcgagtctcaccatggctagcgggaagggatgcgtgaagaagcgcgcagcgaagtgggtggtgtattccagcaccccctcgtaatcctgcgtctgcagcaggtgggagagcttgcgtgagacccggttcctcatgaatatatcgagcaggaccaggataaagaccaaaagcagagttatctgaagcggagttgccatcgttgtccttaccgtatgcggtattgcagcaaacaaagctagagcatagcaaaaagcgattggggatacaaaaagaggtcctgagcgcctcaaacgggtggggcctcacagttacaggtgcgcctatagctggaagtaggagacgccgccttcaaggagcggctggaaggcgtcgccagggatattctggtagcaccccttgctcacacgctcggtgtgtcccatcttgcctaggatacggccgtcggggctcgtgatgccttcgattgccaggtaggagccgttcgggttgtacttcaggtcgtaggaggggctgccctcatcgtcgacgtactgggttgcgatctgaccggtgtccttcagctgcttcagcacctcgtcggaggctacgaatctgccctcaccgtggctgattgcgacgcggtgaaggtcaccgaccttgcacttgctgaaccagaccgacttgtttgaggcgacgcgggtggtcacgatcttggactggtggcgaccgatagggttgaaggtcagcgtcgggctcgcgctcgtggcgcccacgatgtcaccgtaggggacgagacccagtttgatcagagcctggaagccgttgcagataccgaggatcaggccgtcacgtttctggagcaggtcacgcaccgcctcggtgatcgcagggttcctgaagaaggcacagataagctttgcagagccctcaggctcgtcgccaccggagaagccgcccgggatcatcagaatctggctcgcattgatcgcttctacgagggcattgacggactcggtgacctcttcaggcttgaggtttttgattacgagggagtaggggatggcacccgcacgtctccaggcacgctcagagtcgaactcgcagttggtgcctgggaagaccgggatagtgacacgaggttttccgaagtccttgccggtagcctgcaggcgataggtcgcgtgcttatcagtcgtatagcttacggtctcgagtttggggcctgcgacggtgccacggtaggggtagacgccctcgagcggctcctcccaggcttcctgcagctcagcgagatcaagggtctcattgcaagccttgaacgtatagtcactggtcacggtaccgagcagcgctacggtgacgccttcgggtgcctccggtacttcgtagtcgtcgttgagctcgacgatgaaggagccgtaggccggagtgaagaggctctcctgcgtgaagacatcttcgacagcgatgccgagcttgttgccgacgcacatcttgaagagcgcctcagcggccccgccgtagcccggtgtggcgattgcgcggattgccttgtcggcgatcagacggtggacgtagtcgtaggcctctttgagcgcggtggcatcggggacaatcccgtcggagttataagaggggactaccgcgcagacgcggtcgctggcctgcttgaactcagggctcacgatcgagtcggttgtaccgaggcccactgcgaaggagacaagcgtgggtggcacgtcgaggttctcgaaggagccggacatggagtccttgccgccgatcgaggcaatacccagatcgacctgtgccatcagtgtgcccaagagggctgccgtgggtttgccccagcgggcagggtccttgcgcaggcgctcgaagtactcctggaaggtgaggtacatctgtttgtggtcaaagccggtggcgaccagcttggagatggattccactacggagaggtaggcgccgcgaaactggtcttgctccatcagataggggttgaatccccaggccatgcctgagcaggtcgcggtctcacccttgaccgggagctttgccaccatcgcctgtgccggggtcaactgggtctttccaccgaagggcatcagcacgctgcttgcaccgatcgtggagtcaaagcgctcagctagacccttgttagaggcgacgttgaggtcgctcacgagtgagagcatcttctcgtgcaggtcggagccagaccactcgcggtgatagggcttctgcttctcaacgtggaccgtctggtacttcggggcgccgttggagttcaggaactcacgggagatatcgacgactgtgtcgccgcgccacaccatcttcatgcgcggctctttcgtcacacgagcgacgacggtggcctccaggttctcttcgtgtgcgatgttcaggaatttgtctacatcctccggtgcgagggcgacggccatacgctcctgagattcggagatcgcaagctcggtgccgtcaagaccctcatatttcttgggaacgcgatcgaggtcgatataaagtccgtcggcgagttcgccgattgccaccgagacgccgccggcgccgaagtcgttgcagcgcttgatgaggcggcaggcatcctttctgcggaagaggcgctgaagtttacgttcgaccggagcgttgcctttctgtacctcagccccatcctgtgacagggactctttgttgtgtgccttggaggagccggtggcgccgccgataccgtcacggccggttctgccgccgagcaggatgatcttatcacccggttcaggcgtctcacgtctgacgtggtcacgaggggttgcgcctacgacggcaccgatctccatacgcttggcaacatagcccgggtggtagagctcgctcacctgtccggttgccaggccgatctggttgccatagctggagtagccctgagcagcgctgcggcagatcttgcgctggggcagcttgccctggagggtcttcgagacgctctcggttgggtctcccgcgccggtgacgcgcatcgcctggtagacgtagcttctgccggaaagcgggtcgcggattgcgccgccgatacaggtggcggcaccgccgaagggctcgatctcggttgggtggttgtgcgtctcattcttgaagaggaagagccagtcctcgtcgtggccgtcgacatccacggtgcacttcacggtgcaggcgttgatctcctcggactcatcctgcgcggtgaggatgccttttgccttcagatacttggcgccgagggtacccatatccattaggctaaccggcttcttctcgcgcttaagctctttgcgcattgtaaggtacttgtcgtacgcctcctgaaccatatcgtcgtcgatcgtgacggaatccagattggtgttgaaagttgtgtggcggcagtggtctgaccaataggtatcgatcatcttgacctcagtgatagtcgggactctgccctcttttgcgaagtactgctggcagaaggtgatatcagccagatccatcgctaagccgcgatcgtcgataaactgctgcagctgctcctgcgtacgatcaaggaagccctccaggtgctccaccggcttcggagtggggtaggtggtcttgagcgtcctcttcttatcgagggaagtctcgcgggcttcaaccgggttaattacgtagtttttgattgcagcgaggtccttgtcggagaggttgccctcgaggatgtagacccttgcgaaacgcaccagcggccggtccttctggctgatcagctggatgcactggcttgcagagtctgcgcgctgatcgaactggccgggaagtgactcaacggcgaagacgattgcgccatcgggataggtgggcatctcttccagcgtcacgttgtcgacttcaggctcgctgaagaccacgggtgtacaggcatcgaagagctctttggagatgccttccacatcgtagcggttgatgatacgcagaccggtgagacccttaatggacaacatatgtcgtaattcatgggagagtgcctttgcctctccgttaaagccgtccttcttctctacgtagatacgctgaaccatacgccctaccttccgagtggtatttcggcacacaacctcattttaaacaaactattcagatcggatacatccgataggcagggtgttgccaatattgtctaaaagttctcttttggggcctatgggcgggaaagcctgtactgatcctgcccaatagaacggatatccataaaatgtggagaaacaatacgtctgaacttttttgctcaaattgaacctattcagggtgaaatatcctagtattgaactcacgacaaaagaattgaactatatcagatacgaaattgaactctcaaggagggatttcatggcacaggaggtacagacccaggaagcggtcccctatgagcactttgcacagcgtctgcaggatgcactgacgcgcaacgggcttaaacaggtcgacgtcgtccgggctgcacagcgcacaggcgtcaagttagggaagagcaagctcagccaatacgtgtcaggcaaatcatttccgagaaaagagacactcaactttttagcacagacactttcagtcacacctgattggctcaccggaaaggaatccaagaccatgaatacagccactgcagaacctgttacgcaggagcagacaagtatgtcaacacgagaattcagaaagtcccacaagctcgacaacgtgctgtacgacgtccgcggtccggtcgtcgatgaagctaaccggatggaagatgagggtacacacgtgctgaaactcaacatcggcaacccggctccgtttggtttcagagccccggatgaggtcgtctacgatatgcgccgtcagctcaccgagtgcgagggctactctgctagccgtggcctcttcagcgcccgcaaggccatcatgcagtatgatcagctgaagggcctgccgaatgtcgatatgaacgacatctacaccggcaacggcgtctctgaactcatcaacctgacgatgcaggcactgctcgatgacggggatgagattctgatcccgagcccggactacccgctgtggaccgcctgtgcaacgctcgccggtggtcacgtggtgcactacctgtgcgatgagcaggcacactggtatccggaccttgaggatatcaagaagaagatcactccgcgcaccaaggccatcgtcatcatcaaccctaacaacccgaccggcgtgctttacccgaaggaggtcttggaggacatcgtcgaggtcgcccgtgagcaccagctcatgatcctctccgatgagatctatgaccgtctcgttatggacggcaagaagcacatctccatcgcaagcctggcgccggatctcttctgcgtaacgtactccggcctctcgaagtcccacatgatcgccggctaccgcatcggatggatgacgatgtcaggcaataaggactgcgcacgcgacttcatgcagggcatcaacatgctctccaacatgcgcctgtgctccaatgtgccggcccagtccatcgtccagacggctcttggcggacatcagtctgtgaacgactacatcgtgccgggtggccgtgtgtatgagcagaggaacttcgtctacgatgccttgaacaacatcgacggtgtcgaagctgtgaaaccggatgctgccttctacatcttcccgaagctcgatccgaagaagttccatatcacggacgacgagaagtttgcgctcgacctgctgcgccagaagaaggtgctgatcgtccacggcaagggcttcaactgggagacgccagggtacttccgtatcgtctacctgccccgcatcgagacgctgcgcgaggctatggggaagatcaccagcttcctgagctactaccaccagtaagcagatcggcagattctgcagagacattcagatgcgctgcgctccgaagaggggcgtggcgctcctctgctatctcccgtgttctccgttggggcagacaagctggggcagttcgggcatctcgttgtcgcccatgatggaacgaagcatcgctgcaaagcctttggggtcttcgatctgatactgcatatggttgtagccctcgaagactgggaagtgcccttccggccaggcctgcatgatagcatctctgcacttgaagtggccctccttgctattgaattctcagaacgtgtggtgatggagctcttccggaagctgcgggaagggcttgtcctcgagggagcctcccatcatgcggcacatatttcggtaagggagggcttctcttgtctctgtgaagtagggcctgatagcatcattgtcgcaccgcatgatgtgcttgagcgggcctccctgtgatcaatagaggttctttatcaaaagcgccgtaaaacccctgcctttagccatggggatataaggcgcatcgccgcaaggcgctaactacctgcaggtggcataatgtccgcatggaatacaagagcaacaataacgtcgtctacagctgcaaatatcacgtggtcttctgccccaagtacaggcgtgctggtggacggaatggacgtgcgcttcaggcagatagccggccaagtcgcggccaagctctccttcgaggtcatcgagatggaggtcatgccggatcacgcccacatgcttttggaggtggatccccagctcgggatacacaaggccgtaaagcgcatcaagggaaggacgagccacgacctgagacaggagttcccctggctcaaaaacccgcatccctgcgctgtggaccaatagctacttcgtctccaccgtgggcggcgcaccgcttcccatcgtcaagcagtacctcgagaaccagaagagcgtgtagcaatggaaaaggcgttcgagtaccggatatatcccagccaagctcagaaggtccagcttgcaaagactttcggctgctgccgctgggtctacaacagggttcttactctgcgcaaagacgaatacgcccagaatagcaagatgcacttgatcaacttctctatcacgcagatcccgctttggaagaggacagaagccccccctggctcagagaagccgactccatggcattgcagcaggtgccctgagacctcgacaaggcgcacaagaacttcttccgcaatcccaaaaagatcggcttccccaggttcaaggccaaatcctgcgcccggcagagctagcggaccaacaatgtagagatagcggacaacgctcatgtgaaacttcccaagctaggaatggtgagagcccgcatctcaaggccgcttgagggcagggtgctctctgccaccgtcaagcgcacgccgacgtataagtatttcgtcaccatctgctgaaagattctaccaaatcgtcgccaaatttctttggtctcccccttcaggagcctcgctcccctcccgcgctatgttcagagccgcggccacggcgcggtcggtggtgctccccacgcacacaaccggtcttgcttgacgggtaagtcctgccgaccttcacgaagctcgcctataccagagcaccttgtactactcagctgggagatctttccgactggaggcgtccgtgcggacttggccagccggcagttttgctccgagcccttggacgtccaggtcttcgacggcgatggcttggtctctcgcgcagcgccctctgtcgtggtccttttgtgcggggtctcctttctctggttcggctatcctttcgtgtaatgcgggcgaccttcattcagcgctggctggcgtaccctttctggagtctttcttcttcctcggagcctcctttgctcccgcgcgagcttcttttcgactcggtacggctcctggggttggcgacggccgttcccccgagcgggccatggaggtagcggtttccgcccacgcccagagcgttgatgggcccttcggaatgtcggggccttgggcaatcggtg

SEQ ID NO: 292 - DNA, 24334 bp, Unknown
  Metagenome-assembled genome
tcgacgacgtaggtcgacggagaacgggcttgcatggcgcttcgcgcgagcatggggacgaacccgacagacagcccgctcctgtactcgtcctggccctttatcgacgcgaccaccgcgaactcgaacgtcacgaatgtcgccaggtcggtcccgggggcgagccggacgagctcctcgagcgcaatcctccaggctccttcagtggagaagagcagtcgatggtcgcgctcgccggggtcgacggtgcgggcgtagcatcgcccgaccgcccttgagcacgaagatgccgttgccgccggcgaacaacgcgcaacagcagtcgttggaagtagatccgacacggcgcgcccggtatccatcgggacgccgacgcagcggcggattatgaccgccactcgagtgcgggtcgcgctcttggccgtcattcccgcgtcccccctccgaagaagcccggatcatccatcagggctccggaaatctcacatccccgcttctcgccgtacggccctcgagcagtccctgaagcttccgtagtcgaaagtcctggtacatgttcctcgaggcggtccgccaggcaccatccgccacacgagaagtcacgtcgtcgcctgacgatggtcgaagacgggcgctcgagcgcgtcagggagcccccgactcgaacgtaacttcgtcgcgacccacccgcggcctgcgcgaagctcgccgacgggttactcgtgttgattctccttggggcatgagagccgtagggcgagagcctcgcaggtctccgatccagagtgaggcggagcggggctggaccctccgacgcggcgatgccgtcccaatcgtaacccgtcatcctctcgtgggagaaacgtgaccccccccccgggcggtgagcttacatatcgccggccagctcagtgtccgtgaaggagaggtctcgcggaccccaccatgcggtaggcaccctcgcacggacgcgcacgaggcgaccgggactcgaccggcgtcgtgtagggcgcggtcgcgcgggatgcccatgagggccgcgtgcagtggtgaaaacgccctctcagaccggagagtctctgcgatcttatctagtgggtgcgaatgcttcatgtagcaatgtgaggcttttccctacaattgcaacacattatccacaactcaagtactagaggtcgcgaaagcatacgaacggcatttcgatgccagcaactgcaaggccaaggcaaattgagttttattcccactcaatcgttacatggcccgtttctgcgtagtcggaactatcgccgacctgcgataaccgtcactcttcaatcgccaactcagcgtagtcaccatgtagtcagtggtgactacacgctctgtagtcacctggggagagtatttccgcccaaccgaagagtgacacgtaggacctgcggaaacacagttagattgcgcgcagctggctacatgggctgaaacggtgccgacgggtacggcgcctcccgatccaagagtgacaaatcccgactggagagtgacagtgctgaactgggaaaacgcacttcacatagagcgaagtgactacaggacaggtcattcaaacatcctcacttgcggcatcgtgcagcctaagttacatcaatgctatttctggccagtcagctttgccgcaccatgtctcgatagcgtctttgccacgcaagaatccgggtgcctttttcagatactcgataaactccgagggcgtattctcgcgatacttcccccatctatcaacttttccttttgtataagtcccgaagacaccaattcgcgcacgggagatcattacagaaagcaccctggcttcttcgcaattggactcggagcttttcgctctaaagtcaggtatagttccatcctccaagccaagcacgaatacccagtcgaattgttggccttttccggcatgacccgtgaggcagtgaacgccttcatgcgttgcgatagtctcgttaactctttttacggtgatgttctcttcgagttcgtgcgcttttgataattcaaaaccacgttggaaaagttgatcaaagagccagccgcagccttcttctagctcctcagtttggccaacgtgataataggtagcagccctctgttgaatgtattggagagcttcaagactatttgcaaaggaatgggtttgtatatcagaacagatgcgtttaaggactccggctacctctggtctgaagattccgcttccccaatcggtatattcgattccgctttgcgttaaagtcctcttcgcgatgatggcccggttaaccgtcctcgtgatgatgccaattcgttgatgtggacaatgacgcaagatcgactttgacatgacagctacccacgcagcttcacagtcctcgtcatcaaaagatgcaagcccagctactccacccgagccccagcgactggggaaggcggctctgagatgctcgctaccggttaccggagaaagagagttgactgcattcagaactgcaggtgccgacctaaatgacttcagtagctttatctgcctaccagaatctttggcaatctcctgttgtacgtaggctacatctgctccagcaaacgaatagatgctttgagcgacgtcaccggcaaaagtgatgttctctccgcaaagtgccttcacgaacctcaattgttgaggagtcagatcctgaaactcgtcaaccagcgccgcgaagaaatgatttctgtaaaggtcagctaccctatgatcgcttagaagccacagtgcaatcctaatttggtcgtcgtaggaaatcatcttctcgttgatgcgttttttctcaatcgtgcgagcaatttccccagcttgtccaacagcgccttcaagctgtttcattacgttgtcatcggtcaggcacgtcagttttgcatcgcgtaagacctgcctagcccggtcgctgtcattccatccgtatccgccagcacgtagctctcttcccacccagtcaacatttgcaagagtccaatcacttccgatgcctataagttgaccgtgcgacttaataattcgcgaggctaggccgtgaaaattgcagacggtgacatgctctcttagcgtctgcacgccgatgtacttcttaagccgttcgttaatgttgtccttcgcctgattagtgaaggaggtgataagcagtcttctaccgtttcctgaaaaatcgtatcgttcaaggagacccttggctctataggcaagcgcttccgttttaccgcagccagctggcgcggtaatcaccatgccataaggctcgtaatcgaaaatctcttgttgttccttggtgaccccaggcgcgctagcttgcattttggagcacctcagcaacgcttgacactttctccgccgtccctttgtcaaatgttccgcaggcgactacagcacatatgattttgtttgatcggcaatactccgccaggtcctgctcatctggcgttgaggcgccagatgcaatctgacaatttttcagcatgtttttagtgaacagactcgaattgcacattgcgttccatagcctgtccgccccaatagctgaaacatactcgtcttcaagatcttttcttgatacaaagacggatttctccgcgaggttatcgaccgtgactccaagcctcttcgctagtttggctagatttcttccgtcatcctcatcaatcaaaatactgactttgaggccgaatccgctttctccaaagatgtctaatacatgcggcatttcttggcacccgccagcttctaggatttcaataccgtccctttcgaggtgacgtcccatcttcaccgcagcctcttcaaggaccattctgtccgactgcccttcgactgcgataatccgcttagccgtcagaagctcaattttgctgcttatccaccaccttgcgagggttgcctggtcttttttgcccgaaaggaaccctcgacttggctgtgcgggcggaatcccttcgcgagtaaccgttatgttgtcaggttcgaactctccagcaacaactccagaatgcgtggctatgacaagctgctttcctgcactcttcagaatacgtatcaagtttcgctgcgccgatggatgcaagtgagtttccggctcgtcaatggcaatcattccgcccgaattaagtagcccaaagatagagaatgctataagggctttagtaccgtcagactgctctgttgcctggcgagcggttcctgacttgctctcaatctgaagccggacgttattcagtaaatctccgttgattgccgcttcggggacgaagtgaagcttgtttgccgtgatgcctccatcgagcacagggtcaagctgacccgccagggtactcaatgcttcattgaaggcatccgagccgtcaatcgcatcactgagagacttgatggcctcagccaatttcgattcgtctccagaggcatccacctctttgaggtagtcatcaacgatggtcttcctgcctgggtcaagctgcgtggttgaaaaatcggaagggatcatgctccatccgatgctctcaagctgctctcttctcaaattgttatcgccgacgccttttggaaagtatcgtctgatcgtgagatcgtccttgtccagagcggcttccatgcgaacggtcaacgagttgtctattacatcgtaatcatctgggaaaaacgacagctcatcttcgctgagcccttctagcttaacttcaacagcaaaaggctgctcctcgttctcgaagtcagagttgtcgatggagtagtacagctgctgtgtcgtcttgccaagcaccaggtctacgcaccttatgattgagcttttcccgctgccatttgctcccaccagaattaagttgtctctgacatcgatggtgcagtcggaaatcctgctgtggttgttgatagtgatggatgtgattttcattgccctgttgccccttgcgtcaacatagagtaggcgtcgttaactagtttgtaatattaaacgctctcatccaaacaagttgctttccatttctgagagtggaaagtggtcaatctaacccattctctttcattcaactataacctagcgaaccttagcgtgacccagcatcccgtcaggttttgcgcgcacgcctcgcaataagttcgtctctgcttatccgtccaagagacgcggctccttgggcctcgctgcgacctgagaacaacgtatgcaaatggcgagaaggttgaaccaccccatgaaatacgacgtcctccagatgccacttagtgcgctcccggtagttttgagataccgaagaataacgcagaaagtcgcgagaatgccaggtatgcaaatgatgatctgccgcctcctcggcattggaatcgaaccgcctgcccgacggcattgtggacgtaccgcaaatcgcatagcgcctgcgcgtatcgaaggcgccgttctgcgagctcgtcgtacggaaggagatctccgcaacaagtactcatgcgtacgggaaaatcgaagaagcgtccgcaaggcccgcacagcagaaatcagtaaagcaatcgagggcggctagctagcgggctggcagagtgcgcacaaccttggaatcgaggttttccgtcttgcccgcaaccagctcggtgcgccatgagccccaccaatcgagccggctcaaggcgcccatgggagaatgctcgaaattaaaatcgtggaaggccgcacatttcgggcggcattcacgttgtagtgggtagaggaggtgatttggcttgcctagacgggaaaccgggggcctggatacggaccgggcgcgcgagattgccgaggagtgctacgacgacgtgctggcgtactgcaggcgccacgcgcctgccgggcacgaggcggccgacctcgcgcaggagacgttcctgcgcttcgttcgcgccagggggtaccgcgagcgcggcaagcccatcgcctacctcatgcggatagcgagaagcgtgtgcgtcgacgcctgccgcgagaggcgtctgaagacggtgagcctcgaattcgaggtcgccgccggcgagcgcgacgggcgcgaggccgatctcgacctcgcgttggagcggttgccgggtgagctgcgcgagattgtggagctgcggtttggcttgggcctcggggtaagcgaagtcgcccaggccctcgggataagccgtttcgcagcgcgcaggcggataaaggcggcgctgaaggtgcttgaagaggacttgaaggtgatgggtaaggcggagcgatcgaggctcaaaatcgagctctcccagcactattccgcccaacgggagaaggcggggccgaacactatcgattcgctcgcgcgggccatggccgccgaggacgcgcggataagcagggcccggggccgcaggatggggttcgccccgttcgtcgcgtcccaggtgcgctacgtacctccatggacctgggtcgcacagctgggaatcgtcgcgctcatgctcgccgcggcgaacagcaccgcggacgcgagcttcgcgaagctcgtcgtcggcgtcctctccgccgcgaccgtgctcgtcggcgtgcccagcgtgcatgcgagcaagctgcacgatgtggctgagcttgagtactcgtgccccagcaacgcggcgagcgtgatggtggcgcgcctgatcgttctgggctgctcgtcgtcgctggtggtcgccctcatggttggcgcggtcgcgtcctctctggacgccgacgcgctctcggtcgcgctttgcgcctgcccgccgttcttctgctcctgcgccggctcgctagcgctgatcaggagggcggcaccctcttctgccgcagtgctctgctgggcatgggcggcagcgtgctgcgccgtgctcattgcccttgcgagcatgtggccggacatgtacgggacggcttctctcgcctcgtggatcgccgcggccgccgcggcgctcgcgtggctcgtgcgcgaggtcgcggtgctcgtgcgtgcggcctctgcggggttggacgcgttctcgccgcaaatggcgaaaacctaccactagataaggattgcagtatggaactcacattggatcggctgaccaagcagttcggggcgaggatagccgtggaccgcgtgtcggccatgctttccccgggcgtgacggggcttttgggcgcgaacggcgcgggcaagaccacgctcatgcgcatggtctgcgacgtgctgcgccccaccagcgggcaggttctgctcggcgggcgcgacgccctatcgatgggcgacgagtatcgggcgctgctcggctacctcccacaggatttcggctactaccccgacttctcggcgctcgagttcatgcgctatatggccacgctcaagggcttctccagccgggacggccgcgcccgcagcgtgcagctgctcgatgaggtcgggcttgccgacgacgcgcggcgcaaggtgaagaccttctccggcggcatgaagcagcgcctcggaatcgcccaggccatgctcaacgaccccgccatcctggtgctcgacgagcccacggccggcctcgaccccaaggagcgcgtgcgcttccgcaacctcatcgccggcttcgcccaaaacaagatcgtgatactttccacccacatcgtcagcgacgtggagttcatcgccagccgcatcctcgtgatgcgcgagggcggcttcatcatggacggcacgcccgagcaggtgatttcgcaggccgcgggcaaggtgtgggaatgccatgtggaggcgcatctcgccgaggagatgtcggcgcgcatgcccgtggccaacgtgcgctatgccgcagatgggcatgcggtggtgcgcgtggtggcggacgcctcgcccatggagggggcgcaggcggtcgaacccacgttggaagacctgtacctgctcgcgttccgcgacgcgggcatccgttaggagaacacaatgggagagctcatcaagttcgaactcagaaagatactcggcaaccgtgcgggcatggcggcgtgcctggtcgcgctcgccctgctggcaggcatggccttcatgaacctggcgaccacgaccacacgcgaccatgcaacgggcgccgtcgtggaggggctcgccggccagcaggcatgccgcaacaacgaggagtcgcatgccggcgtgctcgacgacgcccgaatcgcgaaagacgcagctgtcctcgatcgcgccaacgagctcgcggaggggacccccggctattacgacctgtcgagcgacgctataatcgcccagtacggtctcgagttctggcagcagacgagggccgtcgcctccgacgactactacaacgagatcgtgggcacgctcgatagcgcaagcccgcgcgcgacgaccctgcgagagggctcgcttgcgagggtagacgccacgctgtccgacggcttcgaacactatttcccctacagcgatgccgaagcgtcctattggcacggcatgttcgaccagattcagtggccggttgaattcggctacgccggcgcatggaagaacgccttggattgggcgagcttccttgctctcgcgatcgtggcgctttgcatagccctctcgggcgtgtacgcgggagagtaccagaaccgcaccgccgccgtggcgctgccgacgagacgcgggaagagggctcttcccgccgccaaggccgtcgcggcgctagcgttcgccacggcatactggtggctttgctcggcggtcgtcgtggggatcaacgtgaccgtgtgcggcgccggagggtgggatctgccggcgcaggtggtcttcggattcgacaacccatacccgctcacagtcgggcaggccatgctcgccgtctacggcctcggctatctcgtcgcgatcggcatggcggcgctcacgctgctcctgtcttcgaagatgcgctccacgatgccggtggccgtgattccgatggcggtggccttcctcgggatgttcgccctcttcatccctccgctcgcgaagcttggggccctcacgcccatggcgggactgaacttcgcattcagccgcatggtcagctacgcggcggggacggcggtaatcgaccttcccactgcgctggcgattctctacgcagtcctcctaatgacttgcacaccgcttgcgatgcgcgttttcgcgagacatcaggtagcctagagaaaagaggaagggcgggtgcctgcgtgcccgactgctgcgcatacgcatccgagaaccggtgaagcagcggttctcggatgcggatcgttttgccgagcggcaaagagaatccggacccggttgcgcgattccggccctttgccaccctgagtgcctaagggcagtgccgcagccaagcccatcctctcgttgagaattcgctatcgcggaaggaagagaggcgccgcgagcgaacccgaggccgcgtagggcactgcggctggaaacgagtcggttcggctacatctcccgcgcctcgtagagccttgccgcgattccggcagaaaccgcgtagagggcgatagagcccacaaggctggcgacggcgagcatagccggcccgttggggtccgcaaagatgccgtcgaggaattcggcgacgaacagagcatcgttcgagccaatcgccgcagacacgagtatcacgaccaatacgatgatcatagggataaagcgcacggccttcgtcatgccggaccgcatcgcgagcggcaaggtaaccgcgagtgccacggttatgaagagcagacccatcgaggcggacagcgtgtaggtccccggatcgattccttcgccgagcgcgcgcacgccgtcaacgtcgtaacccatcgccatgaaggcgcttgcgagcgccatggcggcgagcgacgcgaccagccccacgacgaggccggcagccactgctatggcgagactcgcgtagcgcccggacaccacgtttgctcgggagattggcagcgcgaggcggtagcgttcccagccgttgcgctcatcgagcgcgaggacggtgaatgcgcagttcccgctcaccgttacgctgatgagcggcgaaacgacataggggttttccatcacgaacgcgagcaagatgccgagcgcgaggccgatgactgactgctgagccaggtacttgcgcatgatgatgaggtcggagagaatcatcgccttcatcggatttcccccttcaacacgaggttcaggtagccgtctatgtcggcacggtcaagcgcgattctggggaaccgttccccgaacgcgaaccgatcgggcacgagaatcgccgtaccgtacggctgcctgatgaagcgcatctcgccaggggcgaagaatgagctttccgcgacggaatcgaactccgccgcattgcattgcgcgacgcccgccacgtcggtaatggcatccttttcgacagaaaacgcgatacggcccgcttcgatgcagactacgtagtcggcaatcttctcgaggtcgctcgtgatgtggctcgacatgaggatgccgcgcccctcgtcggccatgaattctcgcagcatcccgagcacttcttctcgagcgatggggtcgaggcccgccgtcgcctcatcgaggacgagcagctctgccccatgcgagagcgcgcatgccagcgatagcttcatgctcataccgcgcgagaggtcagagaccttcttgtcctccggcaggccgaactcgcccaggcaccgcttgaaggccgcctggtcccatcgtccataaaccgaccgcatgagcgagccggcagcagccacagttatctcttcgggcagcgcgcaagtgtcgaacaccacgccgatgcgctgcttggtcgccgcgtcgtgcggggatgcggtgccgaagagcctcactttccctccgtctggtcggatgaggccgagagcggcctttatgaccgtcgtcttcccggcgccgttggcgcccacgagcccgacgacactgcctgcggaaacggagagcgacacgtcgcgtaacgcgaagccgtcgtagcgtttcgagaggtcggttattgtcaaaagttcgttcatggtgcctcctgcctgcttcattccgccagcgcgtctatcatgtcgtgaagctcggatgtcccgatgcccgcagccgaaccctcctcgattgcctgggagagcagctcctcaatgtgacggagcctctcctcccgcaggatctctaggttgccgccggcgacaaaggttcccttgccctgtatcgtttcgacgaggccctggacctcgaggtcggcgtaggcccttttcgtcgttatgacgctcacccgcaggtcgttcgcgagcgcacggatcgagggcaggcgttctccttcggccaaagccccgctcgcgatgagcccccgcagctgcgaggctatctggtcgtagatcggcttgccgctcgcgttcgagatgatgatgtccatgggtcgttcctcgtcatttaggctctccgcacgccgtcccgtgagagttctagtgtagtccgctcagtcgctgaataatatatcgtatatacacactatctacagtatacacagcggtacacactacgcaaggggcaatggtcgaatccgcatggcggctatcaactgccgggcaagtacgccatagaggtcgggcgctggcgagcaagggcgccttgcggtggcctagcgcctcaggccgcattgcctgtcgccaacggatcccgaacatcgctcgacatcgtccgaggaactgggcctcttggcatcaaagagcatccagtgcgaagagatgccggacgagaggtagcgcatggctcacgaagctggcgcacggagagccatcgccccctgaccagccgtcaccccatgacgacatgtcaccccgagagacgctcaaccctgacggctcgtctggggcgccggtgtcggttcgtcatccgaaaggaaatgggaaagcatagctcatgagagaaaacggcttcctcgcccctcgggaggcgcgtgagagggggctcgagttcgaggagcccgaccccatcacatgccggtggtgcggcataccgctcactcccgctcggcgtcgagctgccggggcgggtgcactggctggcgagcgagctgctgatactcgacgacctggacaaggacgatggcagcggctgggcgcgcgcgacgattcagattcagagcatcctgacgtccggggctcccgggcgattacgagggctgcgcccgcgccgcccagcacggggcacaagctcgtcaacgagtaacgcatcaggcagtcggcaccggaagcgacgatgcctgctagcgcgcccagcgcctcgcgaccgcggacggcccggtcgcgctcggatatcagcgcgatccggtgcccctcgaaacgccggccgccgtcgaccgcattgagacccgaagcgcacagcgccgccaatccccgtccggcgccgtcatcccggccacgggccggcgatgccttgcagtggcttggagcgccttggcggcccgcgccgcgttgcgcgcgcaagcgaaccgggatacacctctcgacatcgtccaaggagacgggctccttggcatcaaagggcacccgaacggatcggatgccagacgagaggtgacacatggaagacgacatcttcagcatggagcgcgagcccgggcacgatgccgctgggctcggcggcgccacgtcggataatggggctgagaaccgcgagggtgccgaggcggggaaacggggattcgctgccaccccgagctcagacatccacggccaagacgacgcgctgctcgacgtcccggaagtcgccgagtaccttcgcatctcgcgatcgtcggtctacaagctcatcgagaggcagcagattcccgcgataaggatcgggaggctgctgcgtgtcagaaggaaagagctcgatgagacgcttcgcgcaatgggcgacaacagctgagccgaccctcgatgataatgcgcctgctcgcgcggggcacacgccccatcggaaagccgatagaccctgattcgccggcgtacccgctgaatcccagccgcttcgaccccgctcgcgggcgcatacgctgcgggcgatcgaaggggtgacccggctatggcagtagacgaacagggcaagcagaccaggcaggccaggcctcacgttcccctcaaggacttctattcggtcgaggacgtctcggcgcttctgggcatcggggagaacctcgtgagggcgctcgccagcaggaaagaggaccccctgccgttcaggcgactgcacggaaaggtccgagggatgttcataccgcgcgcggagctcggtgcctgggtcatgaggaactcgttcctcgtggccgccaaagacggggaacggggcaagcatggcgagccgtgagacgcccgccccggaacgcttcctcgtcgtctaccggttcatgtgggacgagctcgggctcgacggcagcggtctcgtagtagcgatagccgtagtagagcccctcggcgtactcgacgaagtacgcgttacccgtggacttctggggatagtagccctcgatgtcggtgtagcgcttgccgccgaagttcttgaaggtggggtcggcggtgaaatcggcagcccagatgtcggtggtcttgccggaggggttcaccgtgccggcgaggacctgaccaaggccagccgcacccgtggcaccgatggagccaacctcgaggatggcgtcgaccgcgtagtcgccggagacgagcgggccaagctccatggtcgtagagagattgagcaccgcgatgaccttggtgcacgccgccttggcagccgcgatgacgctcttctcctcgacggtgagctccagctcgtgctggccgtcctcgtagttggccgtctcgctgttggcggtgaagttctcggagacgccggactcgacgtctgccttcaggttgcgggagaggtcgccgccctcgccgccgccacggccaataaagaccaggccaacggtgcccttgatggatgcctgggcgtcggagctgtagtcggaccaggggatctcgccaatgtagtaggacgccgtggacgggttgtccatggtgatggcggccttggcgtagttggagtagttgtcgttgatccagttgtaggcggtgtcgttgatggtgaagcccgcctggctgatgccctggtagaagttgatgcaggagcttgcatcaacggtaccggagccggcgccgccgtagacagggtctgccgcatagcggccgagcatactcacggtctcggaggtggagagcggcagcgcgttcttgtcgttcttcaagaggacgatgccctcggcctcgatctcggtgaccaactcgtttgcggcctcggtcgcctgcttgcggccacggtagtccgaggtgtagtactccgcgtcccagtcctcggagccctggaccttctcgaccgttgcgggacgtccgcccacgtagtggtcgagaagcgagctgaacttgttcgccgcgacgtttgcggcggcagtgacgcccagcaggccaaccgacgcgatggtcgagccgatgaacttccttctcgttgtgctcttagccattcccactccccttacgttccctccggccccgagggccgcttgttcgacgataagggtaggcagcaagcagggggaaggccaaagagggtcgcatccggttagttagccgtcgcagattgcaggtgtcaaccagcagcggcaacggtcaccggggcctcggccgagggcgatgccgctacgggcagcgctacgacatctggagcacctcgtcgcacgccgccaggagctcggggtcatgcgagacggtaatcacgatgcgcgagcgcttgagatcgtccagaacggcaagcaacctttccctcgaaccctcgtccaaggcggacgtcggctcgtccaggaagaccacgccaggatctttgagaatcacccgtgcgatggcaaccttctgaccctctcctcccgagagctgccgaccgccttccccaagctgcatgccaagggcgtcaggcaccttggcgattgcgtcaagccccacctcgcgcatcacgtcgagaagccgctcgtcgctcaccgggccatcgcacagcagagtcaggttgtccctcagcgtgccgcgtatcatcacggaatcctgctcgacatagccgatctcatgcgttcgcagatcgtactggtcgatgtcgtcgattggcgtcccgtcaagcgtcacttcgcccgtccagcatccccgaaggtctccagacagcagcgtcatgagcgtgctcttcccgctgccgtttggccccacgatgccatagagcctccctttggcaaacgttgcggagactccgtcaaaggtgatcctgcccgcctccaactcgcaggtcacatcgcgcatgcgcacggtcttgatgccacggacgcacgcctctccgacgtcctcgaccttcctctcccatagctccgtgaggcggccgaggttgactttcgcctgctggtattcccgtcccaccttgagaaagtactccatggacgtcaccagcgtcgcaaagtacccgtacaccgtggcaacgaagcccgcctctatgtgtcccgaggcaacctccaccgccgcgactatgaggacgatggcaagcgagaggctccgcgtgacatctgcaaacagggtcatccgcgcagcgatgcagttggtcttgtacatggccggacggacggccgagtaggagcgcctcatctcatcggcgcttcgctcaaacaggacgttccggcgaatgaaggggattttcgccagctgccagagcgcgatggcggagtagcgcgccatctcctcaacaaaggcctgctgggacttggcgaacttctcgctaaagatgcgataggagaggttcgacgccgcggttgacacaaggcagaggatgcacacgagcgggctcaccatgaacagcgacaccgccgcaatggcaacggcgatgacattttccccgacgcccgtgagcgcctggaggaagaagagcgagaggccgttggtgtcatcgtcgagcctcttgcgccagtacgagggatcgaagtcattaaagaacctgtgcgggaggtgctgaatgtgtccggtcgcacgcaggtcaagctcgaacgacgagtccgcctgaaggtaggtgtagagcagcactgccttgtacgagcagagattcgagacacaacacaacgccgccaggacggctcccgcaagcgctatgctgcgcacaacgtcaccggacgccagcgtcatgttgatcataagcccggcaagcaggggcgtgaggtttcccagcaacgcggcaaaaaggctcaggaggagatatctcacgaacccgctatgatcatcgatgctggaccagcacgcggcgataagcgccctcatgggcaccctcctgcggacgtctcccgcgaacgtgcgctctgaagagccaggaggtcaatcttgtcatcaaggttgtatttgattgggccgcacatgtcttttcgaccttccagtgcctcgcggggacatcctccccagcagagcggaaagtagacacagtggtgacattttccttcctggccagggacgtacctcaaccagcgtgaactgttcaaagatgagaaccgcggcgcatcaacagtgccataactcttatctgaacagcccatctcgtcccaacacttacacagacttccctctgggtctatcaccgcagagccgagagctatcgccgagcaaatccctggttccgaccccctgaaaagcccaacatcaaacccaagctcaatcgcgctccggtaaaacagggattcaacagtagaaaaagccttcgcatctaggtaacgtgtactactatggccgtcgtcacctagtgcatcatcaaccatggctagatatatgcccaccttccctgcgagggccatcctgtcgatatctatcagcaacccatcaagatctgcagaattatctgcatccacattcacgcgaatcgttattccaatgtcatcgacagcagacttgatattatgcagaattctctcgtaggtaggctctccattgcttggtattcttctcaggtcatgcggtcgctccgcgccgtcaatggtaacttgggcctcccgaacgccacaatcgcacaacaccttgacagctctttctgtcagatgatagccattggtaactatggatgcctcgtacttacattcaggtggaagagcccctctgatcagttctgtcaattgggcgatacggtcgagacagagtaatggctcacccccataccagttcaccatcaggactttggccttcccaaactcttccgacacgaagcgtgccacagcagccgcacgctctccggacatcgtaagagcagccagcccggcctcgtagcaatatgggcaagcgaagttgcatcccgtcgttggcgcaatagtaacctgtgccctagattcgttgtatctaaggcacaggttcttgacgagaagcgcctcaaattcgtcgatatcatcatcgactataaatccattagcgaatagagcgccggtgaagtcatccaaagaatcaatgcggcccgtctccaattctctatacttagccgcaaactcagagtccagccgaagcagccctttgttgttcgtattgaagaggagcactccatctttctgttcccgaacataattatactgagataacttcatatcggccaatcactctggtccgcaatcaaaggggcgcaaaaaacacccatcagtccagcccccttttgcacggagacatcacatggcacctacccaaaacatcctcatcttcaactggcttaatgatccattccatactcgagcacctccttagctgattgacgatctaaatttctatctatatgtttaatgataccacatacggttgaaaatagatcgtcttttgttgagatttgacgccggctagctgttgtgtgccaacaggttgttgacacatgacgtgacaaaaggggaggactcctccaagctgtgaattgtcgaaggttgcagcgagaggagccctccttgttccagcattctgactcacggctcacgccccgcggatggcaggggctcgtcgagcgcgcacgcgccggcgagagcgtgtccgccgccgcccgggaggcgggcgtgagcaggcagacggcccacaagtggatcgcgagggccgaggcgggcgagcggctgtcggaccgccgcagccgcccctcgcgactcgcgaggctgacgccccccgacgtcgaggcaagggtcgtggaggcccgccgcgcccgcctgctcgccccgctcgccctcgccgccgagaccggggtgcccgcccgcacctgcgccaggatcgtcgcgcgcaacggcctgccgcgccttgccgacgtcgaccgcgtgaccggcgagcccaggaggcgcggtcccgcgaccccgcgccgctacgagggggagaggcccggcgagctcgtgcacgtcgacgtcaggagggtcgcgcgcataccgcccgacggcggctggagggcgcgcggcgccgacgccccgcgccatgccgactcgggggcgggcaccgcctgcctgcacgtggcggtcgacgacaggagcagggtggcctacgccgagctgctcggcgacgagcgcaaggaggcctgcgccgcgttcatggggcgcgcccgggacttctaccggggccttggggtcgaggtcgagcgcgtgatgaccgacaacgggccgggataccgctcgcggctgttcaacgagtggctcgcggcgtccggcacctgctcgggcttgacctcctcccacgagaccacctcgcgcacgggcatgtacccgagctcgaggtaggcgccgtccctgagccgcttgccggcggtgaaggtgagctggcggtgcccgcctccctcgtcgtaggcgtcgagcgtgtactcccaggcctccgcgccgccgcggcccgtgctctgcgcggctgcgtcgtccacccggacgtaccacgtggacgcgttgtccgtgttcgtgaggtagaacacgcccgccatggccgcgagcaccagggcggtcatgacgattgtcgttatccttcgtgccatcgttgggtcctttcctttcgctttgataattcggtcccgcacctgacgggctcacgatgagggcgccccggcattcgccacgacccgggcgcaggcgcagagcgccgcgcaggtgaagatggcggacatggcgaggaacgcggggaggtccgaggccgcgagagcgcctcctccgctgctattcgcccccatctgcataagtgcccagggccaccacatgccccagccctttgccgtgagcacgaggcccgcgatgccgcccgcgagagccacgcccaccggcgcggcgaagctgcgcacaattgccgagacgagcagctgcaccgccactacggacacgccgccggcccatgcgagcagcaggctgatgacgcagcccccggacgggaggcccgggaggcccaccgccttgccgagggccacgaacagagcccccgtcgcggcgagcgcgacgcccagcatgcccgtgcccacgacgagcttcgcggcgacgacgcgccacggcgcgacggggctcgcgagcacctggttccagttggtgcccgcatgctcgaggcccatgagccaggagcatcccgcgccgacgagcgccggcaggaaaaagcagagctcgaacagggtgtgctgagtccagaggttctcccacccaggggtcagcaggcctaggttctgctggtagttgaaggtgccgatgacggaggcaatgaggggcagcaccgcgtaggcgatccagatgggcgcgcggcgcagtttgacggcctccgcgcgcagggcttgcgctctcatgctagagctcctttctcgagaaccaccacgccgagacggcgacgagcgcggcgcacatcgcggccagcagcgccgcgtcgccccaggggaaggggacgctgtaaaaggacgtcgtcctcgcgaccgggtcccagtccatgcgcacgcacgacagcagcccgaagtagccgctggggaccaggcgctggacggcgggagggaagaacaggctgaacaggccggtgagcgagaggccgaggcccaccgccagcgaggcgaactggttctcccagcggagggcgaccgcctgcacgagcgcggcgaccgcgaacgccggccctatctggcaggcggcgaatgccgccagcccgacggcccccggccggtctgcgaagcccttgtacgatgccagtgcgtcgaggcctacggtctccagcgccaccgcggccgcgatgaggacgaggctgcaggcgagcttggcggcgaacaccgttcccgcccgctgcaggcacaggagctccttcagggcctgggcctcgtggtcgacctcgcacgcgcgcgacgagacgacggcggcgaacagggtcatgacgatggagttgacaatcggggccatgtagagcagggccgacgtcccgtccgccgccccctgggctgcgcgcgcggcgtcggacgccatccacgcgacgcacagcgcggcggcgccgaggcagagggaccacacgttcctgcgcctgagcttcgcgaactcgagggcgaccgcgaccatcacagcccccttccctcggtgagggcgaggaagatgtcctcgaggccctcgctgcgctcctcgatacgcacgacgccgatgccctcccgagcgagcgcgagggaggagctcgcgacggcctcgtcgtccgcgaagggcgcgagcagccacccgccctggtcggaggcccccagcagcgcggccgcgcggcggtcgtccgtcgtacggaacgcgagctggcggcgcgcgcgggcccgtagggcctcgagcgtcccctgccacgccatccgcccctggctgataatgcccacgtggtcggccatctgctcgacctccgagagcaggtggctcgagaccaggacggtggtgccgtgcgtccggggcagcccgcggatgagctccctcatctcgtggataccctcggggtcgagcccgttggtgggctcgtcgagcagcacgaggcgggggttgccgagcagcgcggcggccagccccaggcgctgcctcatgccgagcgagaactgcccggcgagcttcctgcccgtgcctgccaggcccaccgtctcgagcgcctcgtcgatcgactcgtcgggcagccccttgagcctgcggacgatgtcgaggttctcgcgcgcggtcaggtgcctgtagcagctggggctctcgatgagtgagcccacgtgcgcgaggacagcgagccggttccgccggtccatcctctctcccagcacctccacctcgccggccgtgggccgcaccaggccgaggaccatcttcatcgtggtggacttgcccgccccgttggggccgaggaagccgtacaccgcgccctcgggcacctcgagctcgatgccgtccacggcgcgcgccccgccatatgacttggtgagctcgctcgtggcgatagccagagttgccatgctcgctcctttcgttcgtctgcttcagcgacagctcggattctgggggatgcgcctttctctcgcctgtccccaacctttcgcgagcctttcgtttcgggtggggcgagggcgctccgggcctgggaaaccccgccccgggatacaatgggggccggagttgggaggcggcatgagagacatacacgaggcgcgggtgctggtggtcgaggacgacccgaccctgctcgggcagctgaccgagctgctcgagcgcgagggctaccggtccgtccgcggcgctgggaccgtggccgacgccctgctcacggtcgcgacctggcagccccagctgctcctgctcgacgtgatgctgcccgacggcaacggcttcgacctgctgcgccgggtgcgcgagacgagcgacgccccggcgctgttcctctccgcgcgcgacgaggacgcgagccgcctgcggggcctgggcctgggggcggacgactacgtggccaagccattcctgcccgccgagctgctgctgcgcctggcggccgtcctgcgccgcagctacaacctgccagacgcgctgcccgccatcgcgctcggagaggcggaggtggacctggccacgggcgaggtgaggcgcctcggcgccgtcgagtcgacgctaaccgcgaaggagcacgcgctcgtcaagaggctgaacgagagccgcggctccatcgtgacgacggacgagctctgctgcagcgtctacggggacgagttcggccacgccaacgcgctcgcgatcctcgtgcggcgcctgcgcgagaaggtcgaggacgacccctcccacccgcgctgggtcgtcacggtgcgagggctgggctaccgcctcatgcgcgaggaggcgcgatgagggggccgctgcgcgcacggctgaggggagtcgcgggcttggccgcatcctgcgtcctcggtgccgttgccatcctcgcggtcaacatggccgtcgtgggggccgccatgtacgccgagggcctcgcgggcggcggcaccgccccggaggcctcgaaggtgtccgagtcgatcgtcgagcgggacggggcgtatgccgtcccgccggacatggagcaggcgcttcgcgacaatgacagctgggccctgctcatcgacgagggaggaaacgtggtctggggcctcggcgtgccagacgacgtgcccacgcgctacaccccggcggacgtggcttccttcgcgcgctggtacctcaacgactaccccgtgtcctgctggcggcgcgatgggaagctcgtcgtggtggggtcccccaggggctctgcctggaagtacagcttctcgcagggcttcgacgagttcagcggcggcgtgctgctcctgatcgcgctcttctgcgtgaacctggtctcgctcgtcgtattcgtgagcgcgctctcccggcgctcgtggaagcggcgcgacgacgcgcgcaacgagtgggtcgccgccgtgtcccacgacgtgcggacgccgctctccgcggtcgttgccgacgccgcgcgcctgatggaggatcccgggctcgatgccggcgcgcgcgaacgggctgcccgcatcgtggcgaagtcgagggaggcggcaggcctgctcgccgacctcaacgcggtgaaccggctgcgctacgccatggagcccatcgacgccggggacgtgcgcctggcggcggtgctgcggtcggtggtggcgggcttcctggacgaggggacgggcgcctgcgagctggagcttgacgtggcgcctgccgccgagggcgtctgcgtgcgcgggagcgagtcgctgctgcgtcgcatggcggtaaacctcgtggggaacagcttccggcacaacctgcagggctgccgcgtgacggtttcccttgatgtccgaggcgggcttctcggcaccccgttcggccggcggctagtgctcgtcgtgagcgacgacggccggggccttggggccgatgcgctcgcggcgctcgggaggaggccgggctccgaccttcccgagcatggtcttggcctcgtgattgtgcggcgcatcgccgcggcgcacggcggggatgcgcgcttctcgaacaacgcgggaggggggtgccgctgcgccgtgaccctgcccgccggaggccgccatatgaaacgcaatctcaaagcgagtccctcccggtgaagcgcgccccggctcttcgatacgggaaccgggaggcggttttcggaagcggcaggggctctagcggcgcctcatccccaggatgtcgagacgctcggtgttgacggtagatgcgccggtccctccgcgcaggtcgacgaactctcgctcaagccgctcgatctcctcgtacaagcgctcatcgacggcgcctcctgcgccgatccgcttcagctcccgcagtagctccaccatgtgctcccgcagcgcccggtacacccggacgtttggcacgacggcgatcgcctcgtcgcgcagccgcgccatgatgaagtcctgcttggacatcccgctctcctcggcgacgcggtcgagccagcgcttctgctccggcgtcatcctgaagccgacggtgacgctgcgctccctgcggtcgttggggcatggcatcagaacccctccttcgaggcgttgagggcgcgcgccatctcgccctgcttgtcggggaagaggtgggcgtagcggaatgtgatgtcggcgctctcgtgcccgagcctctcggcgatcgccacggcggagaagcccatctctatcagcagcgagacgtggctgtggcgcaggtcgtgtatgcggatgcgcttgacgtgggacttagcgcacccgcggtcgagctcgtggtgtagcttcgccttcgtgaacgtgaagatcctcgagtcggg

SEQ ID NO: 293 - DNA, 8671 bp, Unknown
  Metagenome-assembled genome
cactttccggttcggtcatcgaggacgtgaagctcgaccttgagacgccgcaatcccttggttgcgactccgaagtgggtgcccttcgggtggccggcactagagggcccaacaaccacttcggatcagggcctcaaatcgccgccagcagcaaaagccgacagcgatcctgactggtgcgtggcggccggatcctttgaggatctgtggcattcataaaccatgatgcactcgccgtgctgtacccctgctcggttccggtgattcaccgggcagggccagagcccgatacctcaatctggctatagtgttggcggaccgccgctgctcaccccgaccgccgcgccgagtctcgcccccggcgcttgctgagatcgtgcagacgatcaacggcggcagtgcgcctttgaacaagccttctccgcaatccttaaaatcgcagcgcgccagcaggttgatgatgcggggaagatcactaccacgctcgctggaaaacagatcctcgtgagtcagtgcttgtgtagagcttgagcgaacatcgcttgctgcaggagccacgctcgatgatcgaggcccgcactatcatttggcaatgtacggcaacacgactgcaggatcgttccgcgctcgatcgataccgcaattcggactggaaaacagtctccgagcggttggtcagtatcgggggggcaaggctattgactccctacacacagttgcctgccaaggcttggcaggcgctcactttgtctgtgtctccgcctaatgtggtcaagcgcttctatgcgattgtgcatgacagcaagggtcatgtggttaagccaggcaagcgatgtcatgtcaacgccagatcaagatacgatcagggccactgtggcctgacggctcatgttgagagcttcagtctgaagagaatgaggagtaaagatcatggcagaagaatcagagcagaaaagattgaagacatgagctttcaaagagggctctatcgagcttgagaagatttgtccgctccctgagcgtggagatctggagctcgggattccctcaagtgctcgagcgcgagagtctcgcgctgattatgaagccttgcgtcgccttgctgcacgcagagcgaaggtacaggtgctctcgactatacgaaggatgagcaggcgccggtacaccacctcgcaaccctctacccttatctggacagtaaaaattaggggtacccacctcgtgcgctcaaggaggtcacacatgagtgaaatttctattttcagatatcgtctgccggcaagttccgagcaagatggtctaaccgggacgactggttccgcctttcagatgccaatccactacgccgtccatattttttggtgtaccaagaaccactacgagaacattctcgacgatgtcccttctgaggtacttgaggccatggtccacgctgtggagcgtcatcgtaaagcagaccggcattgacaagaccggattcaggctcatcaccaataccggtgacgatgcggggcagacagtccaccacttccacatccatattatgggtggtcgcaagctcgatccgagcgcaggcgagaagcgcgactagtacgtcacaatgacagctgagcattaatctgaagagccgaaccgatgggtccgactcttgtttttaagctcttcgacgtttctagtgggtagcacaggccagctgcctctgggccgagaagttgagttttccagtctgagggagaccatcgccccgaagtaggatatgttcctgaagcccctggcagtgttccggacagactgagcgggggagttaagcccttcgagaaatgaattggttaaactcctctcccaccagttcaagatcccctcacgctccttcctaaggatacctgccaccctcttcatcttagccacggcaagtgcatcatctacaagcaaaggcggtctggggctgcagcagccgattccctgtcggtacacgagtacacgtcgcacatcgcctctgccatctggcaggcgcgcgcctccctgagatgtatcttcgcggaatcgagcttctctcttcgcaagctggcactctgtgaggctctcctcatatattctttctgccacttctcgcgcagtggccgcgctcttttcctgtagacgcgaatatgggataaagggcgtgcatggtgcgggtgcgctggtaatcgaggtcggccatgatgctgatgtagctttggtcgcaccttttggcggtgtcgcctgtacccacacacggctccggaatagtctgctgcatccctcgccttcgatgtcgccttcccaagcagcctccatatgcgcgcgggctgtctcgtgcagaggcttatggccacaacgctcatgacaaagagtaccatcccttattgcctgggcctcaaagagcgccgtgatgcgtcttcgggcacacctcccagagcatccttgcggcaggcacgccgtctttgggggcctcaacactgcgccgtgtataatcgtctcgtattgccagatgttgaaatgccacgaggtcctctcccgtctgccgcaggtgccgcagcgcctgtagcagacagggctcaccacttacctggccccttctgtgcgctatccgcacagggagttcgttctgggctcatctgcgcttctcgaaccagacgccgaagagctccattcgtccctaagccccctggggcttcttaaagagccttgtcagcatacctgccctaagcatccatatcgcaccttaggatcgcatccgtcgccaaaatcttggctgtccgggtaccacgtgctcaagggatgcaggagtgctacccaccataagtagcgaagagcccttttctaggggtaatacgtaacctttgcgttaacaggttgtacgcatttgagaattgctatgataggtatatgtggtgtattaggggagaggcccctcgtatttaaggagaccagctatatgaagtcaagtaaaaaaccatgatcttttgaagagatgtctaaagattgtttttgtaagtgttggattagttgcactttgacagtcgaatatcgaatgcttttaggcgcaatagatgaagcagctgtgaaacataagcacagcagcaaacaaaagtatgcagttttttgattgatacaaatcagttcgggttgtaggctaccttgtctcgcatcacggcaaagatgatgagacagagctttcttgccacggcagctacagccaccctatagggtttgcctcagtaatcgcttctttctacagaactctttgagcttaggaacatagctgctgcagcaagccacagagcgcgtctcaggtaggaagcccctgctttggtgataggcaaccctttagcctcaagcttgccggatcgattcgctctgtgggtcagtccggcgtagtttacgatctgagagctgctcttaggccgagacacatcacctgtctttgtagctgtgtgaaccctgcctgtgacaagacttcaaggatagtgatgatgagggctccaccttacatagcagctcttctatcatcgctttgtcggtgtctttgatgtcgccttccaaatattcgatctcaaagatacagtgcttgatctcaaaacccacagccttcttcccaaggtgcgccccgcaggagtttttggttgccttgctgttattgctttagcctcaccaagacgccccgttctttgtgggcagcgggccatctgtgagaagtgccaaggaaggggcgctgaagatgttagtgaaaagcggcttgcacttcgggaaatgagaatccaaaaggcagatagcctgcacctcttttagggactggcaaaaacgcattaagaatcgcagagcctgtagagtatcatctgcaagcttcgttggctttgtctcacctacacggcagggtctttgcgatgagagagctgtcggctgtatcatttttgacccctgcgaagcccttgagtttgcgtagagcctctacatgtacaggatcaaggacacacactgcctatcccttttccacaagatacgagtggcaggccatccaattctggttctgccagactttctagcccacgaggagcacctatccaaaccttcgctggtacttctgaaagagattaggcacctatctttccctttgttgtcgatggtcccgattaggtggtctacctttgcgatatctacacctgcaaagagcataggtgtatctccttacaaagccagtctggcggacttcccgctatagccatttagatctgcacgcttctaaaagagatgcgaagcccaagccaaaagcttgccttcacccagcttatctgcgatctactccagatgggacaggataccaatctcctttacgagccgcatagctcttcaggcagtatgaagacattcctgccaccggagattctctattgcatctaaaagcatccgatatgaggccaataaatgcaacgcagtgaatataggaggcagtatggctgacttaaatccgttcgacgcggcagagaagatgtttttggcaagcgtcggggcaatggcaacggtgggcgacaagagctcggaggcgtttgacaaccttgtcaagcgtggccagacagcagtgcagcagggccagaatctgaatgaggagctcaagcacacgacctcaaacgcggcgcacaacttctctgagagcgctctcaagacctggatgcagaccatgaaggacgatgagctcaaggacttcgttaagaaggtcgagacgatggcaagcgagatcgaggcaaaccgcgtcaccgtagacgtcaaagacgtagaagatgcttccgataaggatcaggacaaagcggagtaggcgtggaacgaagcgaaccttcggacaacacagatacgacatcacgggcgtccgttgactctcaggaggagacggacgcctatgacaacatgtttcaggcgatcgagaacgaggagtacgaccagacgatcggcctgaggggtggccgctataccacctatcggaccggtgcctggcagggccgcctgaaacgtatgcatgagatcttctcggtggtgcgtaagtacgacattatgcacgggatgacgccggtgacgctgcgtcggatgctcgaggagctgggccctacctttgtgaaggccggacagatcctctcgatgcgctcagagatcctgccggaacctttctgtcaagagctctcgaagctgcaagcgaatgtgatcccgatggatcgcgagactgtcctctcaagcctcagggcagagtatgcgatcccgattgaggacctcttcgacgcaatcgacgacgtgcccctgggatcggcttccatcgcccaggtacaccgggcgcgcctgatcaccggcgaggatgtcgcaatcaagatccaacgccctcatgtgcaggaaacgatggcgcaggatatcgatattatgcgccggcttgcccgctacgctgaccgcttcttcccggatactcaggtacttgatctcggctccgttatcgaggagctctggcactcctttcgtgaggaaaccgattttctcgtcgaggcaaggaatctggcggagtttcgacgcaacaatgccaatatcagatacgtcggctgtcctaagccgtatttgaaactttgtaccctccacgtggtcgtgatggactacatcgaggggatccccatctcacacaccgctcagctcatcgccgagggctatgacctgaatgaaatcgggacgaagctcgtcgacaactacactcaacagatgctcgacaacgggttcttccatgcggatccgcaccccggcaacctcattatcaagggtgggaagatctactttattgacctcggaatgatgggaaggctgtcctcaacggaccgggcagcgcttcgggacatggtcacagcagtggcactcagggactccgcagaccttaaagacgggttgctcgaatttgcagtgtccggggccgatgaggtggaccacgcgcagcttttaagctcacttgatgagattatcgagaagttcggcaacgccgacctcaaagatttcgatatgggtgccttcgtcaatgcactgttcacgatggcacgaaggtgcggtatcgagctgccgagcaatgtcacgatgctcgcacgctcactggtgacccttgaaggcactgtcaatgattttctgtcggatacctcgatcatccagatcatccgaacccatattcggacacaaggatcgcttggagatttaaccaagcaggaagcgaagacctatgcgcgggagctcgagcgtgcgtcacatgggttgcttcaagcagccggggatgccggccttgcttccaagatgctgacccgcggacagctgcgcatgatcctggacctctcaggaaccaagagcccgattgcagatctttcccatgcagcggaccggctaactatgggtatcgtcgcggcaggcctcttcatcggctcctcgattatctactatgcgcgcattcaacctgttatcttcggcatccctatcatcggctttgtagggttcttcatcgccctcttcttggggctctggatcgtctttaatattatcaaagagcacaaacgggaccatcattcctaaggcgtgttccaacaaagtagtggtacacaagaaaccagcgggcacgtacgtgtccgctggtttccctttaagcttagaatgatggattgttagctcctcacgacacggtagccaacggtaccgacgccactgaagcccaacgcagaggcgactgcgggctgaaggtcgatctgacggtttcctgcatagggaccacggtcattcacgattgcacggcaggttctgccactgtaggtgagctccacgatggtgccaagtggcatggttttcattgcgatgcccatggaggtcggggtcaaggtgtcaccgtttgcggtgcggttgcccatgaggccatcgccgctgccgtacatagaggcctcgacgtacgtaaagcccccggaggcagagccggaattcattgcgctgttgtctgcgttattgtctgcgttgttgcctgcactgttgcctgtgctgttgccagaggactgctgatttgagttgttgggattcgagttgttggaatttttggtagcctgatcaatctgcgtgatggtctgatcctgctggccggcagcctgtgccgcctcataggcagcctcgcgctcagccttgccctctgcggctttctggagagccgcatcaacggcggcctgtgcctgatctgaagcatccttagcgactttgacctgctgctcctcgtcggtcttttcctgtgtaagctccgcctgtttggtctgcagttcctgctcaacattgactagattgttgatgtcctgggtgctacttgccataacgcggttgaggctgttgatcaagtttaggacctcattgaagtctttcgatgagaagatcatcgaaagcagggagtttgagttctgatggagcttgtaggacgtggaaattgcggaagcagcgttctgacgcaactgcggcagcttgtcctcgatctcctgcacctgctggttattttcatcgatctgagattgcagggcatccaacttctgttgctcctcgtcgagtttctcattcgcttcaatagcggtgttctgaagtgattccagatcgcttgtatcatcagcgagcgcggcagtaggaactcccgatccgatgagtgcagctgagatcaatgcaacggcggcataacgaaagtaatgtgaaggtgttcgcatctctcctaacccataatcgtcgatgacagcatagggctgtcgtgtacagatttggaattggctgattgcggttaagcttcttttatcgtcaattcgactattaatattaatccctgcgtatcaggggcacaaaatatacacttctatgccataactgaattggttgaagtagtgagacacagaagccctattccttccgaatccctggcttttacagtgccacctctgtaggcctattcagcctcggctataccgcttacgtaccattcttccggcgtgtcgcagctaagcgtatggtgaatccgcctgctgttgtagaactcaacgaactttgcgatggtgtccttgagctctggcaggcgtgctgtattttgtctgcctttaggcattcgctcttgagggtctgaaaccatctctctaccaaagcgttgtccttctatctcgccctttcgtccatgctctgggatatccctttggatgcgagcagaaagacgtactccttagagccaaagaacgctcccctgctcgaagttcatggtaaagggcatccccatgctccctgaaagcctgcttggcgcatgtagcgatctcctgtgctctgcatggtgtcaaagagccttccagcagacgatacagcggctaaaccagtcgatgagcgagcttaagatacaaggtgcttcccttcgatctggacataggtggatgtcggcggaccacacctggttggggaacaggacaccttgcccttcaagagataggggaaccttctggatgcccaggagggctccggaggagacgacagcgtacagcatgggcagatgcctgcaagctccatcagccttaagacaccctgtagcgggtggcatgtgcctctccttgcttttgcagcatcttctatatcttccttgccccatagggcggggcag

SEQ ID NO: 294 - DNA, 5036 bp, Unknown
  Metagenome-assembled genome
gatttgaacccaggatacgctttagacgtatacacgatttccaatcgtgctccttcggccactcggacaactctccctaaaaccgcataggaaagtgtacaatacttgcaccgtatttaccaccatttatttttttcttcatgagatgctacactcacacggaactctgctgaatcgtcgctgaacggtcgcgggactttgacacttagccgacaatcatcgaactaattcaagccacaaatttctggatctacctgggatttgtggcttttcttatgcgtcggtttatggtagacgtatctgtggtatttggtgtcagttgcatgtggattgggtaaagatatgaaggttcagctaacaaggaccaagaccagcgagaccttctatatagccaagacctatcgggacaggaagaccggcagatccacctcaaagatcgtaaggagactgggcactagatccgagattgaggggatgctccccccggcacggacgtgatgggctgggctagggaagaggcaaggcggatgacagagcaggagggcgggctcacccgcaaggtcacggtgtcctatgaccctgcgaggcagatagctccgggcgagaggcgcgcctccaacgtgggctacctcttcctgcaggacatctactccgcactcggactggacgggatctgccgggacatcgcctcccggagcagggcgggatacgacctggactcgatactctccaggctcgtgtatggacggatccttaagccctcatccaaaagggccacctccgaattcgccaaggagctcctcgagcagcctgccttcgatgcccatcaggtctagcgggccctctcgggtgttgcaaagcattccggggagatccaaaggagggtcttcgagaacagcaggaagatgctcagccgccgcctgaagacgatgtactatgactgcactaactactacttcgagatcagcgaggaagacgacttcagaaggtatggcccctccaaggagcaccggcccaaccaatcgttggcatggggctcatgatggacaaagacggccttcccgtggcctttgacctctacccaggcaacgagtccgagcagcccaccctcatcccttaggaggagaggctcgaaggcgagttcggcctctcgaagttcatcgtctgtacggacgccggtctctcgagcgtggccaaccgcgcccacaacagcaaaggcagcctccagttcgtcaccacggtctgcctcaggggccagaggaaggaggtcaaggactgggtgcgcggccctaagggctggtcgtgcacaggcgaggcgggcacgttcgacctcgaccaggtccggaaggcggcagtggaccccctcacgcccgagaagacgcgccgggccctcttcgctaagaccttctacaagacgatgtggacgtccctgaaggaccctgcgaccggagaggagctggggcagaacctgatcgtcaccttctccctcaggtagcgcgcctaccagagctccatcaggaaggcgcaggtggagcgggcgcgcagggcctgcgaggacgggacggccaagaggcagcgcaaggggcccaaggaccccatgcgcttcgtctcctccacctccgtgaccgaggagggcgaagtcgccgagaggtgcatcctctccatcgacgataggaaggtcgaggaggaggcctcctgggacggcttctacggcctggctacctcgctcgacgacgaggatgtcctgggcatcgtgaagctcgccgccggacgctgggaggtcgaggagtgcttccgcatcatgaagggcgagtttgaggcccgtcccgtcttcctctcgcgcagggaccgcatcgaggcccacttcctcacctgctttttggcgcttctcatctaccggatcctcgagaagaggctgggcggcaggttcagctgccctgtgatcgtcgacaccttaagaggcatgcagatggaggaggttacaggcgagggctggcgccccctctacatgaggaccgaggtaaccgatgcgctccatgatgccttcggcttcaggaccgacttcgagatcgttcctgtgcggcagatgaacaagatcgtcaggaagacccaccggaagggcccgattaccacaaagaaggaggctggcaaggatatcaaatagctatcttcaccagcccttatgtgcaagctatgtagggttaagtgtcaaagaccggagtgtacaatacttgcaccgtatttaccaccatttatttttttcttcatgagatgctacactcacacggaactctgctgaatcgtcgctgaacggtcgcttcgatgcttgattttctctttaccggcgcctcacgcggcgcggcaatcccgattcctccctggctggatctgacctccgttgtggtcggcgccttaaccggctgcattgtggcgaagaaacggaacctcgatctcgtcggatttatcgcactctccatactctgcgggctcggcggcgggctcctgcgcgatatggttatgcagcgcggcggcgtctacatgctggattcccactacgcgatccccggaaccgtgatcatcgcccttgttaccttcttctttccgacgccgttcttctcaaatcctgctgcgttggaatggtccgatatcctctcggtgagcctctttgcgatctcaggcaccgataaagcagttgtctggggattgaatccatgggccgtagtcttgatgggtacgctcaccgccgtgggcggcggcatgctcagggatgtctttttgggtgacatccccaggatctttaggaaatccaacctctacgccctgtgcgccgtggcaggctccctctcctatctcttctgcgtcgcgatcggcttcaacaagattgtgtgtgcactcgtctgcaccctggtgacggtgggacttcgccgcacctccatgcgctaccacatcatgtccccggccaatgttgacctgactccccgcgtacgctcgcaggtccaccgagcggaaagctcagtctcgagagctgaacggagaataagaaaagtgcgggcactcaggtgtgccaagcgcatcgatcagcatcaccggcgctaaaaatgggctcttcgctgtttctagtgggtagcgcatgcgagcttcttctgggccgtgaagtccagacggcccagccggaggaagatcatcgtcctgaaataggcaatgctcctgaagcccctggcgatgctgcgggcggactgcacgacggagttgaggccttcgaggaacgagttggtggagcccctcctccatcagttgaggatgccttcccgctccttcctgagggtcctcgccacgctcttcatctcggccacggcagagtacatcatccacgagcagaggcgctctggggctgctgccgccgattccctgtcggggcatgagtacacgtcctgcagcgcctctcccatctggcaggcgcgtgccgtcctgagatggggcttcacggggtcgagctcctccctcttcgcgagctggagctttgtgaggctctccctcctcttgagccatacgtacttcgtccctgcgagctgccggcgcttctccgccgactcgcgccgctctgcgcacctcacatggtcgatcgctctgttcaggagctgcaccacatggaacctgtccacggtctgtgcggcctggggcatctgcgcggcgacccccagcgagtatgcctcggccatgtcgcgcgtgacctctaagaccttcgtgcggtcccctcctgtgctccttaagctgagccctgtcaatataatggacagaggaatctcagattttttatgcggtctgcatcacctttggatcgtatgcaaggcctctctcgaggcgctcgaagaactcctgcatcacctctgccggtacgcgatctcctatggacttatgcgggcgaaagcggttgtagtacgactcgattaaactcgtgtgccttgtgcttggtcgtggatgcgtctaagaggcgcttatggtagtaccacacgttcttgagtgtggcaaagagcgattcggcgaccgcattgtcgtggcagcttccggttctccccacggagagcctcacgtcgtgtacggctgagcaggcggccagctttgagcttatgtactggctgcctgggctgcttagaatatggcccctccggccacgtatccgcgcgaatatgccatcttcagggcaaagacgacaagccctgccctcatgttgtcctgtatgcttcagcccaccaccatgtgtgtgcacagatcgtgtgcgacagcgagatatataaagcctgccgtggtcttgcgataggttgtatcacccacgagcttggctgtcggcacaagacacgaaaagccgcgccgggtgagggcgaggcgctcgggggtatcaggtgcgggcagcgtcgtcctcttggaggcattggatcagatgccgcctatcccagctcagccatgcaccttcgcacgcggtagcgagtcgtcactgtaaattttgcgtactgcggatctcctgtgagcttggatcagaccttgcgaaagctaaagcgcctgtcgctttcctcccatatcgcgcagatggcctccttgaggggaccccataggtcctcaccgcctttggccttgagccatctgtagaagtgagccctgctcacctccagtacgcgctccatcatcgagacgctgtaggttgccctcttctccagcatgagctaaaacctgtccttcaacagaggcttccggcgaagaaggctgccactttttaggaacttattctcgctttcgagctcgtgtatgcgcctgttcactgcgtcgagctccttgtgctcgtcggtcctttcctgggtcacccttttggtctttgagtgcttgatgatccagtcgtttaaggtcttgtcgttggcctcaagcttcgcggcgcatcctctgatgctcttcttcggggtggccttacgtgccttcctgtagtagtcgatagccttaaggcaatacttcttcagtgtagtgtttgggtgtttccggcttcgtgc

SEQ ID NO: 295 - DNA, 25427 bp, Unknown
  Metagenome-assembled genome
cctgcttcgatgcggtccaacttcaacctatggtcaagaagctcggcatgactgtcggtcccgtccagcctttcacccgcaggcagatcgcagagcacgcatggggcttggctcgtgcggccctaacaacaaccgtcacatccacaagggtttacatccggttcgcgaaaaacaacttctccttgagggctcgtcggtgaaaaacttctatcacaagactgccggcatcatcggcaccggctcgtatcgcggtggggccgcattggcccataatctgccagggcttcagcatccgtcctggcgctgacctctacctacccaaacccgaagctcgttgacgaggggtcatcgtcgatgagtacgtcgaactacaccgagctctatcaaacgcgctgacttcatctcctgcatgccttcccctcaacaggattcctaccacctgatcaacgacactccatcgcgagatgaggacggtgtcgtcttcgttaacatacaccgctcgtggtgccttgttgatacgaacgctcttattcttggcaaatccgttccggaaaatcggctcggtgggcctcgatgtcctcgatgcacagctaactcaaacgtctacaagaccgttgagtccgacattcgcgtcactctgtaaccgcactctctgctttctgctcttcccgaaaacatattttttacatgacctcgcatcagccttcgtcaaccaaggaagcctcgagcaagatatgcaaagtgcacgattgagaacgctgagcactacaacgaaccaacgaaggctccatccgatagcgtcgttaacctcgtcctggcgtcgattgtcttaagattcgaaggcccttgtactctccgcccaaagcgtcaccgctggggcggtttttttatttaacgtgtacgacacaattggcgcatcgtttgcatatcctgcatacattatccacggaaaagacccttggggtaatcgtggtcgtaagcgagagaaaaatacacacatatacccccagactttttggttggcctcttttcgtttctttgaacctcacctctttttttcttaccttcacgtcaaattaagtataatgctcatcgttatgacgcggaacgccaacaatgcaacacaaagggatatcaaaggggatatcccgtgttgttatagcctggcccagcaacaatgagagtagactgcagaagcggacgaagtcgtttgcacccatggccctgcaacggacacgacagtactgagcatctcatcctcaacggtatgaatgttcgcacggtttaactcaccatgcaacacatagtatcccgtaaagaatattgagcgcgttcgcgcaatgtcaagaagcttggcatccctgtttccattatgctcgacaaccaaaggccctgaagatccgtaccgggcctgctgaaggatcacaagcccatcaattcaacgtcggtgagcaaaaccacggtcacgaccgacaacacgatcgtgggcacccacgacctcatctcgctgactcaaagatcttggcccacagtcaagcccggcacgaagcttctgatcgacacggactcacaccggcctcaagtcggtccgtctaggcgaagaggtccactgcgtcgggtcgagtctggcggccgagttgggtgagcgcaagggtgtcacgtcccaatcctctttcctcacctccctccgtcacccgagcaggacctctctgattatcaccttcgctgcaaagctcggtatcgacgcaaccgcttgcctccttcatccgcgatgcgaacgccgtcaggaaagatccgccagatctgctatgagaccggccacgccctcgacatcttcccaaagatcgagagcgcctgggtgtcaaaacttcgacgagatcctcgcagcttccaactgatgcatggtcgcagccccgtgttacctgggcgttgaggttccgaccgacaaaaggcccacacatcagaaaccattatcagaacgtgcaacctagtctatcagccggtcatcaccgccccagatgcttgactccatgatcagaaacccacgcccgaacccgcgctggaagccaacgagtctcaacgccgtctatgacgcaccgactgcgtcaggctctccgtgagagtacgcagcaggtcactatccagttgagggctgtgaagacaatggctcaatctgcatggaagaccgagaagtaacctgcagcagcgtgagacctaccacgagcgtgaaggcctacgagccaacgtgaacatcctccatcggattcgcctctttcacgaccgcgcagcgcgtcaacgccaagtgtcatcatcgctccgacacctctggcagaaccgcacgcctgatctcaaacttttccgtccgcatcttccgatcatcgcgctgtccccctctgaccaccaatccgcaagtgctgcttctattggggtgttgaggcaattaagtcgttcgagcagggttcgctctcccgcgacgctctatgaatccctcgatgtcactaaggagcacaagttcatcgactcgggcgacattgtcgtgctgaccgcaggcgatcctcagacctcaccgtcacagggcgactatatcacgtctactaacatgttgatggtggcacaggtccaatagattcctgagcatcacagctcgtaaggcatacaaggctccagctctcaacgaggtggagccctttttgtcacggtgtcagaaaaagcccaatcttaagatagatataaaaacccgctgctgtaccgtacactaataattttggctcagtcctaattcctgtgggcagccccatcacgcgccggccccggaaggcttcgagcagcgcctgctggcaatcgaatatcttgaggaagaagcatccatcgttagggtatccctagcctgccctcctgagcgtcttgatcgtgcagttggtcccttcgactctgccgctgctgatatggtggcgggcataggcgacgatccgctccatcgctgcgcgcatgtcctgcttctgcgtgcacaagtaggcctcaaagagcatctcatccgcgattgtcgcaggcgatagcctctacatgcaaacatccactcctcgcccacgtggtcgcagaaggcatggaggaccttctttcccttcgaatggacaagccacagcacatgtcccatcttgaggtcgacgatcacggtggcgcagcggtgcccgccgtgaagcttgaacgtatctgcacccagataccttccctgccgctcgggcttgcgcagctttcgcttactgtcttccccttccgtgtagagcccagagagcctcgcgcgctcgatctttttcacgacgtttctaggcaggcctgccgtgggcgacaccgccttgagggtctgccccagggcgagcaggtcgcaacgaaagcgagcagcaacagcgtgatgcgctggcctgaagccctgaagggcacatcctcgatgcaggaggccccgcactccctgcatgcccatcttggccgagatatctctatccttgccttcccatctcaagcaggagatgccaaagtgcgatgggagccttcctgtttccctccatcggccttccgcggcagggacacgacggtgcatccgacactgccagcctgctcggcacggagagtatgcaaggtggtgtccggcatcccctggatgacgtcccgaactcctcggtgcgaacagcctctctgggctctcctgtctgcacgaagcccacgagatgggaggggatccggaagaaggcaggagcttctttgacatgggaaatagcgggcagctgggctgccgtggatgctacacttgtcagtgcgctccatccttgttcgggatcttcttgttgcgatgcaagactctagaggagggccgcttctctgtctttgcaggcactatgctgcaggcaccggcccacaacttttaggatgggaccaaaattttcttatccactccacaacacaaaggaagtctcatgatgctcagaaaacacgcccctgtgctctttatgatcgtggcgctcctggcgctcaccctctgcgggggctgcgcacagagcgatacttcaaattcgtccgattctgacgacacccagcaagaacagcaaagcgacacgaagaccatcaccgatgcctatggcagacaggtagaggtccccacgcaggtcaacacggccgcgactgtaggatctggcgctcggctggtcgtctacgccggtggcaagtacaagctcattgccgtcaccgatatggagaccaacccaggcatgaaccgcccatacgcaatggcgtacaaggacctcttcgccgatctcccctccacgagcaacggcaaccacctgaatcagacaaatgtaaacgccgagcagctgatgcagctcaagccggatacgatcatctcgagcagaagcgccgacgagtgcgatcagctccagcagacgaccggcattccggtcatcggcgtctcctaccaaaaccaactcttcagcaatgggatctatgactcaatctcctgtgtcggcgaggccttggacacccaagaccatgctcagtccgtcatctccaagatgaaggagtggaagcaggatctggacaaccgcatcgcctctgttccgcaggattcgaaaccctccgtgtatgtcggcgcaatcaactaccgcggcaagaagagctggaccggcacctacgcccactacactcccaccgatattctgcaggcgaacaacgtcgcagactctacagggcaggatggcgcgatcgacgtctcccttgagcagattggccagtgggatccagactacatcttcctcgacgccgccaacagcgatgtgattgaccaggactacgagaacaacccggacttcttcaacaacctcagcgcgaccagatctggtaacctgtacacgcagccttcatataactttaacggtaccaatgtcgggaccggcatctgtgacacctacttcatcggcgccactatctacccagatgccttctcagatgtcaacctcgacgacaaataccgcgagatctatacgacgatgcttgatgggtatgatttctacaccgacatgcagcagaacggtgagaccttctcgacgttcccgccgctgtcgtaactgcgaggcttaaataaggtcctatgacacaaacgcatccctacaaaacatctaaagtaaccgccgccgtggcaagctatactgcctacggcggctatattaaacacaaacgccgtgtgattgtcataatggcactcataacgtttgtgctcgcaatgatctcgatgggactgggagcctatacgctctcccctgcgcagatcgtccagggtatgttcaacgcatccccagatcccactgttgatgcgatcatccaaaacatccgcctgcctagggtcctcagcgcgattgtctccggcattgcgctcgcacttgccggctgcacctatcaggcgacgctgagaaatcccctggcttctgcaagtaccctcggtatctcccaaggcgccgcattcggagcctccatcgcgatcatcctctttgtggacagcaccgccacctcagcggtcactacggtgggctcctccactgctaacccctacctcaccggcatctgcgcctttatcggcgcgatgctctccactgtcattattctcggactctcgagcttgcgtgacatgagctccgagagcatcgtcctactcggcgtcgctctctcggcggtcttcaccgcaggcaccaccttgatccaatacttcgcctccgacgaccaggtcgctaccgtcatcttttggaccttcggggatctgacccgcgtctcaacccaacagctacggctgctcagcatcatcacagcagccggtgcgatcttcatcttctgcaaccggtggaactacaacgcccttgagactggcgacaccctcgcctatgggttgggcatctccgtcaagggggtcaggctctccaacacgatcatcgcatcgttgcttgcttcttcggtcatcgcctgcgccggcatcatcaactttgtcgggttgatcgctccccacattatgcgccgcatcttgggtgcggattaccgctatctgctccctgccagcgcgctgtgtgggtcctgcgtcctgatcgttgcggatatgctctgcaacctcctgatccccccgactatcctgccggtctctgcaatcacctccctcatcggtgcccccatcttcatctatctactcttcaagggggttcgtcactgatgcttgagctcgaccacatcaactttgcctatccccacggcaatgccctgttacatgacgtctcactctctgtgaaacctgcctgcttcacggccctgttggggaaaaacggctgcgggaaatcgaccttactctccctgatcatggggatcctgcatcccgcttccggcaccatcacactcgacggcgaagacttgccgcatatggagcggggcctgcgcgccaaaaagatctgcatggtcgcccagcgtgaggaggctacccacaatacagtcttcgacgcagtgctgatgggcagaaaaccctacattgaaagtgctccccgacaggaagacttcgatacagtcgcagacatcctggcacggctcagtctctcccaccatgccctctcctatatggatgagctctccggcggtgaacgacaagtcgcaaccttggcacgcgcctttgtccagcagaccgactatcttctcttggatgagccgaccaacaacctggacccctacaatcagcaagagatcatgcagttggtgcaccacgaggtgaacgatcgcgggatcggcgtacttgccgtgatgcacgacatcaacttagccctccagtattgtgaccggtttatcctgatgaaggaagggagcatcaagaccgttggcgactcctcagttatcaccgaggcaaccattcgcgatatctacgggatgaaagtcgacgtaatcacccataatgggaccagggtagttatcccacacacgttgaaatagcatcaatatcgcaactatatgatggccaaatatgtaatgattggttacatgttctatacgaacactaccttgacagaggtgaacaatgactgagaacaagaacagcgacttcaccgcccaaatcggtacctcgctgaaacagtggagagaagtctcccataaatcaattgaccaagtggctcaggagagcggcgtctctagtgaggtcgtctcacagattgagcagggagactcctggatgagaatcgacgatgtcctgaaggttgcacagaccttgggactgcttgagaagcttaagcaggcttttgcggcaccggaagcagcgcctgtcgaacagcaggaggagcagaccgaagcgtccacgaacacgctggagcctgaagcgcaagaaggcatcgcccaggaagaagctcaacccaaacagcaggacaagccacaaccgcaacctgcacctgctgtggagcagccttggctcaccgaggcaaactggtacgacggctcaatggtctatcagatctatccgttgggcctcaccggcgcaccttggagaaacgacggcagcgctgaaggtgctaccaacgacgatccgcaccgtcttttgaagatcatcgatgacggctggatcgtccaggccaagaaactcggcgccacctgcattatgctgaacccagttttcgagagcgattcacacggctatgacacccgcgactatacgaaggtcgacagccgcttgggcaccaatgaggaccttagggcggtcgtcgatgccgcgcaccagcagggcatcaaggtcattctcgacgccgtactcaaccacgtcggccgtggattctgggctttccaagatgttatcaagaacagacaggacagcaagtacgtcggctggttcaacatcgactggaacagcaactccccttacaatgacggcttcagctacgagtcctggcagggcgtcagtgagcttgtgcagctcaaccacaacaacctcgagctcaacaactacctcaacgatgtaatcctgcaatgggaaaaggagttcgatatcgacggactgagactggacgtcgcttactgcctggatccgggatacctgaagtatctccgtcagacggccaaccaactcactgaaaaacgccatcagaagttcctactaatgggtgaaacgatgttcggtgactacaaccagtggatgggcgacgacgcctgcgacaccgtctacaactacgaggcctacaaaggcctgtggggctcaatgaactcctccaacatgcatgagatcgcctacagtctggagcgccagagtggcgacaagccgtgggacctatacactggtaagcacctgttcaacttcctcgataaccacgacaccagccgtatcgcctcaacgctgaacgataagaagcagctgaagccgctctacggcctgctctttggcatgccgggcgtgcctgcggtctactacggcagcgaatggggcatcgagggcgagaagaagttcggcgaccacgagcagcgtccgtcacttgacaagcccgagtggaacgacctcaccgactggatccaaactctcaccaaggcccgcctcacgaccgccggagccgaagcgctatgcgagggagactatcacgagctcctgtgccagccgaaacaattggtcttccagcgtgcttgcgagagcggccgtgtcatcgtcgcaatcaacgcggattcaaaaccggcacaccttgacttcaacgcccaatgtgggcagggaaccaatctgatcaccggtgagcagcacgacttcggtggtggctctgatctgggtgcgtacgacgccgcctactggctctgcgagaaataatcccacactgaaccatatagagtaatgggccagaggaactcaatcctccggcccattttttatgaaaggctttagcctgtgccgggcggaatgctcggcatgaaaatccacccgctatgcggatggaagacaacgatgcaatgcaacgaaactcggtagtgtcggcaaggacgctcctatggtgtatcaagagtcatctcacggctcctgcatatttcggataggagcatcgagtatctgtcctaaagctcgcagtgtttcctcgcttcgcgctcgatctcgctgatcctgacgggctcggtgttaaagccttacagcggtctccctctgggtgaggtgtgccgacagccgcttcgactttaaggctctcttcgcactcgtgctttttggtacccgggttcaaaagagcatggaagacctgtctggttatgtatctcttcaaacatcttgtgatctcgcgcttcgatgtgcctttagctgtccttttgaagacgtaggccagcctcccttcgtcgtagcgcatgcagctgagtgcgatggtatacagcgcccggaaagcctgccggttgagccggtatctggcaggcttgccgctcgatgggtgccgctgcacacagcgctgcgatgccgagggcagcgggccgcagccctatatctttagcagggcaggcgcattgtcctgcacaagctcctccagctcgtctgccctgttcttcgcaagcgcctggagcataagcagtgagtcggcgaccagctcagcaccctttggcatctttctggcaagcgacctcatcatttcgaaagttcccattctggcgaacttcgagtggatctcctccggagccgctgcacctcttgtctcgcttgggccgcaggacctccatgatggagacaccgcacgattccgcatcgcctctacgagcgattcgtatccggccctgtctgccggaaactccccgctgaaggccacttctgcccatggcatccagcacgcagagcacatggttgtccttgtgtatgtgtcgacgctagtgcaaagcgtcccggaaccagacatgcaagacctccatccgtcatgggcatcctatcggcaggccagacacaacactgacagaagcgctagaagcaggagagtccgatctgctggcagtgcccatgctcctgtgaagtcatggcaggccttcgggatgcccacggcagggcgcgacaggtcttttacaggccagttgttaaagttaaccccagacttaccgattgagggtggtaacggttttccgtaccattccacctacaaacctaagctgccagtacgaggccgaggctctgcctgaactccatcgggctcactcctttaagcgagcgcttgcgccttgtcgtgttgtaccagacgatgtagcggtcgatgcgttttccagctccttaagggtcacgctatcccacttgcgcttcctgaacacctccgtcttcagaagtttcgaagaaagccttctgatgcgctggttgtcgaaagtgtagcctttgcgcgacatcgacctcacgatgccgacctcttcgcagatagatatccgcttctggctagcgctagtggcagccgcaatctgagtggattatacgatgcctgcgctgctcctactccaagaagcgtaagagatactcaatcacacctaacgggtgatgggcaggctgactgaaggtgcgcaagactattgatggtacctaccactcaaaacgttacacaaatcctaagagcaagccgacgctgtggacgaggagtgcgaccacataggccacgatgcactggaaggcaacgataccccaggcccacttgccgccgagctcacgctggattgcggagattgccgcgacgcagggcgtatagagcaggcagaaaaccagcagcgtaataaccgccagcggtgtaagggctacagtgagctctgccatggaaccaaacagcacggacaaggttgcgacgacgacctcttttgccatgaagccagcgataagagccgtggtgatacgccaatcgccgaagccgagtggacggaagatcgggctgatccaggttgcaacggctgcaagcattgagtcagcaggatcggtgaccatatcaaaggtcgggctgaaggtctgcagcaaccagatgataacggcagcagcaaagaccgtggtgaaggcacgggttaggaagtccttggtcttctcccacagcagctgaccaacgcttcgcaagcctggcatacggtagttcggcagctccattacgaacggaaccgcctcgcctttcgcgacggtcaggtgcgcgatacgaccgaacagaatagctatcaggatgcccaacaggtaaaggcagatcatgatcagaccgccctgcccagggaagaaggctgcggtgaagaagccgtagatcgtcagcttggtcgagcagctcatgaacggaatcaatgcgacggtgagtttacggtcgcgctcagaaggtagcgttctcgtagccataactgccggcaccgagcagccaaagcccatcagcatcgggacgatggagcggccggagagtcctatcttacgcaacagtttgtccatcacaaaggcgacacgggccatatagccggtatcctccaaaagtgacaggaagaagtacatgcccacgatgtttggcagaatcgggagcaccgtaccaactgcgttaaagacgccgtcgacgatcagggaatggatgaccgggctggcattgccggccgtcagcgccccatctacgatacccgtcacccaatcaacgaacatcgtgatcaggtccccaaagaacggaccgatcacattgaaggtgaggataaagatcgccgccatgatcaagataaacatggggattgcggagtatttaccagtcagcaccgcatcgatcttgcggctgcggatcgtctctttgctctccagcggcttgatcacacaggcggagaccactttgtggatgaaggtaaagcgcatatctgcgattgctgcagcacggtcgagcccgcgttccttctccatctggtgcacaatgtgctctaccgcatcgagttcattttggtcgagcttgagcgcatcctggacgcgcttgtcaccctcgaccagtttcgtggcggcaaagcgcagcgggatatccgcacgcttcgcgtgatcctcgatcaggtgcatgacggcatgcaggcagcggtgtaccgcgccgccgtggtcgttctcatcgcagaagtcctgtctgcccggaagctcctgatagtgggcgacgtggaccgcgtgctcgacgagctcgtcgacaccctcaccgttgactgcggcaatcgggacgaccgggaggcctaagatatcctccatacggttcacgtcaatggaaccaccgttgttctggacttcgtccatcatgttgagcgccaataccatcgggcggttcaactccatcagctgcatcgtcagatagaggttacgctcgatgttggtggcatcgacaatatcaatgattgcgggatgctcctgcaggatgaactgccgggagaccaactcctctgaagaatacggactcatcgaatagatgcctggcaggtcggtgaccttcgtgttgggatgccccagaatggagccttccttacgatccaccgtgacgcctgggaagttgccgacgtgttggttggcgccggtcagcttgttgaagagcgttgtctttccgcagttctcgttgccggcaagcgcgaaacttaaggttgcatcgtccggaagcggatgtgagtggtccttcgtacgggcatcgatataggcgccctcagattcctcaccgaggccggggtgccttacctgcggcgcctccatcaggctgtcagcctgcgcctgtaccgcatcctgagcctgtttcgcttctttgcgggtgaccaggtggcaggtgatctttgctgcatccgctagacgaagcgacagctcatagccgctgatggtaaattccatcggatcgctcatcggagcgtacttgatcagtgtgatgtccgctccggggatgacacccatgtccagaaaatgctgtctcagcgcacccgttccaccgaccgtatcaatctgcgcggtctctccgatttcgagatcccgcacggtcatttggtcatctgttccctttacagacggcgtctggtgttgactcatgctcatcaaccttcaatatgttgttttcggtagcctctcactacaaaaagaaggttaccatacctctctcatgtgtttttatcctataacacttaatttagtgcaatgccctcgttttcagatttctgatgcacaggccgaatatctaccaatccataaaatcagagtccttatcgtgcgatcgatgctctttgcgagctcgtcgtctgtcagagatagcggagacccctattccgatcgcacagccgatcaccacagcgaggataataacgacgacactcattgaactcatagttatagttctcccttatcagccctttttggtatggcacaaggatgccacactgagagctccggtgtcacttcagcatacaaaccccaataacctggatgctgtctctctcacgtccattacagtccttaggtttgagacagtgcggatattcacagaggatttatgcggatgaagccgatcggctccggtaatctgaagtgtgatctgatggaagactttgagtgcctcaacgcccagacaggtattcttggctcctgctatctcataggcggagcgcaccgcaagctgcgcgcctacatccaccgcgtggacggagacctgcacgttgttcaggttgccaagtgtggagcctctccgcatatcggagcggttcgcaaaggtctgataggggacgtcgttgcggttgagtatctcactcagcactgcccggctgaacgcgtcggccgtatagagctggttggccgcctctttgatcaccaggcccttgttgggggatgcaggtattggtggcatctgccacctcagggtggttgggatgcttggcatggggattgccacagagcttacgaggaaagactgcgccgccgagcggtagtactttctcctcggttttgccgagtgtcttgttgatgcgtaccaaggtgtcgtgcaggaaggcgaaaagcgctccctgtttggtgcttgagcccacttcttcgttatcaaagcagacatagacggacacgccgtgctcgttatccgatcccaggaaggcttgcaaacccgcataggcggattgcagatcgtccaggtgcggtgcgctcacaaactcctggactgcaccccacactgtcggcttttgacggttgacgaggtagaggtcacgcgcgaggattgcatccagctcacagctgagctcctcggcgatcaatttgtcgagaggtccctgtttaggttcccctgcagagaacaaagggcagagatcgactgttcggtctggcccaaaggattcattgacctcacggttcatatgaattgcgaggctcgggatggtcaagagattcttatcaaaggagacgggcttctcctcaagtccctttggggggtacgcgtatacacctcgcctgccaggctcagcggacgatcaaaccagatatagtccatcatgccgtcctaggcttcggtatcataactgtcagggccttgaagctccggcacgctcttcagcttgtaggtcgggggatccacataggaggtggtgagctggaagtgataggaatcaagcttatcccctaccttccaggtgatcagggacgagttattgcagatggcgtagtagcgctgtcccggctccatcttccaggaatcaccttccagcagataggttgtcccgacagcctcaagccgcttgcggagcgccgctaccgtgaagaaggtacacgagggacttcctcgataaatgtgtataacccttgtgaggcagtgagatagtcagtctctgacacgaagaaacaccctaccctctatacgatcattccgataatccagcagaccaagccgcctaagacgatcgtaaccggcagggttacaaaccatgcttgcacgatgtcggctgcgacgccccagtgaaccttacgcagtcccttcgcggaaccggagcccatgattgcggtggtgatgacctgggtggtggagaccggcgcaccgattgccgtcatgatctggatcgcaatggcggaggaagtctcagagacaaagcccatgaccggttccagcttggtgacgccggatccaacagtcttcatgatgcgctggccgccaacggaggtgccgattgccattgtcgtcgcgcaaaagatcttgacccacagagggatgccggtaccgactgcgacgagcccctgagagaccagggcgatcgtgatgatgcccatcgttttttgggcgtcgttggagccgtggctgtacgccataaacatcgaagagacgatctgcagccgatggaacaaggtgttcgcgcgatgcggtgtccagctcgcaaagagctcaaagatgaggcgcatgagtgtaaagccaagcgcaaagccaatcagcggtgaagtgaagagcgggatgatgactttatttaagaccccgtcccactgcacgtagccgagcgagtgcgtatagacgattgtggcgccgatgaggctgccgatcagcgcgtgggaggagctggaagggaccgccttccaccaggtgaacaggtcccaaatgattgcgcccacgagcgcagagaagatcacgtagagatccggcgtgatcgagacgatgccctcggcgatggtcatagccacactctcgtgcgtgagggcgcccaaaaagttcatgcacgcggacatgatgatcgcggctctgggcggtaaggcacgggtgtagacggtcgtggcgattgcattggccgcatcgtggaacccgttgatcaactcgaagaggaaggcggcgatcagcacccccacaagaagtgagctaagcattcttcagcaccacattcgccacgagcgtcgcgactgtcttacagtcgtcgagaatgtcctccatcttgccaaagattgtgtcccatttgagcaggtgggtcgcggttacgttctcctcgtcaaagagcttcgccaaggcgctgtggtagacatgatccccctggtcctcaatatcgtggatcatgccagcctgcttctggacttctttgtccttgcggaagttggagaaatgctggaagaggacctgtatatcgtggacggcatcgcggcccagcgccgccatctgctcagcctcgggataggtcgcgttcacatggaagagctcgtagcgccttgagacgttttccatatcatcgacaacgtcatccatctttaggatcaacgcggagatatcctcgcgatcaaacggcgtcacgaacgaattattgagaagatcaaagatcttgctgatttctctatcgcaatcgatctcgtagtctttcatttcagtgatgcgatttgcatgtttcggatatgtggaaacaatgtcatagtagcaatctgctgcgacgaccatcttgtctgcaagctcctgaaataatacgtagaactgatcttccttcttgcttacacgagacatatggcttcctatctacgctcagttcagattacgaaatcaatacgtaatcaagtataaaggtacagatgcagagccgccacataaaagtgccctgatagaccatcaaaaaccaaaaattgtattgtgattgttactttatcgggggctttctaacgtacgccaaagcatttcgcccttgtgaatatatgcacgtatatatacaggtaaagtggcacgcccgtttggacaacgaaatcggcttcagaagtgaacccggtaccttttttcctgacggccttacgccgccatcagccctaagcgataccagtttgaggggcgtctcgtagctaagtagctggtggagccgctcgttgttgtactgcttagcgtaagcccgcgctgagccttcttgagctcagtgggcgctttgtactcgttgatcctcacgcactcactcttgaggcttctagatcatctcttttgcgatagcgttgtcgacccacttggccttgccgtccatgctctggcagatgtttcagcaagctagcaggcctttatacgttgcagcggagaagggcgatccctggtcgaagttggcgcaggagggtctttgtgctcctccagtgtctggcacatgcactcgcacacgcctgcggcgcccatgtcggatgagtccttccggcccgcgacgcagcggaagaaccaaccgatcacacagatcagatacaggtacaagccccctatcggaatgtaggcgatctcgacgctacctggttggggaagcgtatcgccttgttcttcagcaggcaggggtgctttaccgagctcttggccggcttgggacaggttgggcgcacacccatcttctccatgagcctttgcgcccagcacctcgatgcctcgagcgtacggcttatcttcctcgcgcctgcgtaagggctgcttcaggtggacgttatccacgatgcgcatggtgcgcttgcgattcgatccctcaaaagagcgccagtgagggcccttggccttgtagtaggtgaacctggggatctacagctactggagctgcctgaccacgttgatatcagcgtttcttggatcgaccaggaatgtcttttatgttgatgctgtagcgcttaagcacacggcgttgaagatagtcgcgctcgccaatcttgcaatgaggctcactgcacccccgctcgtccttggacgctgtgaacacacgctatctcaaaggtagcctttgcgacctagttcttgaccaggttggggtttaggtcgtgctcaaaggtgagctcgttgacggtcttctttgcgtgcttgtgcacattgtgcgggttcacttcgtcaggccaaatcggcgtccagttttaatgtgccatattaaggtgcggacaactaaacgaccttgaactgatcgaattttaaacattccagtattacactgttcagtaccctgctacccttgcagcgttaggcacaaaacagacccctgtcccgcagcgtcatggtacatggaaaatggaatctgtccccgcgtgcagcgtgcaaacgtgtaggaaatactggtagatgataggtatatcctgcctttgtgcagatacgtgatagattaccgtaacgtgctaactctttctatttctacaacccgactaccgtaagaattcaggtttttactcaatgaatctgttcacaagacattgatcaggcaaccctcacgatcttcccgtggttctctctcggggatgaggactaaccagaacgcggaaaaatgaagaagcctgtcgatgctgatggacacctgtgaggaaactcccctgctgacaagcttctcctttcctttgattctatatgccgttggcttggctgacaacaacaagaccatctgtgcatgtttggtaccaagcgactgcgccgtgaagacacggtgacccctcacccgtaacctctccaatacaggatcgatcccctaatcactcagcgtagtcggtgatgcagggaaggaccgacaagggaagtgggatgaccgcgatccgcacctgcgtgactgaatgtcgccctatcaggaaagcgccggtctccgtcagatctagggtaggatcgatctggaaaaccacggcacaggagcactccgtggctacatttcaatggtcggcttgtaagttcatgctgctcgagccgaaagtacaaaacccaactaacgtccacaccgctacttcgggatacccctgagatgtcaaggagaaaggcgtacccctctccaacatccatcacatcacctggaaggatcgtcgcggaaagcccccttccgtgagaacaatccccttcaaaaagccctgctgaagaatcttggaaacttatccctacatggcaccacaacgctcgcctttgaggattcctggctcaaccatcacctgtaacggctattcagaggcacggagggcgggcgagatcatcccaatcgaccccgtggacatctgcaggctgatgtgatccagaggagcctcaactgaaggcgtgagagtcacccccgcagcattggagacactgggaccgtcgtcgcactgtcctcaaaaagagtcaaaaagagcggcaacttagccttggaggacgtggaacctcatgttacaagaccgtccagggcggaatatcaagagcgcaatatgtttgccgtatcggttagcataagtgatgctccacaatcttttagagaatcacaatgagtccccctgccgtagatagacctatacgacacaggggatttctgtagaacgggatctatttcacgataaacggtgtgacgtgtccttcacgccttcaaggtaatcgaccacccttttgccctccatacggcggcgcagctcctcgatgaggaatacccttactgcaggtccgattagttcacaccagccatgacacaagtcgaggaaggcgtctgcccgtgacggataccgccggcagctttatcctcactgcaggatcgatacattgagcatcaagcgaaactcctcggacgtagcccccaccttttgcaaagccggtgctcgttcttaatgaaggtcggcttacctcgctcgcaattactcacacagtgttatcttcgcaccctgcgacagaagacagtactaagcgattacctttgaaggaacgtgtgcttcgttggcacacatcaacgatctgcccgcatctcgtcttcacaatttccgcagttgcggctttctgacttcggtcaagtgaaaacgtagtcgatctcatggcgccattgcaactcattacctttgtctcaacaccttgtaactatgttggtctgccccaatggaaagctgatggccgcacccggtggttatatcggtcccccacattcagctgctctgaacagaattttgatgacgctctgagttatgcgcaccatttgaagttgatattgcttcgcctcatcgcacagtttcttagatcctcattgtcacatcggctcggaggtggtgtggtcaatcagaccgacagaaatcatcgagggtatccgttcatggcaggcgtcctttcccttggggccaaatacacacctcaatttcttggctcaccaggcttaaccagaggacgatccccaaacgtatcttccttaaatcattcgtaactcccctgttgaggttgtgtcgacagagaaaagctcggagaacactccctcttctccgagctttctcaaaataaggaggttagttagttgcgtgtgtatgtcaggtacaactactcctctctccaagaagtgctgagactcagatatcggactgagatcctctccaacccttatacggagagtacttcgaaggaaagacgaaagatctgtcacttcctattcatttgaggctcttatacccccgtgactaatttcactgcccccttcaaccggtttacgataacaggtctcctcgtaacctgccggaatcaccgaactcaccaagtttggtgacaagcttagggatttctcgttgtccatagcttgtgacgcttgccttcaaagttcatgttaccgttgcgcataccattctccttaggtttgtcaacgcttttccgggaacgtatattctgagtcagtatcatagtgaactcgacactgtcgagttccgtttcaaagtgtcgatttatttttacaacctaattcaccgtttgcacccaaattcaacgtgtcaagtttcgttcaatttaataccgcaaatccaccgtttcacaacgtctaccaaaggttgagtttctacgagtcgctgaccggttatctcgatatgaaatacgcagctgcccaaatagagcgggctggcgttccattatctcgacctgcaactctaatcaattttagtgacccagctggcaaaattgaaccgggtcatacgataggttgagacttcgaccagcaagcctggttatagagatgtttgcgtaggagcttcagtggtcctcatcgccgtccttttgaggacttaccagtttggcgaacacggtgtgtggggtcgagctcgagcgacacgcgggccttcgtgggtcttgtcactctggaacccgcacgataacacggctccatctcaaggaggaaccgggacgttgctggtgatgcgagccggggtatctgttgagccctgcgggacggtcagtcggtaacctggtcgcccagcgcattcttcattgcgtccaaacagatccttgttctagtcggtcgcctgcttggcctcgtccttttcatccttcagttgcgaagtccaacatcgacttggatatgtttttggaactcgaggtccacgggcatggttgccacttatgctcagagtcaccggtaccgcgtcaattgtggtagctcctcatgatctggaacatgacctcatcgaccgtcctgcctaacacggagaacatcgtaccgctgtttgattgcagagtcaccaccggcatcttggccaggcggtccctgagactcgcctgcggcgtagctgtagtcttttcctgatcctcggcactcgccttcacgtactctttgaaggtcacgaacttcttctcttttgcggcagaagaagagcatgacgaggtcagcgacatctgaggcttttggagccgtaggagttgtagatacgaacttgaggccacggccgaagcgctgtcgaagaatttgatgtagttctcacggtcgttgggtccttttccaatcttttccctttgcctttcctcccccttccatatccctttgttgcctgggcacgattctcctgtccttcatggtgttttttagcgtgggctttttatcgctttgctctctttcccttccgtgcccattgacgctcatttccccttttcccttttctttttccactatttcgccctgttcagtctctgccttttcgcgtcccgctcttctcctgccctgttctctaactgtgctgctctgcttgtgtgctcttcttcatcgctttgagcttccggttcttttcgggatcatcacgccgtgcttgtatgtctctgtgctatttgatctttgcgcatcttctcctatcattgtcttttcttttgagtccgccagtcctatggctcttctttgctttccatgttgttttatgcgtattgctcctacccttacatctctctgtcactttagtccatacttttttatacccttttagatgggtcgggagttctttctcgggcggggacgaacgggttaattgcctctgtgtgttctatgtttagcttatccggatccacgccgtactgcgttttagtagggaccgatgtttgcttgcatcccggcgatatgttagaagttgtgttgggtgtaacgaatggcgccttcgatagtcacttgcgtatccagatacaaacggagcactgtgaagaaggtactaacagagcaatgctcatagctcacagtgcctcctgttggaacttaaggtcttgagtggttttgccaatcgtggaacgttgtggactcgtatagaaatagctcgtagtcctttgtcgacctacgctatttcggttcttccagatcgggtcatcgattaatgtgtcaagctctgtagtcctcaactccgacttgtagagggtcacctgcatcacttcggctttggcttctgtctgctctggtccaccacatcgaatcgggtgctgcgcacgtaggtgagtactttctaatgagtccgcagtgtgtgtactcattttgcaagtacttatcggtatcctcgtcctctggaaatccttcaggtagacgattacatcagtgcgttggcctccgcattcggagcgctgtccggcttgcagtatcgatctgtatccggtgataccgtcagaattcccatgcgtagtttctccgcaaccagggcacggcttaaaacggactcttggcgaacataaaggcggcgttagaaccacgccaaactggcccaatgatatcgagtgagtccgccatcatccttattgccggaggccttctcaatctcgtctttgaactgtttgggacccgaatgagacgatcggccccgttcttatccagctcgtctccggtcatcccgattccgttatcaataccggaatggtcctggcatccttgtcaaacgacacattgatcggcaggctcttctggtcatcttcacggaagggtcagtgcaggctcttaaagcgagcttgtcaattgcgcggaggcattgataaagctcacgaaggaaatctccttagttggtgtagtaagttgatcatcagatcaagaagctttttactctctgtcttattgtttcatgtacagtccttccaaccaaacgagtttagttatttgttgcatacctttagcgatgtacccgcccctcccatcctatagcaactaagaactataaaatctcagctatcagcgctaggtcttggatacaagagactaccacaatacatattagtatgatcatctatgcgctgctacacacaagaactgccgggggtaatacatcacaacaaaatggaaaaactacggcaataccaggaggcttatcatggcttcattcaatttgatcaaagacactacacgtgaagagcgcattgaaatcgtgagaaagggactcgcattctgcggtggcggcatcgcttcagaactgcagtggcccgtcaatgggtggtgtttctatcgacacaatgtatcagccctaatatcgacggcgcgatggagtctaagcagaggtcaatattatgaacgccgcagaccatacagttaggtgtttatgcggacgtcttgttccatctatcacttagcggtttagcactcaaagcggggattgaccgagacgtcctcccccccccctgtctcgtcgtccccactcgatcgcaaaggcaaatcgatcgacggcagagcaagaagctcaaagtcaccttcaggaacgccggtgccttcggatcaaagaacttctttcctgcgcttgtgcgcagggctctgctttctgcggtacgaggtgcatgttttggttcgtactcatcacctgcaagtaaggcttgattatatgacccacagtacatccctcatctgcattactcccccttgatttccctcgcaacgatgagacttcctcgggtccttgcattggatatagcgggcaatggtaccggcatttacagacttgccgccacaatctcgtggctcctgtagcgttgacaataccctggtgccggcctcttggttggatgcagtaattaccggttttcgtccttccctgccacctgtgagggagagttcccgtattcaaacccttcaaccttgcccgtagcgctcaccaaaggtgattagtccatggtgctcctttctgtatgccagcgcttcctcaattgaaccggattgggaagatcgctttggcttcctgtccaaagagatcggctctcacagcgagaatgcacggtagacatcgatgattaccgtaagtcctcgggcctgcttagcgccctcaatacaattccaattccgaacattcatggtctatacatgctcccaatatactgtaatcaataatctgtacttatagctaactcatatgctaatgcattttccatttatcctaccattctgcattcatgagcctcttacctcagtagagaagacgaatccaaaaggttgattggatttaacttacttattcttataattggtaagcatcacccacccccccccccccccccccccccccccccccccccccccccccccctcaatcagaatacgctggcttgttcatttttgagattttatcaatctattgatttcggtttgcctatttccaagagacataatctcttgaacagccttacgtactctatatcactgttctgagcaaaaccaaaagcaagaacacgcgttattattatcaaattcgactgcgcttttgcgatatcaataggcgccagcaatccatccagtacatcatcgtttgactctgcatgtaggcagtgcgattacccgtctattgataatcatatatggccctatttctcctacgttttcaatagcatggtcaacataaaagccctaccagattattctcacaaattcagtaaatccgctttttgaattccatctttccaggcttaggcctagattcattcgtatgaactgcataggcatttattttttagaatttccgactcatggcttctgtattcaaattcctcaaagtccttcagtagtgctaactgtttgattattataaattatctccatttttccttatgtttcctgatttcacgatggggctaccaattggatcaatgcatcattatctttcgctattctgcttagaatcatgctgtatttttaaaccttagcttggatattatgatgtcactaatcgtaagcatcggagacatttctttgacatatggaacagtttaactgagtacatctacctatataaactacaaatctaggtgcctgctctctaatcattaagttgaaatcgttgttcgtattgaacaagcgacataaaattgaagtatttttttttttgctcttgaaggtactcacctcatggc

SEQ ID NO: 296 - DNA, 24848 bp, Unknown
  Metagenome-assembled genome
gaatttagagcctgcctgcaccatctgcagatacttggattgatatggctgatgtacttggggtactgtcattctacgggaggagtatttcatgtaaatggacgctcctatagatgtcaagagcctgggccttcgacatctatcggcatgctctcgagcacccaagcggaatacctctccgtaaacatccagctctcgcaccttccggactcaaatccgctcaccgtggaaggcgacacctcgagggcatgcgcgaccttggcctggttcaggccggcgctcttgtgcgcctccctgagtgaaaacctgtcgacccgctcgacctccgtccctgagtgcatgagcgtatggtagacctcgcgcgcgatgtatctcttgacgcacctgattgcctcaagcttcgagagggcgtgtggccccgacatgcgccgcttaacgtagccttttgtccttggggtcgtatctcatgcgcctcgctgtgacggtgtgcagcgccttgttggcacgccggtcagcgcccctgttgaggtatatgcaacccgatgtcttgccagacgacgccgggatgggagacgttttgcacagcatcgcgaatgtggccttgctccttgagcctttcggggttgtcgtctgcggcgacagcgggctcggaggcgcccagggtcttaaggcactagattgtaagcagcgacgggcagtgcttctcgaccacgcccctcatgagggactcgagggtgtctgcctcatccctggcgcccttcccagcgcgtcggctgcgccctcgtcgatcttcagagcagattccatcatcctctcctgggacatgccctcccagctgctgcgcacctcatcgggcctgacctggtaagcgaaagcgtggccgcatgaacctcgagcgcacaggacacgcagcgcttgcgcgccacgagcagcgacctgagctcgtcgagcctgcctcagcgcagcttggggatggacgtcccgtcggctgcgagcacgtcgcgcgcagccctctcggcgccaatctcgtcatccttgccctcgccgcacctccttctttggtccttcttcttgttgaggacctccagcaccctgagtgtccgtgaggccagctccgtaggagcacataccctcgaagccgtccggtgtggacagaaactcgcgtgacagcgcgaccctttacctctcgtccaagacgcacagccagtgcgtgtccgcgtgtgtgtcgatgccggcgacgatcttcccctcgagctttctgtccgtgagctctatgcccttcgacatcttccttccgtcccttcctcgcgctttccctgccggccagggtaggcgagacaaagcagcgaagggagcgctaacatagggttgtgtgggcccaagcctgcgcttaggctcctatcaggtcatcgccaggccttagcttcggcccgtggcacaggacaggtccatttgagtgcagccccctcggggcgtaagctgcaaagatgagtcgtcgcaccacggaccaattatctggcctgcccacgtggacaggtcaactttgaattatcggtgctgacaactttaagcataagcccaacacttcctgtcggcttcgagctgcatactatgggtgaggggctgatgcatctaaaagatcgggaaaagacatggccaaggggcatgcaggcgcacttaagcatgaaggaatgtgagagcagggggaccttggtggagcttctggagaggttctcagacgagcaagtcctgcaggcaaaggcttatcgacgagaagttcccgcaaggggttcatctgccctatctgcggccccacgagctgctcacaccagctcagcgtgagcgcaggaacgatgatggagggcacctatcttgccctaagggagtagtttgtcgcgatgtggttcatatccagctaaaaggcagggatcagcaccaggcaggatacagctacaagacggccgggtacgtgctggtaaggatccgctgtgccatagcaagattgaagtgcctccagcgtcctttctgctgattgcgcagcagtcgacgacttctacatagaagtaagatcaaaaggcacgaggggatgcggcacaaagcagcagcctatgcttactgcgctggacagggctgctgcgtcctgcgctgcgtggatgactgctcgggtaattcctggcaacagttcgaacacgaccacctcggtcatatgtccaagatctgtgccgatgcctggagtaggatatcggcagggctggattgcttctgcgggctcgtctagaaaaagtacgacagctcatacgatgacgcctcacttcccctgaggcccacaggatcctctcgaatatcaaggcatatgtcaaaggagcgttccacgaccttccgaaggcccatatacaagtcgtataccgactcgttcagctaaagatacagccacagggattcttttgatgcttggtgccgatctcctccacgggatgtgcctcacacacatcccgctcgcaggcatcgcggccacactgcagccaaagttgtctaagcagcttacaattcatggagcctaactgtgccgcaagtccttagccattatatcaatatcttgctgtatgcaatatattcactgacgcctaagaacaatcactgtgagccagaaaaccattcgagatacctgctttgctgccacctcatcctttccaccaactagcgaaggaagacactcatcacttaggtgatgatcacaaacatcacttagctctcactaaagaatcgctctacagcacaccatccaaatactccacatgcaaaccgacaaagaccatatccactgcatgatccacccatcgccttccacatatgggagacccacgcatcatagttgtgccatgtctgctggcataaacatacgttctggtcaaatggatacttcattgccaccacaggtgaagtcagcgctaaaaccctcaaacacttgagagctaaggcagacatgattgggcgacgtttcatcctgcgagctgaagttccatgggttttcgcgccacaaatcttctataattcgaagccggcatcgtttacaagacacgattttactgaggcggaaaatctctgatattcgatatggcaccatatttaatgctcggcggtctaaaatcacagcacacaataggcacgctatgtaggactgagaacaatcattaacctgatacggttgatctgcggtgcactagcagcatccgatatagtattcagtggcccttgctcttgatggccgcagccagtgcatcgaagccatggtgaagacacatcaccgggtggtcgagcagcatgcgcggccccgcatagcgcatcacctcacggatctgttcacgctgcttcggcgcatagcagtgcaccgggcactgtgagcagaagctcttggtctgcatgaaagggcaacgctcaatgcgcttgcaggcataggcggcgagctcagcacacacagggcagagtgcatcgtgggtatggtggtgatcgtggcagtagaggtgaatcatctggaggaccacttcacactcgcgtgcccgcttgcgttccgtctcctccactgtgcgttgctttctcacagctcctccccttctgttgcatcctgcaccttggtagggatcttcacccagaagagccagaggtggaaaagccacaccccggcgaggatcacgtggtcccatacgatacgggacatggaggcaaagctgatactcaaaagcagggtcagagcaccgaaggcggctatcttatcctgtacgctcatgccctcgtccgcagcaaccggagcaatcttgctcttatagaactgtgtagggcagagccacaccctcagggaaggcgagctctggctgaagaagaacactgtcagaagatacagcgggaccgtcggcagcaaggacaggacgataccgacagtaccgaggacgaagaagaaacagcccaagacaagaaaaacgatgcagcgcatagtcgcctccccactctctaacttacacggccccgatcgattgagactaccttgtccgcaatagcggcggaacttggacggtgcgtgatcaacatgatggagcacttggagcgctgcatatccagcgccttgaggattgccccttcgtttagggcatccaaattcgacgttggctcatcaagcaacacaaacggtgcttcatgcagaaaggcacgggccaggcctaagcgttggcgctcaccgccagagagggtgtcaccgagctctcccactatcgtgtcaaagccctctggcagacttttgataaagtcaaggacggaagctttatgacaggcttcctccagctctccctgcgtagcgtccggttttgcaatcagcaggttgttgcggatgctgtcgtggaagagcatggtctgctgttcgaccaacgcttcctgctgatgcaaatagccagtcttgatgtccttgatattgtctgagccgatacagatggcgcctgagtccacatcccagaagcgcataaagagtcggcagagggtagacttaccggaaccactcttgcctaccagcgcaacgatgccgcctttggggaccataaagttcacattgtttaagacttgctcttcaccgtaggagaagcccacctgttcggctgaggctccggtgaagaccggctcggtacccttagcacgctcctgcaccagaggttcctcatcgaggatcgtcagcacccgctctccggcagctagggtctgctgcagcgtcgatcccagattcgctaaagcgataaaggggccaaacgaggagagcgtcgtcacctcagccagcacaaaggcttccggggtgaccatactctgcgagatggcataaattcccacaaagagctgcgccagggcgtccagaaccataatcacattgaccgcaatgctgccgccacgcgctaccctgtggagccgcttctgttcggctgcaaggctacggcttttctgatcgagctctgctccccgtttgactcccataccatattgaatgatctgatcaagcccacgcaggttgtcgagcatggtactggagaggcttgcctgctgttcacggatgtctacaccgactgaaccggaagcgtgcgataccacgagcggcactacgatgcccaccgcaaggtagcctgccaaggcaatcagtgcaaaggcccatgacaggtttgccaaaaaggacatcaggataattcccgtaccgatcgcaatcagaaccggggagatcgtatgggcaaagaagacctctagcagctcgatatcacttgtaatcgtcgaaattagatctccgcggtccctgccggagagtttggcgggagccaacgttctgagcttcccaaagacaaggtcccggatatgcgccaaaagcttgaaggcgatgtagtggttgcattcctgctcgatatagtggagtacaccacgggtgatagccagaatgaccagtacgcggcagaaggttgcaataccccagataagtgttgcagtgccgttcacggcgagcatcgcctcaacgccgaccaccggcagtgcggtcgcacagacaaagccggcgatgccagccaccactgatatcaccatcactcctgccagagggcgtacaaacccgagcattcgccccatgatcctaagtttcttcacagatctcaccccttccataggcttcaagtccctgttgggtcttccacagccgcgcatagacgccgtggatatcaaatagctcctggtgcgtaccggattcaatgaggtagcctttgtccaagacgtagatgttctgggcatccaccacgttcgcgagtcggtgtgagatcaggaccaccgcatgatcctgtgctagccgatagatggagtcgagcaacacggcttcactctccacatcgatgttgttcgtcgcttcgtcgaagacatagacggaggaatcgtgcagccaagcccgcgcaaaggcaaggcgctggcgctgtccgccggagaggttgttgccttcctcctcgagcttggtatccaagccttcctgtgtcctaaggaagccggagaggtttgcggcgtcgagcgcttcccaaagttcctggtcacttgcgtttggatttcccatcagcagattgtcccggaccgttccggagaataagtaggcattcgccccgacataggtaaggtgtttcgcacatgctgcctgattgagtccactcaggtctttatcaccgaagcaaatggagccacgaaagcctgagagctttcctgcggcgagcgccgccagcgttgacttccctgatcctgaagcgccgacgatcgccgtgacgcccttctcagcgacccgtaaggttacaccgtggatcacatcccgttttccgtcgtaggcaaagctcacctgctcaaagcggggtacgctgccggggaccggcagctccttcttctcttctggttccagcagttcaaggagcttaaagatcttctgtgaggcggcgatcccgttcattgcaacatggaagtaggagcccagctgccgcatcggtaagaagaagtccgctgagagcaggacgatgatcaaggcttgctgaagggtgatcgtagaggcctgcagttgcccaatcgccacggagatacctgcagcagcgccacccagcgctacaacatccatcacgatgatggagttgagctgcatcgtgagcactttcatcgtcacaatacggaagtgctccgcctcgtggttcatcgccctgtgccgcgccgcatccgcctcatagatcttgagcgtcgtcaggccctgcagattttcgagaaatgagtcgcccagctgcgtgtattggtcccagtactgcgacaggatccgtttcgcgatcttctgtaccgccacagtcgtgagtgggatcaacggtacaaagaccagcaacaccaccgcagtagcgagatccatcggcgcaatcatcgcaaagagaatcaagggtgcaatcatcgcgtagaacagctgcggcagataccgcccaaagtaggtttccaactgttcgcagccctcaaccgagagctgtacgacctccgccgtggagacctttgtatcgaaagtggggcccaaccgcagcatcttctcaaagatacgattccgtagtgtccgcttcacatcctgtgaggcacgcacccgctcccctccgcatccgtaggaactgatgcacttccccacaccagcgatcgcaatcagcatcacgcagactgcaagcgatactgctgtgccggtaatacttgatgcgagtaccgtcgccacgccccagaccaggcagatattggcggcaagccccacgacttgccaaaccaccaccagtatcacgtggtgaaacgctcccggcaccagcgtcagaagcctcctatctatcatggtcccctcactcaacagtctctatgtgttatccatagcttacttattactcaaagttagcttaatagaacaaacgactgttgtcgaggctagagaacaataccatccaaaaatgcacggttgggagcagagctccctacatacgcgaaaaggccacgatcatacgactgtagcctttgaccttcactggagccagctatcagactcgaactgatgacccccgctttacgaggtcgtgtatattcatctcaactggagttttctgatttcaactaatttcatataacaccacgtaaaatagcatttttcttaaatctaatgctcatgattagatttagttttcaccctaatttcacccttttcatccttgcaagggtgaaaactttgcgttacgctcagggccaagactttacgggccttggccttgagcgtaacgcaaccaactattaactactcaccatccgaggcgcccatggaacacagaatcagaccaaatgccaagggatacgcagagcccatagcccatcaaaagcaagccaggcgtgtacagactctacttctccttgggtaaggaccccgagacgggtaggtatctcagaagtccgaagcgcacctttcactgcaaaagcaagaaccccaagaattggtcgaaagagtgcgagaatgccctcagcgcctatcgaaccgaactagaggggtcaaggaagcacgagaatggttctcgttctgtctccgagtacgctgagaacttccatgctctaaggaaaggcacctttaagtccccactcgcctacaaacgggaaggagactacatacggcacatttgcgcgcttttcagagacatacgcctttccgacctccgcccagacgatatcagacacgcctatgccgatgcgcgaaaagacggcatgtccgatggtgagcttcatggcacacacgtcaaactccggcaaattctgcaggatgccgtagacaacgagattatcgagcgaaacccctgcacgccggtgaagctctctaagcccacctatcgcgagcgaaaacctctccctactaaggacgcatcccgctttctcacctgcctgttaaaggagccgctttcctcaaaagcggctggcactatgctcctgctccaatgtggcctcaggcgcggcgaaatgctcggcatgacctggggtgattattcagcagagaatcggacactaaaaatcagcaaacaatacaccaacgacaagacgctccgtccccccaagtcgaagatgagtagaagaacgatagcggtgaacgagacgcttattgactacctcaaccaatggaagtctattcagcgtaaacaattgggacgttacggtctagatcaaaacgagagcacacccatcgtcaatggcataaaggtagtgacgaccgatgatgggaagcacgctacaatcgtcaacattgatggccataatttcgaccgatggttccgcgatttctgcgttgacaacggcttcggcagctatgaaaacgtcactgggacgttcttgcgcaacggaaagaagcacgtcaggggcactggctataccggtcttgtcccacatgccctccgccatacccaggccaccctcttgataggagagggtgcagacgtgaaaaccgtgcaggcacggctgggtcatgcctcgcccaacacaacccttgccatctactctcatgccattgaagccaacgaccgcaaagcggcagacacgtttgcaagaattttggctaaaggaagatagatttatttgactttttcttaaatattgggtaaagtatcgataaatgaatcgggtatcacccgacacagacccgtaatcaacccgcaggaaaggaacacgaatgggcatcaatcctctggggtccaataaaaaagcccgaaccacactcatttttaacaaggatgtagagcgactggagttcaagaacgcactctcagacatagccaccgcgcgaaacatctctccgtccgaagcagccctcgccctagttttagaacatgtggcatccacggctaaagcgcgcgacatagcgcgcacgatgtacgcctacgagtacccccgctgcctcgacggattggaaatcatattccaagatcttgctgcacagggcgaggccggccgagattcaaagcccgtcctcacaaattttcttgaacttgcgctcgactttggcctgagcatcaacaccaatgacgatgatgctatctaccttgtagaacagtggcactcaatcattgatgtgcttgaaagtgcatcgaagaacaaagagcctgaagccatgctcgctgcacgtgatgcaagccaactcggcactacccttgaggacccctgcgccatgcagataatctcccccctgctttcctgtttgctcaaaaactgggatgtgctccgcactcaatccagtacctatcgcactctatgctgcttcgcgcgtatggcctttcccacgcgcaagggtctagaagagaccgctgagacacgccttgcatttatgcgtacagcggatgagttctacgcgagcggaaaggagggcggcctttaggcgacaggccagctcggacaatatcggcagcccgccctccctctcaacgcttcccggctcaggggggaggacgagcagaccaaaggatattctatcatggagtctacttctctttccaaagcgggggtcgatgcccccacgaccggcgtcgttctcggacgcgaacgtctgcttagcattgctgacatctgcgaactgaccggcctcggcgaggcaaccgcttcgaagagaccggctgctgcctaaagctgcacagccgcctctacgtcatcgaatccagcttcttcagctacctccatcacttggaggtgagcgagccgtgccagtaaaaccccttgcctttgtcggagaatcgcttgacgcgcttttcatgcgcgcagtcaacgaccagcccatagagcacttcaccctgcggggcgtcgattcgcttatcggcggggtcaacgccggtcgcctcgtcatcatctcgggcgaacccggtgccgccaagacgaccttgctcggccagctcgccgacgatttggcatccaagggccatccggtgctcttcttcaccttcgagcttgcgcctcaggcacttctggcgaaatcactggtgcgcctcatcgattccgtgagtatcggtgatctttcgaacgcttaccatgatgcggatagcgcgacgaaacttgaaaacgctcgtgagacgtaccgcaagcgtgcaggcactcgccttgcctacatcgaccgcccttgcagccccgtccaaatgggccgctatgtcgcagactgtgaaaaggagacgggactcaaacccgtggtcatgctcgactacctccagatttgcgaatcaagcacagagcgcgccgttgtagatgagcgcgtggccatcaaagaaacagtgatggggctgcgcgatatcgccaacgcttttgacgttcctgttttcgccatctcctctatcaatcgtacaagctacgagatgaagccgacgctcaaatccctcgggggctgctcgttcattgcgtacagtgccgataccgtcctccacctcgcggtcgagagcaaaagcgacgagcgcgagcgcaacctcgggatgagtgtacgcccgcttgtgctcacagcgctcaaaaaccgctacagcgttacgggagccgcgcgcctcgacttcgagccatcccatgccctgttcagagaccaccttgaggactactcccatgggtgggcacggtagttccaagactgcgcacatcaacgtcaggatgacccccgaggagcgcgccaccatcgtggcgcgttcctcgcacttcggcatggcaccttcaacgtttatgcgcgaatcggcgcttttacgcgatgtaaagcccataaaggttgctaacatcgaagagctccacgccctcaggaccgatctcaaacgcgccggaaatctgcttaaccagtcagtccacctcggacacacatacggcttggacgatttaggtcttaagtcactcgaaagtgccgtcagcgaagtgtccgatgcagcgacgcgcatttccgcgcttctggcacacgcctcagataagaagtgaagcatgaacagcatctatatcgcagccatcatcgcatcattcgtcctggtaatccccatagttccgtttcttgccgcccccgcatcgacaatacttcatggggtagttcccaatcttcccgctatcctgaacagcatggaaccgtccgccatccccgggtggtggttctctgacagcttcctcgcttgcccggacggactactcgccacgtgggcgctctgtctcgccgtctccctcctcatggcactctctagcgccgcagggaggcgagccgatgacggcggtgcgctcggccgcgcccacatcaaggaaggggctgaagcgttgcgtggctccacaatatgggatggtagacactcgccaaaggcacgtggatttgtctacggattcacacggggcagatacctctttgaacctgaacgctttgtgcttctcgatggatccacaggctccggcaagtcacgtttctgccttatcccatcaatcgacctgcttacctatgggaacgactccaatggctccagaccgaacggtatcctcgtctcagatgcaaaggacgaaatgttagagttaactggcgaagaacttgagaggcgaggctacaatgtcctgctgctcgatacacagcatcccatgcgcggacatcggtacaacccgctccagctccttattaactatgcagatgtaggactcatggaggaggtggaacaggctgcggataccatctcagcggttatcatccccaacgaaaaaggtgaaggcaccacgcactgggtcgagtcaggtcgtgcattgctctctgccgccatcctacttgtcgtgctctctaaagactgccccaaagacgccaagcacctagcgaccgtctacgaggttatctgtcgtggtaccgagggtgagggtaaagaaccagccgaaccgctcaaagcgtttttcgctcgctgccaacgagacatcccgctcgctcccgcgcctcgcagtttctctccagtggtggcaatgagctacgcagcatcatctcgacagtgaaggcccagatgcgtatcttcggctcctcctcggtcatgtggatgacctcagcgaatgacatcgacctacatagagtcctcacagagaagacagccctgttcctccatgtaatggatgaggcgagcccgtataacaagatttgtgctatccttctggatcaaatctggtcggcagtgcaactcgctgcggactctgaaggcggcactttgagtcgaccgttctctatcgtaggcgacgagtggggtaatatccccgtcgtccccagccttccaagcatcctgagccttggaataagctatggactgttctggctcggagcggtccagaacatcgcccaactcaataaatatagtgagcgcgatggccgtaggaaagttcttgccaactgcaatgtaaaggtcgctctcaagctggacgaggcggaagaccgtcagtatttcacggagttaatcggcaaaacaacgcgccacacgcaagggaaaagcacgaacaaggggacatccggaagcagtggctccacaagctacagtgagcacgcggacgacgtcattcatccctgggagtggacggagaggagtcccgacagggatggcgcaatagtcgtgaagatggccatgaatggcgtcccgacgagccatgcgggaacattttgcgcaccactggtggactgcaccaaaaccccgaccgaggagcacttcaacctcgggacacgcgagcacgagcgggagagacgaagggcttatcagaaaaagcttgacgcccgtgccaagtcgcacaaggacgagcgagcacccgtctggtgccctgagtttccagaagaaaatacaggagaaagcacaggcgactgggacgggcttgtgctcgactagagagaagaaggatgccatgacaatagtcaaacagacgagcgtaacaagcagagggcacctcgaccgactcagggcttatctcgattggaacaaggacaaggtacttgcacacgacacccaaaacatcatcaacgaacggcgctggttcgaggagatggacgagacgcgcgagacgttgggacacaaccgggcgggaaagacaggctgcaaatgtacctatatgcaacaccaagttttggccttcaatcccgatgagtgcagctgcaacggtggaaagatgaccccggagaggtgtatggagtacgcccgcgactacctccgaactcgctatcccgattgtgaagcaattgtcgtactgcacgttgaggtctgccatggagatgacagtaagaggttcgccgcacacatcggactcaaccgctcaaacctctccacggggcgaagactcgatgagggtcctgcccgcaaggccgcagccgcgcgcgtcaagactgtccgcgagcttgataagcagtacgatctgaggcaactcaagcgtggtaaagcgaactcgagggcacacgcgcgtcagcccggggcggcagagcgtgacatggcacgtaaaggtcaggcggagcggtcagagaacgcccgtgtgcgtgagaccgtcgcccgccgcatagacgaggtgggcaggttacctgagtgcgctgaccgcatgagcgagctgtcgcgccgtcttaagaaagacggcatcacactctcccgctcaaagggtggacatctgcagtatcgcttccaatctaaagcgctcggcggcgaacgtaagataaacggcgcacgacttggcttcgcccgaaaccgctcgacgggagcggtgatacgcttcaccttgcgcggtgtgagcctcggtatgcggctcgcatggcggctcgccaacgaacaagaacgcggccgctgaggcagtctgcgttacacatctcatttcgatgggtcccgatttgcaacaagcgaatcgggatccgcttttcagcgggagtgaaccgtagtgaacgattcgcaatccccggtaaagccggggcaagatgattccgtgcaacggaatccatatcttgcctcccctgaggaggtgagcgtaggctggcctggccgagacctatgggagcggcagaggtctccggagcgagagcccatgacgcgcgacacggcacagtaatagcaagagatgctgagatactgggctgtcgaacggagccgttcgcgaggcacgggcggcagtggaaacgcctacgatgtcacctgtcggctttgccgaagagtgttgagaatttctataccattcatcacttttaagccaccgtttctctcaggtcactctatagaactttcgccatttctgaacagctcagccacatcgtgaataccgacatcgtcattgatgatcgtgttatgaactatggcaacgataaattacattgaaatgactctcttccaattatcctatttcatgtggagcggttttcaacgctttccatagccgcagggtctcacgaccaacccgaaggctgtgggaagggttgaaaaccgtttcttataacgagagaaatttctccataaaacttcctttcacccctatttcaccccttcttggagttacagggttgaaagacaaaataaaaagtcagaaagaaaataccttctgacctgctattttacctggagccagctatcagactcgaactgatgacccccgctttacgagagcggtgctctaccaactgagctaagctggcacacaattgcaacgctgtctaactatagagatgcgcgcgagaagttgcaagtccaaaatccccaatttccggccattcaccgagacactacagcagatggacaatcccgcgtacccagcgctggaagtcgtcctcatacctcttagctgtcgccaatacgctctgatggtccacatcgcggccgccactgtagtttgctgccaaggtcagccctaagacatgcataccgagcgcgtgtgccataatcacctcattgaccgtggacatacccacataggagacgccgagctggcgaagcgcgctaacctccgcctgtgtctcaaaggagggccccagcacacctgcaaagacgcctgcaccgatcgtgatgttctggtcttttgctacgccgcgggcgatcgagctcatatagggcgaatagaggtcattcatatccacaaagggagattcaacgtccctgagccctccccactcagccaaagggtttctgccggtaaggttgatctggtcggtcagaatgccgagacccttctcagccttcccggggatcgcgccggttgcgccggcaaagataatgtcacgacagccgaggcgggaggcatggcggacaagagaggtgacctctgctgcagaatacccacgatagaggtggatacggcccggatagacgatcaccggtaccccatcgagcgtgccgatcgccgcttcgaatcggtgtccttcaatcggctgagcgttgtccggaaacccttcaatatcgtgatagtcgatccttcgcaccacgtgtaccagatctgtgatggagcctaatccggtccccaacacgatcgctacggggtgttctactgaggggtgcatctcttcaaccatagtttcagttgtcacggtgattccttcctgtttaagcaggcgggtgaataccccatcgcctgctgtcagcgtaccgctataggtaccatcgtaaatgagatcagatccacacgaggggctcttcgcttttaatatggcaagcggcgccccggattttttcacccgatcaaattctttacatgccccagcctggaattgcttggtgacatcggtcccgtcactcatgtacaccccaccgtcgcgctgctccgccgcgggacgcggaataggcagtttacctgcggattcaggacagaccggcaccacttctacgttcttggcagaccgaatgaccgcggcgttcggtttggctttcccgttgtagcggcagttatcccccaaaaggcatcggctgattgcgacgcgcacacagacctccttgaaataaaaatgttggatgggccttaacggcccacccaacatcatacgtgatatcgtggctgaattttacgcctcgagcgtatagacctgaatgcttgccttgctgagctcgccgttcacgaagttggtccactcagagctcatctgctgccgtgcgcttgcgtacttctgatacgccacatagtaggcagcctgagctgcagcataggttgcactgtcgttcgtaatcgtatagtctgtgagcgcctgcgcataatcgctgttggaatccttccaggtgttgttgtcggagtcccactcatcgccggcaaggttgatgatgtaggtcgcatagtcctgcgtcggagtatcttgctggccatccgcaggctgagacggtgcagtcggctgtgccggcagggttacgtcggtgacgacctgatcgcgcagcttggtcagcgctgcagactgtctcagaacattcttgacggcgtcttcgtccatgttgtaccgagaggcaatctggctgtaatcgttggtgccgagatactgctgagcgtactggtcgagctcatcgtcggagacctggatattgcgctgctggacgatgtcttgcagaatctgggtacgggcggtatcgatcgtgttccccgcagtcggcattctgtacgttccgtcatcgttcttcgcggagtcgagcgaagaggtctgggagataacgtcacggacggtgacgttatgctggccgttgtagttgtagcgtgcgatcggggtatcgagctggttctcactcacggcagtcacattcagggagtgcacgccgccgagggcgtagtggcccacgagtccgccgaccacgaggcataccgcgacgataataacgacaaagtagatcggcattgtcactttctgtgccggcttgttctctttcggagcctgagcctttttgtccgcagtatgctcaggcttggcctcttcgaccttttctggctcttcggcctccgcagtgtccgtatcagtgtctttttcgggcgcttcctgcgccgtatcctcctgcgtgtccggtttcgtcgttggctcttgtttcgattcgttgtcgctcggagtttccatgcctattgtgcctttctgtccagttctttttcgatatcctgagagagcgccctaatatatcccgatccgctcttcacgtcgaacgagatacgctctttcagctcttgagcagtctttgctgagatggtgccctttgccatatcgagcagtgcgacgagcatgtcccgatattcagcatccccatggtagcattgcacggcttcatccaggagaggccacacagtatcggaacgtttttcacttgttgacccatacactgcaaggaaactgaaggctgcgagtctaaccggagcgctctcctcatcgaaaagcgagttctccgctggctccagtgccgattccacctcgtcggggtgcttcggggccaccagcgtaaggatatcaaagatctcccagcgggtctgcgcttcaggatagccaagcgcatcctccagctggttgagatacggcaggatctccttcggatcgtccttgatcccctcgtagatcccctgtgccgcgctctggcgctgtctgcgtgaatgtgcatgtaatcgttcgatcaatgcttccagggatttctgctccatctcattgcctctctaaccgctctctgcgcccttttcgctagtgtttcggattctgttggggacctgctgttttctgtgtcccgctcctctttttactcgatggtgtagaaatctgttgcaccgcacgctcatcgtcagggtcgatcggatcgtccgcctcttcgagcagcgcccagtcaaggcctgccttcttggtcgtgtcatcatcctcaaacagcaatgaggccgcctgggtgcccatctttgccccaccgatgtgtaccagcgtgtcaaagagcgagaaggccgcttcggtttgaggaatctccagatgtttttcctcggcttgccgcagggctaaggccagatcttttctgagatgtatattcttgaaccccggtctgtaatcgccgctgatcgctttcggcagcagctgttcaagctgacgtgaggaacccataccatcgctgatcatgtcgagcacgctgcgttggtcgagcccagaccgcctcgcgagtgccagggcctccacaccgcccaacaggtttgcggcgacgcagatctggttgcagagcttggcgatctgcccattccccgcctcatcgaaatagtagatcttctttgagaaggtcttcaggatcggcagcaccggctctgcggtatcttcggtcgcgcccatgatgagggtcagggtcccggctttggcgccgccctctcctcctgtcaccgggcagtcaaaggcatgcttgtcatcgatctcacaggagtcgtggatatcccgcgccaactgcggcgaggacgtggtcagatcgatcaggtaggcgccctttttcgagcggcggatgagtccgtttttcgtcagatacgtgtcttccacctcgtcgggatagccgagcatcgtgaagatcacgcccgcacctttagcggcgtcgcctgctgaaggtgcccagtgggcgcccctctgtatgagcggttcggctttcttcgcagtgcggttgtagacggtgaggtcatagccagcgtccagtatgtgctctgcaatcggctcacccataatgccggtaccgatgaaagcgacctttgtatttgttgccatgtatatcttccttgaaaaactgcttattcttttgcgcgaaccctgcgtgcaatccgatcagtcagcgaaagcttctcacgccgatcggtgccccagaaagccgccgcgaccatgcccggccccacatgggagccgatgaccggcgagatggagcttctcacgaccgtgatatcggcgcacccatccatttcgcggatcttcttttcgagccattcggcatccttcggagcatccgcatccataatgaccatcgggagtgaggggtcatgtgcgtagttattctcaaaatccttgaggatcgccctgagcgcctttctgcgcccgcggcacatgcccttaagcgataaggatccattcacatcgtaggagagctcaggcttcacatcgagcttgccacccacctgtgctgccgccggcggaattctgccgcctgccgcgagccagtggagggagtcgagcgtgaagtaaccctggataaagtaacgggcatcctccgcccaggcgacgagctctttggctgtcaggccgagggctgcctgacgaacagtctcgataacgaggagctctgcggctgcagaggggcacaggttgtccaccacgtagatctcggcttcggggtagtcctctttgacaagctcaaccccttgacgagctgcatcgatcgaagaggaaagccccccggtcagtcccagatagatgatcgggcggtgccatctctcatagagacccttgaagatctccatgtaggcacccggcgtcaccgcctgtgtgcggaaccgctcatcggggtgcttacgcatgtactcgtagaagtcgtgtgggctgatgctctgccacatatcatccgcatgctccccgtctggccccacatagcggaaggggatgacttcgatcctaagcgctttggccacatccgggttgaaatcggcgccggtgtcggccacgatcgtgaccccgagacgcttctggtaggcctgtgcgtatgagctgagcgccgcgacaccggtgacatttttcaccagtgccgcgacttctgtactatccaccttggtatctggtgcgccttgcggcttattgctcatccacgtcctcgatctcaggtttcaggattccgtatccaccgttctttctatgatagatgacattgatctgtcctgaatttgcatttaagaacatgtaaaaatcatggcccaacagatcggtctctacgagggctttgtcttcggacatcggaatcaacttaacggttttctcccggaccagcagatcgtcgtcatcgttcttcggctcgatcagcttatcgaggtcctccgcagaggtcagcttgtggaccttctggcggtgctgacgcttgtcgataatgcgggtcttgtatttcctgagctggcgctcgactttctctgccgccaggtcgatcgcggcatacatatccggatcgctctcagaggctctgacaacactgtcgcgaacgtgtacggtgacctcgaccgtctttctgtccggattggagcggttccgatcaacacgcagtatgatatcgcaggtcataggctcaatattgaagaccttgagggcattgctgatcttctcggtcgcatagcttctcaatgcgtcggtcacttggatcttacgtcctgatacggtgatgtctgccatagcatcctccttaggatcacacgcgcatgcacgcccttccgtgcatgtactaactagatacccaaatatggtgtgatgagcctcctgtatcacccaacgattgaaaatgtttgtttcgccctattgaactgcaggtttctcctcgtctacctcctcggtactgttgagccatcgattgcggataagctggtattttccgctctccttgagatcatccagcgacgtctgcagggcctgcgccaagtccgcatttgaatccacgatgccacagccgatatcgaccggatcgtcgatcgtcccgatctgagagatatctccggtctgttccgcaaaatagttgccggcggcagaatccgccgctacatagtccactttgcccaaggcgagcgcctccatgcagtcctgcatgttgccgaacacttctattgaggcggtgggaaagagctgagacagggtagtttgcactgcaatcgcatcacgggccccgatagtcctgccgacaagctcttcctgcgtgagggagtcctgcttaccgcgaccgaataagctgatcgactgctgtgcgtagactgcggtctgcgctaccccctcggcttcgccatcttcaacattcatcaccacgtcgcagcttttctgcactgcggtggcatcggacacacccacaaaccggacgtgcaaccccagctcagaggcgagcgcgcttgccaggtcgatatcaaacccccaatagcggttttggctgtctgtctgactgaaaggcacgcccgtgtctgccttgatgccgacggtgaggtagccgttctctttgatcgtggggacacttacctgtggctcaagggcgttagcatcgtcgatatgggcctgtgaagctgagggatagctgctgttatcgcggattgagtcgatgacggagcgcgcagagcacgcacagagccccacgcagagtgtcacaagtgcgacagcacaggtaacctcctttgccactctggcaaccttgctcttttctgccaaggactatcccttccagctgacctggtttttgaccccacactcgcgtaccggaacgttcgcttcgaatgctgcggcattcccacgtgtgtcctctcgcctgggggaagtatgtccccaactgacaggcggtacgtcttacttctaggacgaaccatgatcgccgacgtgcgcacacaccgacttacgtggatccctttggcctcgtctgccttggactagagcatgtgctcacgctcgcaaccacagacctagaagggatgtactgattatactatttatcgcttacgcacaaactgcacaggatccggtaagggcttacgaagtgtcaacggggacttaaaggcagctaaaagcaggcaaaaacgatgtgcgcccaacacttctaccacacccgcgcgaaggcagcggtaaagacgtacggcgccccttgcgctttgagcgagcgcatacaggacttcacagtcgtgccggttgtgatcacgtcgtcgacaagcaacagccgcatcccaaacgtgctctgtgtacatgcaatggcgctctccatctgccgagcgcgctcttccttccccaagtgcctgagatccgctgtgctcctgttttccagcagggcaaaaagcggcagcccgctcaggcgtgagagatgctttccgatgagctccatatggtcaaagccacgacgagcccgcgcctcagcggtgtccggcaccacgacgatcccatcgagtgaggagagatcaagccgcggggagccttctgcatccgccgttttcgacagctcctgcaacaacttccagagcccttgggcgatgagcgccgcaagccgagtctcatggtggtctttgtaggtggtcacgatgcgacgcgcgaccccttcataggagagggcacaggctaccccatcgcccggccagtcacgcttgcattccgtacagaccatccgcccgtagggagccccgcacaccgggcacgcccgactctgatcgatccagggaagctcgctgcggcaggactcacacagaagctcgcccgcagcgtcgcacccgacgcaccgtgtcggccacagtgtctcctccagagcgtctaatgcgcgctcaaggtatgagcggtccttctccatatcagcatgcccttatcccctaccgaatctagctcgtgaggcaaggataccatgcgtcctgatctgacagatcgagcttcgaggcgttggagaagaagagggtattgccattgtcccagagtgcctgatacgtctggttgaggctgtcggcttcaccatgctccaagcgcagctgcgctaacgctgcagctacataggccaccatcgcaggctctgcctccatgccgcgcagcggcaccggcgccatgtaggggcagtcggtctctgacaacagcgcatgttgcgggcacaccaacgctgcatcacggatctcatcggagttcttgaaggtcagcgccccaccaaaggccaccgagcagccgatcgcgacaaagtcatgcaggacgtccggcgtcgaagtaaagcaatgcagatcgcagcccgcctttggtatgccgacctgcttcagaattttcaacgcatcgcggtgtgcctcggcggtactgtctgcccgtgcatcccggatgtgcagctcgacgggcaaaccccagtcctgcgcgatatcgagctgttcaataaaagcgcgtctctgctcctcgtggtccacgccgcaggtgtagtccagcccgatctcccccacgccgacgcacaccggacatctaagaatgaagataagatgctttttcacctcgggatcctccaggtaagctttagctccataggggtgcacaccagcgacgatgcggacaaagtgcgcgatttcggcggcatccgccgtacgcccgtgggcttcctgtccttcaaacttggggaagctcacccccgcttggcgctgagcatcgatcagcgtgtgggcatccttgcaccacatatggaaggcatacatcagatgcctcgggtcagtcgcatcgtcagcggggtccaccggtgagaccagatggcagacgcctgcctgtgcagcgcgggcaagggcccgcgtcggcgtgttttcgtcgaagtcagtgaggtgcccatgcgtatcgatcaggggcaacaaagccatggggtagtccttcgctcttccctttttatcgtgaaagagtgctacagcttgtgcagtctgaaccatctctatccccctttatttacggtatgatgcgaaatcccgccttgtccaaggcgcgttccaagtcaataaattgatcaacctcgagccgttccgcgcgtgcggaaggctcaatccctgcctttgcaaaggccacatcgagcatattcttgtcaaacccggcagagctcattgcgttacggatggtcttgcggcgctggcagaaggcggcgttcaccacctgaaagaccttctgcagctcttcgtttgtcagtgccttctgaggacatctctccagccgtaccacgcaggactccacgtgcggttggggcatgaagttgctcggtgaaacattgaagcggccagtcacctgtgcaaagagcctcagctttaccgtgtaggcgccatactctttggagccgggctgagccacaatgcgatcagcaacctcacactggaccatcaccacggcacgcttcagcggatctaatccctggaagaagcgcaggagtaccgttgccgctacctgatagggaaggttggagacaaaggcatccggagcctcacggcaccccagctctgcaaaggctttctgaatatcttgagggtccagtctcagcgcatcaccccagaggatccgcaagtgatcgagccgatgcgcgcaggtctcctgcaagaccgactcaagtgatcggtccgcctcaagtgagacaaccgcctgtgcccggggaagcagcgcacaggtcagcgtcccgatccccggtccgacctccagcaccgtatcggtctccttgagatcggcaagttcg

SEQ ID NO: 297 - DNA, 13282 bp, Unknown
  Metagenome-assembled genome
gcgacggacaatcttgcacttgtcgcacatcttctttaccgaaggacgtaccttcattgcaatccccttcgattgtttcctacaggttctatatagacgcccagccgcaggcgaaaattgctctctaaaattgctctctatttgtagcgatatgttatgcggccccgagtcagatcatagggagagatctccacggtcaccttgtcacccggaaggatacggatgtagttcatacggatcttcccagaaatggtgcacagaatcgtcttcttattctccagctcaactcgaaacatcgcatttggcaagggctcgaggatggtaccttcaagctcaattgcatcttgcttactcaagtttcacaacctttcacgtcatatagctccacaatgacagtgaattataataatagcaaaaacttctgaaaaatacaaagttttatggatgtccacagagcaatgatatggccggtgattctaagacatggattttgatcatccttttaaatcccggcagattgtcaagctgagtgcaacatctccctaaagacctcgttggctatcctgtatttcaggaccttcctcgctctgtcacagatcagcttcaccgcatgctgcacctcctcgtttgtgaccttttcgaagtcgctgcccttaggggaagaacttgcgcaggagcccgttggtgttcttaactgttagcttctgccatagatggtgagggtcgcagaagtagaactgcacacctcaaagggcatctgtgacatctgtatgtcctgcgaactgcttgcccctatccggaagtgagcgtcttaaggggacgtccctgtagcagcccgacctcggccttagagacgctcccgctgtcgtgctggctctcttctgcgagaaggagcctcactgccctgtcggcaagcacaagcaggcacataggccctgctaccacgagtgtgtcgtttccccactctccgaggtaagacctctcatcggccttctttggcctctcctttacggtgtgtaagatctcgatcttgcctttagtcttaggcctcttcctgcgcaggtggtgccgcatcttgcctaacgcgtccggatcccggcagctcgagggcggcggctacggacctgccggtaagaatagtcggcaggctcaacggtgcacctgccaccaccctcgagcctgagatatagtctatctcctccagggaccagtgtctgtccatgatgagtaagcgcaccttccgtgcgagtgcagggtctgaaagccgccttttcgccctgcatctcctgtggcgctcatccgccctccttttgggcagcgcatgccctaaagcgtccgtgccgtgcgttcctcttgagcttgtggcagacgctggagctgtccctgccgatctctgccgcgatatagccgatggagcttcccttgtgccacacagctcggctatacagtccctctcctgtaggctaagatgcttgtagtggcacattccttttagctttcgacgttgacttggacaaccaacatcgtagccttccggagtgtgccacgcctgcattcagcgggctatcctgttgcactcagaatgctaatccgcccccgcaaagatgtgtccaaaggacacagactgtacagcaggatgtagaagaccataagaaagacagacatacagtgcgagcttcaagatggcagtcgcgctggaggtggcgaaggagcaaaagacactcttacaggttgccgtaaagcacagacgtgaacccgttgcttacaccctcacgaagagacgagctgcttggcgctgcctacaccatattcaacaggacgaaagagagtgaatcctcagagcaagtgcaacgtcttgtggtggtagacctcccagaggcacttccaactcagacgcttgcgcagccctcggttgagtgaatcgtaggccttctggacctcggcgtctgtggcgtgtatttgatagcctctgagttgggcgtctgagcagccttgcggccttgtggtggccgcaaggctgctcgatgctaagatggctgtagcggcccatgcctgcctccaaggtgatgtctttgcgagtaccatcttaggtcgtacgtaggtcgctacctcgtaattagttgttgcacttagagtgtagattcacccctcaaaatagagttttctatacgggcaacacataccacttcccttgttcgcaagccgcatacaaatgggaagcggcagccaccaaaaggagaccaccgcaataaccatcgacacatacaggcacagttgatcattgatttgtttgaccgacagcacgaaagccagccgcacactctaggcgctgaatcctcccatgagcgcatctattacctgatccccactcccataagatgactgggcaccccttcccgttgcagcaaaagccgagacagcagacgccatatgtgcagaatctcctaagttatacccagcgacaagaccagcaaggatggcgcccatatacgcatcaccgcacccagtcatatcaatcgccttgaccgttacaggatctacgtgttcaatctcgccggaatctatgaccactgaacctgcggagcccaacgtaatgatctctcgttcaaacccgatttctgccatacggtaagagatctcatgccagtccgtatcgacaccagccagcttctccgcaccaaggagctgagtgatctcatgctcgtttaccagcagcacatcacaagcttctatcaaatcagttggcaatgacgcggtaaagggcgagtcgttcaggagcactgtcattcctgcgctgtggcagatggtagccgcttcgacaacggcatccattgggctctcgaggcaaagccccaataccgccccttccgtcaagtcgcattgcacagagtcaatatatgatggcgagagaagtgcattcgatcctgccgaatagacaatcgtattctctccagcagcgtcgaccgttatgagagtggagccactggccccttcgagtcttgccacatgagagacgtccactccagcttccatgagtttcccagcaaggaagtcagcattttcatctctgccaagggcgccaaacatccttacgtttgcaccaattcgcgcagcagatgccgcttgattgcccgactttcccccaggaagcagggcaatggggccacccgggactgtctcccccgggagggggagccgctcggtcgtaacggtatagtcggcattcatggaacccaagacgcaaacgataccgttcgaggaggagacacccctgataagggattccacatcgaagcccctattagtttcacgcgtcacttagctccctcccctgcagtagtagcaccaactccgtcctcagtggactgatcgatcgaaagcacagctttcttcaccgactttcgcgctgccatcgcagtcatgccaaaccagaccatcgccacacccgtggcaatagcaagtatgacccatgtaatcgctgaggtctgcctatacagggtcacataagcaatgcagagcaatccgcataggacacagagcatcgaccgatcccgatgcatcactgaggcaactttgatgtcggctacagctttcaccgacttctcgtcgtatgtcggcacacctacaggcttagccttagtctcacggatatgagagcactctgacttccctgtcatcgcgatctcccctttccaacaattggaaacaggcgggcacggccccattgccgcactcgcctgacctcgtagaacaatgctatgccgaaacaacaccagtcattccgaagagcagaccaagtgccatgataccaaggatgagccaaaccacattgacctttttctgtagaagccatgtgcagaatagggtgagcgaaatgggaacgagtcccttgaaaattgcatccaggtacgtctggacctttacggcatccgtattgggaaccggaatgctaagggcgcagctgaacttgacaaagcttgcagacattgcgccaatcatgataagaccaagaatgcttgccgccttcatgatgattcccatgactccagactcgtacgccttggagaggaacgaggatcccagcttgtaacccagaatcagcatccaccagcggcagagcatcgaggggatattgtagatgagcaagaaaagaatgggtccaagcacggagcccgttgctccgatggaaatacccacagcggctgcgatgaccctgagcacgccccagaacactgcatcgcccacgcccgaaagcggtcccatgagagacgctttcaccgcgttgatggagctgacatcgaaatcctcaatttcactgttctctcgctccattgctgcgacaaggcccatgacaaaagtggacacattttcggtcatgttgaaccacgtggtgtggcgaaccattgccttggtgcggtcttcatcactcttgtagaagcgcttgaaggcaggcatcagcgaatagatgaagccatccgaacctgcctcagcttcgcccgcccagaagcagtactccgtgaacgatctccaatagatgctgttgagcatcttcctgtcctcgggcgagagacccttggcactgatgttgactttcatctcgtctggcgaggaagtcttctcaatctcgtcactcatgcgaagaacgcctcctcctcattatctgcatcaggactggactccagcgcaggcctacggccttcgcactcatgctgaagatccagcgtctgcttatccctcagggcagtaacaacaacgaccacagcggcaaatgccgcaactccgaccatgtcgagtcccagatacgaaaccaggatgaaacccagcaagaagtagatggacagcttcttgtcccagagcatcttcaggagcattgccataccgatagcaggaagcaggttgccagaggcggagaatcccgcaataacatttttaggcacctggttgatcatctggctcacaggctcagcaccgagaagcacacccaggaaggtgggaatgcagcagattccatattttatgacccatcccaagaagtgaacgagcttgatgttcctctccttgccggaagctgccgcgcgatcgatgaacggcgcgccaaggctggaaagcgacaggtggataaactcatacaccaaacctgcgagaaggccaataggaaccgcaagggcaattgccacaccctgatccatgtgcatcaccacaacgaagaccacggcaagcgttgtggcagtgaccggctctgccgtaaccgcgccgccaacattaacggcacccatgaatattgcttcgagcgcagcgcccacgatgacaccagtggtcacgtctccaaagagaaggccagcaaccatgccggctacgaggggtcgctcggacatgcattgtccgaacatgtaattactgccgatgcttatgaatgcagacagcatagcgagtagagctgtaccaagcattgttcctccttgactcgtatcttcaacccacgaagggccagctacctaatgtcttccagcgccgtctcaacaccggttttcgcatcattcggggtgacctggtgaaacactggaataccacgcttgcatagctctcgggcggcctcgacctcttcgggagtcagctcgacatttggcatcacgcgagtcttctcgctgttcacgaaccttcctacgtttgcgatatttacctctttgatcatcccagaacatgactccaccaatgcaagggcatccttgacgcagttggtgaggacaaagataggcatcgccttgctgcgtgagtcgttgatgacttcctcagcatcgttaacactcttaatgagaagatgttgagagctcgggcaagccattttaagggtagaggcaaccatcttatccttcgcagcaccatcatttgcgacgatgatacccctggtattcagcgccttcgaccacatgagagcaacttgtccatgtatgagtcgatcgtcaacgcgcaattgttcgatcatttgaacctcctctcgtcgtcccctatgaaaagaaaccctctcctgagttgtcagtggcttcttcgttcagaacctgcactcgccggagctgactcgcagcagcagcacaaatctcgtcgacagattccttcgtcagtttctctggagtcagaagacactccatgaccaccgcgaggttcattccagtcacatgcatgacaccgtgatgctccggctgctctagcgcaactttttgaaagacgctgcctccgaggatgtccgtgaagatgaccgcctcatcatttggagtgcaggagtcaatgaactctcgaatagcggctgtatagtcactgttgtccacataggcatcaattgcagtaactccagagctttcaccagcgaggatgtcgattgagctcttgaggccactggcaaagtgaccatgtgaagctaggagaatccgcctcatcgcacttcccctccatttagagactgaagtggttggggttgaggagctggagcttcttcgccacaaactcatgggcgtcgtcccgtgcacaagacccgaggctcactccatccccgtcatagatcttcccacttgccatgtgcctctccatcgagtgatagatggcacgaaagtactcagtggcgatgttgaacttgctcatgccaaggttaacggcctcctgcaactgatcatcgggaatgcccgagcagccatgcataaccagggggatatttaccgcggcgcgcagttccttgatgcgctcaaaatccaagttgggctcagtgcaatagggtccgtgcgcattgccaactgcaaccgcaagcgaaccgcacccggttctttccacaaagtcaaccgcctgatcaggcttggtgtagtggtcactgttcttgatgtcatccacactagagccctcgcccacatgccccagctccgcttcaacgtccacatcgaacaccctaccgatgttcaccacatcctgcgtgagcttgacgttttcctcatagggaagcgaggacccgtccaccatgacagaggggaaaccatctttaatgccaccgaccgcaatgtcgtagccctttgagtggtccaggtgaaccgcaacgggaacgctagccttgcgagcatattggcaagcagcgaacgccattacattcacaggcatatagtcagcgaatcccgggaagtactgcacgataatcgggagcctctcatgctcggccgcctctattgcaaagcgaaccgtctcgggatttacggagtttattgcagggaccccgtagtggtgcttggtcgcatgctccagaagatccttcacttttatcaatgccatttctctccctctctcttatgcgaggcttgccgtcgtacctcttcgactacgggaatagtaaatctaatttcatttaaagcaacattttttggaatatatttccgtattcggtatgagttttcggttgaacgtagttatatcaatgggttttaactcatattttcttaaactgacaaaccgttgatgttgtttgtgcgctcagaatcccgaaatgcaatttcacttcagctgagaagtgccttaatgctatgtttggcttgcactcgaagggtggcgtaccccagagtatggcgcgccatttcctcgagctgatgggagaaacaatggacagtggagttagcgttatcgacgctatcctttcgcgatatgagaacctttccgcctcggagaagcgcatagcggatttcatcgccgagaatcggcatgaggtctcttcacttaatgcctatgagattgcagttaagtcaggcacatcgcgagcgaccatgtctcggttcgtgcgctcactgggcttcgacaactttgcacagctaagagttgcgctggcacacgacgagcaatcggtctcgccttcaaatcctgctcagactgaaatctcgatagacaacgttcgcgagtcgatggactacatcctcaaagcaaaggtggatgagctcaagagcactgcggcaatgctggatcagtcgacactaaagaaggcaatcagcgcaatcgaatctgccgacctaactatgttcgccgcagtcggaaacaccattcccattgcacagaatgcagcctataagctctggcaagctggctatcgcagtgccgccccagcttcgacagatggaagcgttcaactctccctacagctcacaaaccacgactgtctggttgtcttatcaagctcgggatactctaggcgactcatccccgtcatagacaatgccaacgacgcgggagcctcgatcattaccatcacgagtaacccagagtcagaccttgcaagcagggcagatatcgtaatcgaaactgccaacagagatcgaatgctctcagacctgagcttttcgcagaactccctcaacttcgtcatcgagacactcttcctctttctctcccatgactccgaggacgtgaaggagaagaacctcatgttctggaagtccgcaaagagcgacgtcgagccccaggaacggaaatagaaaacggcagccaccgctgaactgcctggacaccgggtttaaggacgcaattggaagtcatggccctcccgcaggcgacacgcaggtgcaccagggcctcaaactgcctggagaggctcaacgccgaggtgaagcgcacctcgaagctcatcactatattcccgagcgaaggcgatgacgtacagtttctttcgcacttttgaaaaccggatagccgcatagagaaacatggctccgtctcgctacgattggaagcgaccaagtgcaaaccaacggaccaaaggaagtgaaaaccatgccacacgagacagtatcattcgacgagccgaagcttcaggactacctcggggagctcgtcagaaaaaccgtgcaggactcactgaacgccctgctggatgcgcaggcaaaccagatcgtcaacgcaggccgctacgagcggcaggcctgctgctccggccactacaggcaaaacctcaccacgacctcaagggacgtgacgctcaagcatctaaaagctttcaggggtgcgaccttcgcctcgaaggtgatcgagcgctaccacaggcaggagagcttcctcgagcaggcgatgatggagatgtagctggcgggcgtttctaccaaaaggatacagggggtctcagagatcttctggggcttaagcgtctcgtctgccaccgtctccaagctcaaccgcaaggccttcggtgccgtcccctcacgggcaagtaccccctacgtctagctggacggcacgtacgtgaagagaaattgggcaggctcctgcgagggtgtggccataggcgtcaaccaaaagggatagtgcgaagtcatcggctgtaaggagggctacgtggggtcaaaggagagctggagggcctttctgctcaagctcagggagcaagggcttcaggcgtgcgcatggcgccggcgacaaggccgcgggtgtgctcggcgccatccaagaggtcttcctacacgcgatgtagcagcgctgcacgctccacttctaccgcaacgtgctcgacaaggtggtaagcagcaggaaggaagcagccgcctcgctcaaggcgtccaagctcgagtccgccgctggggtgatcgagtccggcgtcgaggagacgctgacctgcgtgctcttcccgcccgagcacttgaaggaggatctgcaccaacaacggcatagagcggctgaaccggcagataaagcgcaggacgcatgcctcggggaagctggcagcggcgaggtgcaagtacgtggccgggggtggctgaggctccaggcgctacctcgacaccgatctgctgaacggatgagacgacagggaggtgctcaagaagcagcagggctagcttcgactaccgggacgggaccccggctggagaaagtgccaaagactattgacggaaccacgagggcttactcatcaggctcgtggggacctatctcatcgagtagaacgacagatgggcggcaaaaagcaaacagtacttgcctgccggcggtcgaggaactaaagaggaggaaggagggctcgcggagatagcctgcacgcagcggcagatgaggcttgattcgtgatggcttgcaggcggtggttgcttatgagctaacttacacacgatttcgaacttgaatcctccggatcccatgatgttcttgtgctcctcgacgctaagatagctgtagtggcccatgcctgcctccaagatgatgtctccgcaaacaccaacttaggtcgtgcgtgagtcgctacctcgtaactagttgttacacttagagtgtggattcaccagctatgaaaccggcagcagaccgtaaaaccaggaacctgaagagtagatatcagctaaagagaaaggcctcgctcgtaaaagcgaagcctccaacagttgatttagttgctaaattcagttactgctggtcagtgctgtcagcctcagaggaactgttctcctcctctgaaacctcagtaccttcctcattctctctgaatggtgccggcacttcgatctcagcatcaggaccaccgaccatcgggcaccagggccctttctcatcggcgctcagaatcaccggtccatcctcagtcacggcaacgacattctcaaaatgagcgcagggcttttcatcgtcggtcactactgtccaaccgttactcagcatgtggacacgggcagaccccaaggtcagcatcggttcaatcgctaagagcataccagcctgcaggcgtacgccacgacccggtttcccatagttcaggacattggggtcttcgtgcatatcgtgtccgataccgtgaccgacgtagtcacgtacaacaccatagccgttttccttcgctaagctctggatcgcatggccgatatcaccgagcgtattgccaggcaacgcctgctggatgccagcggctaagcaatcgcaggcgcactcacacagcgcctttacttcgccggagacctcaccgacctggaaggtccaggcattgtcgcctgcccacccatcggcgtcagcgccggtgtctatggagatgatgtcaccctcattgaggatgaccttcggagatgggataccatgcaccaactggtcgttgaccgaggtgcacagggtagacggaaatccctcaaagcctttaaagcccgactccccgccgcgctctctgataaaactttctgcggccttatcgagctcgagggtggaaatgcccggtttgatcatggtaccgaccatacgcaggacctcttttgagagcttccctgcgctctgtcggtacgtcttgatgtcttcgggggatttcagcgtaatcataagttcagcagatccttaatgtcttggtagaccttatcctgcgactgctcaccgttcacggtcttcaaaattctgtggcccttatagtactcaaccagaggtgcggtctgtgattggtacacagcgaggcggtgctgaatggtctcaggcttatcgtcgtcgcgctgatacatctcgccactacaccgcggacatacctccatatccgcgccaccggtgtagccgcacttcttgcaggtgcggcgggatctcaagcgcttgacgatgacgtcggggtcacatcgattcagaatcgcggcatcaagcttgaatcccataaagcgtcagctcggagtcgagcgtcaactgctgcgcatgttgctcgggaatcccgtcgaggctgatcgagtcccctctgggcatcctcctgtttctgacggtgcaaacgctccttcactcagtcgacgaaccaggctgtctcgcggacgagctgtcattcccttgtcctatcgcctttttgcctgcttgccaaaggggtaacctgccattcaacacaagcgcactgagacaagatcgtaccgtcttgagattgaaggctgacaccgacctcagcaatctcaggcgtctgagcgccgcgtacccttagccggcccaggaccaccgagcataacatttttcatatgactcctcaccttcgctataaaaggactacttgaagacccctcatagttgtgcattctgagttgaccctcagagcggacaagctcgtatcgagcgcgacgcccaccatatcagaagacgtaccgtgcacagcttggatcaattattggcacgtaaagccgaaaatatcgacggaacgacagcgatccacttgccatgaaccagcgcaccggcagggtgaatgtggcgataacgttttgatgtaggcctctttcggcgtgcccggacgcaccccccggatgagccacctgtttgcggagcatatccgcagtctcatcaaggattgaagatcatcgccgtggtagacgtaggcgaagtaagacgatcagccgaaccgtacagaacccgttcagccagcccggaggaaaaagcgttcgcgaaacggcgagtcatccaaccccgcgcgggaagaagacggcgatcctccgggagaatacaggatcgcgtaagccgatgatgaatcggccacaacgccggcagtgttgaccttgatcggcagataggttgcctgaacgccctcatacgtccgaccgctacgcgcttcgcggactggatctgatcgccagctgacacggctcgatgtagccgatgaacgggatgacttcgcgatcgatgactcgtgctaacgtaaatgatcgttcagtcagccaaccgtttccagagttttttcgcaccgacgagatcagcgtcagccggggagccggccatgatgttcacgaaatgatcccagcgacagacccttgccgataaaccaagcaacgcgctgggtgataccaacacattcgccgagccacatgaggccactggcaccgtgacggaccattcgtcgcgccgacgatgtgtcagtgttgctccccagccagaccggggatgcctcataccactcaaaggtgctgcgtagagcggctcggatgaagagaagagatgccgatgctcgggaaagtcttggccagggcggacggtcaacatcgccgcgtgtactagcgtgatcgggcgcctgcgacgtggccgttccaaagctggccttctcagttcgcttggcggcgcagggacgggaacactggcctgcacgcatcgtggatgatgatttgtccgtatgtacgccattcttgccacaaacctgaagacggacacacgggaaccgtgggcgccgcctgaagaacaagataatgcaggacagcggggtgctccggaacctgaaccgaagaggactcccctgccgcagtcctaaagcggagagcatcccctgtgaaggggatgccccgtcacagtatattacgcc

SEQ ID NO: 298 - DNA, 18973 bp, Unknown
  Metagenome-assembled genome
caggaactcctttgtggacagtccgttggtatctttcaccacgcggtcgtagggcaggatattgagctgattggaagggaagagcaccgccaggaagtagttgtagggcgcattcggggaagcgttcagatgctgctcccgtttgtgctgtgagaccttgatggcgctcgcggcacggtggtggccgtcggcgatataggcgttggggacacgctccagcatggcctcaatcgcattggtggcatccttgcgggcgactctccagacaatctggcgaacaccttcatcgtcgataaagtcgtaaagtggctgtccggacatggcgcctttgaggataacgtcgaggactggctcatcgcggtaggcgaggaaggccgggccggtctgggcatcgagcgcctcgatgtgcctgatgcggtcctgctctttctcagggcgggtcgactcgtggcgcttgatggtgccatcgaggtaatcgtccaccgcgcaggcggcgacgatgccggtctgttggtggccattctggatcagctggtagatgtaatagcacgtggcgttgtcggcgatgagggtgccattctgcacgcagtcgaggtagagctcacgcgccttcgcatagacgtcgtcggcatatatgtcgtgaccatctggaaatgcagtatccggacaatcgatcgccagaaatgaatccgggtgatctttcacataggctttggcctgtgcgcggtcgaacacatcgtagggaggggccgcaaaggaagccgccttgtcaggggctggcctcagacatttaaatggaagcgcgtgcatctcaactccttatcctcagcacttggtcggggtgatgatacggatacggtaaatacccccaatttccccgagggccttaaccgtgttctggtccagcggcgtagtggtgtcaagcagggtataggcgtgcgcgccctgtgcctcgttggtcaggtgctgaatgttgacggtggtgttgcccaagatgcttgagatctgaccgatcatacccgggatgttcttgtggagcagcgcgattctgcagccctccttgaccgggccgaagtcgcaggccggatagttgacggagtttctgatcgtgccgttctcgaggtagtctttcatctcaccgatcaccatgtgggcgcagttgtcctccgcctcaccggtacaggcccccatgtggggggtgatcagggtgcggggcatcttcacggtcttcggggtcgcaaagtcgcagatgaatttcgagagtttgcctgactccagcgcggtgcccaccgcgtcttcgtcgataatgtcagcgcgggcatagttcagaagcatcgcgtcgggggccaggaggtccagctggtgggtgctgatcatgtgctgggtgtcctctttggaggggacgtggacggtcaggtactgcatgcctctgcagacatcgtcgagggtatcgacgcgcttgactgcacggtcgagctgccaggcgtgctcaacggagaggtaggggtcatagccgtagacatccataccgagggcgacgagggcgttggcgaccttcgagccgacggcgcccaagccgatcacaccgaccgtgcgtccgatcacttcttggcctacgaaggccttcttgttcttttcggcgtccttgacgacattcggatcattcctgtggtcgatgacccagttcataccgtcccaggtgtcacgggagtttgtgaggatgaggccagccacgagttccttgacggcgtttgagttggcgcccggagcgttgaagacgacgatacccctctcggcacacttctcaagcgggatattgttgacgccggcaccggaacgggcgacgaccaaaagatttggaccaaacttgaggtcgtggatatcagaagcacggacgagaatggcatccgctctctcgagatcgtcggtcttctcgtattcctcacctagctcagcgaccccgtcgcgggtgatgctctttgcgatattgtcgatcacttttacgtaatgcatctactaacaactcctttaggcgttgtgcctctcgaaatctgccatgtaggcgaccagggtatccaccgctttctgggatactgcgttgtagcaggaggctctcatgccgccgaggatacggtggcccttgacgccgaccatgccacgctcgttggcgccctcgatgaactcggcgtccagatccttgttgtcggtcgtgaatacgacgttggagatggagcgatcctgcggtactatgaggccgcggaagagcttgctgtgatcgaggtagtcgtaaagggtattgacctttttccagttggccttttcacgctccaccaggccgccggtgtcttcaatccagtggaagactttgccgcacaggtagataccgaaggtgttcggggtgttgagcatcgagtgcttcgcagcttgcttcttgaagtccatgtagttggggcagatatcggcgcgtgccgggccgttctcaatcaggtccttgcggacgatgatgacggtgacgcctgccgggccgcccgccttctgggcgcccgcatagaggagtccatatttggagatatcaagcgggcaggccaagaacatgctcgagatgtcggagaccagagggacttctccaccctgggggagcttttttgccatcgacccatacacggtctcgttctggcagatatagacgtagtcgagatcctgatcgatggggctactcaggcgggggtagcggtcaaagtgggtgtccttggtggacgccagcacatcgacctgcccatacttcttggcctcttcgtaggccttctcagaccagttgcctgcgatcaggtagcctgcgtggcggtggaacatcaggttcatcgggatgcctgcaaactgtagggttgcgccaccggagaggaagagcaccgcgtaggtatcgggaatgccatagacgcgtcgcagcgttgcctcggcgtcattgttgatcgcctcaaactctggagagcgatggctcatctcaagaacactcatgccggtgtctttgtattccacgaattcggactgtgcctccttcaatacactcaaaggcatggcagccgggccgggattaaagttgaaaacacgcgccatataagcacctccataatgcaaaacgacgtttcttttggacggtatctgattgccccttttccaagatgccctatttaccctaaccctccctcatcctcacaggtgagggagaatcttttattattccaacgtttacgttttctagacgtcacctacccacactatatagtagtctagtggttatggccgcttacccttttccaagggcaattactcttgggatggggggtacaagtgaggcaaggctatcagcacagacttagcatgaaggagattggatgcttgtactcgtaatcaacgctggcagctcatcgctcaaatatcagctgctcgacaccaagacccgcaaggtttttgccaagggcaattgtgagcgtatcggtatcgacggttcctttatcggccatgaggaaaacggcggcgagaagcaaaagttagaagttgcacttccgaaccacgaggtcgcagtcaagcacgtctttcagatcctgaaggatgccgatatcgatgcgaacaagatcggcggcatcggccatcgcgtcgttcagggcggctggtacttcccagagtccaaggtcgtaaccgacgagacgctgggttgggtccgcgaggtagcacctctggcgccgcttcacaactatgcagaagctgacgttatcgacatctgccacaggatgttcccgaacatcggcaacgtgatcgtcacggacaccgcctttcactacaacatgcctgagaaggcctaccgctatgcgttgccgcgtgacgtggttgacaagttccacatccgcaagtacggtgcacatggcacctctcaccgctacatctggagagagacctcaaagttcctgagcggtgacgtccacaagctcgtgagctgccacttaggctccggcgcttccctgtgcgcgattcaggatggtcactccatggacaccacgatgggcctgaccccgctcgacggtctgatcatgggtacccgctgtggcaccattgacccggcaacggtttgctacctcgagcgggagggccactacacggtcgaccaggtcgacacgatgatgaacaagcagtctggcctgctcgcgctttccggtgtctcctccgactcccgcgacatcgagaagggcgccgctgagggcaacaagaactgccagatggcgctcgagatgttctattatcgcacgagtcagctgatcgccgagatggcgcaatccatgcacggtttcgacacgatggttttcactgcgggtatcggcgaaaactccgacacgatgcgtaagggtatcgtggatcagctcgcttggttcggcgtgaagctcgacgacaggaaaaacgccgttagaagcgatgatccgcgcatcatctccgcggaggattcttccgtcaaggtcctggttgtcccgaccaacgaggagctcatgatcgccctcgacgtcgaggagctgctctcaaagtaagatgcttcgatagcgtgactgagcaacaacaaaggctccgccgttcatctgaacggcggagccttaaacgttagagctgtgcgagtacacctaccgcattagaatgggcggatcgtaaaggtacggctcagcttctggcgaggatcgagcgtgaggatgccgcgcttgtgctcgaacactccgtcgtcgtcctcacaatcggcaacgccgacccaaggttcaaccgctacgaagggcgccttatggtcagcggaccacaccccgagatacgggaaaccctcaaagtgaagctcgacgccgtgctggctcttcttgccttcgagcttgacggtgctgtccggcacgctctcaaaggtgagggtcagatacttctcaaagaggtcatgggagagcggtagcgtgtcgctgtgctccaccagggtcaccaccttcttgaagttgtggatgccatcggcattgatgcttacggttttgatatcaaaaggtttgctgaatttcagctcgtagtcgtcaaaggtctcatcggtcttccggaccgggacatcgaaagccgggtgcccgcccagggtgaaggggagcttgacgcttccggtattggtcaccgtgtaggtttggctgaagacgccattgacgatctcgtaggtcatctcgagcatccagttataagggaaggcctcacgggtctccggtgtggagatcactcggtaatgcaccatattcttgtctttttcgacgagctcatgctccatatcacgggcaaacccatgtcgggtgagatggatatcgccctgcgctgaggtcgcggtatcatccttcaagacgcccacgatcgggaacaggatcggggcagagcgcccccaccatctctcatcgcgctgccaaagatattccgtcccgttcaattgtaggcttaccagctgtgcccccttggaatcgagggtagctgtgacatgatctgattggatagtagtttgagacatactgacctccttgagctgtcagaggttgcaattccaccgactcactattcggtggttaagtaaaatatatcccccttagcacgtttaatatccgccgcaaggctaacaattaaatttcctcatttgcttacgttgtgttaataattgcgaagatggtgaaacgttttagtaggatttactatggcaatggaatgctccgcagaagacattggttggaaagaggtagaaaacaatgtgttcaaatgagctcactcaattgggtattcatacggagggtaccgtgttggcagacgcgccgacaccgatacttgttgaagaggctatcaagcgggacgaaggaatcctcacctcaacgggtgcggtgagagtcaagaccggtaagtacaccggacgctccccccacgatcgatctatcgtcgacaccccggatgtacatgacgatatcgcgtggggctccgtcaacgtgcctatcagttctgagaagtacgaccatctgaagcagaagatggttgaccatctctgcggcgaggatatctttgtcacccacgctatggcaggtgctgacagaaagtattcgagaaagttcctcgtggtcaccgaactcgctagccaggcgctctttgtgcaccagctcttggtgagaccgaccgcagatgagctcagaaactacggcaagcctgacttcaccgtccttgcggcaccgaccctaaaggctgacccggctacggacggtaccaactctgaggccgccatcgttatcaacttccatgagcgcatcatcctcatcatgggtacccgctactccggtgagatcaagaagtccgtcttctctgtgatgaactacctcacggtcaaggagaaccacgtgctgccgatgcactcttcagtcaacaaggacccgaagaccggtgacacgtgcgtcttcttcggcctgtccggcaccggcaagactacgctgtccgcagatccttcccgtgtgctcgtgggcgacgatgagcacgcctggaccgacgacgacgtcttcaacttcgagggcggctgctacgccaagtgcatcgatatcaccccgaagaccgagccggacatcttcaatgcgatccgcttcggttctgtctgtgagaacgtcgtgctcgacgacaagcgcgtagctgactacagcgattcccgctatacccagaacacccgtgtcgcctatccgatcaactacatcaacaactccgaccctgccggcaccggtaaccctccttcggtcgtgatctttctgactgctgacgccttcggcgtgcttcctccgatctcgaagctgggcaaggatgccgcaatgtatcagttcatctccggcttcacctccaaggttgcgggcaccgagcgtggcatcacggagccgaccccgaccttctcgacgctcttcggtgagccgttcatgccgctcgaccctatgctctatgccgatatgttcggcgagaggatggagaagttcaacacgagagtctatctcgtgaacaccggctggaccggtggcccctacggtgtgggacaccgtatggagctgcgctacacgagagcgatggtcactgcagcgctcaatggctccatcgagaacgctgagtttgtccatgattcggtcttcaacgtcgatgtcccgcagtccatcgagaatgtcccgagcgaggttctgaacccgcgtgacacctggaaggacaaggacgcttacgacaagcaggctaacaagctcgccggcatgtttgaggacaacgcgaacaagcgctatccgaacatgaaaccggaagtcaaggctgcaggcccgcatcctaagaactagttcgaaggactataggtgctaaaagagggatcggggagtttgaactcctcggtccccttgatcgtattcaatgtatgtgtgtgagcgcgtactagtccatcatctgtgcctgaaccgcggtgattgcaacgacgcccacgatatcggaagcggagcaaccacgggagaggtcgttgaccgggcgggcgatgccctgcaggatcgggccgtaggcctcagcgtcgccgaagcgctggacgagcttgtagccgatattgccggcttccagatccgggaagatcaggacgtttgcgtggccggcgaccgtggacttcggtgctttgagctttgcaacgggctcgacgattgcggcatcgagctgaagatcgccgtcgagcgcaatagaaggatccttctcttttacgagcttcgtagcttcctgaactttctcaggcacgtcgcccttggcggagcccatcgtggagaaggagagcatagcgaccttaggatcggagcctatgtagcgcttccaggagttggcggaggccagcgcgatctcagagagctgttcggcatctggatcgatgttgaggccgcagtctgcaaacaggagggtgccattgtcgccgtactccggcttcttggtgcacataatgaagaaagcgctgacgagcttggtacccggggcggtcttcaggatctgcagggccggacgcagggtattagcggtggagtggcaggcaccggacacgaggccgtcggcatccccctctttgaccatcatcgtgccgaagtaggtgaagtcattcatctgctcgcgcgcctgttcaagggtgacgcctttcttcttgcgcagctcagcgaagtcctgcgcgtacttttcatgcttgtcagaggtgaccgggtcgataaccttagcgccgtcgaccttgatcttgttcggatcgccgaggataatgagctttgcgaggccctccttgatgatctctttggctgcctcgatggtacggggatcttcaccctcaggaagaacgatggtcttcagatcgcccttcgcctttttcttcatttggtcaagaaacttgctcaaactcaaatcaatctcctttgttgcgccgactgtactatcaacttgaacacctaatggggaaaagtccagctgaacctgtctgatagcatgcgagtcaccacacgacaacaatctatctaaggtaacagatggactgcccacattctaccattgaggcgcatcagaagctctacatttgaagagtgggtcacactacagagctgcctgagaaggatggctttgctgagaagtatctgcctaagagctcagtcgacctgtatgctccatcagctacgtggtagggtcgagctctgccacggctaaggcagtgcgccacagagccaaacaagctcaggcatctgtaaggaaagacgcaagagctgttgccacagaacagaatctcctgaagaggcctcagctcacacactgtatggagggccacctcttcaaaggtggctgctcatctgaggtgtgctgcaaccgctcaggagctgcaggggagtttgtgtagaaggacactttatacctacactgaccaaagtttgctggatatccacaactatagcctgcctgaaaagtttaaaagctcaggcctgcctgtttgtcagaacaaagaagagctcgccacaagcttgaaaagcgcccccaaagacacaatgcgcacgcctgaggttaggcgcaaggggagtgatttggtcttaaggcacaagaccaaaggcgataaggcacacctaaccttgttctgagtgtttgagccgtgagtgtctcatccatccctgtcctggatacaacagctgccaagcaccatgcaggctttcagaaagctacagggccactgcagcaagcaccgctacgctatctttcaaaaccatcacagctgacaggggcttttagtttgtagactcttacagctaaaggacatctcagagatactcatctgctgtgtccactcccctacacttcctgtaacaaggggactactgtgcggcacaacagcgtagcctgcgaactcatcctttaaggggactacagtgccacctgctcttttcaagacatcatgccgaagcctggtgtagctcgttgtcaagaaagatttttgggctgtcgcacaccggatgaactattccgaatcagagctagattgcctctatcagacagcctgattaggagtgttcaaggtactcctgcaaggtaggaatcttctttgttgtaccctgcgataaaaagcaggtactttagatatgctttctcactgtttagggcgaggaagcggttcctcttatagagatgcgtgttaaaatcttcaaagaatacgttggtcgatgggcgttttcaattaggtaaaaagagggactcatatacagagtcagtctgagaggtagtatgagcattacacaaggtctgccacaagattttaagcctgatacctacgacgcgttggtgatcggcgcggggtatgcaggtgctgtatgcgcacgccgcctcgcggaagcctgcaacttcaaggtcgctgtcttagagcggcgcaaccatatcgcaggcaacgcctacgattactacgatgaggcggggattctggttcacaagtacggtccccatatctaccacacctacaacgaccgtgtgcacacattcctttcccgctttaccgagtggactgactatcagcacaaagtgcttgccaacatccatggcgcgctgatgccggtgcccttcaaccaccagtcactgaagctggccttcggagaggagaagggtgagaacctctaccagaaactcgtcgcgaccttcgggcaggacaaaaaggttcccatcatggatctgcgtgagcaggacgatcctgagctcgaggaagtcgcagactacgtctacgagaacatcttcctccactacacgatgaagcagtggggcaagaccccggatgagatcgacccggctgtgatgggccgtgttccagtctttatcggcgacgacgaccgctattttccgcaggcgccgcatcagggtatgccgaaagagggctacaccaggctcttcgagaacttgctcaaccacgacctgatcgatgtgtatctgaatgtcgacgtgcgtgacattatgaagctcaacgacacgacgattacggtgtgcgacaaaccgtacggtggagaggttatctataccggtgctctggatgagctctttggattcgatgaaggggcactgccgtaccgcacggtggatatggtctttgagacgcttccgattgaccacttccagccggtcggtaccgtgaactatacggtgtctgagaacttcacccgtatcactgaattcaagaatatgaccgggcaggtggttccgggcaagacaaccatcatgcgtgagtattcacgcgcctatctgccgggtatgggcgagacgccttactacgttatcaacgacccagacaacatcgcgctctacaagcgctaccgcagccgcgttgagaagctcgtcaacttccacccggtgggtcgtctggcggaataccgttactatgatatggatggggtcaccgaatctgcccttgagctctccgatgatataatctcgcatcattaggagtcgctgtgcaaaaaacaataacttttggcattccctgctacaactctgcggcgtatatggaccactgcatctcttctatcctggaggggagcgattacgccgaggacgttcagatcatcatcgtcgacgacggctcaaacaaggacgacacgccccagaaggcggacgactgggccaaggagtatcccacgatcatcaaggcggtccaccagccgaactccggccacggtatcgccgtgctctccagcctgaagagcggcgatggtgtctactacaaggtcgtcgactccgatgactggatcgacaaagaggccttccaggcgctgctgaccacgttgcgtacctttatcaagacggatacccgcgtcgatctcgttatctccaactacgtgtatgaacacgtggaggatgggacccacacgaccgtgaactatgggtttgcgctcccgaaggggaagatcatgacgtgggatcagatcggccacttcaatatggcgcagaacctgctgatgcactcgctgtgctatcgccgcgatctgttgctcaacggtggcatcccgatgccggcgcacaccttctacgtggataacatctacgcttttgtgccgctgccccgtgtcaagaccctctactacctggatgtcgatctctaccgttactttatcggtcgtgaggatcaatccgtcaacgagtcggtcatgacgagcagagtggaccaacagctgcgcatcacgcgcatcatgatgcactcctaccatctgtacgatgatgtaaagcagacaaagctgcgcaactacatgatgaactacttcacgttgatgatggcggcgtgctcgatcttctcgaaactctctgagaagccgggcgctgacgaagctctcaagaacatctggactgagctcaagtattacgacccgaagatgtaccgccgggcccgtatgggtctggtcggcatcgccacgaacctcccgtcagagacgggcaaaaaggccacgatcggtatgttccacatggctgcaaagcttgtgaaatttaactagtattcctatacagcacgtatcaactgcctcctagttcccgaaatggaatcaggaggcagctttggtttactggtaccttagagatgagcagtactcccagtcagtaaggttgacctatggatacagtacacgcagcgcagcagctcgaacagatagctcaggatatggatacgatcgcccgattcgtgggtgcgcaggatattgaggagctgacggctgctgcaaacgagagggtgcttgggatacctcaggtggatgtgctggtgctcttcgggggagcgattctggcaggtgcggatcaattcgcgcaggcgatgcgcaacggcgttgccacaacctacgtaatcgacggtgaggttggccacacgacgcttgcctttcgccagagcgtacggaacctgtgtttggtagtggagttctccgattctgcctcagaggcggagatcttcgaggcctatctggagtacatctgtgggctccacgctgatctgcttgagacgaaatccaccaactgtggcaacaacatcaccagcctgcgggacttgctggcagcgtacaaggtttcgtgccagtccatgatcctgatgggcgatgagacgatgcagtagcgcatcgctgctgtggcagccaaagagatgcctgatatcaggaccttgagctttgcctcctatcaggcgaaggtcgtggtcgatgctgaaggagcaagccctgcctgggcgtttaagaatgaaccgcgcggtatgtggtgcagggaccactacttagagctgctgatgggggaagctccacggctgacggataccgcagacggttatgggccaaaaggcaaaaacttcatcgtgcccgtgggggtgccggcagaggttacccgtgcctggaacacctgagagcgcagtatcccgacctggtacgtccttcacgagcctcgtaacactcatatagatatatagtcctatagtcctatagtccgctacctggctctcacgtgccgataacagcaatacaactgtccagtcatcgtttccctatcggcagaaataggggacatacagaaagctgtgcacctctgtcttggaggatcccggtgctttacaacgtttctgtctgtccccaggcatgcggagtaggacgctccgcatgccctcagtatacgaccatgggagtatcaattggctgaggttagcttgataccgatgatgctgacgatcagcaaaatcacaaagagccagatatttccccatgagtaatggcctctcaggcacaaaacgcacgttatcgtgcaagcgtccaagaatgtgattctagagatcctgtgcggcgatgagcccgtaggagcttgtggcctgtttgaccgcatcgacgattgccccctggatggctctcattgccatagtccccaccaggtcgattggagcctgcacatcaccggttgacatcacgaaaatcgtatccccgtcgtttgaggtatgggtcgggcagatcgcatgggcatagccgtcagcggccatctgtgccactttggtagcctgtggctttgtgagcttcgcattggtgacgacacaggagatcgtggtattggtgtgctctaagggcatcaccaggttgtccccctgatcgatcagtgcctgttcctcgtcttggatctgtgtcttatcaggggagagtaaacctgcgatcggctgcagggtgtgagggtcaacgacgttgccggcggcattgaccgcagataaagctccgaccgtgagctttccggtgttttctacggcctcgccgatccctgatttcatggcgcgctccatgccggccagcttgccgaccgtgcatccggtgccgacgcccacgcaaccgcgctcaagcggttgctcacgttcgttaaaggcggcacgtactgcattgacgccgtcttctgcggtggggcggacatccgcctttccacaggtgaggtcgaagagacaggctccggagacgatcggaaccacgccgacgcctacatccagtcccatgccacgccgctcaagctcttctgcgacgccgactgaggcggcaagtccataggctgagccgccggaaaggataactgcattgaggatctgtacggtctcctcaggccgaagcagatcggtctcacgggtggcaggtgccccaccgcggacatccaccccaccagtggcgccttcggggcatacaattactgtgcaaccggttcctgcttctttattggtggcgtgtccgataaagatattgttgagatcacgcaaatgatttacaggcatactgtggttcctttcaggaggtcctcaagcatcgtagacggggctacgggagctagcaattcccgtacgacgagggtgatcggcagccccatgatcgtatagaaatccccttcaatgttctgaatcagcagacgtccgatgccctgtacgccgtaaccacctgccttatcaaaaggctcctttgaagcgacataggcgtcaatttcagtatcggaaaggggatagaaggtgacctgtgccgtatcgacaagatttttctcgtagtggctcttttggtcgatcacacaggcaccggaggagacaaaatgggttaccccggacagtttgtggagcatcgctttggcgtgctttgcatcgtgcggtttgcccaagacttcaccgtctgctaaccagacaatcgtatcagcagcaaggatcagctcattgggatatttgtcagcaatgacctgagctttgccggtggcgaggcggcgcacaaggtcacgtggggcttcatcaggcttgcgtgtctcatcgatgtcggcgggctctatctcaggggtaaagccggcttcgtgcaggatctgcagacgtctgggagactgtgaagcaagaatcatatggtatagacttccttagagtacaaaaaaggcgaaggcttaaatgccttcgccttctgtcgatctggatagatgctactcgatcgtgattgcgcttgccgggcagttgtcggctgcttcctgtgcggaatcctcggcgtcatccgggacctcgtctacgatgacagaagcggtgccgtcgtcaccgattccgaatacctcagggcaggagcttgcgcacataccgcacccgatacaatcctcagaaactgttgccttcataataaatcctctcgctcgcaatacttacggatttaagtattgatgaatatcttgagtccctttcactcaagtcactatcttttgtaccttattggagacaaaaaggctagtgcaaattagataaaatctgtagtttgcttatgcagtggttgaacgaccctggatttgttttttaacagtcaagtaaatgagggccgatagacctttgccgaactgtgaaaacccgtctttagcttttagcaccataattcttcaggatctgggacatggtccggaacccagaaagccagccctgagctggatttttcatgccttgaagcttaatccggaaactgcttcctggtggaatatatacatggtgctatggtgctttcgtctaacaggggtggcagatggcctacttcctcaagaggacgcgcaacaaaaaggggctctatctccagatctacgagagtcactgggacccggagtgcaggcataccgcgaacaggtcggtaaaggcgctgggctacgtggatgcgctcagggagaagggcatcgaggaccccgaggcccatttcagtgtgatgcccttctaattgtcaagtcgttttgagcatgcgactctgggcaatgatgtcatagtacagctcgcgcgctatgtatcgcttgacacatcgtatcgcctcgagcttggagtgccccttagacatcttgcgggccacctaagcgcgagtcctgtcgtctatctgcagccttcctggcgcagcgatgtgtattgcgctgttcgctgccctgccagcgcccctgttgagcctgtggagtgtcgtgagccccgacgacgcaggacgcgctgccaccccgtacagcagaacgacgactcgctgcttgagcctctccggattgtcccccactctgatcatcagctggacagcgccctgcgagctgacacacttctcctcgagcaggagcggtgccacctcctcgaggatggccccgatggccacgtcgaggtcctggtagcgaccggcgagtgacttgagggcgatgtgcgtgggcgagcgcagggtcgcgctagccggacgcgcccgtccttgacgcagcgtaatctggggacgaggcgggcggttgtcatcgcgcactactggtcgcacacggtgtcgggagccgagacgatcagggagcggatctgctcgatcgcggccttgtgcgccttcagcgcagacgctctcgccctggtcaggacccgcaggctctcgaccatgtcgtccctacccttcagcgtcgcgcaccacacctcgctcctggcgtccttgtgcgccatcgcggcgtcgtccttgcccctgctgcgcctgacgaagcagtcggaggcgctcacctcgacgacctgcacgtgctcgcgcgagaggtgcttaaagcagctccggcaccgtaggtccctgtgcactccacgccgaagcgggccacctcgccgttcgagcgggcccacgcgagcatctcggcgcacccccgcctgctcctcgggaagaaggcacgctcgacctccgtcccgccggcgtcgacgccaacgtagatgaccctttcccccctgtccttgttgcatgggcgaccttcaactgcttacggctgaacgatcgcctctgccatttgcttctcgatcagaacagtagggggacgcctgtcggtatcagacccttctttggtcacgggagccgtcagggcgaaggccctagtgggtttgcgccctgggcatccgacagatcacagaagcgacatcgatcaagtcggttttgtcatgggtcagggcgccgggggcacctcccccaccagatttgcacaccccgtcggatagtgaagcatctggcatctgtgagtcttatgtttagtcaagtcagaatttcgtctttgagcatgacttcttttcgggtttctgctctaaaatttcgagccttcgttgattcctgtggctgaaggctaggcggcagaggcggagcgctccttccggcgcttcctcgagcgttccttgttgcgcttcctccttgcctcgaccttccttgcctcctcggccctgtcctcccagggcatggcaggctacaggtcggagcagcgcagcatgagcagcgataccaggctgtcgatgttcctgaagccatagtccataggcaccgtcaccttgatcttgttgttgatcgactcgacacgcccgttgccggttccgagctcgacagcggccaccacgtctgcatgcctgcacctcaccttcttctcgactgcgacgacgggcgcgatcctgcagtatgcggcggccttcagccaggcatcgagcagcccttgtgcctcatgcgtatccccagcgcggaagacggcccttaaggtccttcttgagcgtccatgcccgtgcaagatggccctctgcgcgcttcagctccgagagcttctccctctgccgcgcggtcaggtcctcaggggttcttcgcgagtgcatactgagctgtaatcttttggtggacagtgggattcagggactggcaacagatatgctctgtccagatacccacccagcatcgccaacagattggagagatgagatgtcggtaagcgcaagcgagatagagaaggcaaagtcccgcacgaagccggaaacacccaaacactacactgaagaagtattgcctcgaggctatcgactactacaggaaggcacgtaaggccaacccgaagaagagcatcagaggatgcgccgcgaagcttgaggccaacgacaagaccttaaacgactggatcatcaagcactcaaagaccaaaagggtgacccaggaaaggaccgaggagcagaaggagcttgacaggaccaacaggcgcatacacgagctcgagagcggaaataagttcctaaaaaagaggcagccttcttcgccggaagcctctgtcgaaggacaggttttagctcatgctgacaaagagggcaacctacagcgtctcgatgatggcacgcgtgttgggggtgagcagggctcacttctacagatggctcaaggccggaggtggtgaggacctatggggtcccctcaaggaagccatctgcgcgatatgggaggaaagcgacaggcgcttcggctttcgcaaggtctgatccaagctcacaggagacccaaagttacgcaaaatttacaggcacgacccgctaccgcgtgcgcaggtgcatggctgaactgggataggcggcatctgatccaatgcctccaagaggacgacactgcccgcacctgatacccccgagcgccccgacctcatccggcgcggcttttcgtgtcttgtgccgacagccaagctcgtgggcgatacaacctatcgcaggaccacggcaggcttcatatatctcgccgtcgcacacgatctgtgcacacacatggtggtgggctgaagcatacaggacaacatgagggcagggcttgtcgtctttgccctgaagatggcatattcgcgcggatacgtggccaaaggggccatattctaagcagcccaggcagccagtacataagctcaaagctggccgcctgctcagccgtacccgacgtgaggctctccgtggggagaaccggaagctgccacgacaatgcgctcgccgaatcgcttttcgccacgctcaagaacgagtggtactaccacaagcgcctcttagatgcatccacgaccaagcacaaggcacacgagtttaatcgagtcgtactacaaccgcttccgcccgcataagtccataggagatcgcgtgcccgcagaggtgatgcaggagttcttcgagcgcctcgag

SEQ ID NO: 299 - DNA, 2772 bp, Unknown
  Metagenome-assembled genome
tttcgctctcagacattgcagttgataggagaattcaagaaataatagaaatcattgcagctttggcatacggtaaaggtaggaattcgatttaccgacattggagcatacgctatggatctccctgagcagaccttaatcagtaactacaagagtgtgcagcaacgcatcgcaaatgcctgtgaaaaggcccaccgtgacccgaacgaggtgcagctgctagcggtcagcaagactcatccaattgacgatatccaagccctcatgaaacaagggcagcgctccttcggcgaaaactatgtccaggagatcaacaagaagtatgaggccttaggcgacacagtcgactggcagatgattggccacctgcaacgcaacaaggtgaggtacctgatcgacaaagtgagcattatccactcggtcgacactgtgagattggcacagcaaattgataaggaagcggcgaaacacgacacagcagtggacgtgctgatggagatcaacatcgcgcaggaggagtccaagtggggcttctcagaggctgaggcgatcggcgccgcacaggaaatcgctcagttcccccatgtacatctgaagggaatcatgacctcagcaccaattaccgaagaccctgaggccaaccgtccctacttcaagggcatgaaacagctcgcccaacgcatcgatgcggcgcatatcccaggcgtcgaaatgaatgcgctatcgatggggatgacgaaagactttgaagtcgcggtcgaggaaggtgccacaatcgttcgtatcggtaccgcaatcttcggtgcacggcactatgccaataaagacaagtaagcgtaagcagtcgttcaatatacggcatcaaaggaactaggggcgcgccttctttagatgggcacgctctctgtttaccgcaacaaagaaggcatactgctgcatgatacccgccgtgtccccataggaaggaaacggattgacacccccatagtagttcttgattatctttccgatccaagtgtcgaccgggcacagcgccgtcctaccataggcaaagagcgccacacagctcgccaccttgatgcccacaccctgaattgtctccaactgctcaatcatctcatcgtcgggaacctgtgcaagtccttggagatcaatctgtcctgagcacaccttctcaaccgcgtcacgcacatagggtgcccgatagcccaactttgctgcgcgcaggtcttcctctgaagctgccgataactgttccggcgtcggaaagagatgcaactcaggttccagatctgtaggatgtggtgagccgtagcggagggcaagggtatcgacgcaggaacggattgccgggatggactttcgctgtgagcagataaaggtaatgagggtctcgaaaagatcctgcttcagtaccctgagcccccgtgatatccgcgcagctttggtcagaaacgtatcgtccgccgggatggagcgcctgatctgttcgtagtcacggtcaaaatcaaagtagcggtgccagattcgattccattcccctgccgtgcaggaaaccaaatactgcgactcagtatcaggtacactgcgaatgtagagcacgtggtcaaggtcaataaaccgatagaccaggctgtcagctatcgaagcagtctgctctggagaaagccgaaccgcccgaaaacactgcccactgttgataatcttttccgcatcaaattctccgtcgaaatgaaccacagttttgaatgtcctcatactgagctcctataagacgccccatgtctgaatggttgggattatagcccgacacacatcgaacaatcgaacaggcgactaccgtgctcctcctacacatgaaagcaaattcaacagtatggagcaattgtatttgtgcatctcaataaaaactggctctgcagtagttcatatgggtgccgatccagcaaagtgccagccctggcacggaaatcacgcagatatggaaggggcggctccatgaggggccgccctgtgcttctctcctctagggaaacgatgattaattcccaatgatgtgccagaaaggaccagccacgtggcctttcgcggccggcataggcattaatcatcatttccctagattcgactttgccaaaagtattccggaccggaggaagggctgcgcatggaaaagatttctacgctgggcgctcgggcttgtgaagacggtcgtgctcggagtccgcatcgaaaacggagggcatcgtggtctttgcaaggccgtacaggaaggaggcgctgcgctgccccgtatgcggcaggagatgcgcctgccatgaccatctcggcatacgccgatggcgcgccatggacctcggaagctcgatgggctcaggcgcaaaggtataagacaagacgagctacaagaaggaccacagatacctcacggtcgtcgtcgaccatgacaggggatgcctcgtctgggcgcacgagggatacacggcaaggaggtgctgtccctcttcctggatgagctcaggcgctccgaatggcaggcagcgcgcaacctcgccgaggaggcctcccgcatcaaggggagcaggtatgagccctgtcaatataatggacagaggaatctcagattttttatgcggtctgcatcacctttggatcgtatgcaaggcctctctcgaggcgctcgaagaactcctgcatcacctctgcgggcacgcgatctcctatggacttatgcgggcggaagcggttgtagtacgactcgattaaactcgt

SEQ ID NO: 300 - DNA, 39451 bp, Unknown
  Metagenome-assembled genome
tgttgttatcgttcgtattcgtcgtatcggacgtcgtcttttccgttgaggtgttctgttcggtcgtagtagtccggtcagtgttctgctcggtcgtagtagtccggtcagtattctgctcggtcgtcgaggacgccgttgtctcggtcgcgttcgcgttcgcagaagtctgctcggtggtcgaacttgaatcctggttgttggatgtcgtcgtggaggtcttggaccgtctcgactttcctgaacgggagttgctcgaagagctgccgccgctcacggcgatgctccagctggagttgtccttgtagttcggcgccgctgccgtcgcaaattcctgccgcggggtgttggcgagtgcagtgttcaggaagttgacgaagataggaaccgagctgacgcctggccaaccctcagcaccgttgatagtgaccatgtcgccgttatcgtttctgtaaccgcaccacaccgccacagagagctttggggtataaccgatcatccacaggtcacggtcattctcagaggtgcccgtcttgccggcgaccggttggttgatcgagagccttctcagcggctgcgcagcggtgccgttctggactacaccctcgagaacctgggtgactgcccaggtggttgaggtgtcctcaacctgctgaccgtcgtcctggtgctcatagacggaattgccgtttctgtcctcgatcttggtgatcgcgaccgggtttctgtggacgccaccggaagcgagagtcgcataggcctcagccatctgcaggggcggaacgccagccgcgcccagggtgatggagggaacgacggggatgtcctcgtcgataccgagatcctttgcggtctgcacgatgttgtcggcgccaaccgtgaccgccacctgtgcataggcagtattggaggagagctccgttgcacgggcgagtgagatgatgccgtactggttgttgtggtagttctcaacgcaccaggtcggggtgacctgctgtggggagttgcagttcaggaagatattggggttcatgccctggttgatcgctgtcgttaaggtgatggtcttgaatgaggaacccggctgacgttcgccgtaggctgcgacattgaactggtcggagttgtaatccttgccgccgaccatagccttgatgtagccggtctgagggtcgatcgctaccagcgcagagtcgaggcgggagttaccgctcgagctgatctggtttgcgactgcggtctcggctgcccgctgcatgttcgggtcaagcgtcgtgtagacacgcaggccacctttgtagatggtgtcctggtcgaagtcctgggagagctggtcgcggatatagtctgtccaataggggtaggtgccgcttgagtccatacccactgagccctcgttgatcgtgatcggttcagcttgtgcggcgtcgtgctcctcctgggagatatcgcctgcagtaagcatatggtccaggacagtgtttctgcggtcaagggccgcatcgtagttctgggtagggtcataggtcgaaggggactgcggaaggccgcagagcgtggctgcctcagacagggtcaggtcgctggcgtgcttattgaagtaggtgagggaagccgcttcgataccgtaagcggagtggccgaaatacacggtattcagatacatcgtgaggatctgatccttcgtgtactgcttttccatctggattgcgatataggcctcacggaccttacggcgcagtgagtagtcgaactgctcatcggagaggaccgtgtttctgaccagctgctgggtgatagtggagccgccttcggatccaccgccgagctggactgctacagcacgcagaatgccctgggggtcgacgccgttgtgctgatagaaccggatgtcttcggtgtccacgatgcccttgagcacgtagggggagatctggttctcgtcgacgtttctgcgattctgctgatagaactcagcgatcagggtgttgtttgcgtcgtaaatctcagtcggctcagatgagaggtacgcaccagccgaggtgtagtctggcaagtcctgaagccaggagttgaccagctgtgtacctgagatcgccagcgcgatcagaagcagcgcgataaaaccgaagatgccggcaatgctaagagctacggcatgggttttagaatgtttgcgagcgcgccgtgtgcgaatgcccatgaagttccccttccatatagatactaaccattatatatggaatgttcataagactccaaaagggagggtcggcataccttagtcacttcacgtaaatagtgcttttctgtaggtattctgtacgagaggctcccaaaggaaattccagcctagaacatctgtttggaagccaccctaaagaatcatatcaaaagcgtaaacgatggttgagacccaatttagcaccgggcagatctgacacccctacatggtacccgaacgcctcaccaggcacaatggtacgtgttaggtgcggtgatccggccttaataagctctatatacccacacgtttgattcactgatcaggttcagtgctgtgtgcctgaaaagtgctgaaggtgtgcacatcgctgaaacaaaacccgaaatcagatgtagttcagcggtggcggtctcttcagactggcacgatctgaaattgcggtatgctagatcactgcaaaatatatagcctatatagccgtggggtttcgatacatagaggagatacactatgccgccagtcgacgaacagctgaaagttatcacttcaggcaccatgcagatcgtgccgttggatgagctgaaagagaagctcaagcggggcaagccgctgaacatcaagttgggcgtcgacccgacgagtccggatctgcacctcggccatgcagtgccgctgcgcaagatgcgtcagttccaggatctggggcaccacgtcacgttgatcatcggcgatggcaccgccctgatcggtgacccttcaggccgtgactctacccgtccgccgctgacggaggagcaggtcaacgaaaatgcgaagacctacgtggcacaggccatgaagatcctgaatccggagaagaccaggatcgtgcacaacggggactggatcaagccgatgaagctggaccagctcttggggttgctatccaagttcaacgtcgcacgcatcctcgagcgtgaggatttccacaagcgctatgaggcagggcttccgattgcgctgcacgagttcatctacccagtccttcaggcttacgattccgtgatggtcaaggctgacgtggagatgggaggcaacgaccagatcttcaacctgcttgcaggccgtgacctgatgcgcgatgaggggatggagccgcaggtggtgctgaccatgccgctcttggtaggcctcgacggcgtcaagaagatgtccaagtcctataagaactatgtaggtctcaccgatcctgccgacgatatgtacggtaagctcatgtccatcaaagatgaactcgtcccgacttacttcagactgtgctctacctgctccatcgactgcatcgacgagatcgatcagagcttcaaagagggcactgctgatccgtatgctctcaagcgtgagctcgcacgcaacatctgcgacctctatcacggctccggtgccggcaagaaagctgaggaggccttcgacgcgcagttcaagcgcaatgaggttcctgaggatatcccggtgttcccggcgagcttggctgctgtcaacgataggggagaggtgtatctggcaaagcttctggtcgatgtgaagatcgcccagtccaccggtgaagcccgccgcctgatcgatggaggctccgtcaagattgatggtaagaagattgctccgaagttctacaacgtcgatccctcactcttccagggtcagaccatcctgcagtccggcaaaaagcgttgggcaaggcttgtctaaatggctgagaatcatccattagagctgcttgccccggcaggcggccctgagccgtttgcagctgccctggctgcgggtgccgatgcaatttactgtggcttcggcaacgatttcaatgcccggcgcaatgcggacaacttcgacgacgagagtttcgaagctgcctgccgggctgcccatctcgtgggcgtcaaagtctatgtgaccgtcaacgtcgtaatcaaaactgaagagatgcccaaggtattaggagtcatccgccgtgcctggttgctcggtgccgatgccttcatcattcaggactggggcttgattgccgaagtcaggcgcacctggcccgagatggaggtccatgtctcgacgcaggccaatgtgcacgacgcccgaggtgttgagtggtgcaagaaactcggcgtcacccgggtgacgctttcccgtgagctgagcctgaaagagatgaggacgatcgcgcgggtcggcgtgccgcttgaggtctttgggcacggtgctctgtgcttctgctattctggcctctgtatgctttcaagtctctcgggtggcagatccgccaaccgtggtatgtgcgcgcagccctgccggctgccctataccttggtggatgaggacgggaaggtccgttctcccaagggcaacacccgtgccctttgcccgaaggattactgcacctttgatgacctgaaggagctggagaaggccggagtctcctcgctcaagatcgagggacgtatgaaagccccggactatgtctatgcagtcacgagtgcctaccgagcacagctggacgacgccgatagcaacagaaagcctactgctgaggaggaagcgcagcgcaagcggcgcctcaaacggtccttcaaccggggctttaccgacggctacctcagaggcatccacgataattcgatgatgagctacgctcgctccaacaaccggggcgagctcgtaggggaggttgtagactcccaccgcctggaggataccctcgtgagaaggggtggctccaatgggggacgccgccgcaatcgacatctctcccaggcctcagtgaccattaagctgaatgaaccggtccagcagggtgacttgctcgagatcagaccccaggataatccctcacagttcctgactgcctatgcgcgcaacgacgcgccggcagggaccgacattgaggtcaagacgacacgggtgattgagaaggggtcgctggttcgagtgatccgctccaagagtgcacttgataaagcgcaggaggcgctgcatgaacagatcacccgtaagcgcccagtctctgtggagatctccgcccacctggggcaacccttccgcgtgacgctcacgacggaggacggcatcgctgccactgctgaaggttttgttgtggaaaaggcacgcactaaagcggtggctaaagaagagctgatcgagcatgtctgtcggatgggacagactccctttgagcctacgaaagtgagctgtgagctcgatcctggctgcggtatgggcttctctgcagtgcacaaggtgcgcgcacaggcttgtgaggctttgattgccaacattttgaagccctatacgagccgggtagaacacactgctttggtccctcatgcctggagaatacaggaacggttgcgtgaagtacggagtactcatgatattcaagatcccctcagtgtgggccctattgaggtagaaatctctgctacggtcgctacacctgagtgcgctcaagccgcgcttaaagcgggggcagacgtcctctttgtcaggactgatgatctgacacagggggagtggcccgaaggcataatcccgatagcagatgaagtgtgtcgcgagatggaccatacacggatcgatccggcgatacagccgggtaagcgggtgcttgtcggcaatgtctctgagcttgcgttggcgcaggaacgcggtgcgctcgccgaggtacgccagctgatcccggtgcacaacgaatctgccctggtagcgcttgagcaggcgggagcagaagggttctggttctcgccggagctcaccttagaggaactcaaggccctcactaagctggcctcggttccctgtgggcttgtcgtttcaggcaggacaagggcaatgacgagcgaacactgcattctgcaggtagtggaccagtgcatccacgactgtgcgcactgcaagcttcggcaggagcggctctcgctcaaggatatcgacgggcaggaactgccggtaaggacaaaccttcagggcagaagtcacctctatgcgacaaatccgctcgatgctaccccacagattccggagctctaccaggttggcatgagaagatttatggcggatgcaacgcttctgactccacaggaaaccaagtttgcggtcgcgcgcgttgtccgcgcggtgtatgctgcgcaggtgggtagagctgtcgcaccacgcgaacagggcgccaactcaggtcatcttttcgtcgggattggctagttttaaacggaaagattctatgcggccccgctctggcaaacttttctgtaattgctagccagagaggggtattatcttttcaaacacaggtgagggtagtgtggctaccccaaacgatgcgttgaattgagcgtcgttaagagaggagagagttctcgtggctgtcgataagaaattgctgtcatcgaccatcgatgtgatccgtcagagtctgcaggcagatggcggtgacattgagctcgtcgatgtggataaagacggtgtcgtctccctggagatgcaaggggcgtgcgcggggtgcccgctttcttcctatgatatgtccatgggaatcgagcgcattttgaaggagcatgtacccggtgtcacgcgcgtgcaggcaatgatgtaaactaaaatacgctcgtcacttcaatcgggggccgagagcctccgatttttttatgcaaagaaaaggtatctcatgtggctcaatgacatctaccaacatctcgatccggtcgcaatccagatcggaccactctcgattcgctggtacgggatcgcctacctcgcaggctttatctgcgcctacctggtgattcgctccctcaacaaacgctggaagctcaatatcaccgacgacgatctgctctccataatgatcggcgcggcgctcggcgtgatcttgggggcccgcctcttctatgtaattttctacggcgcaggctactacctggcgcatcctgcctcgatctttgccttctctgagggtggcatgagtttccacggggggttcgtcggagcactcatcggtggcggcatcgtctgccaccatttgcatatctcaatgatgagcatgacggacatagcggtgtgcggtgctccgatcggcatcttctttggccgtatcgccaactttatcaacggcgagctctggggtaagccgactgatctgccctggggtgtgatgtttgagaatggtggccacgtctaccggcatccctcccaactctatgaagcgatcctcgaaggtctcgttatctttattgtcctctttgccctgagcagaaagcgtcctccacgtccacggggtacctttatcggtacgtttatgttgctctacggaatcttccgcttcctgattgagtttgtccgtctccccgatgcgcagctggggtatctgttgggtactgactggctcacgatggggcaatgtctctccatcccaatcttcattatcggtatcctgatcttagtctttgcccacaaggagcagctgccccaggtgggatatctggtagaccacaccaagtgatcttacatccccgctacacagatcccttgaatagaatatccagtgttctatactgaagggttaaaaaccgtgagatgttgtggttcacgtgcactctctgcacgtgattaaaagggaagccggtgcgaatccgacacagccgccactactgtgatacgagctatgctcagacgcaatcccattgggcatctgcctgagaaggggtctgaacaggggactgaagctttcagttccacttgttaagtcaggagacctgcctcagcgtttgtaagttgtatctgaccgggcatgggggaaggagacttatcacaggaagtagcgggatgggcacagtggtgccatccaggtatctgtgatgcctctctcctttgatgggaaaggagaagaagacatgaaacggtgggtaggtagcaggcgtccgggacggggacaggctgttactgcatggattgtcagcgtagcgctttgtctgagtatggtgccattaccagctttggctgagacagatacacagaagtcccaagcagcttcggatgtggcaacaaccgaacccgtatcgcgctccattgcgaagccgtcgaagtcccaagcagcttcggatgtgacaacagttgaaccgagccatactgaggccggcgccgctgacagttcgaagaacactgcacagccaagtgcacaggattcaaacgtcgaatcttcagagcaagtgcgacgtgatcccgtacaagcagattcacaagcacaggcagtaactaatggtgctgacactgcacaggacacctcgcctgagcaagctacggtacccgaaacaccaaaaagcgcagcagatattcctgatacagacccaatcacggccacgatcgaagtgatcggtcctgacgccgtgggaaacgatacggactggctacagacgcagagcgttgaatatagcgatgggaagacgcatactgccgaagagttgaccaagatgacctttgacaaagctgggcttactgccgatatccaagaaggcagcatctacggggcgttcctcaagtcaatcacctctcccttcgacgggaaggtataccaatttgaccgtggttctggcaaatattggcagctcttctttgatgggaaaccagcccaggagggaatgtcctcaatagatctctcgcaaggtaccaccattgtctggtactactctgcatccggcgttgagagcacaccggatgccagaagccttggaggcaatccggtcaaggttgacccaacagccaagcctgattcttcagtcaaagcagattggggaggctttgcgaacggcggcagcagccaagcggtggtcgaggattcagctcctgacgcggatgatgtgaaacctgcttgggataagcctttccatgtaggaatgggcgcatctgatccgatcattgccggtggctccatctatatggtgggggatggcaacctcatgaaaattgatgagaagactggaaagctgcagcaatccgtcaagattgcgaaccactactcctatttctgccgtcctgcctacgtcgatggatctatcgtaattccgttcgatgatggcagccttcgtgcctatactgctaacgatttaaaacttgcgtggtgtacaccgaggcttgatacgaaagggacattgagcccggatggcttcgaaaacttgcaagctctgagctctgtgagcgttgggaataaacgtattctgacagccttcagcgatatcgattattcaagtcgtgaggatgagaccggcattctcgtaagcactgaccttaacggtgaaaatcgctggcacaaagtgatcgctcgcgaccggttctactggtgcggcgccgtacatgtcgacgataccttcataatcggtgaccaacttgggaatgtgtatctgctcgatgggaaggacgggaaggagctttcgcgggtctccttaggtacttcaatcaactccactataggcaaggtgtccgatgatacgtttgcggtctcagatactgctggtaccttgcatatcctcaagctacaaaaggggaaactttctgaggttcgctcagtccactttgcgaataagtccacatcttctccggttgctgcaggaacggttgtctttgtaggaggtcttaaaggtcaaaccggcgttgtggctgccatcgataccgcagacgcttcctctgcagtgcgggtgatcgacgtgggggagggtgaggtccaatcgactccgctcgtggtacagagcggctcagatctttccatctatgtgacgctcaaccatcgcccaggaggtatctatgtagtccattaccgtgagggaatgctcggtccttcctcgtggctctatacacctcaggacaaaatctatcagaattggtgtaccgcttccccagtgatgggtaaggatggcacgctctattacacaaatgattcaggttatctctttgccttgaagcggggaccgagtgggctggtcttctttgacgcacaggatggaagctctatagactcaattgcccgcgtaaaactccgccgtatcacagatctgcccgctccacaccgtgaaggatatacctttactggttggtcgtttgataaagagggtaagttgccgctcggaccgagcttacctgcctccggtgctacgctgtatgcgcagtggaagcagaatgcaactgattcgggttcctcaaccgactcacaaccggatggaaataacaacaatgctggtggatctggaaaccaagataatggccaggcacctatgggtaacggtttcatcccagtacagaagaatcctggaggtggaggcggagcgttctttggtactccatccgctgcaatcggatctcctgccagtaatgccaacgtggcttcttccagtgcagctcctatgcagacacagcaggcaagcgatcagaaagaagattccgctggaacctccggaagcctgctcggccagcatgggaatactagcaacagccaacaggctgacggccatagcgagagcgacaacgctggcggcgatgtgaacagctccgagaattcgtctctgccgggctttgtgatcccgatcatcgggattatcgcaggcgttgttattctgatcgctgcattccacaattcaaataagaaaaggactcatgcgtgagtaatgactatatagttcacaacacgaatcaggaacctgaagacgccgacaaggttgacaagcagccccaacaaaatccgcatcccaaacgtggactgatcattctggcgattgtgatcatcgcagcctcggtggtgggcttcgtttttgcctttcggggtcagggcggtgcctcactcgagacaactgaacctacccaggcagggcagcaacaacaggtgagcgttactgaagatcaggtgcgctcagcgctgcagaatttatcagccaacggacaggatgtctcggttgatccagacagcgtcacgattgcgatagacaacaataaagtctggattgagcagaatgaagaggatgaagccaagaagatggccctcctcactgcgcaacgtactcagagcctcacaaatgctttgagtgacagcgcaggtggacaggtctctgcggtctggattgcggagaatgctgagggtacggtccgctttgcaatcgagcagggtacttttgctgacacgattgccgacaacctgcacgatatccttgatgcttgcgatagctatatcttctcaggggcgacttataaagagctcagcgacgattcaatcgcgcagcaaaaaggccatacgatcacgttgcctgatggctccgaaattccagttaccacggacgtggatgaggaagacttaggagccgaaacgacgggggcgcagcagagcaaagcacagacaaatggggcctcctctgagaacggacagagccaaggtgcctttggcaccggctctcagagctcagagcggggcagtctgcttaccggaggctcttcggtgcagcaatcacaaagcacgacatcttcttcaaataatggtggaaatgcctcctcaggagaaaatgacgggaccatttcagtgagtgtccaggttgatggttcatatggtgggggaggtacgacgagccgcacggtacggatccaggagggttcaaccgtgtgggatgccctgcaggcgagtgggaactctgtacagtcccagatgacctctatggggatctatgttaccggtatcaacggtgtctctgccggtaagcataccggttgggtctacagtgtgaacgggattgagccggatgtaggcgccggcggctatactctgcacgacggcgatcaagtcgtgtggacctttgtggaagtgcattattagggggaattcagcagatacgtatggaatcgaacggtgtccaacagagtcttgagacaatccatcccaccgtgctgctcctctatacggtcgtgatgctctgcttcacgatgttcgtgatgcagccggtctatgtggcgatctcgctggtgagcggctgcatcgttcacggaacgcttaagggattcaggagaaccggggcccggctgtcctggcagatccccctcatctgtatgattgcgctgttcaatgcgctgatcacacagttagggaccactgttctggtgagtgctggaccgatacgtatcactcttgagagcttgtgctacgggattacgatggggtgtgcgctggtcgccgtaatgctctggcttgagatcggagccacgctggtgcgtgaagatgctctgatggaggtctttggcaaacgattcccgaccctcacgacgatgctcacagttgtcttgcagctggtcccccagctctgccgtcggttccgtctggcggttgggctctctgatgcctgcagcgcctcccatgcccaccatccttcccgaaagcgggcccaggtgctcgccggtggtattctcttgagctggtcgctggaagattccctcgagcgctccgatgcgatgcgcgctcggggctggggcatcgctgataccagaagcagctaccacaattggcgcttcacggatcgggatgcagtctgcatagctgtggtgatcatctttgggattctcaatgcgatctgcgcggttgccgcagtgggtccatgggagttctatccggtgatgccacagctgcgcctgtggtgggggtatgtgccgtacctgattctgtgcttattccctttgataccggttgccattgatgcatacgcttggagagatgtacgcaatggatgacgaagcactccgcgtagacaatctatcgttttcctatcccgcgatcgacgaggatagacccacccagccggtcttggatcgcgttttgtttagtgtagagactggagccttctgtgtgcttcagggctcaacagggtcaggtaagacaacccttctgaggttgataaaacccgaactcaaaccgaaggggatccagcagggtaccatcaccctgtttgggcaggaacagtcgacgatcaccgaacgggaaagtgtgcagctcgtcggctacgtcttccaaaatcccgagaatcagatcgtgtgtgacacggtgtggcacgagcttgcctttgggcttgagaacttagggctcgaacagacgcagatgcaccagcgtatcgctgaggcctgctatttctttggaattgagccctggttccacaagaagacgagtgaactttccggaggacagaaacagatcctgactttggcggcgctcatggtgatgcatccgaagctgctgctattggatgaggcgacaagcgcgcttgatccgctggcacggcagacctttatctccctactctatcgcatgaaccaggagttggggatcaccgtggttgtggcaacccacgacccggagccctttgtgccctatgcggataccttctttatgctcgagcaaaacgatcggcgtgtcgcaggtgtgcgtgagctcagtaaagcggaagagcaaacctatctgagtcagctgccgcaaccccaaccctataagcccgctccggtatcggatgagccagttgtgaccgtgaaagatctctccttccgctattcccgcactgctccctgggtgatcagagacgcaagccttgaggtgtcaaagcaggagatccgtgcattagtcggtggtaacggatccggtaagtccacactcctgaaactgatcgcgggaatggagaaagggcagcggggcaaaatcagcaatgcctgttcaggctcgcaggtacttctcccacagaatcctcaggcactcttcacccatgagagtgtggaggaagagctgatggagtgggctcagactgtcgggtatgagaaggacgatgcgatcacaatgttgaagcagctcaggctgcccagtggtcccgcattccttgcccgtcacccctttgacctatcaggtgggcagcaggaactcttgggattggcgaagctgctgctgacccaacccgcactcgtgctgctcgatgagccgaccaaaggattggaccgacaggcgcgctttgcagtgatggaagcgctgcaccatgcgcagttaggtggcgcgacgattgtggtggctacccacgatgtggggctggtcgcggtactcgccacttcggtatccttagcctttgacaaagggattacggtgacgcagcccactaaagagttcttggcgcacagttgggtttggaggcagacatcgtgacgaaagcgcagcgtatcctccatcacctcgaactgcctatcctcttgctggttccgattgtgatggcaatatcagcgctctcctcaagcgacttcacgggtgggctcaccctgctcgcggcgctcgtctgctgcggcttcctctttgaggaagtggagcgagagcggccgaccctgcggcagattatgccaacggtctgcctgggggcgcttgccgcggcagggaggatcctctttgcagcgatccccgatgtgaagcctgtctccgctatcgctattctcgccggagcctgtttgggccctcgctatggctttgtgaccggagcgctcgccgctttggtctcaaacatgttcttcggacagggagcatggacgccgctacagatgtatgcctggggcttaatcgggtatatagcaggggtattagctgcacaccatctgctggacaagcgctggcagttggcgatagcgggctttctctccggattgctctttgggctcatcctcaacgggtggtacatactggggtatgtgcggccgctgacttgggccaccgcaggaattgccttcgcggcggggatcccgttcgatattgtgcatgggattgcgactgcggggtttctgctcctgatctggatcccctggggacgctcgttaagaagggtactcgcgcggttctagcgggcttctatagaccttccacaaagtggcaggtgtctgagctgcctatttgcaatgaggtctgtttcttagtattatttgatcgtttcttgagaaaaggagatgtgcatgtccgggcattctaaatgggcgactactaaacataaaaaagctgctatcgacgcaaagcgttctgcgctgttctcaaagcactcccgtaacatcaccgttgcggcgagaaacggcggcgatccgaatcctgacaacaacgcctcactggcggcagctatcgcgcgtgcccgcatggtctctatgccgaacgcgagaatcaaggccgcaatcgataaggcgtttggttccggtgcagactctgtcgtctacaagaacgtcgactatgagggctacggccccgcaggtgtcgccctgtacgtcgagtgcctgaccgataacctgaaccgcaccgcagctgacgtccgttctgccttcacccatgcaggcggcaatctcggtacggcaggttccgtttccttccagttcactcgtaagggctccatcgccgtggagaaggttatccactccgacgataagaaggtgcccgataaaaacaacgcaaccgacgaggacgagtttatgcttgcagtcgcagaggccggtggcgaggattacgaggacgacggcgaccagtggatcgtctacaccccgtacgatcagatgcaagatgtccagaagggtcttgaggaccagggtattcaggtcaagggcagcgagctcacgatgattccgaagaccccggtcaagctcgacttggcagacgcccgtaaggtacagcgcctggtcgaccgtcttgaggacctcgacgatgtccagaacgtctactccaccatgaaggtctccgacgaggttgcagcgcagctcgcagaggatgatgactagctctgtacaaacaaatttggtttgaagatggctcttgactggtgtcaggagccatcttcatgcgacgtatgagttgaaatgatatgagctgtgataacaaacagtttggctatactactctttgattggttttgaggaacagatcccaaatgatgggaagggcatgtagtgccactgattaaaaagcttgcctgtgtgattacatttgattcggcgacagcggcgatggaggcagagagctatctgcctgcgcgcggcctaccgggacgcatcattccgatcccggagcagatttcggcaggctgcggactctcctggaaagcagagcctgaggataaggacaggatcgtgaaagcgctcgctgaggctggcattaagtatgcgggcgtctacgtgctaaagatctgaagaatgatccctgttttttctctatgagtgtagatcgaggtcacatggttcagtgataaatgtcactgcactgatgaactgattgcacagggattccagtgagatagtcttaaggttttccacacgtcttagaatcgcgtggtagaagctgacagtgatgtcgtttaagattttggtttcctttggggtatacccgagtgagtgggcacaggcttccagtacgcggtaattgcggcggaagggatccccgggcatcatctggtccagcatcgtgtcgctgatcatggcaagttcctgcggatagatagagtagtagtagcgcttggcggttttgttcgcccgctcaggctcaccctcgaagaagaatattcaaagatccttgggcacgcaaaggcgctgtggcagaaggttgtccagtaggtgtagtagcatcccttgtcgctcatactggtgcggtcgatagctgccaagtccttgcagcaatccttgaaataggtgatggtcgaaagcgcaagtagcccgttgagatcccaaaagtaaagatagagtgcagcgctgctgcaacccaccttgctggcgaccttacggatcgaaacgccgccaatgccatcactgtctataatgctgcgcgcagcgtcgataaatgaggtgaccataagagcccactcttgggcgtgtattttgctcctcccatctatggcctcacctctcgcaatgccgttacatcatcaactttagtgctaggcgatttaaagcgtcctatgttggaaactgtagccctccctctgtttttatccctctatgaaaaccggactgcctacggaatacaccacacgcagtccggcccacgaaaagagaaaggtctcatttcatataggagggatctcatcgagcgtggaacgctccatagctgctgttagattaattcatccaagctgacgctctggtctgcgccgattgcctcagtgctctctgagccattccaggtcatcgttccctcaaatccgtcaatggtggttgtaccgtaggtgtagcccaccgcggctccgacgtatttgccgtttgagaccgtgaagttggaaacgctgcaatccttgatttcagatttcgaaggctccggatagtattgtttaaaggcagaagcatagaaaccgccgccggtaattccgccgatacgctctgagttttcgccggtggtgatcgatacgctctgtacttttccgttctcaaccaacgtcgggtcaccctcaaaagtgccggaatggcctgccagaccgccgagcagccagcagttgtcaccggtctcaatcgtgatatcttccgcagtgcagtttctcgcatactggctgttgtggaagcagcccgccagaccgccgatactgtagcagccatcaggggcggtaacggttccatgtgcgatacagttttccagattcccatcttcctgtccgccgacgatcacgcctgctccttgcttttcagcctgcgtgagcgtgacgtttgcggtcgccgtgcagtttgtaatgttcgcgtgtgaggctccgacaaccccgccgatcagggagatgccgtgtacggaattgtccccgtcgagggtgatactgtcgacttgagcgccgtagtctgcatagccgatcacgccgccggtgcagttgccaccggttacagtgatattctctacgtgcagattctgtacgctagaattctcaccggtcacacaaccaaacaggcccacaccgttttggtctgcggcatcgatcgtgaagtttgatagggtgtggccgttgccgtcaaaggtgccggtaaaggcgcgatcaggattaggcgtttcggcatcctcctctgcgtcggacttcggctcaaagacgccgatcgagtcgatcgtgtcaccaccgaagtcgatatctgcggtgaggatataggagccgctcagatcgtcgtagatcttattgaagtcatccttgctgctgatctcaatcgtctgccgttggctgtcgctttctatagtctgagttgactcctgctgtggttgagtaggctggccacatcccaccagtgcaggggagagcgccagagcgcctgtcagcccaagcgccagcaatcgtgttctcaatggtttcacgtgtaccgtcctttcccattatttgtcttgcctgttcagatcttctgctgttgaagggaggagaactatcaataagtaagctagagctaacttatgaaaatatattagcttaatctgacttttagtaaaggaatgatttcggtgagagcgccctctgcgtaggcaagtagagaagacagaccagtacaggtagtcagtgctttatagaagatttgtggcgtgaaaacccatggaacttcagttcgcgggatgagatgccgtccaagcatgtctgccttagctctcaagtgtttgagggttttagcgctgacttcatctgtgatggcaatgagctatccgcttgatcagaacgtatgtttatgccagcagacatggcacaactatgatgcgtgggccttccatatgtggaaggcggtgagtactttcaaagtacgcacgaactcgcttaggtgggcgctgggtggatcatgtagtggatatggtctttgtcggtttgcatgtgaagtatttagatggtgtgctgcagagcgattttttagtgagagctaagtgatgtttgtgatcatcacctaagcgatgagtgtcttcctttgctagttggtggaaaggatgaggtggcagcaaagcaggtatctcgaagggtttttgtgctcacagtgattgttcaaggtggtacttcccactcttaggtgtcagtgaatatattgcatacagcaagctattgatatttaggcaggtaagacaagcatgcagtatggagcgcaaaccaactacagctgccatctcagtgccaaccactatcgcaagttgaaatgcctttgcctatatgcgaacaacctctatagcaaggctttgtatcaaacaaggcagcatctcttcattgcaggcgggcttttcagctgaaagaccaactatcatctgtgcaaaaccaacgatacctacaagatgctgcaagcctaagtggccccgcacacgataaagggtgtcgcctatagcttgaaagcatcccctacagtattgagaagatgcaagagtggcgactacagctgctctcaagtgttgatctcacactacagggcaaaaggcagtgtgttcttgttgatacttcccacgaacgggttgtagagactgcccaaaagcaggtagcttctacagacctatcctagccatgtcggacatttggatgggcagtgtatcaagggcatcctctctagacagccaacaaccccttagcttggatgagtgctgtgttatgggagtggatatagaagctgacaatctcgccgtacggctcacctctggccatgggcgcttggttggcaggcgatggctcaagtcagccaaccactattgcaacaggcacctggcgtatctgaaaagccgactagacacagacaagttctgacaggtagccgacaaagggagtcggcgtgtgcgagactgcatgctcaaagcgccacgcaccatcaccaacttgttcatagagaagaacacagacacactgattgttagatccaccatgggatgcaagcagggagcagctacggcagaaagaatgatcaagcgttcatacagattccctgtaggctgtccaaacgctagcttacatatcgatacatacagcagaaagagacctacacgtccaaagcatcctgtatgggtggggatcgaatacaagcccgccgacaagtaagcacaccttttcttaggcaagcgcatctgaggcggcctatagcgaacccaaagatagcatcttggtgagtgcagacatcaacgctgccgtaaacattacacacaagcaaaagccagcagagcggcaactgtgtagaggtgttgtggcaacacctcagcaaattcacgtcgattgaggcatgggtcacgccaaaatcccgtaaactgtagtttacgggaatgtcaagatttgatatacagcaggtaggtacagagagggatctatggatttcaaacagctccagccatttgtggcggtcattcggtgtgagagctccatccgcgccgcaggtaagctcgggatctcacagctgagtgtgtcgacccatggccgtaccctttaggaggagctgagagtcccgttgatcctgcgcacctcgaggcgtgttgagacgacgtcggtcggaccgaaggtgtttgagtaagccgagcatatcctctcgaggtgtgatcgcctcgttgagacaagccgaacacgaaagaacaacacgatctatctcggggcttccgcaatcctttctgcgtatctgttgccggacatcttgaaaagcttcacccaggagcatcttgaaaccgaattcatgatctcacagagtggcttccgtgatattatcaccggtctctatcactggcctcaccgaggggatctacgatgtcggtttggtcggtatgaacgccgacgaggagagcctggaatgcattccctttggccgggatcggctcgtgtcagtgatgcctgtgagtgagcagtattccgaaaaggaactgacggccgaagaagtacgttcgctgctcctgcatgaaaacctcgtgctacgtcgcgaaggcagcgcccgcaggatgatggtggaccggatcctggacgtccttaacatagacgaacggacgttacgcatcggtgcccggatcaacgatcaggagacgatcaagaacctggttgaatgtgggtatgggatcacgatcgtgttcgagcgtgtggtagccgaccgtggaaaaaagaaagctccgctcctttgagaccaaaggagctcccggtgagcgcaacctgtatatagcgtaccgcaaagggagtctggtcgacgaggttagcagttttgtagcctacgtgtggctgaaccaggtgggacaggttgcggatgggaaagaaaagacccaacagtaagacgtataagagaatgcagctctcgttcattaaaggaaagggactgcattggtttcactgaagtcgtttgtgtgtagatcacactgagtagtcacgtgagcgtttgctctatcccaacacctgctcagcgatcttgactccttggttcgcgtctttggcgtagtaatcggcaccgaccatcttggcatattcagcgttgagcaccgcaccgccgacgacaatcttgcaccagggcgtctctttgtggagcaactcaatggtctctttcattgctggcagcgttgtcgtcatgagcgccgacaacccgcagagctgtacgtaatctttcttgacagcctccacaacctgttccggttcgacatcacgtcccagatcgatcacctggtaaccatagttttccatcagcatcttcaggatattcttgcctatatcgtggatgtcgcccttgacggtgcagagcacgatcttgcccttgaggggcgccttatttgagggctgggaatcccggattgtgttgaaacccgccttggcggcctgcgcggatgccataagctgtggcaggaagaacgtgcctctctcgaagcggtcgcctacgtcgttgagtgcggggatcaggacatggtcgatcggatagagcgggtcatgctcttggatcaatttcttggtcagctccgggatcggcccttcacggccctgcaggaccaactggtagatagccttctctggatcgctctcatcgatatccgcgctctcttgggaggaagcagtagcagtctgtgcctgtggctttgcatcggttctcgtagcgttgactgtgcaatagtgctgtgccgctctatcttcgccggaaaggactctccaagcgtcgattgcgtcgtggatccgctgctgtcccgggttcacgattgccaagtcgagccctgcggcaaaggcggcagataggaaggtagcattgacgagtgaacggtagggaaggccgaagctgatgttggagacacctaacacggtgcgcacacctggcagctcctgcttgatcgcgcggattgagtccagaatagtcctgggggcgctctggtcggtcgaggcggccagagctaagcagtcaaacacgagatcctgcggcgggatgtggtactcctgggccctcctgtagatcttattgacaattgctaaacgtccctcaacggtgttggggataccattttcgtccagtgtcaggcacaccaatgcgcagccgtagtgggcggcgatcgggattacctgatccataatgtccctgcggccattggtcgagttgatcagaggcttgcccgcatagctgcggaccaccgtctctaccgctttagaattggaggagtcgacctgcactggaagcgaggagaccgtgcctatcgcgtcgacggtacgcttaagggttttcacttcgtcgacttcggggagcccaacgttgatatcgagcacctgcgccccatccttctcctgttggatcgctaaggtgagcagatagtcgagctcgttgtcccgaagggcagccttgaccttcttcttgccggtggggttgatgcgctcaccgatcacgccgatatggccttccggcaaagagaacagggtttgggcgctcgcgagcgtcagatcgtggttgtgttcatgaggttgagggctcttgtagcgctcgagcagttctttctccttcgcggtgtatgccggggtggagccgcagcaagcgccgatgatcgaggcgccgtgtttgaccatctgctccatatcgtgggcaaaggtggccgcatccacatcgtaggtggtcttgccatctttgaccgtgggcaggccagcgttgggttgcaccatgaccggtgcgtcgagataggggatcatttgatctaaaagccctgcggtcttcgcgggtccgagtgagcagttgatgccgaccgcattggcgccgagggcctgcagggttacagcagcgacttccggggtggttcccaggaaggttctgccgtcctcttcgaacgtcatggtcaccaataccggcaggtcagagttctctttggcagccaaaagcgctgacttagcttccttcaaatcagccatggtctcaatcaggataaggtttgcacctgcgtcggttgcagctcggacttcctctgtgaagaggtcgtaggcctcctcgaatttcatcgctcccattggctctaacagggaaccgattggcccgatatccgcggcgatgtaatgtgccccgcttttttgggcgcaggctactgcagcctggaagacttcccgaacgcttgcctgcccggcaagtttttgggcattagcgccaaaagtgttagtggtgatcacctctgcaccggcttctacaaagcttgtgtgaatggatgtgatcgtatcgggatcggtgaggttgaagagttctgggatggcgccggcaggcattccgtgggcttgcaaggaggtacccattgcgccgtcgacgagcagaaaacgcttgccttcgagcacttcttggaggttcgaatctttgatctttaaggggcgtctcacgcctaccggatagagcgtctctacagtcttacctcccatagcaggtcaccccacgctctctcaggctgcagaagtcacggcagacgcagcctgcacaggtgagatgtgaggagcgctgcggctcggtgaagaagccgatgatcgcggtcacactcttggtcggggtcatcaagagcgacggcgagaggctgataccgatacggctctgggcgttcaaggccgccagcagcgtcggctgcgttgcgaggggtagatccccgtagcccggcgagaagcgccaattggtgtaaaggcggtgctcagcgccatagctcacatagtgggcttccacctcgtcgcatacccgctcgatcagggcggttgaagctgcgtcgaagaagatctgtccgagtttgttcgtgagcgccaaccgcctcagttctcgctcgtcagtcatgcccagggtcgcggcgaagacgccgacctgtttggcgtctttcagatgtttgacaatgcctttgcccttaagaaccagtgaggtgtctttgagggtgacctgagggttgggatcctcagtgatcgtgtccacatcgaagatgtcggcaactgcggcaggcttcgagatgtctctggcagcctgcatctgtgtctcgaggtcctggctgatttcgtcgctgtatttctgtccgtgatagcccatatagcgcagaacctctgagcgctcaatcgtagggctttcaaaatgtaagacagcgtgctcatgcggcaaggtaaccacactcctttagtgctgaatggatctggtgtgctacctgcagtttgttcatggtatagatatgtagcccatcgaccccgttttgggcgagatcttggagctgctcgattgcatattccaggccggcctgcgcctgtttgtctctatcgtctccggccgcaatgatgcgcttgatcaccgccgaggggatcgaagccccgcaggtgaacgctatgcgttggatctgcttctgtgaggtgaacggcatgatcccgacgacgatcgggcgcttgatgcggcttctggcgcagctctcgcggaatcggtagaagtactcattgtcgaagaagagctgggtcacaaagaaatccgccccggcatcctgcttgtacttcatgacctccatcgactccttcatatttttggtctcgatgtggccctccggataacaggcagccccacagcacaggctggggtagtgctccttaatgtaggcgatcaggtctgaagcgtaacggaagtccttaggctccttgctcgcagttttgtctccgcgcagtgcaaggacgttctggatcccgtcatgctcgagggtatccaggtagtggtcaacgtcctccttggtggaccccatgcaggtgaggtgtgccagagcggtgacgccgagctcattttgggtctgtgcacagatcgcggcgacgttctgtgagttgccgtggccaccagcggagaaggtggtggagatccaatcgggatggtcttgggccagctcacctgcgatctccttagcctgctgcaagggtagctcaccccggggagggaagatttcgtaggaataggtctgtttgcgcgcgagaatagtgtcgatcctcatgactctccctttctgatgggcaatgtcccctatgatagagcccaactatttcaatcagttgaaaccttctgtacttcatgacctgaggtgctggttcctatggtatcccactgcgaaaattggtttcgtcaactctattaaaggcccaattagggtatcctgaaactacgtgatacatgctgacacctgcgcgtgtctgcagctggttttggaggctaatcgcaatgagttttctcaaaaagctctgcatgaccctgtggtttttggcgaccgtctttgcggcagcggcgctgggcctgaccttatatggcccctacgttatccaagcgcggcggctcttcgccaatacgtactatagctacgcggtgcagatctgcctggcgatttcgctgatcggcgctctgatcatgtggatcagcgccctggcaaaacggaaaggtcccaacgcactcgtgatcgacgaggatgagggtaccctcactgtcacccgcgacgcaatcgcctcccaggcccgctacctcaccgaggaggatggctcctgtgaggcaacccgcgtgaccgtgaccgaaggcaaacagggagatgtgaatgtctctatcaccctgcgcccgcactattcgctctcagtcgtcacgaggggtccggagctacaggagaagctgaaggaaggcctcacgcagctctgcggcgacaagatcggcctcctcaacatcgagttcttagctccggaggagcctgaccagatcaaagaggatgacacctcagatgcaatcaaaggtgagatcaccgcgggcacgacaaccgactctgagagcgcgccggaatcctcggatacagctgataaggacaacaggagcggcgacgacagcaacgaggatgaggacaacggtgagacgatcacgtatcaacccgcctcagacggcgacggtgtgacgattgccctgaaccgtgcaaagaagtcgcaggaggaatctcatgagcaataagtgggagaaactccaggtgaatatcgacagcagcgacaacgctgagaaagatggccgcgaagagcagcccagcgctgctacagctgctgccgaagatgcttccaagcagaaagtggacaaaggcgcgggccccatcgcgcacatcgactggtggctcaagcacaacttcccgggtcacgaatacgcggtgtccttcggtttccttgggctgatcactgcaattctgctctttttgatcggcttttggcggactttgctcgtggtgatcctcgtgacgctcggcgtcgcaatcgggcagaagttcgatggggacccgaagatcttcacctttttccacaacctattccgttcccgtgacgagaggtaatgatacaaggagtgtacgatggcacaagatactgatgagaagacaaagacgactgcgcaggctagcgagaatgatgcccaggacatcaaagtgaccggcaagccgaagtcgatgagcaacaacgaggatatcgaagcggcggaggatgacgacaactctgaggattcgctgaccttctcaaatggtgtgatcgaaaagatcgtcgctttggccgtgcgtgacgttcctggtgttgtcggtatgaaaggcggctgggtcagccgcgttcaggacgccttcggcgccacgagtccgagaaagggcgtcacggtcgaagtcactccggacgcttccgtcagagtcaacatctcagttttgattgagtacggcgcctatgccccgcagatctttgaggacgtgaagaaagctgtcgtgaagcaggttatgggcatgacggggctgcaggtggccggtgtaaacctgcgcatcgaggatgtgctcacccccgaagaggtcaagcgtaggaaggccgatgccgacaggctggagcagcaggacagcgcggagtcggcagaggctgacaagtccgaaaagacggaagagcagccagtggatcagaagatagaggctactgcggactagcgtcctccataaaaaatcgtgtatcctataagcgtcaagcagattacttggcgctttctttttatgctctgattcccttttctgatgccgcttgatattaataatctatttagacgaaaatagggtgttggtgtgtgcgtgcggtggaggatcaccgtctgaaaagtcgacgtctaccagcgcctttcaggtcgcgctaaagtagaacattaacgggtgaaagaagcataccatgagtcgtattcctaccataattgatattgatcctggtatcgatgatgcagcggctctcttcattgcgctcacctgttcaagactcgatacgcggctgattacgacggcgggaggatccatcgacgtccatcaggccaccgcgaatgccctgaagctggaggcttttttaggaagccgtatctgggtttccaccggcatcgatctcccgaattccgaaaaacgtcactacatggagcccaagcttggcccatcaggtctcggtaactgggtcttcgccgacgaggcagaggatctgcttgccaacctacccgccgatgaggcgatgtaccagacgatcaaacaggtcgattccgaaggcaagaagatctacattatctgtttggctccgctttcgaacctggcatcgctccttatcaaacatccggaggtcaagccgatgatcggcggggtgtactgtatgggtacgacgcttgaggacaaggatacgctgcagcaggcaggccgcaatgtggctgccgacccggatgctgcccgtgttgtcgtgaattccggactcaatgtgaacttcgtaccgcttgaggtggctgtacaggtccccctgagcgagcttgatatgaccgatatcgcgctcagcggccgtattgggaatgccgtctacacaatgctctctggggcagagagcttggatggaaggggtaaagagatcgccgatcccgtggcagtggcgttggcgatccaccccaatttctttacgatcaaacctgccacgctcaccatcgggaaagacgggaaactggatgtcgcaatcccaggagaccatccaaatgtgaagatggcgacggcggtcaaccgcgacgaatttgtcgattggttcaagtgggcgctcgagcgcgcttcccgttaatcttttatatttgtgcgactttgctgcgatacgcccaatctgtgcacaaccgtctgcgttttgcgtagagtaagacgcggaaggtaggttttattacgcaacgcaaccagaagaacctgatagtcaaatggatcgcgggtatctccgcggtgctctttctcgccctcgccacctatgcggggcacggatgggagcagacccagccggtccccgaagaccggactgagaccgcgcaggaagagcaacaggagcaggggatcggaggtcccgcagagggctctgataccccgcagaacgtctatgggctctttcctcaggattcatactatgacgggacacggctgagcgataacggtaccatgacgtttcctgagggggataccggttccgactcgcagccgcgctcaatgtctctgcgctgtgagctcgatgactatctcgatcggaacttccccagaaccggtctgccgggggtggcggtgatcgtcgtgaacgcgagcggtacccaatatcagaagctgctgggggatatcacctcagaacatgacacgatgctgatcgggtcactcaccaaatccttctgcgcgatctccgtcctgcagctggcacaggagggtgcgcttgatctggataccccagtatcccaatatgtaccatcctatggcaccgattgggatgtgacggtcagaagtctgctgaaccaaaccagtggctttggctactatgagtcgctctcagaggcgcactcagggccgatgaagggtaggttctcctactcgaatgcgaactacgacctcttggggcacatcgtcgatgcggtctccggcgagccctacacccaatacgttgaggagcatgtgttaatcccattggggatggacgattccggggcaacccttgaggaccgtgaggcggtgcatggtcaccgcaactattttggatggcccgtggcggatggctttgcccgcggcgacagcgacgacgcttggggaagtgcctcctccggctacatgtgcacgagccccgcggacttcgccaaatatttgcagatgtatctcaatcagggcagcgcaatgcccaccggtggcgctcagatcctgcagcctgcttcagtgcgcgcgatgttcttgagcagggtgctggatcccacctctgattccttctatgggatgggatggagctccttctatacagattccggggagctcatcctctcacacgacggagacgtggaaaacggtgtggcgagaatgatgatcctgccacagcgggggatcgccctggcagtcctcggggatgccgcggatgccttcggcggcaatgacgccttctatgcgatggcaggcggggtggttgcctgcgtgatgggcgcagaacctgacgatgtctctccaatgctccgtatccagcatcacctggggatggactttttctacttcatccttattgcgatcgccgtgatcccgattgtgtgtttcggtaagtggaagcaggatgtgaagacccagcctcacacgcagcttgtctggcgtctgatcacgctgcaggtgctgttcccgcttacggtgtatttcctgcccatctggcaaaactatacctggcgggacaccctgacctttatgcctgacttcagtattgtctgcatcggctgtatcgtcgtgagtgttgcctgtggcatcgctaaagcggtcgtgctggtccgctcctcaggtagtagcaaggcagttgttaagcggtagcagaaacggcaacctctcagatgtactgaggtgctgccgttagtatcacgtctgttgtgggagagcgctagaagccggcgtaaacgaaggttgcaggcgcggtgtagcctgagaaattgacgaaccagaagagcaggatacccattgcgacgaccgagatcgcggaaaggacatagaccagcacaggatggtcattcgcataggcgatgattgtcttcttcgtgtcggcgaccggtgtgaactctctcttctttgcgctcatacgtcccccttggctcctctcatatcgtccaagccttcagcggttgcggtgccgtagccccagccaccgaggcagtcgtcgtcctggcccataatgaagtggtagatcgcgcgctcgatgtgaacccagccacgccagccggggtggactgtatccgcaaaaaaatagcgctcatactcgaagagggagaagtccgcacaggtgaccccggcggtatctgtggcatcacgcaaccgttggtagtagccgtctctggtctcttgtggcacgcctacccgatcgtaccagggcccgtgcatcggcagcatcacgacgagcgtggaagccccgcactcctgggctacctggaagaagaggttgagctcaccccattcatcctctgcctgatcgaaggtctggttctgttcaggagagaagtgggagttccgggtccagtaggagtcgtagatcccaaaatcgttgttcgtgcagcggtttgccccttcatcgcttgcctgcgccaagagggtctcccaatcaggctcactagtgtagtagttgatcgtgcgctcccgacttttgctcggtgcgcctgcgaccatcttctccagctctgatctgatgcgcagtgtattctgctcgtgtttctgcaggtcgttcaaagcatccgccggggtatcctggttggcggctgcgaccgtccccgcatcgattcccagattgagcacgtgctgtctgatagtagccttgagctcgcccgagatcatcgtgttctggcagaaagctcggtagagctcgtagttgaagaggccagtgaagttggagcgtgagccgttgcccttgaagaaccattgggggctcacgaagagcacacactcgtggttcttggcacggcccatataggctccgcaggcgatcgcctgccacaggctctggtcgtagggctggccgataacggtcatatcgaccccggtgttgtgctctccgaagaccgcctgtggaacttccgggatcaaatccttggagaagtagaactcagaggtaccgaagcagaagcgtccgttctcgctcatgttggtgaggacaaactcgatagcctcggacttgggcataccgtagacgtagtcgtagacacgtgagccgtcggctttattctccaatttgggaaacatcagccgatcggcgccgataaggctggcacccagcgctgccaagcttcccacagttgtcttgagaagggtccttctggtaatcataggcgtatcactttaggcgtttttcaacctgcttgataatgaggttgggggtgttcatttcggagcgctggacctcggtcggggcgatcgagacgccgagctcatcttggattgtgacgagtagctcgattgcgcccatcgagtcgaggtagccttcctcgaagaggtcaccatccatatcggaggtggcatcgtcgtcgccggcgacatcgacgatcatgtccttaatcttttctacgagctgattatgtgtcatagccatactttatgctcctcccagaagcagtgaaatctgaccgttgaagatcgcaaagccgaagaagacgagctgcatcacgatgaaccaggagataatccgatagacggttccatggcggtgcttcttgtagaacttcgtcttttcccaactttgttcgagggctaataagatgccgtggtagaggccgtagcacacgtactcgacggtcggcccgtgccagaagcccataaccaccatatcaataatcagggctgcctgcgcggtatgtaaccgtctgttcttcccgctgaaggtcttatgctcgatcatccagcgcgcgagacgcatgaagacgaagtcacgcagccaggtggaaagcgtgatgtgccagcggttccagaagtcggtgatgcttgtagcaacaaagggtgccttgaagttgcggggaaccttgatccctaaggcgtagcctgtccccattgccatcatcgaatagcctgcgaaatcgaagaagagatagaggccatatgcgtaagcgtttctgatctggcgccacagcgcaagccagaagtcctccccatactgtgcccaggtctccggcacccagtaggttcgcgcgatcgtagcgaagacgatgttgtaaaccataccgatcataatgaggaggatgcctttggcgagcattccttcgtactcacctttgggaagcgttctgtccagatcctcctgaaagcgccgagagcgatcgatcggccctgaggtaaaggtcgggaagaagatcaagaagtagacgtagtcagcaaggtccatagcggtggtgaggccatccttggtctcgatcagcacctgcaccacacggaaggtcacataggagattcccataaagcccaggatattggtcgcgtaggtctgggtgatcttggaaaccacgagcggtaccagtgcgcacaccaaagctatccgcaggcgcatcttggacttgggtttctgccacacccattgggtcatgagggccgaaagcacgacgtaggccgccgcgtagatgccctcgatgggggtgcggaagaagagccagaagagcatgaagaccgaggcgccgagcccgaagcgcttgagcggcttctcatggatgcccaaccaggcagcgatacacatgatgatcgtcaggaagacgaagaagcttgtgtcagcaaagaaattcatacgttatggacttccgactatttgaggtctttacggtcgattttcccgttgttggtgagtggcagcgcatcgaggatcttaaccaagcgaggcaccatgtaggccggaacgctcttgctcaaggtctgcttgatcgcgcgcggggtgatctttcccttgtgtttgtcgtccagcacaacgaaggctttgagggcactgatgcggccttggcggcgcatcgggatgacgcaggccttatcgaccccgtcgatcccgcgcaggtggttttcaatatccccgagctcgatcctgaagccgttgagcttgatcagggtacccatgcgcccttcgtagtggagaagcccctgctcgtctaagtgtgccaggtcgccggtgcggaaggctctgaccggggtgccgtcgcccagcttcgcttcgctgaaggcctgggtggtcttctccggctgtccgaggtaatccttagcgaccgtgtcacccacgattacgacctcaccgctctcaccgggtttgcagacctcacccagagggccgccagcctccttgaccttgcggattacaagctcggtgcggggacggggatagccgaccggcagcggccgattgtctttgagcatctcatcggtgatctcacagtaggtcactgcgacggtggactccgtagggccataggtgttggcaaccactgcctccgggaaacgctgcttcagcgcacgggcaacccgatgggtgaggtagtcaccgcagaagaggaagagtgagaccttgggtaagagctcacggttgaagcccggatctgccaggcacatatcggcaaagggtggggtggagacccatacgtccatgtttgagtttttgagttcttcaaagagatggcgcatatcggttgcggcatctggggtgattccgtagaggcagccgccggtgctgagggcaccgataacctcaaactcggagaggtcaaaggagtagggcgcctggtccataaagaccttgctgccctcacggatcgtcgggaaggtgttgagccaatccataaagttcgcgacatcgttttcagtgacttcgatgcccttcggcttcccagtggagccggatgtgaagatgatgtactgggtctcctcaccggtcacccaacactcaggttcaaaaggaagctgttcaacggtcctatctgtttgattgtctttcaggacctcaggcagaaagacgtagtcgctttcactgtggacgtcggcatgctcatggtcgagtgtgacaagcactgtcggatcacattcgaaggcagctttgagctgttcacgcatggactcgacgcgcgtggagggcatcgacacggtcaccggaacataggcgtggccgacgcgcaaacaaccgatcagcgtcgcaatcatcagattcgacttgtcaccgattacgatgacgggaaccggtttctctccggttctcagtttgtgcagcttgttcgcaatccgtcctgacagattccagagcccggcataggtgaggggctcttgtcccagcatcgtgaatgcggacgcctcaggatgggtggtggcggtggtccagatcttctcgagcagagcattgtgggcgtgatcagatgcgtgtgcttccgtagtataagcaaccatgcgaccctcttttgttgcgctacttgacctattcaaatacctaaaagaaaatcctagtcaaacaatccagaaagtaatttacgcgatgcagaaaatgaatcaatagacataaaaaacgcttagaactttgagacttcggcatgattgtgggtaacacactccgcctctgacttgcaaaagtcgccctggctcctgtaaagtatcagcgtcaaaactgcaacaaacagaagaacaagatggccttctctgatacttcatgtaagaaactgctcaacatcaaaaatactgctgtagaggctcacgacatctacaatgaccaggatggggcacaatccacatccgcatggatgagtgttcatagtgcgacaggcactgatctggctatgatagcgcatcggtaaatcccaaagtctggcgtgctctggactggggcgccatcctggcagagtttgaatgtcctacccacaggcttttctgtccgaaacacagtgtggtaactgctggcgtgccctgggcttacccagaaagctgctctaccaaggaagtttgaccttaccgtcagctggcttgcagaatagctgcccagaagtggcgtggcaacattcatgcgcattggctagcagacagttagaaactgcatattcaaaaagcctgaacgaccttgtttgcaatggtatcgataagaccaactagcgcaagggccacaaaatacatcacggttgtcgcaaaccgcgacaccactatcgttgtatgggtggctgacggccacgacaaatctgtcctggagcagttctacaaaggtctcagtaaggagcagcttgccagcatccgggttgtcagcggcgacgctgcatgttgaatcacagagtacgtcaacgagcctgcgcactctgcaagcgctgtgtcgatccattccatgtcgctgagtgggccacagatgtgctggataaagtccgcaaagactgctggcgtgctgctttgtgacagagccaaacagctacccgcagaagccactcgacccaaggctgacggcagggttgcagcgaaggtgcgaccagcccgccggcaggcctgcgagatcaagcgcaccacatactcttttggcaaggcagcacaacatctcacggagagccaaaaagaggctcttcgctacttatggtgggtagcacacccgcatcctcttgagggcgtggcctttgaacgatagaatttccggaaaggaaagacttcggtccaaagatgcgatatggatgcttaaggcaggcatgctggcaaggctctttaagagatcccttggggttcggcgacgaatgggagctcttcgatgtctggtttaaggagcgcgaggaggtgcaagataagctccctgtgagggtggcgcatgttaggggcaggcggtggtgagccccgtatgccacaggaagtgcggcacctgtgacacgtgcgagaggaccttgtggcatcttagcatctggcaatacgatacgatcgtgcactgcgcgctgcccagggccgactgccccaaagacggcgtgcatgccacaaggatgccctgggaggtgcggccgaagacgcacttcacggcgctctttggcatgagcgtggcgacaatagcgcatctggtgcacgagacagcccacgcgcatatggtgcctgctgggcaaggcggtatcacaggcaagggatgccgccgactactcggatgtcgtgcgcgtagggatagacgacaccgccaaaaggcgcaaccaaagctacatcagcatcatggccaacctcgactgtcagcgtgccgtggccatcacgcagggcagagataaaggggccttaggcaggctctgagacgagcttaaggagcacgcaggggacaggaagaaggtcttagaggtcacgcgcgatatggctttaaggcgtactcgctgggggggcggcgccaagatgccccaggccgcacagagcgtggacaggttccatgtggtgcagctcctgatgagggcgacagaccctgtgaggtgccaagagcggcgcgagtcggcggagaagcacaaggcagcttgcccagacgaagtacatctggctgaagaagaaggagtcgctcacaaagcgccagcttacgaagagagggaggagctcggccccgcgaagacccatctcagaactgcacgcgcctgccagatgggagaggcgctgcaggacgtctattcatgcgccgacagacaatcggcagccagggccctggagcgcctctgctcgtggatgatgcactctgccgtggccgagatgaagagcgtggcaaggaccctcaggaaggagcgggaaggcatcctcaactggtggaagagaggatctaccaactcgttcctggaaggcctcaactccgtcgtgcagtccgtccgcagcatcgccagggacttcaggagtatcgactacttcaggacgatgatcttcctcaggctaggccgtctggacttcacggcccagaagaagctcgtatgcgctacccactagaaacagcgaagagcccaaaaagatccgccttgatatgatttaggcaaaacgactcacagctgtattgggcgtactgcatgaaggagtctttgcggcttcctttaaaatcgggaaatgtcaaacaggcagaaaccgaccttaaacacaggctttggtgggcaagccacagcaggatagcggcactctacgacctgtatgagaagatcaggcaccacaaggatcatatcctgaacacgatccgactgggggctgagcaatgccaggattgaggcaaccagcaataagatcagctgattgttcacaaggcatatggatttcggaatatacagaaacatgatagatacggtatatctcgtatattctgatatctgtgttccacttcctaaccgaaaacctatacccgctgatgtggcttagttactggagaaaatggcatttctcacccacaggggtgcctgaagagtctaatttacacacaaatttggacttgaccactagatccctaagagtgcccgcagctcattgatcgtatgtgcgattttgtatgctccggcatccgtgcgcttcggattccggtgcggtatgtgcccataggtgaccccgatcgtggggaatggccgacctcatggggcaattgtacaatcgtaaacttgcggtctccgaccatcatggcctgttcaggggccgttttttcgcaatgattcctggattgactgcgttcttggtatggttggcggtgtcatcctgaccgaagatgtacggtaaagtaactggttggattccaatcttccagggagtttctggagaaaacatcttggcgctttgagcttgcggcgggcggaacgcatttgcccacgcatcgtgcaggctttttagcatctcaggcacaaacacctgggatagggaggcccaggcccccttctttcccccagttgccgtagatcttacggtaacgggcggtgatgtcttcgcgtccttgcctttttgagtaacccaaaaccgttgagaaggccatcgggaacggcggtccgattacacccggggataaatctgtgaacttctctttgggcatcccatagtcctttcaagaccttgtttgcaacagctgagtgatgcttttcgtcgggtgtcggccgagggtgccggcccgtcgatcacagatatgaaccggtcacttacttgtttcgtgtcaacggtaacggtagccatacagttttttgtgttaatttttgccctttctctgaaaattgtccacatcggtgttcagtataaggcttctcacaaccaaccgtggcgccggccgaagttggaaccgaacaatcattggagccttcaacgtcacactcactccgttacttcctcagcaaggtcgagcgcagtcgtgctcaagagcctggcccgccttggattgggcgtgtttcttctgccagacagggtgagcggttcggttatgtggggacctagggccgaaacaaggtccgatcctcgtcttttcttcttgacgccgttaaatcaggcggtcaaagttgatcacacaccaggactgatcttttaacgatcagcatctgggcattgaagaccacgtgaaggtacccatgaggcatcggctgctaatgttgccaccaccagtcccccttgaagcggtgttcctcccgggctttcctgagagacccatgagctttcgatacactaaatcctccgggccagcgcggctttgctcgcgagcgtatcgtttttgttgcatcatcacgccccactgctcacgctctggtgctggcaggtaaggttataaggctcaaggggcgctgtcccccgtcccaactatgcaaaaatctacgaccccgttttgtcgagtgccccactccatctcacttgcgttgccgttcacacagaatggatcggatgtcccc

SEQ ID NO: 301 - DNA, 19186 bp, Unknown
  Metagenome-assembled genome
ttctgcctgagtaagcatttcttgccgacccaagcagaacagccataatcttacttaactatgataggcattgaccaccgctttattatgactctgagaaggcatggcgtttgcgcatggatactcttccttgaacatcgatcgaatacttgttgtgaataatccggtcaaggatggcttcagcaacagcgctgtcttcatcttttccacggtcacagtcaatcctgaggtaccagtcatctgtgtcgtagtgggtgcaaagaatcatagcccctttgcggctgcaggcctcgatgatttcaaggagatcatacaccttagcctccggaagcggccttagcagccattcatcaatgatcagtaggtcaaactttctgtatgccgcctttactttgtcctgtgtgttcatagcttttgcaacggcgaactcattcagcaggtcaggcagccgcacataacgtatcttgtacagcttgcggcatgcagcgatccccagcgcattggcgatgtaagatttgccagccccggttgctcccttcagtacaacatgatggttatcacgtatgtatgaacaggtggcaagctttgtgatcagtcctttatccagatgccggtcttcatggtactcgatttcttcaatgcttgccgtaggctcacttaaccgggcttctttaatacgccgtttaactgtgtttgtccttctggatagagttttagcatccaccatcatgccaagccgttcttcaaaagaaaggcttttgtaattctgtggatcttccaactgtggttcaagttccctggccatacccgggagatgcagggcgcgaagtgcctttacggtctcaagattgatcaccgctcatcacctcccttacggaactgatccacaccacgtgtgattctgtggcttcggcgtctggtattgggtgatggctcttttttgcctgaaccgttatcggtaacaggcgatttgagaaggattgataatccccaaatcgaaggctctccgctgaatgtaaggatctgcctgcaggcttcttcgatacgttccggcttatagtgagaggcatactttttcaggctgacacatgatttaaacccttgctccgcagccctgcctgattccagaaagaaacgaacgaccttttccgtgttctcaccaactccggaagcccaggaaagaaagttatctttggtataggccagatactggcgatggtttcccggcatctcgctgttagaccataattgacctaagaagggcccaaaagtgtccgggcctttgcctacaatgcatgtcgtcaaacaaagacatcgaggatcaaagggtccggatggatccaatgatactgcagcagatcaaaaagatggggatcgccgagaagcgcgagctcctggagagaggctgaaggcgctcatagctaagaagatggcaggctcggcacttgcgggaacacccaagaggtgcccgaggtgcaaatcgctcagcttctactgcaagggccacgacgcgtgtggccttaagagatggaagtgttgctcgtgaggcaagaccttctttgtaaagacaagatctgtcctggccatatccaagctcacggccgccacatgggccgcatatgcaaagggcacgcttgcaggcatgtcccttaagggagcttgcgaagagctgccatgtgagccttaaggacatcgtggttccatgcgcatgaggctcttcgagctgctgcaggccgctcttggcgccttcaggtatggacccaccgtctcctgccaggcagacggcctctatctcgacgagtcgcttgcgaacaacagggcaaggtcggccatccagatgctgagaaaggcgcacacgcacggccatgttgtgcattgctgtggcatatcgaacaagaaggtctgtgtggagtgctgcgcaaatgacttaagcgacgaatatgccatcctctgcggcaggggcaggaccgaggacgggaagctgacagatgccctttcaggtatcgtcgacaacttatgggtcgccactgacgaccatgcaggatatgcgcgcgtggctcccctcgcttggggtcttcaagcacacggcgagcttagcctcgtcaatgcgatgcagcgaaggctgcgcgagttcctgcttttcttccatggggtcttctacgaagtggctggggcacttgtcttgcctgctttttgtggatagagcaggtaaggcattctgagcgggagaagaaggagacgctctcaggcaagcttgcaggaggcaggtatgttccataccaggcgtgcgctcatagatatggagcagcccttctggagctattggaaggacaggggcgtcaggtcagtcatggtctaacagcgagatgatacttgaagctcgagcttctggctcgtttctctatttacaccactttacagacgtgaccatcacgtgggcaagctttacagcacagcataaaacaaaagccagaggctcaccgcctctggcttcaaacatttctggtcgggttgactggatttgaaccagcgacctctcggtcccgaaccgagcgctctaccaagctgagccacaacccgttatgacagacatcctattccaaaactgtctgcgtcgactactttagcagattttgaccaccaatgctgaactttgtgcgctttatcagcaatctcttttgccatttcatctttctcacaaagagcaaagcaacaggcacctgatccgctgactgcggcactgactgcaccttcctgttgattgagccacaccacgaccgctgcaaggtccggttccagccgctcacacgccgtctgcagattatttgagatgttctccataatccgtgccgtgtcatgcgcgcgcagcgcttcgagcatcacttcgagatccccggctttctcagggcgccgatcaaactcctgataggcttcctgcgcaggggatccatggatcggtggcctcactaccacgaccgaaagtttcggcgcctcaaactgctctactaaggtatcccctgtccctgccagatagctcgtgtgtgggcttaggaagaaggggatatccgcgcctacacgctgcgcaactttaactacacggggatcaagcgggccaataccccagcccatacagattgccttcaatactgccccagcatcggtggaagagccgcccaaaccgctgcgctcggggatcccgcgcttcacgtgaatctcgaaattggtcggacgctggaaggccttccccaacgcctcaaccgtccgataggttgtcgttttctcagtggcggcctggatcgccgggttgaacttaagcgtcagcgaatctgacggctcgatagttatctcatcaccgaaatccagtgttgtcattactgaatcgacacggtgatagccacgctcatcgcgctcggtgtggacgccgagatagaggttgatttttgcaggggcaaacaggtttctcatcagagggcccttcgaagtgcaggcagaagaaaaatacccctgaagtcgctacacagcttccggggtacccttcacagcggtttattcttcggcagagtagttgaacagtttctcaccggtatctgcatcaaagacctctacgctgccggtcagaatgtcaacgtactggtaggactgacggctcttgcggccgcggcgctcttcgacctccacgacgaacagcgagggatggacctgtaccaatacaccagtgccctcgttgatgcgtgagcgtcccatatttgcgcgtaccttgatgcgtttgccttctaaggtagctagcttttcacgaatctgatcgacacgattgattggcggcatgtcgatatccatagcgacctccttgagtgcgagtgagctctatctaaaagtttgattttttcacaaattgttagtttacacctacccactatttctccatatttataggagattttaaaggttcttatgcacaaagtaggaccccgctgcaacgggtatatagttacggcggcagagaaactacctggctctgcagaggaaggaacactatgtatcagaatcgtgttcaacgcgtactcgacaaccttgcaacaaagggttgccggcaggccatcatcgccgacccactgtcgatcttttaccttacgggctactacgctgagccttatgagcgctttttggccctctatatcagccccgatgactgcactctctttgtcaacaagctgttcccttcagctgagcagtactgcgaccgcatcgaggttcacgatgatacggacaacccgctgcccgccgtggtaaagcacatacacagggatgagaccttgggtttggataaaatgtttccagcccgctggacgctgccgttgatcaacaaccacgtcgcaaagcagttcatcctcgcttccttcgccgtagatgacacacgatcccacaaggataaggaagagcgggacttgatgcgtgaagcctcccgcatcaacgatcaagcgatgggctggctgcagggccagattcgcatcggcgtggccgagcaggagatcgctgaggggctcttagggacctatcgctcactcggcgcacagaaccactccttcagtccgattgtgagctttggagccaatagcgctgacccccatcatatgccagatgatatcaagctcaagcccggcgatatggtactcttcgatgtcggctgcaagaaggatatgtactgctccgatatgacccgcaccttctttaccgccgaaccgatggatgagcaagagaaggcctatgagaccgtacgcagagcaaatgaggctgcagagagtttagtggcgccgggcgtcaccttcgctgaactagacgattgtgcccgctctattatttccgatgccgggtatggacagtactttacgcatcgtttagggcaccagatcggcctttccgaccatgagccaggggatgtgtcctccactcacactgatccggttgagtcgggccagatcttttcgattgagccgggcatctacatccccggccgtttcggtgtcagaatcgaggatctagtcctcgtcactgaccatggttgcgaggtactcaattcctatccgaaggacctcacgatcgtctctgttgactaaccctacgaataggtcttcagactgtcctcggatctcagggccaatcccacgttgaacgtgagattggcttttttaactcattgcgtcaagagagaggctacctggcttctgcagtagaaaattcccaggcttgcattcggaacctgggagttgaatccactgtgtgagatcaaatccttatacgcagaagaaacttagctattggggcacagggacagtgccgcagcatctgcgacgacggtgcagttagtgtgaagctgcaggattgaggccggtaccttcggcgtcaccggaccgtaaatcatatccttgaccgcctgagccttctcagtgccggaggcaaccaggatgatgcgacgggcatgcataatcgtctggatgcccatcgtataagcctgtcttggcacctgatcaggggaatcaaagagacgggagttagcctcaatcgtgctcggggtcaaatcgacgcagtgcgtgcccttgctgaagacctcatccggctcattgaagccgatgtgaccgttgcgtccgatgcccagaagctgcaggtcaacgtaccctgccgctttgaccattgcgtcatagcttgtgcaggcatgctcgatgtcaggatccgcgccgtcaggcacatgggtattggcaagatcaaggttcacggagtcaaagaagttcttgcgcataaagtagtgataggactgagggtcctcatatgtaaggccacggtactcatccaggttataggtgtggacctgggagaagtcaatgtcccccttcttgtaccaatcgatcaactgctgataggttccaattggggaagaaccggttgccaggccgaggattgcgtccggcttcaggatgacctgagcggaaataatgttggcggccttgcggctcatatcgtgataatccttgcaacgaatgacgcgcatgattgcccctctcacgaaattagtgggcgtctctcatatcaattttgattatagagagctcacatccgaagcaacacgataaaccaagtttccactttttaataccaatttcgtcgagttcgagaggagaacccgtctctttagcctattccttgagcttctgggccaaatccgccagggcgtggaatcggtgggagactgtgttcttctcctccggtgtcagttccgccatagttttccccggcgcatccgtcggtagaaagagtggatcgtagccaaagccgtgcataccgcggcactcgtatccgatcgtgccaacacagtcgccctcgccgaagagatcctcttccccatcctcaccgcgggtcaccaagaccactgaggagtgaaagtgagcctggcgcttaccgtcaggtacctcctgcatcgcacgcttgagcttctcgttgttcgctttgtcgtcaccgtgctctccggcccagcgggcagagaagattcctggcgcaccatctaaggcgtcgacgcacagacccgaatcatccgcaatcgcctgggtaaattcagtctcatcgagggcggcgtgtgccttgatcaaggcattctcgtcgaagctcgtcccattctcttcagggtccgggaagtcacccagctcccccagcgcgacaaagtgtttgtcggccaggaccgggcccagaatcgcctcaatctcagtgaccttatgggggtttccggttgccacgacaatcgtgttgtttggggtatatccgctcttcatttcgttcctcctgatgtctctcacccctactgtacgcctgcggcagcgactgcctcgcgctgtttctcagggagttttatgagagcaggctcggccatatcgaggatggaagtgagctccgaacgcgtaagcagtgagcgctccccggtgtcttggatctccacgatgccgtcgttgggttgctctaccacgttgaggtcgacatcgacttgactgtcctgcgaatagtccagatcgcacagcagcttcccacccacctttcccaacgagattgccgcaacctgtaccactaaagccccaggcttcaccgctccggcggcgacttccttctgaagtgccaggttcagtaccactcaggctccagttatcgaagcggtccgcgtacctccatccacctgcaggacgtcacagtccagcgtaatcgtgttcttcctgaaggattttatatccacagcgctgcgcagacttctgccaatcaaccgctcgatctccatggagcgccctttccgtttgaggtgctcgtaccaggtccgggtattggtgaccgccggcagcatcgcgacctcggcggtggcccagcctaagccctacccttcccgccagcgaggtacgcctgcctcaaagtttgcagtatacagaaccttggtctttccggtcgcagtgaaacaggctcttgcaggattatccagcacctttggggtgatggtcaccgtacgtgtctcgtctgcggcacggttgtaggagcgtccactatccatgtattggtccccctcatagcaaaagaggctgaaaaccgtacgtggcttccaacctctcatcaggtcatatggtgggcgatgagggatttgaacccccgaccttgtgcgtgtaaagcacctgcgctaaccactgcgccaaacgcccgtacgaggaatcagtgtatcacagtctaagtttcaggtcatccacgcgcataagtatatatactcattactatgaacactgcaaagacacctacactggcagacctttcccgtctgctgcaggagaagggctccctttctccggtcagtgagccccttactgcagaagaggcggcgctgaccatcaccggagccgactgtgactcccgcgtcgttaagccccaccacctctttatctgtaagggtgcacagttcaagagcaactatctgagcgccgccaaacaggcaggtaccgtagcgtatctgtgcgatgaggaacacgcagacgagctcaaggcgatagagccgacgcttcccgcgctcgtcaccaaccagctgcgtcccgcaatggcagacgtcagcgctgcggccttcggacaccctgaccgggagctcaccaccatcggtatcaccggcaccaaaggcaaatcgaccacaggctacatggtgcgctcggtgcttgaagcgggatctcagcatcccacctgcggtttaatcggctcggtcgaatacttcgacgggatcgagcaggaggaagcggtcaacaccaccccggagtctccggacctctggcgccacatcgcaaatatgcgtgacagcggccttccctatgcggtaatggagatctcaagccaggcgctcaaatacaaccgtgtggataacttaagtctcgatgtcggcgcgttcctcaatatcgggtatgaccacatctcccctttagagcaccccacttgggaggattacttccagagcaaacttaagatctttgaccatgcacagacggcggtcgtcaatctcaactcggaccatgcggaccgtatcctggcacgctcccacgagtgtacgcaggtactgaccttcagcaccacggactcaacggcgactgtttcagcgcgcgacattcaatcctcattcggaagcatccagttcgtgtgtaccacccccagctggaaggacccgatcaaactggtgatgcccggcctcttcaacgtcgataacgcgcttgccgcaatcgcgatctgcgagtatctgcatatcccctatgagcaggtcgctgaaggcctcgcccacacgaaggtccccggcaggatggagcttatccccaccccgggccgccaggtgatgggaatcgtcgactttgcgcacaacaagatgtcttttgagaagttcttccccaatgtgaagaaggaattcccgggctacaaggtgatcgcggtctttggggccaccggcgacaaagcagtcgaacggcgctacgagctgcccaaggctgcagcaccctatgcggacaaactgatctacacgctcgatgacccgggttatgaaaaggtggaggacatctgtaggacaatggcagaggcgaccccggcaggggctgactatgagatcatccctgaccgcgcacatgcggtgcagcgggccgtcgatctcgcctactcgtgcgaccagcccaccctcgtatgcctcttggcacgggggactgaaggcgctgagcacatcaaaggcaaactggtacctgccccgctcgatgcagacctcttcaacgacgctgtgaaacgccactcctaagttcacaggccctcgctatcacctacaactgttcgctcgttaacgcgcaataaaaaaggaaggaatctacggggatcaatgtcattaagttagactctgttagaccactgtggatatagggaagcgaaaagatgtcacggggtcaccctacaatcgggttcgactaagaaaccgacctgaagaaggccctgtatgctcgatatgatacgacaactagcaaagtagctgacccgcgaggagaaggtcgcgcttaccgccgacctcaagcgcatgatagccgagaagctaacatcgcaggccgacaagtccgccacatgcccgcagttcaccaggcgcgggtgctcgctcacagcagggacaggcaagctgctcgcgcagtcgaagccagcagcatcccagtggatgaagcttacccagtgcctggctggcaggctcacacagcacaggtgtacgaagagatgcggcgtgtgtctgtacagcgtctggttcatgcgccagcgcgcatgtgaggcgatagcgttaaggcttaagttgttgcgcgccgccggcaaacacttcgcaaagagcctggccggccacgatggggcaggctcattcgagacagtgctccctcaagcaccgcagcgtgttaatggcaatctagaagctgccaatcaggacagaggaatgcgccagatgagggtggtaactgctttccgtaccattccacctacaaacctaagctgccagtgcgaggccgaggctctgcctgaactccatcgggctcactcctttaagcgagcgcttgcgctttgtcgtgttgtaccagacgatgtagcggtcgatgcgttttccagctccttaagggtcacgctatcccacttgcgcttcctgaacatctccgtcttcagaagttggtcgtgtccgtaaagtggtgtaaaaggcgggcgagccagaggcccgccgccaaggtgggatcgcagtcgcccatgcaacaaggacaggtggaaaggatcatctacgttggcgtcgacaccggcggggcggaggtcgcccccatgccttctgcccgacgaacaggcgggggtgcgccgagatgctcgcgtgggcccgctcgaggcggcgaggtggcccgcttcggcgtggagtgcacggggatctacggtgccggagctgctcaggtacctctcgcgcgagcacgtgcaggtcgtcgagctgaagcgcccccgactgcacggtcgggcgcagcaggggcaaggacgaccttggtggcgccacgatggcgcacaaggccgcgatcgagcagatccgctccctgatcgtctcggccctcgacgccgtgtgagaccagtaatgcgcgatgacaaccgcccgcctcgtccccaggtcacgctgcgtcaaggacgggcgcgtccggctagcgcgaccctgcgctcgcccacgcacatcgccctcaaggcgctcgccgctcgctatcaggacctcgacgataaggtgggcgagctcgatgtggccatcggggccatcctcgaggagaagtgtgtcagctcgcagggcgctgtccagctgatgatcagagtgggggacaatccggagaggctcaagcagcgagtcgtcgttctgctgtgcggggtggcagcgcgtcctgcgtcgttggggctcacgacactccacaggctcaacaggggcgctggcagggcagcgaacagcgcaatacacatcgtcgctgtcggaaggctgaagatagacgacaggactcgcgcttaggtggcccgcgagatgtctaagggacactccaagctcgaggcgatacgatgcgttaagccgttaagcgatacatagtgcgcgagctgtactacgacatcattgcccagagtcgcatgctcaaaacgacttgacaattagaaaggcatcataggagcgcttccgactctaaggaatacgtcttcctgctcacatccagagggaatatcccagagcatggacggcagggcgagatggagggacaacgctctggcaaagcaccggtttaaggccctcaagagcgaatgcctaaagacagacaaaatacagcacgcctgccagagcttagggacgctatcgcaaagttcgtcgagttctacaacagcaggcggatccactatacgcttagctacgacacgctggaagaaaatggtacatgagcggcatagctgagactgcataagcctacaatggtaaggttgcgaaagccagggactcgggaggaatagagcttctgtgtctcactacttcagccaattcgataagattgcacaggatgagaggaataagaaatgaaatataaaaaaatgtgcgagcaaatcattagggctgttggtggtgaaagcaatattagctccgttgttcactgttcaacacgtttgcgttttgttctaaaagatgaaagtaaagctaacgatagtgaagccgaaaatattgatggtgttttacaggtagttaaaaaaggcgggcaatatcagttagttatcggtaatacagttgaagatgtttacgatgatttaatgcaattactccatttagataatagcaataccgattctactgataacaagtcaaagaaaaagggcaatatttttgatacgattatcagtgtaattactggatcaattgcgccagctattccattactggccggtgctggtatgggaaaggttttgcttttaattttgacaatcactggctgtctgtcagatgaaagtcaaacttaccagatgcttaacttgatctttgacacaggatattactttatgcctgtttacgttggcttctcagctgccaaggtctttaacacaaatcaaatgcttggcgcttttctaggtttagtaactgagcatcccttatgggtgcaaatcgttaatgctgaaaagccatttcattttttaggcgttaacgtacctttgattcaatactcatcaactttaattacggctattttgtcagtttggattatgtcttatgtttataagtttatacgtaggattacaccaggaatggtcaaagttttcctggaaccaatgttaactatgctaatcatgggaccgttgacattcatagttcttggacctatttcaaactggatttcacaaggtattggatttattgcaatgtggttgtaccacaatgcaggattggttgctattcctattttggctgctgcctatccttggttggtttctatcggtatccacaaagctcttagtccaattagtattcaattagttgcaacgcaaggatttgacccgatcattcgtgttgtcgctttatgttctaacatgtcacaagctgccgcttcattagcagttggtttaaagacaaaaaatcaaaaattaagatcattagctctttcatcaagtgctactgcctacttgggtggtattactgaaccagctttgtttggtgttaaccttcgtttaaagaagccaatgtacggtgccatgattggtggtgctattgctggtgttgttgcaagtttcttaaagttaaaagcgtttatttatgtaactccagcatttttgagcttaccaatgtggatttcaaagactgaaaactttgttattcaagcaatttatataattgtaattgctagtattgcaacctttattgcaacttggatcattggattcaaagatccagttgacgaggatcaaattaagaaagcagctaaagaaaaagagaacttcaaacaagatcatcaaaagcatgaattacatagtccagctaatggtacattgaaagatgtttccaaggttgatgaccctacttttgctagtggagtgatgggtaaaggtattgctattattcctagtgaaggtaaaatctttgcaccagataacggtatcgttacagctacttttgaaactcaccatgcaattggattacatttagataatgatgctgacgtattgattcatattggaattgatactgttcaaatgaaaggtacaggatttaaacaattagttaataaaggtgatcatgttaagaagggacaagaactagttgactttgatattgatgaaatcaaaaaagcaggttatgatccaactatcattatgattgtcttaaatagtaaggacttcttagaagttttaccctcattacaagacaaagagatgactaaatcagttaaagccggcgataatgttatggtcttagcgtaggtgctaatatgaaatgttatacagtgccgcaagattttatgtggggtgtcgctacttctgctaatcaggtcgaaggtgcctggaatgaggatggcaagggtatgtcgattgctgattgtgagagatacaatccgcatcaagacttgaatgattataaaagagtcaatagcatgtcgactgcagaattaaatcaggctatcaaggatcattccactaaaaaatggggcaagcgtcacggcgtagatttttaccatcgctacccctccgacttaaagttactagctaaagcacacatcaatgcctttagaatttctatcgcttggaccagaatttatccgaatggggatgattctgaacctaatcaaaaggggttagaatactacgattcattgtttaagacaatgaaagattatggcattcaacctatcgtaactttatcgcattatgaaatgcctttaaatcttgtgttgaagtatgatgcgtggttcgacaagaaggtagcagactactttgttaaattttctaaaacagttattgatcgttatcataatttagttaaatattggattccgatcaatgaaatcgacagtattgttcggcaccccttctcgtcagcaggattagtagaagatcgttttcctgatcaaaattttacgcaagtgatttatcaggcaatgcataaccaatttattgcttcagctaagattactgcttacattcataagaattaccctgaagctaaagttggtagcatgattactagtacgatggtctacccttacaatagcgaccctcgaaatatgtttaaagccactgagactatgcgcgaaaactataattttagtgatattcaagttcgaggtgcttatcctaaagttttattggatcatatgcaaaaaataggtgtggatatcccgatcactcaagaggataaagctttgcttgaagctaatacagctgactttgttgcattttcctactactcatcagtctgcacagcatatgatacgacagggttgaaaattactaaagctaaccgtacgacaggtgtttacaataaatatttacctgaaagtgaatggggctggcagattgatccagtcggtctacgaattatcttaattaatctatttgatcgttatcaaaagccactgtttattgtagaaaatggtttgggtgctaaagatgccttaacttcaaataattacgttcatgatcaatatcggatagattatttgcgtcagcatattaagcaaatgcttctttccctccaaaatgatggcattgacttaatgggctatctgatgtgggggtcaacagatatggtttcggcgtcaacgacacaaatgtcaaagcgctatggcttaatctatgtggatttggatgataacggtaatggtagctacacaaggacgttaaaagactcctattactggtatcagaagttgttaagctttggtaccgaaatccctatcgcttatctagaaaatgactaaggacttgcggcacagctaggctccatgaactgtaagctgcttagacaactttggctgcaccgtggatgtggttgcgatgcctgcgagcgggatgtgtgtgaggcacatcctgtggaggagatcggcaccaagcatcaaaagaatccctgtggctgtatctttagctgaacgagtcggcatacgacttgtatatgggcctgcggaaggccgtggaacgctccttcgacatatgccttgatattcgagaggatcctgtgggcctcaggggaagcgaggtgtcatcgtctgagctgtcgtactgcttctggacgagctcgcagaagcaatccagccctgccgatatcccgcttccaggcatcggcacagatctttgtgtattccgcttgagaagatcactttgcacggccgaatagatcacctttagcggagatttagatcacttgtcacggacaagagatcagtagcggcagttctgcctgagtaagcatttcttgccgacccaagcagaacagccataatcttacttaactatgataggcattgaccaccgctttattatgactctgagaaggcatggcgtttgcgcatggatactcttccttgaacatcgatcgaatacttgttgtgaataatccggtcaaggatggcttcagcaacagcgctgtcttcatcttttccacggtcacagtcaatcctgaggtaccagtcatctgtgtcgtagtgggtgcaaagaatcatagcccctttgcggctgcaggcctcgatgatttcaaggagatcatacaccttagcctccggaagcggccttagcagccattcatcaatgatcagtaggtcaaactttctgtatgccgcctttactttgtcctgtgtgttcatagcttttgcaacggcgaactcattcagcaggttgagtatttgcgcgtgtaggcaccagtgattattgcggctgagcaccgactgcgtcgcgaatcggcaccgggggcagtgccatgcagcaccgccccctcatgagggctcagctcactgcatcaggatctggggccggaagatgctgcagccctggcagcggcacgcatgttcatctctcccatgtctacccatgccgtcttgtggacgatgcggcccatgcccggctcggccgtgacatccgcgccgaggcgggcatgccagtccttctgccggtactgggtgcaaaaagatcatcgacctctcgtcgtagcgcagctcgaagatctcgagcagaaagcggcaaaagccgtcatccggcctgctgagcagccattcgtcgaggacgaggacctggaaggccccgtatttcctcacggccttcgcgacccctcccgggcgctcctgcgcatccttccaggcgcatgccttcttggtaagcgcgcaggcgagataggtctttcccgtgcctgcaggccgaagagcacgacgtcctggcctctcgtggcgggtccgcagatcgcgagctcgcctgagagcacgcggtcgagcctgcgctcctttgcatagtcgatacggcgcacgtctgcctgcggatatctgaggttcgccctcttcacgaggttgtagatcttgtcggcgacatatcctgcatgcgccttaccgaccgccatctgcatcttctgctcgaagggcatccccatgcagacggaatcgtcctgggcaaggagcgcctcgagcaacccgtccgctcccatgtccctcatcttcctgcgcgtctcctgcccgatgttcatcgtgcaccatcccttccgtatcagtccttcccgcggaggcatcctccttcctcgtgcgctggctgctgcgccgctgccgaatcctgccctgccttcaggatcggttctatgtcgcggtagcgcggcgatctcctgccggatgcgagcgccatcccgcatgccctctcgagccgggcgctcccgtatctgcgcgagagcctcagcactgcgaggccacgcattgaacgcctgctcttcgaatgcgtaggactggaatatgcgctccgccaccccgcggcagctgggtgagccctgtcaatataatggacagggctcatcaagcacacagcgagcgtggcgaacaaggccgtacacggcgagcttagcctcgtcaatgcgatgcagcgaaggctgcgcgagttcctgctttttcccatggggtcttctacgaagtggctggggcacttgtcttgtctgctttctgtggatagagcaggtaaggcattctgagcgggagaagaaggatatgctctcaggcaagcttgcagaaggcaggtatgttctataccaggcgtgcgctcatagatatggagcagcccttctggagctattggaaggacaggggcgtcaggtcagtcatggtctaacagcgagttttgtaaaaaaggaatcgaatctaaatgattcgattcctaaaaagatcagtttccaaatttcaatgtcttaacttaatgacattgccacgaggattccttccttttgtttagcgcttatactctagcttcaattagaagttgaccggctcatcgtagtagcagcacttgagcagcttttcgaagtcagcagcatcagtcttgcgcgggttctcaggcgtgcaggcgtcgccgacagcgttctcagcgatcttcggcagcttctcgaggaactccttctcagagaccatgactggcttgccagttgcgtcagccttaatgccgcccgcagcgtagttgtcgattgcctgagggatgttcatcttatcgttcataccacggatatactggacgaggttcgcgacacgctgatcgtcggtgtcgcccgggagatgcaggatctccttggcgatgtagccgtagcgctccttcgcacggctgtcgtgagagttccactgaatgaccttacccagatacattgcgttagcagcaccgtgaataatgtggccgccgctgaaggctgcaccagtcttgtgggccatggaatgggtgatgccgagcaggccagaggagaatgccagaccagcgaggcactgtgctccgtgcatatgctgacgagcctcatgatcgcccgtgtagctcttcggcagccactcggtgatctcacgaatgccgtgcagtgcgtctgcatcggtgaacatagaagcggcggttgagacataagcctcaatgcagtgcgtcagtgcatccatgccggtgtgggcagcgagttttgcaggcatgctgtaggtgagctcagggtcgacgattgcgacatccggggtgatctggaagtcacccagcgggtacttgatacccttcttgtagtcagtaatgacggagaatgcagtcacctcagtgccggtgccggacgtagaggagattgcacagaagtgagccttgtggcggagctcagggaagctgaatggctgaagaatgttgacgaacttctcatcaggatactcgtagaagacccacatagccttagcagcgtcaatcggggagccgccgccgattgcaacgatccaatcaggctggaactcctgcattgccttggcgccttccataacaacatcgacagaaggatcagacgtaacgccctcgaacagctttacttcaaagccagcatcctcgaggtccttctgcagctcctgcagaaagcccccacgacgcatagagtgtccgccagagacaacaaatgccttcttgcctttgagattctttacttcgtgacgagagccctctccaaaatagatatcacgtggattggtataacggcccatatacagcccatcctttcgtacccgctgcatgtgcaacggctttacgccgatacgtctcgctgcgatcggtgcctctctaatcgaggaccaagcgcataacgttctatgcacaagatcctcaccagtactattatttatcccaccccaggtgatttatgcacctctattccgttattgggcgagcggttgtgggatagagctttggcatagggtccgctataatatgaatcttacctatatataagaccaggtaaatgaccacatttctgtatacatatcggaggctttcgctaccgttcgcgctgccgtgcagtaggaaccactgtcccttgttgctatcacagtagattccggatacgcgtgtaccacagacgggaaaccgtctgtggaacttcagtttcggctgagtcgcacttcgtttgtgtccactactctggtatact

SEQ ID NO: 302 - DNA, 19782 bp, Unknown
  Metagenome-assembled genome
gcttttctaggcgtttggcttcgatatggggcgaagggtcaaactttcgccccatatcatatgcagatgcaacaggaaggaaaagccatgtatcgtctagccatgcgacttgctgcatgtactttcgcaattgtgctttgcttttgcggaacccaatcggtcaagagctaccagaggcaagcgccatttggtgccgatgtttccttctctcttaatatcgttgattcttcggcaccaaaaagccagcttgcaagagagcttgccgcaattggcgaagagcacaatgccctgatctgcaaggtttctcctgacgaaaagcactacctaacgaaaacggacattgttttattctcaggctccactgattctgagatcggtccatctttggatagggacaacatacagtggactgatggcgacatttcgggaaaattgatcgattacgaagacatgggatcgaggaccctgaacgggtcatactgcgcttccaacactgcaggccttcgtgacgcaatccagcaatgggcagcatcacgagccatagtcattgagtggcatgccctttcgggactcacggcacccgtcctggtaggttcaatgtttgccaatgcgtccggtctcctgattcccgcatcgatgctctttgttgcagcatcggtgctattcatggcacagaaaagatggaacacaaaccgcatcctcttgattggcggagtcccatacagtcgcgttcgcggttcgctggcggcatgcgccatcctatccctcttgcaagggctgctggcaggctatctgatgtttgcaatatatgttgcgatctttgctggaggccttgctcagctccatattattgcttcggccatcctgccaactattctgtcgctctccatcatcgccgctatcgcagggtcaatccttggcggagcaatggttccatcctttgaaagccttcatcagaggaaagcctcttctctcccgatcaggattctcaaatcatcgttgactgtctgcagtcttctgatagtcatggctggcattttcttcggatgctcgctgttggaaaatgaacgtatgctgctgtctcagtcgtcaatgtacgagcaaatggcaagcgcaacacgcgtcagcctgagagccataccgtctgagagaaatgatggcgggatcagctacgctaaggaacatatagagaagctgattgacgaggcggaacgcagcaacattttgcttgcatcaatcgatgtaaagcaatccatgtccctcagtgcaagcgaatgcgaaggctttgatagctacgtaattgtcaacagggcatatcttgatcttcttgacattggaattgggaagagcggatccggaggctcaatcacacagcttgagataggcgatgttccggaaacagccatagagctgaccgatctctggggcggagattccgctaacgacaatttctcattctggtcctatagcggaagtggactgctcgctcttggcgccaacacatctcaagggggaagaaacgtaacttatgataatccccttgtcatacttatcgaagcgccaatgtcatctctcaactacgaaggattcacgtcggccatgctctcgacaggcaatgtattcttctccgactatgacacgcttgacgaattgatttctgcaaccggttcaagggagttcatcgcatcgattgatcgcctgttcgaagtcgctcagctatatgcgcagatagcatcaagccgggcgaatgttctgctggccgccatcatagcagcttgcgccgtagtcatatccatggcaattcaatcggctctgtcatggagctcattgaatcgagaaaggatcttcgccaatagaaccagcggaaaatcgtatccgcgcatcgtcctgaacaacatgaagcgaatgatatgcattggtgtggcactcatctttgcttccgccgccattgagattgcctgtcagatgcgatacgtgacgctttcagttgccgtccctttgattctttacctatcggctcagttcatatttcgtggaatcttctcttcgaccgtattccgcagcaccatcgctcgaaaggaggcatagcaaatgctaatcgtcggaaagaaccttggcgttgatatatcgggcaggaccatcttcaaggcaattaacctgagaattgaaccgggaacgtcaatggcaattgtcggagcatccggatcgggaaaaacaacgctgctcaattgtctcggccttttgatgaagccaactcatggagacgtgataatcgacgatcggatcatgtcgcatgcggcacgcggcgaagttctaagattctggcgcgactcggcagcgttcgtatatcaggacagcggggttatagacgatgagtcagttggatacaatgtttcgctttcccggaaagcggagaaatacgatgccaaatcaatcgaatcaacactagagaaggttgggctcggaggcagaacaaaagaacgtgccgtgacactctctggcggcgaaaaacagcgtcttggtatcgctcgagcaatatataaaaatgcagatgtcatttttgctgacgagccgacagcatcactcgacagcaacaacagatccatggttcgcaatcttcttcttgaacaatcaaaaagaggagcctgtatcgtgattgcaacacacgatattgattttgcgcgcgcatgcgatggaataacagacctttcgatggaaccgcccgcaggttaaggggccgtcattctcatctcaagcccttcgatgatgagccctgaaacggtagtattgtgatccgccgcataggtacttgtcttctgtttctgcccatcagcagcccagaagataatgcagctgtctttcttgcgggccgtggaatcgcccttgctgcgcgtgtcctgggtgcccatgagagtcgtgctcgcttctccagcgggcatgatgcggcgggcaggcttcttaatcgccgccgtagaatctccctatcttccttgatgctcttcttgagctgttcgtaaacggcctcgtatccgtagaagtcgtcatcgaaggcgttgccgaagaagctcttcaaggcctcgaggctcgtcacctgaatgtcgaagcagctggcgtggcgttctttaagctcgtcaatcgattgcttgaggccgagggtgttggggatgatgcgggtgagcaggattgggtagagaatgtctagcgccccgagggtcttggtggtctcgaaggtcttcacgttgctggcaggtccggtcgtggtcggcgctatcacgaggtctgagcagtcggcggcctcgtccatagcgcgaccattcggtggacagtcgatgaagagctctctgctctcgtgagcctgcgctccgctgtgcgaacggtcgtaacattggcgggtgtgacggagaacggcagcgggtcgccgttctcctctgccctcatcgcccatgggctcgcgcttgactgggggtcggtgtcgttaagctcaacgtctttgccgtcgcgttttgccgccgtggctagtgctatggccgtggttgccttgccgaccccgcccttgaggttgatggttgagatgatcacgcacccctccttctgaaatcctatgtaggctgtatatacaatctgtgtcggagtcaatcgtcttcctcggctatcatgagtgccttggctggtcaaaagcgcaggcgcaggtctcttccttcaggcatgggtcaggccgcgcatccggcgacagccggatgataagacagcgacgcgtggcatgatgcatccaagaagcacaggggcagcagaaacgccgtcctgcacaagccagagaaactgggtcgacctgagcgaagcgcttgatgcccttggtcgagcccagattgaagcgacgtgtcttggagagggcctggcccggagtcaggccatagatctctcggatggtcagacgcagatcaaaaggtgcacgcttcgctatagcgagacggcagaggctatggagatcctgctgtacgtctcggacagaatcgatattgctgacagcggggaaggtgttcacggcagctggcatcccaccgctcatgagagagcggtggaagatatcgggaagtctcataggggaactccggcagagcggctcgttccctgaagcattggattacttgctggcaagtttcctcatcatggccgttggcccagcagaatccccgaaatcgggaggatgcatctgcattttcgtgacagagccggcagcacagaaccgatcgcatcaagacgcaagccgagatacaagtcggtaagggcgaaccgatatgtgcgcttctgcacaagatgctttatgaaggtgacgatatcggggcattcctgcacctcatcggcagctgctcggtcctgcccggcacgagggaagacgtggcggcgacggacatctgcagttcgagaccgtctgcgcttttcgctgcagcgaatgattctggtacggaggcgttttagatcaggtcgaacttctcgacgtgtttgaagcgctcactcagaacgcatcgggcagacagcttttgccgacctggcgtatgccataacacgaagtgcctttctggaaagggcttcgagccagttcttgaagagtctagggagctttccttttgagcatgcagcgtgtcgatattgaagggccctatcaaagatcagcatgatgcgctgtccagaattcctgcagggtcatgggatctggtttcttgctacagcgtgctctggccccactggactgtgcagggaaggacctggtgaggatcgatcctgccagtgccgctgatgaggtcgaggaggatcttcgctgcctcgacgccttccttgaaggcaggctgtgcgatgacagagacggatggggaggcgacttctgcccagtcggtgttgtcgaagccgagaaggcctacctccttcggcatgcgcccatagaagtcgcgcatagcgacatagatgtcgggcagggcccagcagttcggagcgaagaccagggtcggcaccgtgcattcgtcgagctgctcatgcagccatgccgtgagctcctcttgaggcacgcctttgtcgggaatcacgaaatgctcggaggggaggcccagggcttcgatcgtatcggtcgtgccctggaggcgttcggtcctcgagctcagaagctgcggctctgccgccacgacaagcacgcgctggtagcccttggcaagaacctcggagagggcccgcttcgtggcttcgtagttgtcggtcttgacccagcttgccgtgtagtcatagtacttggagtcgaagaagacgagcttcttgccggagcttccgatcgcttctgccacttcgcggaagcgtgcggtcggctgcacgatgaagccatccaccccgaccgagatgaggcggtcgatcagggcatgctcgttgtcgcggtcgaagttcgagctcgaaatcagaagacggtatcctgcctcgcttgccaccgagtcgatgcccttcacgatctggttcgagaagtggttcgcgatgtcgccgacgacgacgtctatcagataggtctgcttggcattcatgctgcgcgccaaggggctcggctcatagccggtctcgcggatgacctggcctatcctgtcatgggtctctttcgacatgcggtcggtgtgcccattgaggtagaaggagaccgtcgtcttcgaagttccggcaaggcgggcaatctcggtgatcgtgacacgcttcttggtggctggcatgatgcttcctcgggatgaagagggtttagtaaaccaataatagcatgggacacggaaaaggcctgcttccccgtgtcccacggacgatgctctgcagcagctgctaggcgagaatctccttgacggctgcaatgacctcggcatcggttgcctcggcgaagaagtactcctggaagtgctcgcctgcgaaggcacccttcacgaggtcgcggtcgaggtcgcgcaggagctccgggaacggacggaaggctgtggcgcgtaccgcatcgaggatcttcttgttgcgctgctcgggctcgacgcgctctgccggatagccattgccggagccgaagccgaagagcttctcgaacgtgtactcgaggttgagctcctggccccagccgttcttgagggcaaagggcatggccacggcgttgccgtcattgatctgggcaaaggtgtaggcatcgagcggatcctcgacgtgtccgcagatgacgccggggaaggagttgagcgcgagcatggcgccctcgccggtgccgcagccggtgaccacatagtctgctgccttgccgttcagaagcgttgcggcaaggatgccgttctggacataggtgagctgggcagcgtcgtctgcggcatacatgccgtagttgaagaccttatgccccatcggctctgtgaccttgcgcagcgccttctcgatcattgcgttctttgctgcctggctgttctcgttgataagcgcgattctcatggtggtgtgcctttcatactgagggggtgttctcgaaggacaggcgccccggagaagaggcgccgatcttttgtgctactgcggctgcttgccgatgtaggcgaggatgccgccgtcaacatagaggatgtggccgttcacgaagttcgaggcgtcggaagccagaaagactgccgggcccttgaggtcctcgggcgtgccccagcgtcctgccggcgtcttcgcgcagatgaactggtcgaacgggtggcgggagccatcaggctggatctcgcgcagcggggctgtctgcggcgttgcgatgtagcccggcccgatgccgttgcactggatgttcgcgccgccgaactcggagcagatgttcttcgtgagcatcttgaggccgcccttggctgccgtgtagcctgcgatggtctcgcggccgagctcgctcatcatcgagcagatgttgatgatcttgccgtggcccttctcgatcatgcccgggatgcatgcctttgccatgatgaaaggcccgacgaggtcgatatcgatgacctggcggtagtcctcgacggacatgtcgagcatcgggatgcgcttgatgatgccggcattgttcacgaggatgtcaggcgtcgtgccgaaggtctcggagatcttgtccatgaggcccttgacctgctcctcgaccgtgacatcggccacgaagccatgggctgtgatgccgagctccttatacttcttctctgcctcgtcgatgcgctcctggcggcggtcattgaaggcaatcttggcgcctgcctgtgcaagcgccgtcgcgatggcaaagccgatgccgtaggtggcaccggtcacgagggcaagcttcccctcgagggagaagctcttctgggggtcgaatctctcttccatccatatcctcctagaggtctcatatcagcgatcagcgttcctactgtgcaattctgatagtaaaccagttttgcaaacttgcaagagagcaaatggatgctccgggaaatttgccggcaaagataggtatcagccacacattatgcagaaaggatgcttatacgtcgtatggggctgatagcaaaacggtttaatagcgaggggagcgcgcggtgggccgcctggcgtgtctggcaggagggcgcatgccttcttcgagaaaacagagcaaggagccctgccggcaggtccggtcagggctccttgaagcatcaggctcaatgcagctttctcagcgctcggggatgaagccatccgagtagtcgggctttgcaagccagcgcttcctcagaaggaaggcaacggccttgggctggcggtcgcgggtgaaggcgcccttcctgttgccgtcgactctcatgatgccctcggtggtctggaagtcgcagaggttccagggctgctctccgcagatccagtcgaaggaatcgaagatcttgtgctggagctcgaagaactcgagctggtactcctcgctccacatgacgctcggcagcttgtgcactcctgccatggtatcggtgccgtactcggtgaacatgaagggcttgtcaggctcgagcttctcccatgtatggagctcttctttgaggatctgctcggcatcctggatgcgcgggccgcccgacacgtaccatccgtcatagcggttgagcatcatgaagtcggcaagatgggtgcatttgtcgatgccggcgcggcaccgggtgacattcgtgtagctgcgcgggcgcttctgcgggtcgagctcctgggcccgggcgaagaccttctcggcgtaggggacggctgcctcggaggagaaatcgggttcgttgaacagcgaccaggcacagacgcttgcgtggcgcttgtcgcgctcgatgagctcttccagggcggcaaggtgtgccggcagggtcttttcctgcacggcaggatcgtcgaagaaggtggcgccctgcgccttggtcgtggcatcggcgaagttcttggtcgagcgcagcatgccgacagcggctacctcgtcgattacgaagaagccttcgcggtcggcctcgtagagctgctcttcggcatacggatagtggctcgtgcggaaggagtttgcgcccatccacttcaggagctcgaagtcgcggtggttcacgacggggtctgtgcccctgccatggaccggcgaatcctcgtggcgcccgaagcccttgaggtagaccggatggccattgacgaggatctgacggtgcgagatctcgacggtcctgagtccgatctcgtcgtaccactcgtcgacgagcgcatcttcgtcccagatctctgcacggaaggtgtagaggtaggcagcgcgcaggttccagagatgggcagaggcgatctcgatcgtgccggcagagcccaaagccgcgccgacctcgcctccatcctcgtcgaggacatgcacctcgacgcggtgggtgcctgtcgtgcgcaccgtgtagctgacgcgggccgtggagccaccatctgcctggggcacgatctgggtcgtgaccgcaaagtcctcgatgcgctctttcggggtggcaagcaggcgcaccgtgcggttcaggccgctgtagttgaagaagtcgaagtagggcgcgcagatctttgtgccatcgcgcagcgtcgccgtgccgccacaggggatggtatgctcggtgagctcgttgttgacaaggacggcgaccgtattccagtcgttgaaccgcacatggccattgagatgggccacgaagggcgtgaagcccccttcgtgggaggcgatctcgtctccgttcacgaagacccgtgcacggtgcgtcgcggcatcgaagcggatgtcgagctccttgtcctgccactcgccggggatgaagaccttcctgagataccagaagtcgccgtagtactcgcggcttgccttgtcggtgaagatgtcgttgaagctggcaggcaccggcatctcgatcgggtcgggaaggcctttggcccacccctgggcgactccccggcgctcgggatcgaattggaagtcccagacgcccgaaaggtcctcgatgcggcgggtgcgtgtgatgcggggatagagcgatgcaaaagacatttcgaaacctttcttgttgtacaggctcgggtccgtgccgggggcgggtgtggcctgaggtagtatggggcaagtattgcagattggatcttgatggcaggacgcaggcccaggatatgcgcatccggtcatggctgttccgcatcagatccctgtctgggaaggcagcgtggagccgtgacgcccgaagagctcgacaggcagctgaggacgctctcagaccatgagcagctctaccgaaacggtgctgcccctgcgcccgagcggcgcaggttcgtggatgtcggcggccagcaggttgagaactgcaatatatggacagacggaatccagagtttggatgcttgtttggcatcacctggatcgtatgcataggccttctctcgaggtgccgaagaactcctgcaatcactctgccgtaaccgcgattttctttttccctatggactatgcgggtggaagcgggggttttatagtacggactcgattaaaaatagtgtgccttgtgcttgggaagccctcacacgaatctttttaccctccatatgtctttccccccccccccacacacccaccacccatcgctaccccaccaactcccccccaacatccacatctatataccaaccctctccatcacaacaccccaccacccacaatcaaaccaccctcacctattccgcccaccaactcacccctcctcactacacctctcccaaaaaccaaacccccccaactaccccgcacccatacctaaccatacccctcttccttcctcctgctccggacaaccgcacatcaaacccccacccccacacccctccaccacaaccctcacccaaacctccaaaactcaccctaccccccaccccacccccctccatcaccctactcccaacacataacatcccccacaacactccaccccaccacaccccctcacaaacactaatcccaaccgcccaaacactccccctcacccagctaagaacacctccatccaaaacccacaagccataacacccccaaccttcccccccctccagacaccgaaatccaaaaccactaacccgccccctcccttccccccctaaaccacaaccctcccacaaccaccccacctcctacatccgccaacccccacccctcaccaccccccccccgtccccacacaaccccccccaaccccttatcccacgcctctaccgcgccccacacccaccccaccatctacccagccataaccccacacctacccaccccacaacccaccgctcccctttctcctcaatccacccgccctcaaccctaccaccctcataatcagacatacaaagacccacaacctcccatatctcccaccctcccgccccttcacataaccccccaacttcccctaaccccccattcataaacttaactaaaaccctacaacacacgacaaaacctaaatccaacactaccccctcccccttcccttctcaaatctctctattcccccctccgccccccccccacatactcaaccaattaccacaccaccacccaactccacccttacatctcccccacacaacgcccccatctcccacccattccctccataactcctccaaccccacactcccacaaccctcccatcttctagcctcctaacctccccacaatctaacaccccactaccctcccccgcccccatctcaacaaacaccccccccccactcaaacatccccaccctctcccatcgccaacaaactcctcagcccaattaatgccgtcgcctttttcccccctcgacctacacacccccctctaaacgctcccccaccccccacaccccccccacacctccccctccccccccccccccacaaaaaccccacaacccatacccatcatctacactcacccactatcccccacctcaccaccccccgcctctcattcgcgccccccccaacattattctgttacattccccctccacacaaaacgccccccaccacttccaaacatcccctgcccccaccaacccttcattttcatatcacactcgacacccacgccctcccactatctccccccttgcctaatcttccccccccccccccctggatggtctaagaggcgcttcaggtagtaccattcgttcttgagtgtggcgaaaagcgattcggcgaccgcgttgtcgtggcagtttcggtttctccccacggagagcctcacgtcgtgtacggctgagcaggcggcgagctttgagcttatgtactggctgcctgggactgcttagaatatggcccctttggccacgtatccgcgcgaatatgccattctcagggcaaagacgacaagccctgccctcatgtgtcctgtatgcttcagcccaccacccatgtgtgtgcacagatcgtgcgcgcggcaagatatattaaagcctgccgtggcctgcgataggttgtatccgcccacgagcttggctgggatggtaccgaaaaagccgccgcgggtgagggcagcgtcgttcctcttggaggcattggatcatatgccgcccagatgcccaagttagccctgcaactctgcgcagcggtagcgggtcgtcactgtatttgcgtaactgcggatctcctgtgagctgtccataccttgcaaaattaaagcgcctgtcgatttcctccatatcgcgcgatggctccttgagagacaccataggtcctcacgcctttggccttgagccatcgtgagagtgagccctgctcacctccagtatgcgctccatcatcgagacgttgtaggttgcccctctttaccagcgtgagctaaaaccttcctcccagaggcttccggcgaagaagggctgcctctttttaggaactcgtttctcgctttcgagctcgtgtatgcgcctcttcactgcgtcgagctgctgtgctcgtcggtcctttcctgggtcacctttggtctttgagtgcttgatgatccagtcgtttaaggtcttgtcgtggcctaagcttcgcggcatcctttgatgctcttcttcgggttggcttacgtgccttcctgtagtagtcgatagcctcgagcaatactcttcagtgtagtgtttgggtgtttccggcttcgtgcgggcttgaccttctctatactcgcttgcactcagcgacatctcatcttcaatctgctggtgtggtaggggtattggacagagcatatctgttgccagtccctgaatcccactgtccaccaaaagattacagctcactggtcacattcgacgcccacggcggcctgcgccgcgcggtctttgaggtctacccagaaggcggcctggcagcgctgcgtcgcgtacatcaagtgcgacgtgctcgccaggatcgactccggggagggcctgacggcgcgccctctaccatcgcgccgtcgatgagctaagggaggacgccccgtcggtggccagggtggtcaaggacgccgagcttgccgccctcgcgtatctgtccttccccagacagcagcgcctgaagatctgcaccaacaacgtgatgcagcgcatgaacggcaagctcaagcgcagggccgggtcgtgcaggtgttcccgtcaacggggtcgatcatgcggctgctcgccggcattatcggcaagcttaacgccgagtgggagtgcagaaggctgttcatgtcgaaggagtcaccagagcccgttttctcccttaagagggcaaagatgcgcatcaaggagctggaggcggacgaggaggcgcactccgaagcgagggtgatcatgaagctagtgattgataagtacgagagagcggcataaagttacgccaacgcaggaggctgccgatatcgaaactggcgcggccctactcttacaccacaaaatccgacacaatccaatgaagcattcttttggtcttcttgatacatctgatattccaatctttgagtcagatgttcggatttttggctgcacatccaaatctaccgctcgccgccacctctaagaatatccagtacaacgtactggagcggtgctataaataagcacagtgcattgtactgcagctgcccgggagctggaacagtgtgctgcatctgcagcggcttagccgagtggaaggactagctatgagatatctgcttctggtgagccatggaacaatggctccgggcgtatcgagcgtactggacatgctggtagggcatcacgacaacgtgcttgtgtgcaacatgcctgatggcatgggggcagacaagttcgtcgagaacctcaagaagacgcttacgccggttggggcagacgacgaaattgtcgttctcggcgatgttatcggaggatctccgcttacgaacacgatgaacgttctgacggagaagggccttttatcccatacccatgccttcggtggcctgagcctgcctatggcgatcactgccgtgatgggcgacgatgttgcatttgacgagctggcttcccagattgtcgacgagggacgcgctgccatccgcgagatcgagatcgatcttaccgacgacgaagaggatgaggacgatctgtaagcatgcaaaagcggagccagaggggctccgggcaaagaaaggggagggacatgatctcatttgtccgcattgacgaccgcatgatccatgggcagaccgtcacaagatgggcactcgagtatccctgcgacggcatcattgccgtgaacgatgctgcggcatccaacaaggtattgaagtccgcctacaaaggcgcagctcctgacaagaagatcttcgtttggaccaaggagcatttcaaggagaaggcacagaaggtgctcgagagcagctcccgctatttcctcatcacgaagaatccgctcgatatgaagtggatcctctgcgacctgggctttgttccctccgatgtgaagaccgtcatcgtcggtccgtgcaacgaccgtccgggtgccgtgaagctgggcaacaaccagtccatcacccccgaggaggcacaggcgcttgaggacatcacgaagaagggctacgacgtcgtcttcgcgcttctcaaggacaactcgattggcccctggtcgaagttccgcgaccagttcgatctcaagtaggcacagcttctgcctctgtacgaagaaaggaacgctatggaaatcaatgtattccaggcagcattgctcggcttattcgcctgcctggcatcactgcccggcatgggcggcacgacgataggcaactatacgctcggccgtcccctggtcggtggccttgtcgtcggtctgattctgggcgatgtccagactggcatcatcgttggctccgctatccagatcgtctacatcgcgctggtcactccgggcgggactgtctccgcagatgtgcgtgccgtcacctatatcggcatcccgctctcaatcctcgcgatccatgcacaggggcttgatccctcttcgaccgaagcagcaaacctcgcagcagccctcggtgcagcagttggcacgctcggcaccgttctcttctatggcaccgcaacgctcaacctggtctggcagggtatcggctggaaggtcatggagacgaaagattggagcaagatcaagaagactattcctctcgtcgacgtcgtctatccctggatctcccacatcctcttctccttccttcccacgttcgtcatctgcctcgctggcgccggcatggtccagatcatgaaggactacctgccgatgaacggcatcgcaatgaagacgctgttcacggtcggctccctgctgcctgctgtcggcatcggcatcctctgtaagcaggtcatcaccaagccgcttgactgggtcacgttcgccttcggtttcacgcttgccgcagtgcttcactgcaacctcattgcgtccgcagtcatcgctgtcttcttcgcgatgatcaacttcgagattcagcagctgaggacgcagctcaagaatggcactgtcgcccttgcatccggcgacgaggatgatgaagacgaggaggacatctgatcatggcagacatgaacaagaagctgtcgaacaagaagttgtccgagaaggcgctgtcacggtccttccacaactgggcttacggcaacctcacctgcttctctcaggagcatatgcagacgtttggctatctgttcgcaatgctccctatcgtggaagacctctacgacaaggatgaggacaaggtcaacgcactcgagacctatacgaccttcttcaacaccgagccacagatcggcaccatggtcgtcggcctgacagcaggcctagaagaagcacgcgccaacggcgagcctgtcgaggacgagaccatcaacggcatccgtgccggcctcatgggacctcttgcaggtcttggtgactccatcatcgttggcacgttcatccccatccttcttggcatcgcgctcggccttgcccagggcggctctgtcctcggcccgattttctacatcgtggcttggaacgtgctcatgtacttcggcatgaagtttgcctatcgccgcggctataagctcggcggctcggcagtcgaagctctcgtcggtccccagtccgaggcactgcgcaactctatcatcatggttggcaccatcgttatcggtgctgtcgccgcaacgtggatttctatcgacacggcacttgtccttccgggccttggacccctgtcgcgcgtcctgtggtcgagctcccagacggtctctgccgatgcacttgcttcctctggctccgtcaccctcaatgtctttggctctggcatctatccgaagatcctgaacttcgccttcgtttacctctgctggtggctcatgacaaagaagaaggcctctgcaacgaaggtcatgctcatcatggtcattatcgccttcgtcggcgtcctgattggcttcttcgatccgggcctgtcctactagcacgattgctcttctgggaagagggaaggcaggaggggattcctgccttccttttctgtatgccggggaatgtgaaaggatggtatgggatgacaagaaatgatgcgcaggcaaagaagcgtgcacagctcgtgagcgaggcaagggcacagaccgatgccatccagcggctggagacctgggcaagagttttctatgggctgcttgcattgggcatcatcctcgggctctggcacttcacgtacaacggccctgctgcggcaggcatagcgggcatcatccttactatactttccggtgcgcttgcggctgtgttccatgttggcatctcccatgcgaagaagaatgtcgcagcgctcctccgtgcagcaggcattgacctggcaacggggcgtcccatcgacgagaagaccggcaagccagttggtggatcggaggagaagaaagcttcagccaagagatcggctgcctccgatttcgccctggcaaagcaggcgctcaagatcctctatgggcgtcagccccagaagaaatgagcttgagcagcctctccggctttctggagaggctatctttgtcttaggtagaaggtgcatcttcgaaaagtttcctgcatccctcgtcctcgtcgcttgccgcgcagacgaagtctgccttctctctgacctgaggcactgcattgcccatgacaattcctgtacctgtcgtttcgagcatggacaggtcatctgctgtgtctcctatggctgtcgtgtatacaggctctatgcctggcgcagcgcatccgtcgacaacggctgctgccttcgagatgccggctgtattcgcttcgactaagatacctgacaaagtcgagacatggcgcttggggaagcgccccctcagcgagtcgcggacagggatggttgtctcgggattgcagatgaagaggatcttgccgaccaccttatcgtatgcaagggccgtagctcctttttcctgggaggatgtctttacgatgcgtttcctcgcgggcaatcctcgggtccttggggctcttcacatactaatgttcggtggaatagatgctggcagcagcatcgctgaaatgctcttcgatgtggtgctcgattgtaaaagtaagttcgcggctgaatccgtgttctgatagttcttccttcagcgtcaagcaggagccctcctccatacactgcaatccagaccctttcgagtctgttcgctctgacgattggcatcatgccctggggacttcttgaagaggcgagcacggccgtgcagctcctgttcatgcagttcctgaacgtgtctgccactgccttactcatcgtatggtcactcctgagcgccattccgtcgatatcgctggagagcaccttgcatttggatttcatggccatcctctctcttgttctggcattcacgatagaggagggaagaggcagcttcggcaaggacaaataaaaggtagtatggatacatactagtagtaccaatgagagaccaaggaccagcaatggatgtgctggaactcatttcgcgtaatggcatcgatcctgcgggtcccatgatgctgcgtgctcagatagagagtcacatacgtcagttcatcgcggcaagcgctctcgtaccagggccctaccttcctgtcgagcacatgctgcgcccttctgagaagcgagacgctcctgtcattcagcagggtggagatattctgaggcaagcctgtcatcacgagggccacacagcgatccttgcggacaaagagctggtaagtggctgcaagggcgaacatctcatcgagaagggaggtgtccctatagctctgtcgactggtttttctagccagcctcctagagaaacgatgattaattcgcctcgatgagatcgctgggaccacacgctgtatgccgccggctcaaaatgtctcgaactacgcagtgcccatacccacatagatgcctatctgccttctggatatggtatagctacatccacacattccagcatatccaaaaggaagatatgggcagccagatgagcttttaggaccttaaatcctaaggtcttaggaaaaagacccggcgagaggcattcctggagcggatggatacaatcgttgtgtgggacagctggattgcactggtagataccagctaccactgacaggctcttgtcaggcatgtgcgcgctgcaaagacaaagctttaggatgtatcctgctttaggtaatgtttgctctcttaagacgagggaacttaaagatgctatcctggattgtcactcctggtggcgtttctgtgcacgtagacctcatgtctgagcaggtgccagatgcgacgacacttgcgaagatgcgccatagccttaaagcgagagggactcggcaaagcttgtgctttgcacctgaacttagaagcttgagaaggcagggatcacggggcggggtggctccatggtagatgtgaccttcatctgggctctaaagcttaacgaagaacaaggaccatgcgcgcgacccttaaagcgcaccagtccaagaaagggaaggggtggcgtatcggatacaaggcgcatatcagcgtggatgccggtagcggccttgtgcatggtgtggagacgatcgcctagaatgtatccgacatatcctgtggcacatgcactcgtaagggaagatgttaggttctgctatgcagactttaggctatataggtatagcgaagctcccttaaggtcacataagacccacacctctcatctatgcgctaaagcgttgctaaggaaaccttcgactagagagggccttgcctgtgcactcttctccgagaagggcatcgagtccaggaaggcatccggccgctcaaaggtagagcatcccttccttatcgtgaagcggcgcttctgccccttaaagaagcgctactaggggatagagaagatgcctgtacactcgagtctttctcgcccttgcaaaccttacccatgtgtatcttttgccggcaggctgcacctcccggctctcagagtcgcttgatctgtcttggagccttcttgcggtgcatggggcaggacaaatgtaaggatagcggctcctgcacgtgctggatgagcatccttccctgcctttcccgcatgccggctgcgaaaagtcgtgtggtcggtcccctctgacacgttatggggcattaatcatcgtttccctagagtgcttcgagggccttcacgacctacaggtcaagctgagcgatcacatgtggtggtacaaccacgagcggatacactcgaagctaagttaca

SEQ ID NO: 303 - DNA, 68346 bp, Unknown
  Metagenome-assembled genome
ggcgcttcggccacttaaggaagcgctactaggggatagagaagaactcctgtatgctcgatgtctgcttcgcccttgcaaaccttacccatgtgcatctctgccggcaggctgcacctcccggctcccagcgtcgcttgatccgtcttggagccttcttgcggtgcatgggacgggatagatgtaaggatagtggctcctgcacgtgctggatgagcatccttccctgcttttcctacattccggcctagaaagaccgtgtggtcggtcccctctaacacgttatggggcattaatcatcgtttccctaggcgtgcctctcgtcgggtctttctcctcagaccttaggatttaaggtcctaaaaggctcttcgtcacttctggtgggtagcatatctgcatccccttgagggcgtggcctttaaacggtaggatttccggaaaggaaaagcttcggtcctaaggtgcgatatggatgcttaaggcagggatgctagcaaggctctttaagaggtcccagggggcttagggacgagtgggagctcttcgatgtctggtttaaggagcgcgagggagcgcaagacgagctccatgtgagggtggcgcacaggaagggccaggcagtcgagtgccccgtatgccacaggaggtgcgacacctgtgacacgcgcgagaggaccttgtggcatcttagcatctggcaatacgatacgatcgtgcactgcgcgctgcccagggccgactgccccaaagacggcgtacatgccgcaaggatgccctgggaggtgcggccgaactcgcacttcacggcgctcttcgaggcgcaggtgataagtgatggcgctctttggcatgagcgtgacgccggtcgcgcagcagctgcacgagacagcccacgcgcatatggaggctgctgggcaaggccgtggccgaggcgagggatgccgccgactactcggatgtcgtgtgcgtagggatagacgacaccgccaaaaggcgcaaccaaagctacatcagcatcatggccaacctcgactgtcagcgcgccgtggccgtcacgcagggcagagacaagggggccttaggcaggctctgcggcaagcttaaggagcacgcaggggacaggaagaaggtcttagaggtcacgcgcgacatggcttaaggcatactcgctgggagtctccgagatgccccaggccgcccagagcgtggacagcttccatgtggtgcagctcctgaacgtgaggtgcgcagagaggcgcgagtccgccgagaagcacaaggcagcttgctcagatgaaatacatatggctcacgaagagggaggaactcgaccccgcgaagacccatctcagggaggcatgagctgtaatcttttggtggacagggggattcagggactggcagcagatatgctctgtccagatacccacctaccaacaccagcagattgaagagatgagatgccgctaagcccaagcgagatagagaaggcaaagtcccgcacgaagccggaaacacccaggcactacactgaagaagtatcgccttaaggctatcgactactacaggaaggcacgtaaggccaacccgaagaagagcatcagagaatgcgccgcgaagcttgaggccaacgacaagaccttaaacgactggatcatcaagcacaacaagaccggaagggtgacccaggcaaggaccgacgagcacaagcagctcgacgcagtgaacaggcgcatacacgagctcgaaagcgaaaataagttcctaaaaagtggcagccttcttcgccagaagcctctgtcgaaggacaggttttagctcatgctggagaagagggcaacctacagcgtctcgatgatggagcgcgtactggaggtgagcagggctcacttctacagatggctcaaggccaaaggcggtgaggacctatggggtcccctcaaggaggccatctgcgcgatatgggaggaaagcgacaggcgctttagctttcgctaggtctgatccaagctcacaggagatccgaagttacgcaaaatttacaggcacgacccgctaccgcgtgcgcaggtgcatggctgaacttgggcatctgcggcatctgatccaatgcctccaagagaacgatactgcccgcacctgatacccccgagcgcagcgccctcacccggcgcggcttttcgtgtcttgtgccgacagccaagctcgtgggagatataacctatcgcaggaccacggcaggctttatatatctcgccgtcgcacaccatctgtgcacacacatggtggtgggctgaagcatacaggacaacatgagggcagggcttgtcgtctttgccctgaagatggcatattcgcgcggatacgtggccaaaggggccatattctaagcagcccaggcagccagtacacaagctcaaagctcgccgcctgctcagccgtacccgacgtgaggctctccgtggggagaaccggaagctgccacgacaatgcgctcgccgaatcgtttttcgccacgctcaagaacgtgtggtactaccacaagcgcctcttagacgcatccacgaccaagcacaaggcacacgagtttaatcgagtcgtactgcaaccgcttccgcccgcataagtccataggagatcgcgtacccgcagaggtgatgcaggagttcttcgagcgcctcgagagaggccttgcatacgatccaaaggcgatgcagaccgcataaaaaatctgagattcctctgtccattttaggctcactcttttaagcgagcgcatgcgccttgtcgtgttgtaccagacgatgtagcagttgatgcgctcctccagctccttaagggtcacgccgtcccacttgcgcttcctgaacatctccgtcttcagaagttacaaagaaagcctttaatgcgctggttgtcgaaagtgtagcccttgcgcgacatcggcctttcgatgccggcctctttacagatagatatccacttctggctagcgctagtggcggccgcaatctgagtggatcataagatggctgcactgctgcccggtcgtggttaagatcgtaacacgcagcattgagtttgtcgtctcggcgctcagcgtcctcgacgacgtcctgcccacgatcgcggagtcaaagcagccgaggatagggctcaggtagagcttgcaggcgggtatctcaaagtgcgtgacgcctaagagccacaaggaagttgggaaggcctgccgtaaagtcctgcttggccttgttgttcggatgctctgagatctctttcttataggaatcgtagcgcttgttcttcttgtagctcttacaaccaaaggcaatcctgccctgctctttcaggatgcgggatatcctgcgcttaccgacgaccatgccgatctcaaggttggctgcgatctcgtcgtggatgcgccgccttccataggctccctcgttgtcgtcgaatatgccaaataccggatccctgagcttagcatctctgtcggccttcatggcaccaacccggtagaagtaactggactttttcatgtcgacagcactcagcaggctggtgagcgagtatctcccccccacacttgtagtagagctcgatcgcacttttcttgtctgcgtagctgaacatctgcagaatccttccatacatctgttcggtacggattttcggtatcaccctcaatcggtaagtctggggttgactttaacaaacgtgcagatcgacgagaagtactacccgtaagcccgcgccgacgaggagcaggaagtgcggcctctccaggaataagctctgcgcggcaatcggatgcgatggggagggcaggtcggtcttcgtgtcgtgcggcaggagaaagccgagcagggccagggcctgggaggcatacgggagccagctctcccatgacaaggagaggtcgtactcggtgttggtcgagaggctgtccctgaaaagcgtcgagtatggcgcaagggagatatcgcgcatgcccgacagggacaatccgctgaggagcgtcaaccgcctgtgcttcctgctggagaccttcctcaactcccattccggattcgacaggcatgacctccctggctggttcgagctgttccatatcatgatggatggccctgcggacaagacagagaaggccgcgatggtgctgggatgcgcaatgcgcatcccaaagacgctgtcgttcagggagttcttcggcataaagtccagctcggagagctaacgattcagatgcatctgcacattgtgcaaaggatgatttttcctgaaagcctgcatggtgcttggcagctgttgtatccaggacagggatggatgaaacactcacggctcaaacactcagacaaggttaggtgtgccttatcgcctttggtcttgtggctcaagaccaaatcactccccttgcacctaacctcaggtgtgcgcaacgtgtctttgggagcgcttttcaagcttgtggcgagctctcctttgtgctggtggacaagtgggcctgcgcttttaagcttttcaggcaggctatagttgtggatacccagcaagctttggtcagcgtaggtataaagtgtccttctacacaaactcccctgctgcccctgagcggttgcagcacgcctcaggtggccagccacctttgaagaggtgatcctctacacagtgtgtgagctaaggcctcttcaggagattctgttctgtgacaacagctcttgcgtctttccttacagatgccctgcccttgtttggctctgtggcgcactgtcttagccgtggcagagctcgaccctgccacgtagctgatgaagtatacaggccggctgagctcttaggcagatacttctcagcaaagccatccttccaggcagctctgtagtgtggcccgctcttcaaatgtagagtgcttttccttctgctgcgcctcaatggtagaatgagggcagtccatctgttaccttcactagattgttgtcgtgtggtgatccacatactatcggacaggttcagctggacttttccccttaggtgttcaagttgatagtacagtcggtggatttttcttcgctgcttcctgaaagagacgactccaagctgggatacactgaggtggactacctggcgaatacaggcaatgaatctgtttgctctgtggacatccataaaactttgtgtttttcagaggtttttgttactattataattcactgtcattgtggagctatatgacgtgaaaggttgtgaaacttgagtaagcaagatgcaattgagcttgaaggtactatcctcgagcccttgccaaatgcgatgtttcgagttgagctggagaataagaagacaattctgtgcaccatttccgggaagatccgtatgaactacatccgtatccttccaggtgacaaggtgaccgtggagatctctccctatgatctgactcggggtcgcataacatatcgctacaaatagagagcaattttcgcctgcggctgggcgtctatatagaacctgtaggaaacaatcgaaggggattgcaatgaaggtacgtccttcggtaaagaagatgtgcgacaagtgcaagattgtccgtcgccatggtcgggtttacgttatttgcgaaaaccctcgtcataagcagcgccaaggttaagagaggagcaaaagttgccacgtattaatggtgttgacctcccgcgtgagaagcgcgttgaagttggcttaacctatctttatggcattggccgtacgtccgctaccaagatttgcaaagagagtgggatcaatccggacactcgtgtccgcgatctcactgagggagaagtaacaaagatccgcgagtacatcaacgcgcattacactgtcgagggcgatcttcgccgtgagcgtcgtcagaacatcaaccgtctcatggagatcggttgctaccgtggtcttcgtcaccgtaaaggtttacctgttcatggacagcgcacccacacgaacgctcgcacccgcaagggtccgcgtcgccagatcggtgctagggcgaaggcttaaggagtagtagatgccacagaagaatcagcgcacgacgcgcgtgaagcgctctgagcgcaaaaatatcgctgtgggccaagcccacatcaagagcacctttaacaacacgatcgtctctatctccgatgcacagggcaatgtcattgcctggcagtccggcggcacggtcggcttcaagggctcccgtaaatccaccccgttcgcggcacagatcgcagctgagcaggctgccaaggccgctatggagcatggtcttcacaagatcaccgtcttcgtgaagggtcccggctctggccgagagaccgctattcgttcacttcaggcagcaggcctggaggtttcaggtattcaggataagacacccatcgcgcacaacggttgccgtccgcgcaagcgtcgtcgcaactgaggaaggacagtagctatggcagtagataggacgcctgtccttaagagatgccgccaactcggcatcgagcccacgattatgggcatcaataagaaatcgaatcgtcagccgaagcagcgccgccgtcaggaatctgagtacggccagcagctccgtgagaagcagaaggcaaagttcatctacggtgtgctcgaagagcagttccacgggtattatgagaaggccctgagaattgagggcgtcaccggtgacaacctgatgatcctgcttgagacccgccttgacaacgttgtgttccgtctgggctttgctcgtacgcgcaaagaggcccgtcagaccgttcgtcacggccacatcacggtcaatggtaagcgcgtcgacatcccctcttaccgcgtgaaggcgggggacgttgtggcagttgcgcagaaggcaaaggatctgctcccgatcaaggaggcaatcgtcgcctctgagcacatggccgttccctcttggcttgaggtagacatcgagaaactttctggtacggtgctgaccctcccgacgctggatcagatcgatactggtattgacccgcggcttatcgtcgagctctactccaagtaataggaaacggttggaggttatacatgtccgatttcatccggccaactgtgtcggtagaagaggtcaatgacaaaattgcccgtgtcaccgctgagccgcttgagcgcggctacggtgataccctcggtaattctttgaggcgtgtcctgctttcctcacttaaaggagctgcggcagagtctatcaagatcgacggtgtacagcatgagttcaccacggttccgggcgtctacgaggacgtcacggacattgtcctgaacatcaagggtctggtcttccattccatggggacaggcgatcgtgcgatcgcgaccatcaacgtggacggtccgatgacggtcaccggcggagatctgcaggtccctgctgagttcgaggtcgtcaacccagaccatgtgatctgtacgctcgatgacggcgcccatctgaagatggggatcaacatcggcatgggccgtggctatgtctctgaggcagaccacgacaaccctgatgacccgatcggtacgatcgcggtcgattccctgtattcaccggtgcgtcgttgtgcgaaggtcgtcgagccctgccgtgtcgggcagcggaccgactatgacagattgatccttgaggtcgaaaccgacgggtctgtgaccccgcaggatgcggtcgttgaggcagcgaatatcatcgatcagcacatgaacgcattcatgggcctgggagagaagcccgaagacgaagaggatgcttccatcttcgttcagaagaaggaagatgacaacactgagctcgacaagaagatcgaggatctggacctttcggtccgttcctacaactgcctgaagcgtgcagggatccactctgtccgccagcttgttgagttctctgagaatgacctgctcaacatccgcaattttggtgttaagtccatcgaggaagtcaaggataagctagagtccatgggactctcattaaagccttaagactcaccgaacgttgttaataggagcatatataccatgagacacaataagaaacatggcatgaagctcgggactgatgcgagtcataccaaggccatgaagaggagcctcacctgtgctcttctggccaatgaccgtatcaagaccctcgaaccgcgtgctaaggcaatccgccctgatgtcgatcacgttatcacctgggcaaagaagggcgatctgcactctcgccgtctcgcaatcaagaccgtcggcgacaaagaggtcgtacgtgaggtcttcgagaaggctcagcagggcctttggaaggaccgccagggtggctacacccgcatcatgaagctcggcaagcgcaagggcgacaattccgatgtcgttatcatcgagcttgtcaacgaggcagtgaagccgaaagctactgccgatactgtcaagcctgtcgctgagcctgagccggttgcggctgaggacagcaaggatgacgctgctgaggctgcgaaagacgatgagcccgcagaggattctgtagaggatgacactcctgctgaggaaactcctacagagtagtcaagcgcaacatgtggttattggtagaggcctcggacgtatattcggggcctttttgctgcacaaatataggacaggggagggggatcaatgctggcatttcaagacgtaggattcagctatgacagcgatacggacgtcttacacgacattagcttcagtgtggcccctggatcctgcgttgccgtggttggcgccaacggttcagggaagtcgacagtagcctcccttgccaatgctacctatctgccgagtatagggaaggttagtgtcgataaagactcgactgctgatacttcagagcttgagatcaagcagcgcgttgcgatcgtgaggcaggatcctactactcagattgtctcgagccgggttgccggtgaagtggcttttggtccgcacaaccttggaatgaccggtgcagccctgcgtgagcgggttgactacgcgctcagggtagtcgggcttgccgacaaggaggatgcggataccgaggggctctccgggggagagcaggtgtgcctttcagttgcaagcgcccttgcgatgaaacccaggtatgtggtgctcgacgaggtcggggcccaactcgatgtcacgatgcgcgaacgggtccgctcacagtgggtcgccgccaagtgtgcgggtaccggtatcctgctgatcacccatgaacccaccgacctgctctgggctgacaccgttgtggttctgcatgagggaaggatcggatggagtggatcctccgatcagttcttctctgatgcaaaagcactcactatggctgaaatggacactcttccgtttgcgcaggcgctacatatgactctcggcaatggattgacctgcagccaattggctggtgacgatggaaccgtgaagatcgacgagctcgctagcttcgctcctcagcataacctgactgcaaagttgcgtgcgtgttttgaacgggcacaccactacgagccctcgcacaagagaacacctctattggagctcaagggcggctgcgcctgctatgggaagcagcaggtcctcaactcgattgatctcacgatccactccaaggagattctcctcgtagccgggagatcgggaagcgggaagagtaccctcgcgcgctgctgcgcgggcgtacaacccttgtcatccggtcgctgcacattgaagggtcggccggtacacgccggtgagattggcctcagcttccagcggccgcactcacagctcttctgcgacatggtttctgaagatatagggtttggtcccaccaatataggtatgccccctgagcgtgtgtctcaggcggttcaggactcctgtgagagtctctctatcccgtccacgatgcttccccggcatcccctcaccctttcgggcggctatcagcgccgtgtcgcaattgccggtgtggtggcgatgcagcctcctgtctacgtgttcgatgagccgggagccggactggacgcggcgggaaaatcccagatccacaggctgctccacagccttgcccgacaaggggcggggattcttttggtctcccacgatctagatgagtggatccctgaggcggatcgggtcgcactcctcgcacagggtacgttggtaggcttgtatccggcgcatgaggttgttcagcgtccggaacttctacggcaggtggagctcgccgtacctcctgagcttgcattgcgttcgtatttggagggacgtacagtgccggctgctcctgcggcacaaccagatgggaagcctatagtgccaggccagctgtctgttcttgagcgttgcgacgctcgcatcaaagcgcttgcgcttatcctggtgacggtggccacgtttatggcacagggaccagtggcctttgcggcgctcgcaggaatccttgtcctcgtctgtgcactgagtccgatccatccctgcgatatcgcgcatggggtccgtcccaccttgatcattctgatcgtagtgttgctgatcaactccctcaggtttgatgggacgggggacctgcaattggggtatctctcggcgagcagtatcggggcgctgaggggcgcctgcgcggttctacggatcgttctgatcgtcggctttgccctcgtcgtagcttcgagcacaacccctcctgagggggctgacggggtagcgcggcttctacagccgctgcgaaacctcgaagttgcagttgacgatgtgagcatgacgatggcactggcgttacggtttctgccggtcagcgcacaggagtttgcgcagatcaaagatgcgcaggaggctcgggcgcttgatttcagtaaaggaaacatcgcagagcggttgggtcattggaacgcggttctggtgcctgcgatcgtggcactcttccggagatcggatgaggtagcgcttgccctcaatgatcgggcctacggggcacatgcgcggattcctgaggcaaagccgctcggtgtgcgtgacattgcgcttctcgtggtgagttgtggtgtggtagtgatagcaggaagtgggctataacatgcagcctgagatggatacaacattggtgctgaagatcggataccgcggggcccaatttgcgggctttgcagcgcagccaaacacaaggaccgtggcaggggaacttggccgcgccctcaagacctttctgcgaaggccggttgagctcacttgtgccggtaggacggataccggcgtccacgccctggctcagtatgtgagcctgccggttaccgcacaggaagcgtgtatcaacgccagccgcattcagcgtgctctgaatgccctcaccccggacgatatctctatccgtggggtcttccgggcttcaaaggatttctctgcccgctttgaggcgacctcccgccactatatttaccgcatcgtggctgggcaggcgcggccggtactctcatgggactatgcctggtggtaccgtggcgcgctcgatccgcttgcaatgaaccaggccgcacaggcactggtaggggagcacgactttgtcagcttctgcaaggtggagtcggcgcagctcttgcagcaggcggggctctcgacctgccgcaatatccaggaggtcaaggtctaccggactcaggagaccggagagaacctgatctgtgtatcggttaagggcaacgccttcctccacaatatggtccgcatcatcgtcggcaccttagccgaagtgggacgaggtcaccgggatgtgagctgggtgcagaaagcgctggcggcccgtgaccggaaagctgccggcccgaccgcaccggcgagggggctgacctttgtggacgtcacctatcccaagagcgcactcctaccctgggactagaggcctgtgctccttctttcggctcttcgatgtttctagtgggtagtacaggccagctgcctctgggccgagaagttgagtttcccagtttgaggaagattatcgtcctgaagtatccggtgttcctgaagcccctggcggcgctcctcgctgactggacgggggagttgagcccttcgagaaacgaaatggtggatccccttcttccaccagttcaagattccctcacgctccttcctaagggtacctgccgccctcttcatcttagccacgacagagtgcatcatccacaaacagagccggtctggggctttggctgtagattctctgttaaggcagccatagacgtcctgcatcgctttgccgtctggcaggtatgcgcctccctgagatgtgtcttcgcggggtcgagctcctctctcttcgcaagctggtactctgtgaggctctcctttttctttagccatgcgtaagttcgtctgggtaagcatccttgtgcttcttcgccgaccctcacctctccgcgcacctcacagggtctgtcgcctttgtgaaaagctgccactacatggacgctgtccaggatctgggcggcctggggcatcgctgcggtgactcccagggagttatgactttgctatgtcgcgtatgacctctaagatctccgtcctgtcccctgtatgctcctttaagctcatctcagagcctgcctgtgtcacctttgtcctttgccttccgtaatggcgtgggtgcgcaggcggtcgaggtcggccatgatgctgatgtagctttggttgcaccttttggcggtgtcgcctgtacccacacgcacgactccggaatagtctgctgatctctcacttccgatactgccttctcaagcagcctccatatgagcgtgggctgtctcgtgcagaggcttatgaccacaacgctcatgacacaaagagcgccatcatgtatcagctgggcctcaaagagcgccgtgatgcatcttcggctggacccccagggtatccttgcagcatgcacgctgtccttaggggtactcggtaccgcgcagtgcacgatggtctcgtatcgccagatgtcgagatgccacaaggtcctcttgcgtctgtcacaggtgccgcagcgcctgtggcaggcagggctcaccactgcccgaccctggcgtgcgccaccttcatatggaactcgtcctgcgctcatctgcgcttctcaaatcagacatcgaagagctccctttcgtctctaagccccatgggatctcttaaagagccttgccagcatacctgcctaaagcatccatatcgcaccttaggatcgcatccgtcgccaaaatcttggctgtccgggtaccacgtgctcaaggggatgcaggagtgctacccaccatcagtagcgagcttcttttctaatggctgtatgggggcgtaactctgtggttctcctctgcctgaggcatagtgtcaagtgcatgtgggcatacatatacattgtttgtatcagtgaacaattttcttcgatcatgacgtggctggtcgggaccagccacaggaggtagttttggatctctttgtggacacattgctggacagcctgggcgacaccctccagctcatccccttcctcttcgtgacctactttgcgatggagtggttagagcatgcggcaggctccaaaacggaacaggcggtcagtaatgccgggaaagcaggccctctgatcggatcgcttctgggcgcgatcccccagtgcgggttttcggcgatggcggcaacgctctattccgcccgtatggttacggtaggcaccttggttgcggtgatcctctcgacgagcgatgagatgctgccgatctttgtggctgcccagcagccgcctgcgcgcctcttgtcgatcatgggcattaagattgcctgcggtattatctttggatttgcaatcgatggaatcatccgcctgatctgtcgcgggaaagagggggatggatacttccatatccatgaattgtgcgaacgtgagcactgcgagtgcgatgaggagagcggcgctcaagagggtaccgacgaccattcggcgcacaacaagtggtggcgcatcacgcgcagtgccctgatccacacggtgcggatctcgctttttgtgttggtgatcaccttcgcgttcggcctcctgatcgcggcgatcggctccgatacggtgacgagtatggctgcctatcacccggtccgtgcggtattcgcgacggcgctgatcggtctgatcccgaactgtggagcctcggttgcgatcaccgagctcttcctcgaggggctgctgcccaccggctcaatgttggccggtcttttgacggcaggcggtgtcggattgttggtactcttccgcaccaatgagcacgtgaaggagaatctcgcaatcgtcctcgccatttatctgattggtgtgcttgtgggtttggccttttccgctgcgggtattacactttgattgttattctgactctgtttcaactgcggctctaagagggtacctatgcgacgaagagcaagattcgaaagaacggacgtcccgacaccgagcccgagacgcgatgcgatcgctgtcgccgcaatcatcgttgtcgctatcgtttccatccttattttttcgtattgctatactcgcgctgagagctatgcgcacttcaacgatccggacctggaggatgcccgggacaaccaacataccccggatatcactgcgttgagcgcatccgctcgaaaggtcgacgggattgatacctacctcgtgctgacccgtagcgaagatggcagcagccttaagtgggccagcatctttgccctcaatacgaataacgggatgatgacaagggcagagctgccggtcgatctggcgatctccacgaacagcggaaccacgacgctttccgcgctcttcgcaagcaacggaggccctgactgtgtcgtaccggtgagcgatgtggcctcaatcaggttcacccacattatggttgtgaaccataacttctgggacctgttgaagacctactgcaacaccccggaggatcaggcccgcgagattgcaacctcactgcgcgcctcgatcacgaccgatctcagcaaccgcagcgccgacgatatgctctcgcagttccacacgggggatgcaggcgatgtggcaggtgtctcctacacgaccgcggagggagccagcggctccacgatcaacgcgcttgaactcaacgtagcgctgggggtcctcactgcatagacacgacggtttcaagagaagtgatggaaccgtgtccaatatttgtaggtgtcttgttagttctgtttgtaaattatgggaatgcccactcctttcaacacgtgtataaaaagctgatagagtaatgaaaatacagcgcacagtctctgtgcgcatgagccttgtaatgtagggtggaggcttcagtaagttcatgtcagtcagcgggcgaagcatacccaaggtaagtgtgatcgtgagggcgcacaatgctgccacaacactgccgcgcctgttggactgtcttgccgctcagacactcgataagctacagattatggtgatcgacgccgcatcgaccgatgcgaccttacgtgtcctgtccatggcgcaggagcgggatgtgacgctggaggccgcccacatcgaggcggccgagtacccccatgcctacaacctagggattgaacgggcccggggcacctatctcttctttatggacgggtcggctaccatggcgagagggacgctcgagcgcctctacacgctgtgcgaggaccacaacctcgatctggcgatgggatctgtgggtacctctgagcgcagcttctccggccagctgagtacgcgggtcctctacgatagcaacgatcagttccaccgggatgcctggcggttcttcgccttgggattgctcccgtatccggaaggcaaactgatgcgccgctcctgtgtcaaacaggctggctccctcttctcctgtgatggcgggatgtcgttcatggtgagctttctgaaggaagcctcaggcgtcgccttcgatccgctcgcgatctacaacgcgaataccctctgcgatccggtgggctggggcatcaccgactgcatggaggatggcagccaggatatgctcgatgagctcttcgcctcgtgggggctctcacaggatgcgcagacccagtccatgcttcagaatcgctatctggccgggttgatcgcctcgatcatccatacctgcagtcccgcctgtgagcttgatggggcgcagaagcgcgcccacattgagaaagcgattatggatgatcgcacgcagaaggtcgcccatggggaccgctcgctcaggagcctgatcgcccggatgatgctggcggccatccgccgcaaggatgtgacgatgacgatgaaggagggggagctcttctcctggctcacccgtcgctatcccaacctcaagatggatctcgtctagatttttctcccgttaccgtttgtcattcttagaagccttagaatcacgctgattcggggcgtggcgcagtgcgccgaacgtaaagcggggcccgtcggtcacgagccgataggcggtttcgctcatcatatggggcaggtagctcagatcagaaatattgggggcttcgattcccacgatcgcgcagtatctgcgcttggcccctggggcaatgattgaactattgaggacaatctcagaatccaaccttctatagcaacgctcgattgcgtcgtagagcccagggtaggtgagccctgctgcgttgactgaaagctgcgcatagttgagggcgcgtaccgcgagcgcctcctgtacttttgattcatggattttgagccgatccgccacgtcgagcatgtcttcgatgcgctccatcggcatgagcggatgcttgcgcagctgtgcctgcgcctgctgcgcgctgttctcgtggtagcggtagtaaggcttgtccacataggcgatgcgatcggtctgacagagggtctcaatcaggaaggggttgtctgaccaacctgcaccggggatggggaggaagcggatgtgtttctcctcaatccagtccctgcggtagagcgccgaccagatcgcggggtggtggagcaaaaactcctgcgcctcagtgattgcgaagggctgctgcaggggatggatccgatggtagtacgcgcaggggatccgcatcggtttgccaccgttctcaccctcaaagaggcgccagtaggctgctttgataacatcgacgggcttcgggaaggtatccgcgaaggtcagcaagtccgaaaagaagtcaggctccacactgtcatccggctctaagatcgccaggtagtcgccagtggcctgctcaaagcctaagttacaggttgcgccgtagcctgagttcggtctgtcgatcacgcggatgcgggggtcccggtcggcctgcgcctgcaggtgcgccaaggtctgatcggtggagccgtcgttgagcgctaggatctcgaggtcggagaagctctgatccttaagcgattggagcgccacattgaccgtttgttcgacattcatgcaggggacaatgaccgataccttgtgtttcatagcaaccctcgctgtgcttgcgtgttcttgcatcggtctgtatgatacgtcaagccgatgtcccctcctcttgtccgggatatggagtatgcttggcattcccgtaaactacagtttacgggatttcggcatgacccatgcctcaatcgacgtgaatttgctgaggtgtcgccacaacacctctacacagttgccgctctgccggcttttgcttgtgtgtaatgtttgcggcagcgttgatgtctgcactcaccaagatgctatctttgggttcgctataggccgcctcagatgtgcttgcctaagaaaaggtgtgcttacttgtcagcgggtttgtattcgatccccacccatatataggatgctttggacgtgtaggtctctttctgctgcatgtatcggtatgtaagctagcgtttggacaacctacagggaatctgtatgaacgcttgatcactctttctgctgtggctgcttcctgcttgcatcccatgttggatccaacaatcagtgtgtctgtgttcttctctatgcacaggttggtgatggtgcgtggcgctttgagcatgcagtcttgcacacgctgactccctttgtcggctacctgtcggaacttgtctgtgtctagtcggcttttcagatacgccaagtgtgtgttgcaatagtggttagctgacttgagccatcgcctgccaaccaagcgcccatggccagaggtgacgtacggcgagattgtcagcttctatatctactcccataacacagcactcatccaagctaaggggctgtcgggctttaagcacatattggattttgaaagcagctgctggctgtttaggaaggatgcccttgatatagtgcccatccaatatggcccagatgggtctgtagaagctgcctgcttttgggcagtctctacaacccgttcgtgggaagtatcagcaagaacacactgccctttgccctgtagtgtgagatcaacacttgaggatagctgtagttgccactcttgtatcttctcaatactgcaggggaagctttcaagctataggcgataccctttatcgtgtgcgtggccactttggcttgcaacatcttgtaggtatcgttggttttgcacagatgatagttggtctttcagctgaaaagcccgcctgcaatgaagagatgctgccttgtttgatacaaagccttgctgtagaggttgttcgcatataggcaaaggcatttcaacccgcgatagtggttggcactgagatggcagctgtagttggtttgcgctccatactgcatgcttgtcttacctgcctaaatatcaatgtcttgctgtatgcaatatattcactgacacctaagaacaatcactgtgagcacaaaaatcattcgagatacctgctttgcttccacctcatcctttccaccaactagcaaaggaagacactcatcgcttaggtgatgatcacaaacatcacttagctctcactaaaaaaatcgctctgaagcacaccatccaaatactccacatgcaaaccgacaaagaccatatccactacatgatccacccactgcctaagcgagttcgtgcatactttaaaagcactcaccgccttccacataagggaggcccacgcatcatagttgtgccatgtctgctggcatgaacatatgttctgatcaagtggatacttcattgccatcacaggtgaagtcagcgctaaaaccctcaaacatttgagagctaaggcagacatgatcgtacggcgtttcatctcgcgagctgaagttccacaggttttcacaccacaaatcttctataaactgatggctggtataatcgtgagaacgcagagacttactcgaagggttgaatcatggagcgattggcactggtgactgtcacgtacaaacgacaggacctgctgcgccgcttatttgattcgatcctgaagcttaagcaggccccttggcgcatcgtcgtggtcgacaacgagaacagcccaaagaccgctggcatggtctcagagttcacccagcaggtgcacgacgcctggggtgacacgccctcagaccctgatagagagggcggtgtgaagcgggttgtgtatttcccccaacgtgataactgcgggggctcaggcggcttttcacgcggtgtggggcgctcctataagttaggggcggaatggttctggctgatggacgacgatgtcacggtcctgcctggtgcggtcgatgccttcgacaggtggagtcaccagttccaagccatccagggccagcgctacgacactgacggcgggcacttctactggcaatatcggttctggactgcgctggcgatctacaatcctttctcccgggacagctggcgtgaaggagagacctacaagagctgcaatgccctgtgctttgagggcagctgtgtgagccgcaaagtggtcaagcagattggtttgcccgatgagcggttcttcgtgtatctcgatgacgcgctctatggctatttggcaagcaaagtgtgcgaggtggcgctcgttcctgactacgtgctgcgccgtgaacgcgcggtgcctgacaaggagctcggcgtgcgccaactgaactctacgagcgatatgacgcgctactatgtgacgcgcaaccgcggttatttcgcgcggtacctgatgctctatcacgactacaatccggtcggctatggctttgggacgctcctcaccttcctaaaggaattcatccgcctggtggcggtcgatcgagaacatttaaagaccggttgggcacgcctgtgggcgggctatcaggattccaagcagattctgcacgaccccacctggaagccgatgccaccgcttgaggattaatctggtcgagataccaacacggtcatttatagtttctttcacaacactgagggagcagaagagggacccatctatgaggacgggtccctcttcacaactcaagcaatgctgaagcatcgaacctatgcggtcgcaaccagcttcttggtcatatcagctgcggcagccttgcctgcgcccatagccagaatgacggtagctgcaccagtgacgatgtcgccgcctgcccagatacgaggatctgaggtttggccggtcttctcgtctgcctcgatgtagccccacttgttgatcttctcagggccaatcagcttggagatcgggttggcgttcgtgccgattgcggagatgcccagatcgcaggggagtacgtcgacggagccctcgattgggataggacgacgacggccggactcatccggctcaccgagtctcatgttctggaccttgacttgggccacggagccattctcgccggcgatgaactcgatcggggaggcaagttcgtggatttggacgccctctgcctttgcgtgctcgatctcagcacgacgggctggcatctctttctcagttctgcggtagcagagcatgacgttctcagcgccgaggcgcagtgcggtacggacggagtccattgcgacgttgccgccgccgaagaccacgacgtcctttgcgtgcttggtcggggtgtcgtacttcgggaactcgtttgccttcatcaggttgacacgggtcagatattcgttcgcgaagaagacgttcgggaggttctcgcccgggatgttgagcatcttcgggagacctgcaccggttgcgatatacatcgcgtcgtagccctcgtcgaagagctcctctgcggtggtgatacggccgacaaccgagttgtactcgaacttgacgccgagctgctcaaggccgtcgatctcacgcttgacgaccgctttcggcagacggaactcagggatgccgtaagcaaggacgccgccaccggtgaagaaggcctcaaagacggttacgtcaaagccgttgcgggcaagctcacctgcacaggtgatgccagacgggccggcgcccacgacggcgaccttcttgccgttcttcggagcaaccttcggcgcggaggcaacctcaggcatatcgcccaggaagcgctcgagctgaccgattgcgaccggctcgcccttcttgctgcggatgcacttgccctcgcactggttctcctgcgggcagacacggccgcagattgcagggagcatagactgttcgtggatgatatcgaggccacggccgaagtcctcgttgcggatagcctcgatgaacttcgggatatcgatgccgaccgggcagccgtcaatgcagaacggcttcttgcagtcgaggcagcggttagcttctttgatggccatctctttggtgtagcccttatcaacaggacggaagtcctttgcgcgctctttcggatcctcttcgttggccggagtgcgtggagatttcatatccggtacgtaacgaccatttacttgtggcatgcgcagatctcctcctcataggcgtgaagtgcctgtccctcttcggtatggtatgcagcctgacgggcacgcagatcgttccagttgactttcgtggcatcgaaatcagggccgtcgacgcatgcaaacttggtcttgccgtcgacctcaacacggcagcagccgcacatgccggtgccgtctaccatgatcggattgagcgatgcggtgatcgggcagttgtacttttcagcagtgagcgttgagaacttcatcatcggtaccgggccgacgcagaagatgtggtcgatgtcgccagccttcaatagacgctcctccggagcggtgacaacgcccttctcgccgtaggagccgtcatccgttgtgatgtggatacggtcatccggcaggatggagcggaactgatcctcgagcaggagcaggcccttcgtgcgggcacccatgatcgcatggacgtccttgccatccttgacgagtttgcgggtgatcgggaatgcgatagcgaggccaacgccgccgccgatgacaccccacttgccatcggcgaactcgctcggccggccgagcggacccgtgacatcctccagcgaatctccagcctcataggtagagagcatcttcgtagtcttgccgaccaccatgaagatgaactcgacccagccctcttcaggattccagtccgcgaacgtgaacgggacacgctcgcccgtctcgttggcgcgcaccatcaggaactgaccagcatgtgcatgctttgccatctgcggtgcctcgacgcggaacttaaacaccttctcggagaactgcgtcttttcaaggatcttgtacattgataaactcctctccaaaaacgtccataggatggttgagccccttcccgtgggcccggccatcaattcaccaacatgcccattgtagcggtcaaataagcatgtcttctgcatgatttgcagcaatcggtgccatatatgtagattgtggtaccgatattgtgtacctcatccgaggcgtgcagcttctgccgcaaagcccttcgcaacggtgcgctccacgacatctgcagcgtcctgggcctcgattgcgaacgactcgagctgggtgcccttcaagggacgcagcgtatactgggcgacgctcatgcgtccgggaggtctgcccacgccgaaccgcaggcggcagaagtcgcggctccccatcttctggatgatggagcgcaggccgttgtgtccgtcatggcctcctccgaacttgagccgtagcctcatgtctggcacatcgacatcgtcgtgcacgacgaggagctcctccggggagatcttgagctgccggacaagcttcgagatgggccctcctacctcgttcatgtaggtctggggtcgggcgagatagatatcttttcctgcaatccttacccctgccatcatcatgccggcctggctcttccagtagcgcactcctgcatgctttgccagcatatcgatcgtggcatagccagcgttgtggcgggtcttctgatatttggcgcccgggtttccgaggccgacgacgagtcgtatgtctttgggctctgccatggcaacctttccgctttgggccctgaccatcatctcaagcatatactcctggcgggagggagaggtgggattaaatggccgggtccttcccttctccagaggatgaaggcatcgaaagccgtattcgggaaggaagctctcccggccgtcctcccacgcgaagtgtccacctgaagctgcggcgccgatttcgaaatggagaaggacgatatcgaggtctgcggcagagaaaaggctacctttcgagcggatcgagacgacaggtgtcgcgtcctgcgtggtgcgaccgcaccagccgatcttaaagccctgctggttggtggaggtgggggtaaggagggcggaagagatgcccgccttggaccagacaggagactctgtttcttccgggatggatgtgacatcttcttcgctcttcgaggggtgtggatgtcctgcgtctgcaccgtgtcccagggctacgacgagcacgaggcagtcttcaggctcgaccatgcgcttcacgagacgcttcttaaacgtgagcgccacctagcaagtggcaaagcccagctcctgtgccgtcagcacaacgcgtgagacatcccctgcacactgcttgagcgaaggggtgggggcgtcggcaagcagaagatagcttaagacattgcggaatttctcgtggtgggcaagaaacgagctgagggcttccagctcggtgatggcgaggctcatatgcaggctgtctgcctcattcgagtgggcaatctcctggccgaaggcagagcgctcctcttctgtgagcagggaggacgtgaagcttctgatagagtgtctggactcttgtgcgtcatggaaatccatgagagtcctttctgtcttgtggctatctggtgtctacccgggagtgcttttcgccacgccgtttttcccctgttccacgaagtgtccgggacaagggagaagggatgtcttgaggtggatgaaatacctcgggtgcgaccggtggcacgcggacggtgggcggtgctgagacagcctcatccggctgtcttcgtgccatgctttgaaatgaaagtgtcagatagagcatatcccatgattaagacataacatatatgtaaatcgtcggaaacttgatggaagcagttgcctgcaacgatgggacgacgaaggggtcgggatacagaaaggggagccagatgcctttggtacgcagtcataaagcgcagggaggcagaagttcctccgaaagttcggcggcgatgcgcggcttccgcgtgcatctcgaagagtatcggccgcttgcaagctcggcagagcgcaatatcgtgaacttcctgctcgagcatccgaggggcgctgtcggcgtctcggcacatcgtctcgcagagcttacctatacctctccttcgacggttgtgcgcctctcgcgcaagctcggcttcacgggctacaaggagctccagcaggcactgctctacgagcttgccgtggcagacaagagcagaaatatcgtctccgaaggggtcatgtcaaccgattcaacccaggaaattatcgacaagatcacagcccgtaacgcctcgacgcttgcactcacacgcgacgggctcgaccctgccgcaattgaccggacggtcgaactcatccacacggcgccgcgcatcagcctctacggtatcggcgcatcgcttatggttgcccacgatctgcagctgaaactcctgcgtctcgatatcccggcagaccttatagacgatctgcactcccagctcgtctatgcaaagaatgagcgtcccggtgacctcgctatcgtcatctcctattcgggcatgacggaagacatactgaggtgcgctcgggctgccaaagcaaacggagccacgattgtttccatcacgcgcggcagcttttcgtcgccgctcgtaaagatgtccgatgtggtgcttggggtcgcagcgacagagctcgtgctcagaagcggggcgatgtcctcgaggatcgcacagctcaatgttgtggatgtgctgttcacggcctatgtgagcaggaactacgagaagagcatggagcatctctcgaagaactggatcaagaggagcgaggtgccgcaggaagaggcaagtatcgaggacggtgccgagctcggatggaaggactgagaagggcacaggaaaggagaggaacagacaatggagacaggagatgtgcccgcgatcgatctcggtaagctcgcgacggaagcgcgcaaccccaggaccatgcatctcgacgagatgagcccgcgcgagcttgtcgaggtcatgaactccgaggacacgaaggttgcgggtgccgtgcacgaggtcttggacgatgtggccgtggcggtcgaatgggcacgcgatgcccttcaggctggcggcaggatcgtctacttcggagcaggcacctcgggtaggctcggcgtgctcgatgcagtcgagtgtccgccgaccttcggtgtctcgcccgacgtcgtggtcggcctcatcgcaggcggcgagaaggcattcgtgcgtgccgtcgaaggagcggaggactcgctcacactctgcgcagaggagcttgatgcacttcatctggagccacgcgatcttgctgtcggaatcgctgcctcggggcgcacgccctacgtgatcggcggcctcaagcatgcgcatgagctcggctgccgcacggtcgcgattgcctgcaacaaggggtccgatatcggcaaggtcgcagatcttgcgatcgaaccctgctgcgggcctgaagtcctgacgggatcgacccgcctcaaggccggtactgcccagaagatggttctcaacatgatctccaccggtgctatggtcggctgcggcaaggcctatgagaacctgatggtcgatgtgcagcagtcaaacgagaagctcgaggtcagggcccagaatatcgttatggcggcgactggctgcgaaagagcggcagcagagcgtgtgctcgccgaggcaaagggctccgcgaaatgcgcgatcgtggcaatcctggcggacgtcacggcagacgaggcgaagcgtcgcctcgatgcaacgggtggcaaggtccgccaggctctcaagggaagctgataagggtactgagcggatggtgtagggggaccatctgcgaggcatagcacaacaaggaggaacaatgagcaaggatttcgaagggatagccaagagtgtccttgccgcagtaggcggcaaatccaatgtcgtgggcaacatggcatgtatgacaaggctgagggtcaaggtagtcgattcttctagggtcgatgaagcagccttgaagcaggtcgacagcgtcatgggccttgtcgctgacggcgaccgctatgagatcgtcttcgggccgggtgtggtgaacaaggttctcgagccgttcgcgaagcttaccggcatcaagccggatgatatggccgatatcgtgaacgatgctgctgcgaagaacaaggcagcgcagaaggcgaagcacgacaagccggttcagcgcttcctcaagaagatcgcgaacatcttcgtaccactgcttcctggtatcatcgccgcaggcctcatcaacggcattgccaatgtcatcaacgtctcgagcggcaacgcctttgcaggcgtctggtggtaccagtgcatccgcacgatgggctgggctctcttcctgtatcttccgctctttgtcggtatgaatgcctgtaaggagtttggcggctccggcatcctcggtgccatggcaggcgccctttccatctcgaacacggctatgccgctcctgctcaagacgtctgatggtgctgcagccgtgaatctgccgatcgcgcttccggtcccaaccttcgctaatggcgccttcacgatcaacttctcgacggtctacaacccgtctgcaggtggccttttaggtgccctcatctgtggcatcttctttgcgtggctcgagaaaaagttccataaggtcatgccgagcgcgctcgacacgttcctgaccccgctcttcacggtctgcatcggctcagtcgtcgccgtgctcgtcctgcagccggtcggtgcattcctgactcagggcatcttcttcatcctgttcttcttctacaacacgctcggcgttgtcggcgcctatctgctctctgccacattcctgccgctcgtctctgtgggcctgcaccaggcgctcacaccgatccatgcaatgctcaacgatccttctggcccgaccggcggtatcaactatctgctcccgatcctcatgatggcaggcggcggacaggtcggcgctggccttgccctctatgtgaagaccaagaacgagcgcgtcaagacgtacctgcgcgagtccatccctgtcggtattctcggtatcggtgaacctttgatgtatgccgtgacgctgccactcggtaagccattcgtgacggcctgcctgggagctggcatcggcggcgtccttgcctggctctttcatcttggtacggtctcccagggcgtctcgggcctctttggtctcctgattgtcgttccgggcacgcagggactctatgtcgtcgcgatgcttgcagcctatgcagcaggctttgccttcacgtacttcttcggcgtggatgaggatcgcatcaacgacgtcttcggcaccgaagcttaagcttcactatctccggtggttccatgtcccgccggaatgcaggggagcgggtctgcggcttggctgcaggctcgctttttaggaaaaacacaactggatgcagatgagcaggagggaccttcatggagtgcggcatatcgctctatctctcatctggggcagactttgcgtcgaaaatcgtggaaaaggcatcgcttgctggtatccactacgccttcacgtcgcttcagataccggaggagggtggcatcgacgatgcggcgggggcgaagaagctccttgcgctctgccgtgatcacaacatcaagctcatctgtgacatatcgccggcgacgctcgcaaagctcggatgccgcgactatttcgagctcaggcgcctgggtatcgagtatgtgagactcgatgacgggtttgatgccagacagacggtggagctctcgggcagcttccatgtggtcttcaatgcttcgacaattacggaggaagatatagcggcctggcggcgcgcaggagcagacttcatgcgtttcagtgcctgccacaacttctatccgaagccgctcacggggctctcgatcgactacgcggctgctgtgaacaggaggctcaaggacctcggtttcaagacgatggcattcgtgccgggagacgagacactgcgcggacctcttatgcagggccttcctacggtcgaagcacatagaggggatactggcgatgagctcgtgtgcgacatgctcgagcttggctctgttgcgacggatgtcgtactcatcggcgatcctaatgtatccgatcatgtctggcagcgcattggcgagctttcctgcggatacgtgagccttggctgcgaggtcgaagagcctttccactacattctcgaccgcgtgcagcatgacagaccggactcctcgccctggatcttgcgctcgcaggagtcgaggcgctggaaggatgtgccggaggcgcccgaggcagataggcacggtgaggtccaggtgcagccaggagacatccttatgagcacgaaggcgtatggccgctacgcaggagagctcgagattgcacgccagagctttgcgctcgatgcacgtgacaggattatcggccatatcgcagagtcagaccgtgtcttcctgccgtatctcgtgcgaggagcaggcttcaggcttcggaatgtgagaagaagtctctgacaaacatggagtaccgggaagcagctgccttccggtgctcttcttaggcaaggcctggcatcggcatttcggaggccagacagtatcggagcatgcacaaaagggctcttcggtagtttctatgggtgagattcgctcaagggcccagatgagagcgcgatatcaaggggcagattgtcaagctgagtgcaacatctccctaaagacctcgttggctgtcctgtatttcaggaccttcgaccttcctcggcctgtcgttgatcagctccaccgcatgctgcacctcctcgtccgtgaccttgctgaagtcgctgcccttggggaagaactcccgcaggagcccgttagtgtttcccactgtcggcttctgccagggatggtgagggtcgcagaagtagaactgcacgcctcccaaggcctttgtgagctctgtatgccctgcgagctgcttgcccctatccggggtgagcgtctcgaggggacgtccctgcagcagcccgacctcggccttagagacgctcccgctgtcgtggtggcatcttctcgcgagactcgctgttagaccataattgacctaagaagggcccaaaagtgtccgggcctttgcctacaatgtatatcgtcaaacaaagacatcgaggatcgaaggccccggatggatccaatgatactgcagcagatcaaaaagatggggatcgccgagaagcgcgagctcttagagaggctgaaggcgctcatagccaagaagatggcaggctctgcccttgcgggaacacccaagaggtgcccgaggtgcaaatcgctcagtttctattgcaagggccacgacgcgtgtggctcccagagatggaagtgttgctcgtgaggcaagaccttctttgtaaagacaagatctgtcctgactatgtcaaagcccacggccgccacatgggccgtgtatgcaaagggcacccttgcaggcatgacgcttaaagaagcttgcgaagagctgccatgtgagccttaaggacattgtggtttcatgcgcatgaggctcttcgaggtgatgcaggcagcgcttggcaccttcaggtatggacggatccaccgtctcctgccaaaagatcgggatctatatcgacgagtcgcttgcaggcaacagggataaggtcggccatccagatgctgagggaggcgcacacacaacggccatgctatgcattcctgtggcatatcgaacgagaagatctgcatggagtgttgtgcgaacgacctagggaaacgatgattaattcgcctcgatgaggtagctggggctgtacgctgtatgccgtcggcttaaaatgtctcgaaccacgcagtgcccatacccacataaatgcctatctgcctgcggatatgttataattacagcaacgtattccagcatatccaggaggaagatatgggcagccagatgagcttcggggaccttaaattccagggtcagaggaagaagactcggcgagaggcattcctggagcggatggatgcgatcgtgccatgggatagctggattgcactggtagaacccagctaccattctcaggcgcgtggcaggcatgtgcgcggtgcaaagacaaagctttaggatgtagcctgctttaggtcatgtttgctctcttaagacgagggaacttaaagatgctatcctggattgtcactcctggcagcgcttctgtgcacttggacctcatgtctgagcaggtgccagatgcaacgacacttgcgaaattccgtcatagcctcgagcggcaaggactcggtaaagctatgcttcacgacctgaattcggagctcgagaaggcagggatcacggcgcggggcggctccattgtggatgcgaccttcatcgaggctcttaagctccacgaagaacaaggaccatgcgcgcgacctcgaagcgcaccagtccaagaaagggaagaactggcgtatcggatacaaggcgcatatcggcgtagacgccggcagcggccttgtgcatgccgtggagacgaccgcctagaatgtatctgacatatcctatggcacacacactcgtaagggaagatgacaggttctgctatgcagactttaggctataccggtatagcgaagcgcccttaaggtcacataagacccacacctctcatctatgcgctggagtgtcgcaaggaaaccttcgaccataaagggtcttgcctgtgtgctcttgaccgagaagggcatcgagtccaggaaggcatccggccgctcaaaggtagagcatcccttccttatcgtgaagcgccgcttcggccacttaaggacacgctacagggggatagagaagaactcctgtatgctcaatgtctgcttcgcccttgcaaaccttaccatgtgcatctctgccggcaggctgcttagcccggctctcagcgtcgcttgatctgtcttggagccttattgcggtgcatgcggcaggacagatgtaaggatagcggctcctgcacatgctggatgagcatcctttcctgcctttcccgcatgccggccgcgaaaagtcgtgtggtcggtcccctctgacacgttatggggcattaatcatcgtttccctagggaaacgatgattaattcgcctcgatgaggtcactggggccacacgctgtatgccgccggcttaaaatgtctcgaaccacgcagttgcccatacccacataaatgcctatctgtctttctggatatggtatagctacatccacacattccagcatatccaaaaggaagatatggacagatagatgagcttttaagagcttaaatcctaaggtctgaggaaaaagactgggcgagaggcattcctggagcggatggatgcaatcgttgtgtgggatagctggattgttctggtagataccagctaccacggacaggctcttgtcaggcatgtgcgcgctgcaaagacaaagctttagataatatgaagtgacctcacattagtagcaacgtggatttgccgctatacgataggtgtttaacataaagtaagctggtttgacacatacaaaaggagatcactaatgaatggaatactcaaaatcgcaatggatgtccatagttcgaattacactttgtgtgcaatggagcctgtggttggggcaaaggacagggtcttcgccaacatccaggtaccccctgattataaaaacgttctccaatttattgagaaccttaaaaagaaacttggccttaccgatacttattctgttgaatgcggctacgaagccggatgtcttggatactccttataccatcagctaacgaacgccggtgtaaaatgcgtcattcttgcgccgagcacaatgctagcccctcagggcaagcgggtgaagacggatgcacgtgatgccaacatgatcgctcagtgtctttgctatggcggatatcttgcggttcatgttcccaccgataaggatgactctgtagaagaatatctccgtatgagggatgaccacaaactggcactcaagaagatcaaacagcagatcaatgctttctgcctgtatcatggcttcttctatgatggcaacaaatggacaatcaagcactggaactggctgaagacacttggaggtggatgatctgctgcgtaagaccctcgacgagtatctggcatcctataaggaacactcatcaaagatcgaacgcttcgacaaacggatcgaggaacttgctggcgatgatgattacaaggaaagtgtcaaaaagcttggctgtcttgtcggtataaagactcatacggcaccttcactgattgtagaaaccggcgatttcagtcgttttgccaaaggcaatacctacgctgcattcctcgcccttgcgccgggagaatcttccagtggaacaaagatccaacgtagcggaatttcaaaagctggcaacagtcatcttcgtacgcttctcattgaaggggcaaaaggaatctgcaagggacagatcggacataaatccaaggaactgcgctgcaggcaggacggaaatacagctgatgtcattgcatatgctgacagagcaaacacaagacttcgaagcaagtattaccggatgatccgccatgggaaaaaaagaaatgtagcggttgctgcggctgccagggaacttgcctgctttgtatgggcaatgatgacaggcactatcgctcccagagaagcctaaaagaaggcagcatgagtaacatctggtccatttgtctgtcaagggtgctacgcaccgcttacgcggcaagtcctgtgacagccatctgtccatgatgtctatgggcagccaaggcataaatccacaggaatctgcggatttatgcagtaatagacaaagtaaatacctgacagcatctggaggaagctgtgatcactgtaaggtttaagccatccgcgtccatcctatgttggcactggaaacagaaatccacgcttttagatcgcagggctcacggcaaaaccattagtctgttggtagccaatccacgtataacagagtggccacatgccgggaactgttaaatcagagctctttccagatgctgtcagagaaacacaaatgtggccagccagggggggaaatttcctgaaattgcctcttgacaacggtcacttcataacaggatgtagcctgctttaggttatgtttgctctcttaagacgagagaacctaaggatgctatcctggattgtcgctcctggcagcgcttctgtgcacgcagacctcatgcaggcgcaggtgccagatacaacgacacttgcgaagatccgtcatagccttaaagcgagaggggctcggcaaagcttgtgctttgcgcctgaacttagagcttaagaaggcagggatcacggggcaaggtggctccatggtggatgcgaccttcacctgggctctaaagcttaacgaagaacaaggaccttgcgcgtaactcttaaagcgcaccagtccaagaaagggggagcctggcgtatcggatacaaggcgcatatcggcgtggatgccgcaggtggccttgtgcatggtgtggagacgatcgcctagaatgtatctggcatatcctatggcacatgcactcgtaagggaagatgacaggttctgctatgcagactttaggctatataggtatagcgaagcgcccttaaggacgcataaagacccacacctctcatctatgcgctaaagcgttgctaaggaaaccttcgactagagagggccttgcctgtgcgctcttgtccgagaagggcatcgagtccaggaaggcatccggccgcttaaaggtagaagcatcccttccttatcgtgaagcggcgcttcgacccccttaaggacacgttacagggggatagagaagatctcctgtacactcgatgtctgcttcgcccttgcaaaccttacccatgtgcatcttttgccggcaggctacacttcccggctcccagagtcgcttgatctgtcttggagccttattgcggtgcatgcggcaggacagatgtaaggatggtggctcctgtacgtgctggatgagcatccttccctgcctttcccgcattccggcctagaaaagtcgtgtggccggtcctctctaacacgttatggggcattaatcatcgtttccctaagggacgaatatgccgtcctctgcggcaggggcaggcccgaggacggggaactgacagatgccctttcaggtatcgtgggcagcttatgggtcgccactgacgaccatgcaggatatgcacgtgtggctcccctcgcttggggtcttcaagcacacggcgagcgtggcgaagaaggccgtgtacggcgagcttagcctcgtcaatgcgatgcagcgaaggctgcgcgagttcctgcttttcttccatggggtcttctacgaagtggctggggcacttgtcttgcctgcttcctgtggatagagcaggtaaggcattctgagcgggagaagaaggatacgctctcaggcaagcttgcaggaggcaggtatgtccataccaggcgtgcgctcatagacatagagcagcccttctggagctattggaaggacaggggcgtcaggtcaattatggtctaacagcgagtcgcgagaagcagcctcactgccctgtcggcaagtacgagcaagcacacgggtcccgctgccacgagcgtgtcgtctgccccctctccgagacgagacctctcatcggcctgcttgggcctctcctttacgctgtgtaagatctcgatcttacccctcgtcttaggcctcttgctgcggatctgcttccccttcctgcgcaggtggcgccgcaccttgccttcggggccggatcccggcaggtcgagggcggcggctaaggacctcacggtagaatagtcggtaggctcaacgacgcagctgccgccaccctcgagcctgagatatagtctatctgctccagggaccagtgtctgtccatgatgagcaagcgcaccttttgcgtaagcgcagggtctgaaagccgccttttcgccctgcatctcctgtggcgctcatccgccctccttttgggcagcacatgccctaaagcgcccgtgccgtgcgttcctcttgagctcgcggcagacgctggagctgtccctgccgatctttcccgcgatatagccgattggccttcccttgtgcatgcagcgtggctatgcagtccctctcctgtaggcttgagatgcttgtagtggcacattccttccagctttcgacgttgattgagacaaccaacatcgtagccttccggagtgtgccacgcttgcattcagcgggctatcctgttgcgcttagaatgctaatccgccacctaaaaatccggattgttgtggctaaatacagtttcaggaaggcaggtctcagtctctgagggagataccccaagaagggttgccactccaatgtacgctcgcgaagaatctggaggacctgacggagtatcaaaggggactctcggagctgaagcgcgcagaggaccatttcgcccgcgcatggacactcaaggaggacctcagggccgtcttgagcgcggaggatgcgcaaaagagtagcagactgtctaagctgcctgccactctgaaactacaaccgctgatgtttacacgattcagcgctgccttttatgtttcactgtctattagaattttgcctttaacagctccacgcatgcggtacatatcaaatgcccgatcgatctgggagagggggaactttttaaagataattccctcatcaaaaggaatcatgccagtgcgataggcatctgctgtaagggtccactcgtgtcccgggaatggagcactgtagctcatccaggaacctgtaagtgtgaactctttacggttgaggcattcccattcgtcgacagagaatttaatctctgaggttggggtaccaatcagacatgcctgacctctgttgcaaactaactgaaagagcatcttagcagtaagagcactaccagcggtttcatatacgtagtcataaccacgaccacctgttaaagcgagcgcttgggccagccaatccttatcttttgaattgatagtactggtagctccgagctccctagcaaattcaagcttttcaggaacaacatcaaacaccgtcagttcacgagcaccaaatgcttttgcccacagcatggtgaacataccaatagtaccgccacctacgattgcaacatttttaccaccatggtaatcgagccgttcaagaccgtgtaaggcaatagtcgttggttcaaagagtgcagcttgctcaaaggagactgaatcatcgaatttaattacattctgttcaggtacgcagacatattcagcaaagctgccaaacttacgagaaccaatgaaaatatagtgcttacagagtgagaaattacctcgtttacaatcctcacatttcatacagggaatcaaaggtactccggccacgcgatctccgggctttaccgactcaaccctgtctcctacttctgagacgacaccagaaaattcgtgacccaatacattgggatagaagtggcaggcgtcacctaacacgcgtggtacatcggaaccacagatgccagtgtatttaacctttacaagaacttcacccacttttggctctggcttgtcaattgcttcgtagcggatatcgtcatttgcgtggacgacacctgccatcattttttccgtcatggatttgctccttcagagaggtggcagttttactgcttaacctctctattgatgtaaaattcgttgtcttgagattactctgcttcttgtgtgattattctccgcgtttagcaccaccgctctcggcagatgcaccgcctagcgccgactcatcaatctcgcaatcagcaccgccccctagtcttctttcctttctagggccaccaacctaggaaaggacagtgatggccaacaaggcacgggcgacgcccgttttcgggtacaacctttcggggcatccctgcgacatgcacgccgtctttggggggcacttagcactgcgcagtgtacgatcgtctcatattgccagatgtcgagatgcctttaggtcctctcccgtctgtcacaggtgccgcagcgcctgtgacagaccgggctcaccactgcctggccctgacgtgtgtcaccctcacatgcaggattccctgcgctcatctgcgcttttcgaaccagacgtccgtgacctccattcatccctaagccccctgggacctcttaaagagctttgccagcatacttgccttgaacattcatattgcgctttaggaccgaagccttccgccggcaaaatcctaccgtctaggcaccacgtgctcaaggggatgcaggagtgctgtacaccatcagtagcgaagagctgcaagttcagcagcacgttggcgtgaagtgtgaaccgcaaagatccagcagatgatgtaaattactgcaattacgatcatacctggcatgttttcttgagtaaaaatctgtgtgaagacatacgtgatcgggttgccaccttgatcgagagaagcgatggtagagcctgcttcgatagcaccaactgagacaccgagtgcagtaagccaagggatagtctggttggagatccagatggtcatatacatgataaagaaaccagagattatcgtacggaacaggttacctctgtgcactgccactgctattgcgatgaagaagccaatggtagcaaggtccgcgaagggaagaacacggttgccagggacaaggacagcaatgagtagcgttaagggtacaaaaatgagaccagcagttacaacttgtgagtcgccgagcaaaatagcaggatctagaccaatatagtactgttctccgtggaaacgtttattcataacttcacgagcacgttcagtaagtggaacaaggccatccataatgcacttgacgatcttcggcattaagaccataacggcagccatgttgatacctaaaggaaggaactctgagggagtatatcctgctaagaggccgattacggcacctaagataaagcccataacaaccggttggccaaatggcccaatcttatcttgcaagttatctgcattgatatcgatcttattgaggccagggatcttgtcgatgattgcatcgacaacgcaagcgattggtgccattgttgcactggttccgtgtgggatggtaataccatcgagttcgaagtagtcagtagtaagcggagcccagagatcgccgagtttatatgcaatgattgcgtgtacaacaacgcctaagataccaatccagaagtttccagtgactacataggcgattgctcccgtacaggtcatgtgccagatgttccagatatcaatatttactgtatgagtccactttagaaggagcatcaagatattgacaccgatggctacaggtattgcgattgtagcaatctcgcttgcccaaacgattggggagttgcctggccaaccaatatcaacaacactgagtgacaggccgaaacgttcactcatagcttctgccgcaggtcctagctggttattcattaagccaacgattaagccaaggcctacaaagccaactcctaatgtaagtgctgcaggtagagcttttccgggcttaactccaacgattatagagatgatgaaaattactatgggtagcataacagacgcacccatatcgactatataatttataatgtttgatataacttcccacatgatttctctctttctttagtaagtgggtcagctaactcccaaatagaggaatttagaagttgtatgggggtttgagcgcgaattctgttgccgcaggttcgcgtttttttatgtgtttgggatgtaggatagcttacggttcgatgccttcaggtttctttgatctcaaacatgatgtactctaacttttattgagtacatcaagaattgctcgttcagtcttctctactccaattccagaaataaatggcataccagttatgcaggggattccatagtccttcttaatgcgggatgtaggaacaatcagcactgcatcatctagatgggaagggatttcagaaatacgacattgacatatatcgacatcgatgtcgttcttttttgcaagatcctttacatggttggcagcaatagttgaagttgcaactgcgccgccacaggctacaatgactttctttttcataatgtttgctccttttctttgatggtatctatgacgctttcttcactagcactattcaaaatcttggtcagtgtattgccatcctgaagaatttgaatgatgcgctgtaactcttctatatgttcatgaggatcagtgactgcaagcacgaatacgagttgtacatttacatcaccttctgatcccatatcttcgaagatgactgaatgttttaaagtagcaatagcgatgccacttttgttgacatgctctacttcagtgtgtggtattgcaacacctactccattgatatcaagaccagtaggatactctcgttcacggtcaatgagggcttgaacatagctctctttaccgtatcccagttcaatcagtttgccgcccacggtctgcatgacatcttccatgcggttcgcatccgtattaagtaaaattcgattggtttcgagttcttcccaaatcatgtgtcatcccctttattcatgattacattatagatgtgcaggtagacgccttgttggttcattgttctgcaatttgattgcaaaggggttgtcaaatctttaagcagtggtagtgtaattaaaataaatcgtgtgtttatgcttggcaccattcactgtaaaaaataaaccgctcaccaggtatcaagcgtgaacggttttggtatatgtaactaaacaaaagaatatgtacttgaggcttcacagcattttacagtcctagactacttgcttagaccaatctcttccatctgaaggataagcgctgcctcatcaggcgtagtagcttcacggagtgactctctgaccccaggtttcctcatcatgttaatgagattaaagaaggcatggagatgctttttatggtccacagcagagaagcaacagacgaactcgacagggtcgttctcctctgatccaaaattgataggttttgctaaccgaatcagtgagaagccaacttcaagtgaaccttgatcgattccttcatgaggcattgcaaaacctggacacagtacgatgtaaggtccattttcttcaacgtttttaatgcaagcatctacgtagcgtggttctatatagccaccccttactaatacccgagcactctcacggatggcttctctccaatcactacacgcaacgtcgagacgaatatgtgagggtctcaaaaaatcatgtgcagcaggagaggatggattgtcggtgtgttgcgtatcttcggcaaagtaactattgactgcccggcggatagcgcgcatcaactgcggagcgtgactactatctaaatcgtagacaattggcgctattgtactcactaccccttgagcagaaggctcagtattgtttctcgatttcgatgctgtagcagaaaggctttgcgcgctgcgcaataagtcaatagtttgagagagctttagttggtctgtttctttaagaagtggggatacctgtgtccatccgactgcgcaagattctaaaggtacagtcgagatgacaagatcagcatcggtaggagaaagcttctcagcttcatgcgcggtaacagtacttgaaatctgtatattgaaacgatgccgtagttcttgtattaagagttgagatgtaccaacaccagcgttactagcaagtatgatgcgaaggtctggattttgttcctttttgcgctcaatagctgcgcaaacatgtaaagcaatatagcctatctctagatctgtcagttcgcggtgaatatgtgagcgaactatatcgtcacaggcacgtactgcatctacgattggcttgttctgttgtacaacctcacgcactaaaggagtgtctggatattcaacgggatcgggttttagaacggattctaagtgattcgagagattttcaaagaagatgaaatcatcattcaaattgatgcctagctcatctgaaaggcgttcaatgagaatctttgtcagcagctgtacctttggagcactggaaggttgaaggtcacgacggatgtaccgttgcttttctagtaaatccgcaagcgtatctacttctgcttcatcgtgttccagtttgtacatttgtacgatactgatccaaatattacatgccatatcatgcaagatactgtcactatgttgagcctgtgtaatctgcatacctttggagctgcgcatttgtgcaatgcagagatagctcaagacatggtggtgcgcatagccagttaatacacaaccccactgctcttcttgttgagagaggatagcatcgatagaatctcttttttctttgtcaagatccagctgaattggcaacagtgttgccgcaggactttcttttaaatctaagaagagttgcaacaagagatgacgttttgagcgctcgtcacctttaatcgtaatacctttgcttgcctgtgagcgaaaggtaagtccagcctcactgactttggtacggatctctggtaagcttttaactaaagtattacggctaatatgcagtttttctgccacttctgcaatggttgttggcttatcggtacagaggatgtggatacatgcaagactaacacgctctgcaggtgttggctgatagtttgaggtatcgagtggaatatcctctgttaataggtgcgaagggtcttctgggcatacaactgcacctgaacgttcgagcgttacgcccgcgcgtccagcgtgtagtagtgagtcattgagacttgctatatcatttcgtattgtgcgctcggacacattaaagtgttgagcaaggccagaaagtgtcagcttggatccctctgcaagaagctggacaatttctgccgtcctatggttcatagttccctcatgtcgtgcaatttagttcttatatcaattattagaatacgttaatagtgaaactacgggaaatactctcgttgggtggtgcaataaggcaaccacgcttatgctcgaatacattgtcttcatctgagcaggtagaaagtcctccccagggttcaagtgcaacaaaatccgcttgaggtttagaccagataatcagataggggaattcggggaaactcagatgaattccgtgtgtatgttgtttatcagagtattcgagttgacgactattaagcgtgtcatagatagtttcggcttttgcaaacaactcgtgagaaagggcgacgacccgtcctttgcgtggggaggttacattgttttgaggcgctaccatgcggcgatctacatcgataagaccactttctgcaaggggtgttggaactgactgtggttcttccttctcaaacgtcacctgatagtcgtagtagctctttccaatttcaagggggcatctgaatgcagggtgtcctccgatataaaatggcaggtctttgttaccgtggttgataacctcaaaggtcacagtgagcgttgcatctgctatctggtagtgggaacggaactcaaaatcaaaaggatattgttctttgaggatgggcgtggtcgcaagtgcaaaggttgcagaatctttagtctgatcaatcagtgtgaattcttgttttctcgcaaaaccgtgacgaggcagattgatggtatccccatcaagagttgtggcagtattgtttctcagagacccgcagatagggaagcagattggagcctgtccactccagaccgtcggatctccctgccacagatactccaggcctcctgctttgatagagataagagtacctcccttcgttgtgagtcccactgtaagtttcccagatgtaatgctcaattccatggtttcctctcctaaaactcttctacggttgtgtgtgcgaagatatcatcccagctatccatcttcagatgtcctgtctgtagatccattgcatttaaagtgccgcagacgtttccgatttttaaggttgtcttttcatcagcaccaccagcaattgcatgtgcaaagcctgcgatcgttgagtctcctgagcctgttgcgttgactgctttgattgaagctgaatgagcacgcaatcgtttcccgttatgaagagcgatagaaccatccttgcccattgagacaacgacccactcgatccctgcaaaacgattatcctgtgtcaatgtatccataagtttgtctgtctcgtttgatgcaaaggatgtgttgagcaggccgttgatctctttcagattgggcttaacaagggtaggttttgtgtctatcacaagtgctgctttcaaagaggtaccagaggtatcgagaagtaccgggacgttgttctggcgtgcgatagcaacaagtgttgcataggtgttggcgggaagaccacgaggaagactgccggacatggtcacaacggaggctttctctacgagcttagtgaagtgtgcgataaaagtgttaagttcttcttcgcttacaacaggtccactctccaaaagttcggtttgattaccttcgtgtaagatactcaagcatgtacggctttcacctgcaatgggtgtgaagtcattgggaatattgtcttctttcataagatcagaaagtagggctcccgtatgaccaccgagaaggccggtagctaatacttgatctcttaactgaacaagtacacggctcacgttcaatcccttgccacctgcggtcttgtgcggagccacatggttcacatcgttaattgcaagatgatcaagcgagtaagcggtatcgattgagggattcatagtgactgtgagaatcatgtgttcctcctcctttgctagggtggtaaatatagcttttaagccttattggttgagcctaagttgtccatatgcgaacaaactacttgatagatgttatgcataccttctttgctcggcttcttcggatcaaagcatgcaggattttgggtcatatagcccataaatcctttagtaaatgcttggcgcaactcggttgcatagttgactttgcagataccgttttggatggcctctgctacttgattgtcaggtactccagaggttccatgtaagactaaggggatatcgacatgtttgcggatttcctttaagatttcctgctcgatgtgtggggttcctttgtatataccatgagcggttcccaccccaactgcaagtgaggtgcagtgggtgcgcgcaacgaactcctcggcttctgctggatcagtgaaagggtcttctccctctactgctggtctgtcatcttccttaccaccaactttaccgagttctgcttctacaggaactcccatagagcctgctactttggtgacggaggaagtgaggattatgttgtcttcaaagggtacatgtgaaccgtcgatcataatggaggtataacctgcacggagtgcttgcatacagcgcccaaagctatcaccatgatcaagatgcagcgctatcgggatacgtacactctttgctgcggttgtgaccattgcgacaaagtagtccagatttgcgtactttatcgtccctggagtggtttgcattatgacaggagagtttttatcttcagcggctttgatgactgccattacaaactcaaggttctcgacattaaaagcacctactgcgtagtgaccggcttgtgcgttcaaaagcatctcttttgttgtggtaagcatactgttctccatagtcttctatgacttactgttttgcttttagaaactttgattttgaccggcctttttatttgtttgagtgcattctaagtgtaaaaagcctaatacatgcaggtaaataggtaaaaataatgctcatgagtgtaaaatgaggaaatacatttgcttgttttttgatatataaagatcaaaaaatctttttatggcaaataaaagatataaaaagaaacatgttatagtgggactggataagattctatcatcacaatttattcacatattgatttgtaagcactgtggtcagatagttgcataagtagagattgggaaatcatgacagaattcgctgaggaacgccgtacagaaattctcaagcttctggataagaatgcctcagtacaggtctcagagattgcacagcagttcggtgtgtctcgagtgactgcacgctcagatttagatactcttgcaaaggatggaaagcttcgccgtacacacggtggtgctgtctcactcggtcgtgcacttactgtctctgttcaggataaacgtatgaatgttaatgtggaagcgaagcgtcttattgccgaacgagcagcagaatttgtacaagattctatgtccgttttggttgataccggtacaacaggacttgctcttgttcgtgctttgcgtgaacgtagaggccttatgattattactgcagacctaaccattgcagattatgtagatagatcgctaccagagtcagatgtcttcctacttgggggcaagctgcgtaaaggtcatcgctacgtaactggccctgctactgtacgtgcgctctctacactccaccctgatattagttttgtgtgtcctacggcttattcatcacagaatggctttgctacaaactttgaaggcatggcacaactgaagcaggctttcttgaagtgtgctgctgttacctacgtgatgatggatgcggagaaaataaatgcacccgggctctttagtttcggtttccctaaggatgcagatgcaatcatctgcgacagtgatcctattggcatcatggctgatgctacagaggatatctcgacgcgactcatcttagcgaaatagttataagtttggatgggtgtgaacgggctgggtttgttcgacatggattggctcttgctaccgaaagcccgcgtccgatggtgtccccaccctagggaaacgatgattaatgccctatgacgtgccagagaggaccgaccacacggcctttctagaccggcatgcgggaaaggcagggaaagattgtgatgcccttctaattgtcaagtcgttttgaacatgcggttctgggcaatgatgtcgtagtacagctcgcgcgctatgtatcgcttgaagcatcgtatcgcctcgagcttggagtgccccttagatatcttgcgggccacctaagcgcgggtcctgtcgtctatctgcagtcttcccggcgcaacgatgtgtatcgcgctgttcgctgccctgccagcgcccctgttgagcctgtagagtgtcgtgagcctcgacgacacaggacacgctgccaccccgcacaagcatcgcgaacgacgactcgctgcttgagcctctccggattgtccctccacggtgatcatcagctgggcgctgccctgcgagctgacgcacttctcctcgaggatggctccgatggtcgtaccgagctcgcccacctcgtcgaggttctggtagcgatcggcgagcgtcttgagggcgatgcgcccgtccttgacgcagcgtgatctggggacgaggcgggcggttgtcatcgcgcactactggtcgcacacggtgtcgggggccgagacaatcagggagcggatctgctcgattgcggccttgtgcgccttcagcgcggacgccttcgccctggtcaggacccgcaggctctcgaccatgccgtccctggcctttactgtcacgcaccacaccccgctcctggctgtgttgtgtcaataggtcttgcgcgaaattcacatcgggatttgagcggaattcccgcgcgaggtgagcggaccctgcgcaattgtgccagggtccgcccccgtcagaagcggaggtgtgggtccctaatccgagcctcccgcgtcgccgaccgcggacatgagggcgtgctcacgcggtatgggccctgtcaatataatggacagaggaatctcagatttttagagtcttcggtagtttctgtgggtgagaagttcatctaagcagccttcttcttcgtgctttcctcggcccttcccggaagtgtcggcctgctgtcggagcacctcaacatgagcactccgatgaggttgtcggtgttgcggaagccatagcccatcctgaccgtcaccttgatcttgttgttgatcgcctcgacgcggccgttgcctatgccgagttcggccgtccctgccctgaacacggcccgcaggtcctctttttagctcccaggccctgaacaagtacgaagcggctgcccttgatcgcgtcggcggccttcttcgcaacctgccattcctcgcagcacacctcgtcgagcgcgtcggttatccactgcacgacatggaacgggtccatgagccacctcgcactgtcggtagtgacaacctcgatagcgcgcctctgctctcaggtgagctcgtcgaaaaacaggttcagcacgtccttgccatacccctcgtgggcccatatcagccatccccggtcgtagtcgatgatgacaatcaggtacttgtggcccttcttgtaggaggtcttatcgatcccgatgcgccttgcgccctcgaagacccctgccgcgcgcagcctgcagatcggcgcagacgcgggcgcacacctcgccgagcgtgtgccactccacgcgcgcgagcgccgcgacggcgcgggccggatccgcgccaggcacgccacccactctcaaagtcgtacgtgaagcgcgatttgcgcctcgcccagggcagcgactggttacgtccgtaaagtggtgtaaaaacgggagcgagctagaggcccgccttccaagtaaacttgcaatcaccaaaaggcacagagaatcggaggcttagcatggctcgaatcaatattacccttgaaagcgacaagatagcgcagatcctcgcggattccagaggggacgcgtttcggctcctcttgcagcagtttctcaacgcgatcctgtcggcaaactccgccgagcagctgcgcgccgagccctacgagcaaacgcaggagcggaccgacttccgcaacggcacccgcaagagatccctcgtcaccagggtcggcacggtcgagcttgccgtcccgcgccaccgcaacgtctcgtttaagacgctcgtgttcgacaactacaggcgcgccgaggccgccctggtcctcacgatggccgagatggtcgtcgtcggcggtgtctcgatagccaaggtcggccgcgtgatggaggagatctgcggcaggggcttctccaagcaggccgtctcgcaggcctgcttggagctcgacgaggcgctcgagaggtttcgcaaccgccccatagagggcgcccaccccttcgtcatggtcgacgcgacctacctcaaggcgcgcgagggcggccgcgtcaggccgaaggcgctgctcgtggacgccgacgggtggcaaggaggcgctcggcgtcgagctcgccgacggcgagacttaaggggtctggtcgagcttcctgtcctcgctcgccgcgcgcggcctggcgggcgtgcgcgtggtcacctccgatgcctgcgaggggctggtggcggcctgagctgtaatcttttggtggacagtgggattcagggactggcaacagatatgctctgtccagatacccacctaccaacaccagcagattgaagagatgagatgtcgctgagcgcaagcgagatagagaaggcaaagtcccgcacgaagccggaaacacccaaacactacactgaagaagtattgcctcgaggctgtcgactactacaggaaggcacataaggccaacccgaagaagagcatcagaggatgcgccgcgaagcttgaggccaacgacaagaccttaaacgactggatcatcaagcactcaaagaccaaaagggtgacccaggtaaggaccgacgagcacaagcagctcgacgcagtgaacaggcgcatacacgagctcgagagaaagaataagttcctaaaaagtggcagccttcttcgccggaagcctctgttgaaggacaggttttagctcatgctggagaagagggcaacctacagcgtctcgatgatggagcgcgtactggaggtgagcagggctcacttctacagatggctcaaggccgaaggcggtgaggacctatggggtcccctcaaggaagccatctgcgcgatataggaggaaagcgacaggcgctttagcttttgctaggtctgatccaagctcacaggagatccaaagttacgcaaaatttacaggcacgacccgctaccgcgtgcgcaggtgcatggctgaactgggataggcggcatctgatccaatgcctccaagagaacgacgctgcccgcacctgatacccccgagcgccccgccctcacccggcgcggcttttcgtgtcttgtgccgacagccaagctcgtgggcgatacaacctatcgcaggaccacggcaggctttatatatctcgccgtcgcacacgatctgtgcacacacatggtggtgggctgaagcatacaggacaacatgagggcagggcttgtcgtctttgccctgaagatggcatattcgcgcggatacgtggccggaggggccatattctaagcagcccaggcagctagtacataagctcagagctcgccgcctgctcagccgtgcccgacgtgaggctcttccgtggggagaaccggaagctgccacgacaacgcgctagccgaatcgcttttcgccacgctcaagaacgtgtggtactaccataagcgcctcttagatgcatccacgaccaagcacaaggcacacgagtttatcgagtcatactacaaccgcttccgcccgcataagtccataggagatcgcgtgcccgcagaggtgatgcaggagttcttcgagcgcttcgagagaggccttgcgtatgatccggaggcgatgcagaccgcatagaatctgagattcctctgtccattatattgacagggctcaagcagctatgagtatgcctcccataccctggagcgcggcgagagcggagcgcatgcgcactcccgcgcctcggtcgttgtctccttcaacggcagccaggggagatacggataccgccgcatcgcctcggagaccggcctcggcgaatggaccgtgaggcagatcatgaaggaggagggcctcgaggcgaaggcggcgaagaggcgcaagcgctacagctcctatgcaggcaagatatcggatgctccggacaacctgctcagggacgcaaacggcacccaccatttcagcgccgatgcccccaacgaggtatggattacgcacgtcacggaattcaggatccctgccggcaaggcctacctctctcccatagtcgactgcttcgacggcatgcccataagctggagcatctcctgctctcccgatgccaagatggccaactcgtcgcttctcggcgcatgcagccagctcggggaggacgagcatccgatcgtccacagcgaccgcagctgccactacaggtggcccggatggatcggcatctgcagcgaatatggcctcaggagatcgatgtcacgcaagggctcaagcccccgacaatgccagggcgaagggactgttcggaaggctgaaggtggagttcttctacggatgcgactggacgggagccacgatggagaggttcatagagcttctggacgagtatctggtatggtaccgggacgagaggatcaagagtgatctcggatacaggagccccatgcagtaccggaaggatctggggctggcagcgtaggaatcaggtccaaattaaccaccgcagttccggtatacattgagcgaccagacgggcatgatggctttcaccatgtcgcctgctggcttcccgatgatgtctgggaaggtaattttggattccccgagagcgaccttacccgcttcaaggacatagtacgttcctgcgctcatctgctgctcgagtttgcggcgggcggaagatttgagaacgtctgagacttctgggcgggtactgcttctcgtcaggcccttcgcgaatatttcgtccctctgcctcttccgctgcgttccaccaggtttttctgctcgagcgaagcaaggagacgtcctgtcgtcgaaaggctcatgtcgcaggcgttcgcaatctgctttcgagacatgagcattcctgtgggcaatgcattcaggactgctttttcttctactgttgtggcaggatgggagccgaacgtgggaagcgttacacggatgctcgcatcgagaacatcgaagcgaggaggtagttccccctctggataggcttcccggatgcgcggaactccggacccgaagagttcgatatagcccagtctgaacatgaccgtggcaagggtcggatttctaggtacagatagaccacctgcaaggtaggcctctctctcgatccctgaggggagcgagccaggagatgttaccacaacacggtcagggtgcatcgcgactgtaatggtagctggcacatcccatgcgcgatgcgcaattgcgttggcaagcgtctcccggagagcatccagaggcaatctttcgctccgctctctggtggttgctgtcactttttcgaatgtatagtttctttcggcaatgcctattgccctatcgagctggtcgagcaccgagcgtccccctatgcgcgctctctcgagaatctccgatgtgctctcgccgaacctcatgatatcgattccaggaaagggatttgaatcggacagaagtgcagcagcattcacgagctggccgtctgcatccgcaagcccaagcgtccgcaaggtgttcctgtcgaatctgtcgaccccgagtctgtcatgcagacgctgcttgagggagccgaactccatcttctggttgtctgccggcagctgatcgaaagacatgtgcttaccggcgagcacgagccgtttcagctccagtggatctgccttggtggtcgaagagtcgtttctgatgtatgccttcccctcgtagaggtaaggcttgtccggcccttcgaatacggtaagggtcatagtgccagatctgctgtcgacctctattgcgtagcggggtcgtggatcgatgaagtcatggaccatgtgctccacgcgcagacaatctttatcgacgtcaggaaggcctacgatggtgccatcatccgccatgccaaagatgatgctgcctgtccggtagtttgcatatgcgctgactgttttaaggaaagacttggataccgagactttgagctctcggtctttagactcgagcagggccatggtacgacctcctgagcacagcgaattgactagataaaagttatctggtcaattataatcctatttatagtcccattaatgtttggtaattgaccagaaaaaattagctagtcaatcagtctgaacggatatagccgttgtccatgctgccacgcagggacactagcatcaggagaggacgccgcctggcaagccatatttacgtccgcttgggtgcgtgctaggatggaacgcctggacagggcagcatcaggacaatgcattccagaggcaaaagggatctgtcatggcatagcctgaggcggggtttccgtcactcgccactgaactgacggatccgtccgtattctatctgcagcttcctgtcccttggaggaattcttgccagagtatctatcgaagtcttccgagggggcatatgccctccgtctagccttcaccaccttctttcgtgcgctgggtttccaggctacctactttgtcggcatcatcggctctgcgacctaccttctaggtgctgatgcgatggaggcctccttgctcgtcgtcctcctcaatgtcacgtttgtggctgcaggggccgcagcaggcgtcgttgtcgaccgtatcgggccgaggatgacgatgcttttcttccttgctctcctgggcgtcaccggcatcatcggtgtcgccttcccgatgggcatgatgttgcttgtggtcgtgaatgtgctcgaagggattgccgggggcttctgcatgacggcaagctctgcctatccgcgctatctcgcagataatgctgccgtgctccagaagatcaacagctacaataatacggccctctgcgttgccgttatcgcagggccactcatcggcggctggctcacggtgctcttcacgagccagatggtgtttgcggtcctgccggtctcgtcgtcgatatcggcgctcttcgtctggaagctgccggagcttttgcatcctgaaggcacagagaagaaggagggggagggcttctggaaacagcttgccgagggcatccatatcgtgttctcccacccggtgatcgcagcgctcttcctgatctatttcctcggctactttgcctatggcgccttcgactcgctcgagtcgctcttctaccgcgatgtgctcagggtgggctctgagtggatgggatggctctcttcagcagcaggtctgggatcgacggtaggtgccttggcggtgctgcgcttctccacaaagcggctctctctcgagacgatcgcccttctccttgtcgtaatcggcgtgggctccatggtgtacgtaggaacggcttctgtcgctatcgctcttataggccagctcatcgctggcttcggctttggcgccatggggcccgtgaaggacacggtgctccagaggaactgcgacatccgctacatagggcgtgccacctcggtcctctctgtcggcatgaactctgctggcacgctgccgctcctgatcgctccttccgtggcggatgtcttcggtgtgcaagcagccctcttcggtgcctccaccatcgctgctgccataggcgctctggctcttgcctggacgcatgtgggcaacccgaaagaggcataaggacgccacgcctgctggaagcggtgctgccgaatctccagcgacgccgctcgcccattggaatgcacagggcgcatacatgctcatccaaatctaggggccgatctgcttatcgtcgccccattcagagagcagcatggcgatgccctctgaattcagcatggcacgataggcctccgatgcaaggttctcttagggaggttttcccaccttcgggttgaaggggagacctccggctgtgactgacttggtcaggaacatgctgatggcatcggagaggcttggctcctggcgaacagagatttctgttgcgtcttctcttggatggtggcagtgcgtaccgttatcccggcccttcttgtcgctgcgactctcattgtgctccccatctccctgtctctcgtgtgcccgaactggggcatggccgaggtggagccgggagatatggtccgggtccggccgggcggcaagataccggccgacgggagggccctttccggcccggagaccgtggacgagttgagcatcacaggggcgcccatactggtagcgaagcaggcgggaagtccgatctttgccagcgctattctcggcaatggcacgcttgagctcacggccgagaaggccagcgaggataccgcattcgggaagatcgtcgagcgtgtggaagaggcccaggactccaagacgccgacagagcgcttcatagaccggttctcgaagcgctatacgcccgcagtgctggcaatcgctgttctcgtttggtttgtcacgcgcaatacagagcttgtgatcacaatccttgtgctcggttgccccggcgccttcgtgataggcgtgccggtatcgaatgtggccagcatcggcaatggtgcccgccatgacatcctcttcaagggggagcgatacggttacgagattcaactaggtggatacgatgctcttcgacaagacgggggtgctgacctatggggcgtcgcagttcgtgcgggagctgctcttcgacgacagcgaggatcctgaggacagggagagtgcagaggccctgcttgcaagcgtggagagggaatctgggcacccgtttgcacatgccttcgcagggtgccttgaagatctgccatcctttgaggtggaggcgatggatgtgatctggggccggggcattgcctcccaggtggtagggcatgaggtgctcgcaggaaactgcctccttatggagcgctcgggcattgtgcttgccgacgaggcgaaggaagatctcgatactctggaggcagaagaagacccccttgttcctgttgcagaggatggcaggctcgtgctcgccctcggcattcgcgacaaggtctgcaagggcatgaggcaggatcgggagacgcccagaaagctcggtgtcctctcgggagacagccagaagactgcagagcgcgtcggacgcgagctcagactcgacaaggttcggggaggcctccttcctgaagccaaggctgcctatgcacggtagcaccaggaagcgggcgaggtcgtcgcctttgtcagcgacgggatcaatgatagtcccccctgcggtagcagatatcggcatcgcaatggatagcggtaccgatgccgcaatcgaggtacccgatgtcgtcctggtgggatcggatttccccaggatggctcatgccctggggcttacaaaggcaacccgatagaacatggcagaaaacatcgcgatcgctcccgacctcgttgccagcacctggatgaacatagctctcggcatactcgtgcatgaaggtagcatcctcgtcgtgatcctgaatgcgatgcggctcatgagattccatgaaagatagcaggacttgacagctatcaatttctggaacgcaatctggaagaaagtgttcctgcacagagagaccaggagaaaggaaactgaaatgaccaagacagcaactctccagctcgaagccctcgcgtccccaacctgtatgcagaagatcgaagccgcaatcaagagtgtcgacggcgtcgatcaggacaacgtgaaggtcctctttaacgcgagcaaggcaaaggcaggcttcgatgcagacgtgactgacgcagacgaaatagcagatgccgtgcacgccatcggctacgacgccctgaaggtcaagagctgctgaagaggtggcatccagaaagagcaggatctaatatcagagaagaagcacatcgtggagaacgcaaaggcataggaactcctcgaggcagcagacgaggagctcgacctctataccaggacaatcgcgaaggcacatggcaggcatcaccctgaggtcttcggggctaggggatttacgaggagatccagtgcaagatgaggggcgaggagcaggatatgagggatgaggtcctgaggctctgcagcgtgacaggcggctacgatattccttcggatatctgtagcgccttcgcctcgaggccctccttcttcatgatcttcctcacggtccattcgccgaggccggtctccgaggcgatgcggcggtatccgtatctccctcggctgctgtcgaaggaggcaactgagctgtaatcttttggtggacagtggggttcagggactggcaacagatatgctctgtccagatacccacctaccaacaccagcagattgaagagatgagatgtcgctaagcccaagcgagatagagaaggcaaagtcccgcacgaagccggcaccacccaaacactacactgaaggagtattgcctcgaggctatcgactactacaggaaggcacgtaaggccaacccgaagaagagcatcagaggatgtgccgcgaagcttgaggccaacgacaagaccttaaggaaacgatgattaatgccccataacgtgtcagaggggaccgaccacacgatttttcgcggccggtatgcgggaaaggcaggaaaggatgctcatccagcacgtgcaggagccgctatccttacatctgtcctgccccatgcaccgcaataaggctccaagacagatcaagcgacgctgagagccgggctaagcagcctgccggcagagatgcacatggtaaggtttgcaagggcgaagcagacattgagcatacaggagttcttctctatccccctgtagcgtgtccttaagtggccgaagcggcgcttcacgataaggaagggatgctctacctttgagcggccggaggccttcctggactcgatgcccttttcggctgagagtgcacagttaaggccctttatggtcgaaggtttccttgcgacactccagcgcatagatgagaggtgtgggtctgctgtgaccttaagggcgcttcgctataccggtatagccggagtctgcatagcagaacctgtcatcttcccttacgagtgcatatgcctgggatatgtcggacacattcgcagcggtcgtctccacggcatgcacaaggccgctgccggcatctacgccgatatgcgccttgtatccgatacgccagttcttccctttcttggactggtgcactttaagggtcgcgcgcatggtcgtggttcttcgtggagctcggggcctcgataaaggtcacatccaccatggagccaccccgcgccgtgatccctgccttctcgagctccgaattcaggtcgtgaagcatagctttaccgagtccctgccgctcgaggctatggcggaatttcgcaagtgtcgttgcatctggcacctgctcagacatgaggtctacgtgcatgaagcgctgccaggaccgacaatccaggatagcatcttcggttccctcgtcttaagagcccaaacatgacctgcagcagatacatcctaagcatcgtctttgcaccgcgcacatgcctgccacgcgcctgagaatggtagctgggttctaccagtgcaacccagctatcccatggcacgatcgcatccatccgctccaggaatgcctctcgccgagtcttcttcctctgaccctggaatttaaggtccccgaagctcatctggctgcccatatcttcctcctggatatgctggaatacgttgctgtaattataacatatccgcaggcagataggcatttatgtgggtatgggcactgtgtggttcgagacattttaagccggcggcatacagcgtacagccccagctacctcatcgaggcgaattaatcatcgtttccctaaacgactggatcatcaagcactcaaagactaaaagggtgacccaggaaaggaccgacgagcacaagcagctcgacgcagtgaacaggcgcatacacgagctcgaaagcgagaataagttcctaaaaaagtggcagccttcttcgccagaagcctctgtcgaaggacaggttttagctcatgctggagaagagggcaacctacagcgtctcgatgatggagcgcgtactggaggtgagcagggctcacttctacagatggctcaaggccaaaggcggtgaggacctatggggtcccctcaaggaagccatctgcgcgatatgggaggaaagcgacaggcgctttagctttcgcaaggtctgatccaagctcacaggagatccaaagttacgcaaaatttacagtgacgactcgctaccgcgtgcgcaggtgcatggctaaactgggataggcggcatctgatccaatgcatcgaagaagacgacgctgcccgcacctgatacccccgagcgccccgccctcacccggcgtggcttttcgtgtcttgtgtcgacagccaagctcgtgggagacataacctatcgcaggaccacggcaggctttatatatctcgccgtcgcacaccatctgtgcacacacatggtggtgggctgaagcatacaggacaacatgagggcagggcttgtcgtctttgccctgaagatggcatattcgcgcggatacgtggccaaaggggccatattctaagcagcccaggcagccagtacataagctcagagctggccgcctgctcagccgtacccgacgtgaggctcttccgtcgggagaaccggaagctgccacgacaacgctgtagccgaatcgtttttcgccacgctcaagaacgaatggtactaccataagcgcctcttcgatacatccacgaccaagcacaaggcacacgagtttaatcgagtcgtactacaaccgcttccgcccgcataagtccataggagatcgcgtgcccgcagaggtgatgcaggagttcttcgagcgcctcgagagaggccttgcatacgatccggaggtgatgcagaccgcatagaatctgagattcctctgtccattatattgacagggctcaagctcatctcagagcctgcctaaggcccccttgtctctgccctgcgtgacggctcaggcacgctggtagtcgaggttggccatgatgctgatgtagctttggttgcgccttttggcggtgtcgtctatccctacgcgcacgacatccgagtagtcggcggtatcccttgcctgggctacggccttgccgagcaggcaccatatgcgcgtgggctgtctcgtgcagctgctgcgcgaccggcgtcacgctcatgccaaagagcgccgtgaagtgcgtcttcggccgcacctttcagggcatccttgtggcatgcacaccgtctttggggcagtcggccctgggcagcgcgcagtgcacgatggtctcgtattgccagatgtcgagatgccacaaggtcctctcgcgcgtatcgtaggtgccgcacttcctgtgggatacggggcactccacggcctggcccttcctgtgcgcgaccctcacatggagctcgtcttgcgcttcctcgcgctccttaaaccagacgcccgtgacctcccattcgtcgctgagtcccatcgacctctcgaagagccttgctagcatccctgccttaagcatccatatcgcaccttaggaacgcagccacctgtcggggaaaatcctaccgtttaaaggccacgccctcaagggatgcagatatgctacccaccagaagtgacgaagagccccaaaatatagaggtatctcaaacggatacaaattagagaacggggctgttgatgagcgcaacaattcgagatgtggctaaccaagctggtacatcaattgctacagtttctcacgtcattaacgggacaagacatgttagtgatgacttgacggatcgcgtttggaatgcgattaaatcaacaggctatatacataagctcgattctcgaatgaaacaagggaaaataaatttcaataaggtgattgccattgttataccgacattcaacagccccatgtataacatattaacaaaacatctatcgagtaattttatgaaaagagggctacttccagcaatatattgcaatgaaaatgattccgaaaaagagcgaatgattctaagacatattttaggagattgtcgtatcgccggcatcgcgcttgttccacttcaagagagagtagacgtatatagctctctttattcgaatggacttgcagtggaattcatggatgcaattattgccacgcacgagaaggattgcgtcgttatggaagactttgaaggtactcgtgacgcagtgcgatatttgatatcaattgggcaccgacatatagctggcatatttggtgacaaaaataagacttcggttaccgaacgtattaatggttatcgagcagctctctctgaggttggagttccctttgatgagcatatgataattacaatgatgcataacgatacagatatatttaatagagtgatccctaattttattaatgatgttgccccaacggcaataatatcttgtggtaattttctaacactcaatcttattgcggcactcaaaaagaatggtcttaagtgcccggatgacatatccatcgttggatatggatgttttgatgaagcatatccttttgataagaatcttacctatgtatgccaagatcccagtaaaatggctgatatagttagtgagagaatagtaaataaagtgccctgcattggtacaaaaaaatctagttgcatgctagacgactctaatagaagtattaaagttccaacgaaactgcatattggaaattcagcacaggtagtcggagcaggcccgtttggagagtgcgccacctctccggatgaaattgtcccctcggaaaatgaacggaatcaactcaaggaaggacactatacagtcgctcttacatttcattatggtggcactgcgtggcactcactgcatcagcttggcataacggaaacgcttaacaatcttggcatttcagtgatatcgacatgcgaggcacagcttgaccctcaactgcagatggttcaaattgagggcataaaaatgcagagacctgatgctgttatagccattccggtcgatgacaaaattacagcgcctgcgtttaaaagtctttcgaaacaaacgaaacttgtctttctcagtaacatcccctccggtttttcaaggaaagactattcagcctgtgtttctgtcaatgagtgtgagagtggcagaattatcgcgcatatgataggtgactactttgccggacaagaaaacgtgcagataggaattataaaacatggcagtactttctacggtaccttcctgcgagacatggttacagtaaaaacaattgagcgcaactatcccaatatcaaaatcgaagctacaaattcattcatcaatatagcagacgcgtatgagatatgctgcaaaatgctaacggaacatccgggtattagggcactttatgtctgctgggatggtcctgccctacaagcagtacgagctctacgcgacttaaaccggacggatatcgttctctttacctgtgaccttgatgaagaaataggtatgctcatggcaaaaggagaattggtctgtgggatatctgctcaaagacctttcgagcagggtgttgctgcagcatatgcggttgcgcatgccttattaggaaatgatttccataaatatataggtgtctcaccacttggagttactcgcgagaacttggctgatgcatggaaggaaattttgcatgagccttttccacgggggttactttgattttgatatggctgcttgcatgaaccaatcctggtggaggagagtctgcccatttgactttaagagcaatacagcgttctttaaaaatttacgtaaaattcgtagaaaagtccacttaccggtgtcgataacatgacaagataaacgtagcactccctctatttaaaataagttacgaaaatcctatcaaggtcttgataggagaagacggagggagatcttagtatgggtaatggtggtttgaagctaagccgacgtgagtttttgggtgttggagtatcggctgcggttcttggatgtctgacagttactggttgtggtgtaacaccgaattcgactgcgcaggattcatcgtcgtcttcgtcaaagaatggtccctactcctttgcttttcttacgaacaccctcaataacactttccagtcctctatgaatgacaagttccaagagcaatgcgacaacgcaggctattcatacgtctgcctaaatccagactacaatctcaatactcagctgagccaactgtcagacgcggcaaaccaagatttggatgcagtattcgtcatactggtcgattccgcaggaatccgctcgggccttcaagagttgaaagatgcgggcaagaagattctaaatgtcgatacggcagtgactgaggatgataggtctctaattgacacactgatcgggacgaatgcggagcaagcaggacagcttgtcgggcagcagatggtaaaagactatccgaatggtgctgacattgccattcttgactttccctcgaacgagagttgtgtgaagcgagtcaagggcttcaatgaggggcttggtgacagcgcaagtaaattcaatatagttgcgcaacaggatggtaaggctaccttggatagctcacttaacgtggcacaggacatcattcaagccaatccgaaccttcaagcgtttttctgtataaatgatccctcctcgcttggtgctgtcgccgcaattaaggccgcaaacaagcaggggttgattaacgtgtattcgattgatgcttctcctgatggcaagaaagcgcttatcgatggcgactttaaagccgttgcgtgccaagtacctctcggtatagccgaaaaagcgttcgagtgcgcagttgacctcatgcagggccagtcagtggacaaggagatatggctcgactctcatctcatctccatcgatgaggcgaagcagacagaagatgaatggcagtagccgatagcctgtctgtactgtaatttgtgactctgactaagcgcagcctgtacgaaagcaagctgcgcgtgtcggattatccaaaaggggaggtagcttcttgggcaaacctattctacagatgcacgggattaccaaatcctttgggaatacgagggttctcaaaggggtcgacttcaaacttgagagaggcgaggtccacgcactccttggtgaaaacggagcaggtaagtcaacacttatcaacgttctcggtggcgtatatccacctaacgctggttccattgagattgatggtaaccaggtcgacattgatagtgtgctaaccgcccgaagaaacggtatcgaaatcatccatcaagagatagtgctcgttccctatctgaacatagcgcaaaacatctttcttggtagggagatagtcaagaaaggtggcattgtcgacgagcaggaaatggaagcgcaggccaaacaaaagctaagcgtgcttggtgttgacatatccgtcaccactctcgtgaaggatttgagtatcgctcagcagcagatggttgagattgccaaggcagtctcatttgatgctcgtattctcgtgatggacgagccaacctcttcgctctcagatgaagaagtggaatcactgtttagcattatcagaaatctcaaaaagcgtggtgtgagcatcgtatacatctcccacaggatgagtgaactgcttgagataacggattgtattacggttattcgcgatggggagtacatagggactgtccggaccagtcagaccaatcaaggcgagcttgtgcagatgatggtgggtcgcagcctctctaatttctatcagaggacctatgagcccactgaacatgtcgtgttcgaggccagacatttggagaaaaaaggcgtgttcggcgatgtgagcttccaagtacatgctggtgagattcttggattcgctggtcttatcggagccggccggagcgaactcatgcaggccatcttcgggagtagcacctatgactctggagagatgctgattgatggggatccggtttacttcaagaactgcgctgacgcaatcattaacggccttgccctcgttcctgagagccgaaagaagcaaggtttggacctcttggcatcagtgaggttcaacgtggctctttccaacttggggaaaatcagttatggcagcatagtcaactggggtaaggcagatacgctggtcagtaaatacatcgacgatctacatgtcaaaacaccttcgttatcaacagaggtctcgagcttgtctggcgggaatcagcagaaagtagtcctagcgaaatggcttgcgacaaatccgaaggttctcatcctagatgagccaactcgaggtattgacattggagcgaagaccgagatctactcgatcatcaacgagctctcaaaagggggcacggccattatccttgtctcctctgagcttcccgagctcatcaacatgtgtgacaggatctgcgtcgttcatggcgggcgtatcaccggtacgcttcaacgtagggagttcagccaagagaagattatgcatttggcgacagaggaggatcagtgagtaagaaggcgggaaatagaacaacttcggttctcggcaaattcggaagtatcataaagaaaaacataggtattattatcgtaatgataatactgttcatattcatgtcattgctcagcccatcattcttaactaccagcaatgtaatttcagttctcagggaaatttcaaataacgtgtttcttgcccttggtatgacattcgttatcattcttggtgggatcgatctttctgttggatctatcgtcgccatgagtggaaccataaccgttgggctcatgacctatagccagtttcctatgtggggggcgatattggtcggtctctgtctgggggccctggttggattcttcaatggcgctgtggtctctaaattcaaggtaccggccttcatcgttacgcttgctaccatgaacattgcacgtggcgttgcgtatatctatacgggtggccagtcgacgcgcgtaactgatgatgccttctcgctcatcgggacgggatatctctttggttggattcccatgccagtcgtctatatggtggtactgaccaccatcttctctgtgcttctctcaaagacaaagtttggtacctatgtttatgcagtcggtggcaatcgcgaatgtgcgcgtctgtcaggtattcccataaagaagacggagatcttggtttataccatctcaggtctgcttgctgcttttgcaggtatcgttcttgcctcgagaatgttctcagggcaaccggcctctggatcgggatatgagatggacgctatcgcagcatgtgtccttggtggcatctcgatgtctggcggcgtagggagcatcagcggtacgttcattggtgctgttgtgattggcatgatttcgaatgggctgaatctcatgggtgtaagctcattctggcagcttgttgtgaagggaattatcattcttgctgccgtcatcattgattctcagaagagctccttcagcacttggctcttcaagactgtgcctcctgccagcaagtccaaagacaccgtttctggggaggagcaatgaacgggatattccgtaagccagtgggggcagatgcgaccggggatgccattccgttcttccatgacggtatgtaccatatattctctctgacacccccagctggtacgactgtatatcccgaccgccttcggacaacatggagtcacaccgtttctcgagacctgtggaattgggaggaattgccgacagcgttgtgcccaggtatggggagtgagcccgacgccgatggcatatggacgggatcggtcatctttggtaaaggtctctaccacattttttacactggctacaactatcacatcaaaacacaacagacgatatgccatgccaccagtgaggatggcatatcctggatgaaagatccggataatcccatccttgttcctttaaccgatctgtatagacctcttgactggagagatccatacattttcttcaataaggacgatggatgctactggctgcttgtatccgctcgcttgcgtaagggtccatcatcaaagtcgggatgtatcgtgttgtttcgttccgacgatttgtctcattgggtgcattacgggccaatctacactccctatcataccaactgtccagagtgttctgagatgtacaagctgaaagatacctggtacctctcgtattcgcgtttctcagagcatgtagagacgatctaccgtatggcagattcgccttttggtccttggcggaccccacatattgatgggatcgggggacggagattctatgcagccaagtcgtgcatcaatagtgaggggcgttgcatatatttcggctgggtgcatgataggaccgatggccgtgatgacggggagtggtactggggtggtgacttctgtgtaccccatgaggttattcctaattcttatagggagcttgacgtaaagatgccctatgagattgagtcaggcctcagtgcaagagtcctgccatggtcactcgtcccaaggcttggacaggttacaagtgctggtaacaaatccatatctatcaactctccgggttcgttcggctatagcctgctcaagatacatgagaagacctttctcttcagatgtcgcgtccgcatctcctattgccgcgataactttggaatcttgttcaaaacggatgcggatgcaaatcagtgcctcgaactgcgcttcgagattggtatgcaacgcgcttcccttctaagtctgcccatggatgtcgatccgttctggagggaatcctgtacagacgtagggagtccagcagtgccaggaccagatggaaatcgggttgcagagaagcatttcacagttgtggatggaagcactttcgaaattagcgctcttgttgatcatgacttagtggagatttttgtaggagaaaagattgcttttacctatcgtatttatagacaggttgattaccagatgggactgttcgtgagagatgggctagtggactttaccaatattaggattactggttgtgaataagaaagactaactattaaaagtcaatcatgaaaaatggctgagtacctccagcatagttaggctccctgaactgtaagcggcttaaggcaagatcgaaggcatcttcggctggaccgtcgcggtggctgcgatgccaaagagcaagacatggatgaggcacatc

SEQ ID NO: 304 - DNA, 40505 bp, Unknown
  Metagenome-assembled genome
gctcaacccgcgtgatgcaagtcacgacgagattgtggagctcttctgtaaggttatgctgcaagcgtactgctgataggcctctgatatgaaaaatcccgtgtggttttcaaagccacgcaggatttgaagtttacagtgcaatcgctgctccgttctcgttttgtccagttgctcttactcactgaatcagcatatcgaggaaccaggagaagatcgatatcaggagcgctgcccacatagccgtgccaaaatcagggacgatgatgccgacctggaagattccctgggtgatcgtggaggcaatttccaaggcaaaggcattgacgaagagcgaaaagagccccagggtcaaaatcgtcagcggaagtgccaggatctggagcaaaggtttgatggagatgttgaccagggccaggaccagtgcggtgaagataacagcggcataggtgtttccaactgtccggatggtgggaacgaaaaagattacaagcgcgatagcaatggttgtggcaagccattgttctacgaaacgcattgaggtacaccttcttaaagaactgtgggaaatatatcaggggtttattgtaccctaacgggccagcttgccttcaggtgcttgcgcgatgcgctgcactttagtaagctacagtagtttagcagcctacagtggaacgcagctatgtgggagggaccatggcggaaagccaacacagaacagaggaagagacacggttgttcgaagccttctgcactctgcaggctccgcaggaggtgcgggcattcctccttgacctctgcagcaagaaagagatacaggatctggcccagcgattagaaatggcacacctgttggatgccggagcttcctatctggaagtctcaaaggtcaccggagcttcctcaaccacggtgagccgtgtctcaaagtgcctgaatggtcccatcgggggctaccgcgtggtacttaaacggctgaaggaacaatcagactaaactgcattgtttcagaagtataggtactgactcgatgggcattttattgcccataggtgcgtacactcgtcgatgtgcctttttgttgtgcacgctgtttgctagatttatatacgcatgcctaaaccaatcaacgaaatgggagccttatggctgaacatatcatcgtgaccaatgctgagggaatcgcctccgaaccggttcggaaggcgctcaaggaagcacagagagccggtgggcgtcccaccctgtttgtgccggggttaccccagcaagatgaagcccaacgcgtgtttgcgcaggaaggtcccgatttcttcggtgtcgatgtgaccagcatgtcgagctggctcgaagagcgttgggaaacctggggagacggcacacacctcgtgagcccgcccgagcggactctgatctttcagcaactgctctccggtggagagacggcgagcctaactcccaatccgggtaccctgcgggtacttggacagcttgcgcgctccgcgcttccatatttgccactcaatagcgatgggaatgtcgagggtgaacaggcaaaacaggcgaatctcacgagtgcagagattgaagcgattgagtgggtcgcccgctatagcaaagaactttgtgcccgtaacctcaccgaaggctgtgtagcggcaggcactataatccagcgcctgcttaaggctcaggttacgctgccggctgtcgtcgtcagtggctttgcgacgatgcggcgtccgcagcgtgaacttttggttcagcttgctcagcacagccacgtctggattgtctttgagatgggaaatgaggtggcgactgcgcagactgctcagctcatagaacagttgaaacaggaagccgctgcagctgacgttgtgtgtgaggtagaggaagaccactgcaaaccacaagcggtacgcactacgggattgactgccttgaagaatgcgattttccagggtagaaacgacctcaccgcagatggctcggtagagctcttgtaccccgccggctctcatgcagaagcagaattgatcgcgcgtcgtattgaggatctggtcaaacagggagaaagacagatcgtagttgcggccccctctgcggagcgggcgtggagagagctggccccaaaactggtagctcggggtatctcggttgaaggatcgatcagtaagaatctgttgtcctgtgacgcaggaagggcatttctggagtttgcacagaaggtagcaacgctcaaccagcttgccgagagttggcctgagcccacacagactaaagagggggagactgcaattcgactcggcgatatgagctggtggccacccgaagagctgattgacttcttcgaaaacgatattgcccagatgagcgtctatcgggcgcagcggctcgataagcgctggagaggagatcggctcctcaccccacaggaagtcctgggtaccctgcagaagcagaacagctgctctccgatagtcgctgcagcgacgagagagctgctcaaaggccacatcggtggtgctgccatgaagctggcagagccctatctcaatcacactgaaaatcgagtaatcgatgactatgcgatcgatgcggaaggtgagcaggtgaatttgcacaagcgaccgcatgatccctatgccgacgcagaggcacagggtgttctgcgtggcgtggtgaacgcttctacggtactgagaagtcagggcttgcgttacgatcccaagaacgattccgcggacaaactgtgtgaggtggtcgagtacttaaaacagcctttaggggagaccaccgtatccctgcaccccgccgttgaggctgagggatcacgaggacgggtgctgattgtcagcaaatcggaagctgcaacgatggagcctgcgagcgccgatgttctgatcagctgcgcagagacctcgacagagtctgcggtggatgacggagatgatgtggtgagctcgctctttgagcggctcaatatcgatcctgctcaagatcccatgatgtcagcgcgtgcacggttctaccggatgctgtgcgtgcccacccacaaattcatctgtgagcggacgcagttcggtgcagattcaaaacagtgttttccctcggtcatggtgcaggaactcttaggagcctatgggatgagcgatgagaaaccgaagcaggtcaaggcctgcattgacaaccatattccggtaactgaattgagtgaatatgacgcggcgcgcaatatctccgccgaaggtaaggaatctgaggtcacctcacatgagaaaatcggaccaaccggttcgatcagcaaggcttcacgtccctacatctcatttccttctccaacgaaggtggagctctatcacggaaagccggttctgtccgcctctcagatagagtcctatctcgagtgcccctataagtggttcagtatgagaagactcaatttaacaaacagcgatgctgaattcggcaacatggagatgggaaccttcgtacatcgcgtgctccaggtgactggcgagcgaatgctcacacaggcgcttgcgggaggtggcatctccgaagaggatctcaaacgtgagccgtggactgaggtagcaggatctcgggtatcggatccgaagagcttagaggtcgctcagaagcttttgaatgaggagttcgatgagcatctagcgcaccaatatatagtgaaggggaagaatagccgtccacaggcctttgtaccccatactgaggaggatcagggaaagctgatggcattgcggcaggatctgctctctgccctgaagtatcaaggcgaactctttgatgggtttgagccacgattctttgagtggaatttcggcaaagaggacccggttgacaaagaggggacccggttgacgatgtgctggtgtactacatggtaggcaaccatgaccgtatcgacgtcatgcccacagcagggcttgtgatcgattacaagcatcgttcagcgaatagcttctttagcgactacgccgtttttccctccgaacaggacgaaaacgggagcaaaaaagcggagtcagaaccggaaggggaagaggaccgaccctttgtgctacccaagcatatccagacgcttgcatatgcgcagatcctccgcaggcttaccggccttaaggtctgcgatggcgtgtatctgtgcacaaggagagatcatgggctgtcaggcgcagtgagcgagcatatggccgacatagtctacggtgaccatcagctcagctcacgctcactgaaccgcgtcgcggtgcccccggacttcaccggtacctcctctgaggagagcggcttcaatgccctgctcgacacgacggagggcctgatcgcggagaagattgaagagctgttggacggcaatattgaagcgaatccgcgtgacaaagacgcctgtaaattttgtccggctttgaactgtgagaagagacagccatgagcacccttgacctgtcaggattaaacgacaatcagcgagccatcgtacagacgctcgataagcctctcttcgtcgcagcgggcgcaggctccggcaagacttttacgctgacgcagcggatcgcctgggctctatcaccgggctccggtacagatggaaagccctttctggacgatatctctcagatcctggtgattactttcaccaatgcggccgcgcgtgaaattaaagagcgcgttcgtcccacgttgcgccagtgtggcctgagggagcaggcgctcaacgtcgacagcgcctggatttccacgatccatgggatgtgctcccgtatccttaagagacatgccctcgatctgaacatcgatccggagttctctatcgcctcagaaaatgaagtgaatgagctgagaggcaatgccttacagcacgttgtcggtgacgtccaaaagaagcaggataaaacaccccaggaacagctgctctttgaacgcatgaattttggttctctggaaggggtgggcagcaacgaggtatcgattctcaattcagtgtctaaggtcatgacgatcgcggctcagaccccgggaggctacaaaagcctctgggtccctaagagtggagatatcgcaagtgcgatggagagctttgcgaatcactacgacggggtgcggacgtatcccctgtcggtaaaagatagacctaaggtggaagcttcctgtgaagcgctccaagagttccttgcgcttgctccgggcaaacgtacgccccaggcagccctcgatacgctcaatcaggtaagcatgcctcggagttcaagaggtggcctcaaggaatataaagctcccctcgaggaagagttcgctctgttgaagattgacatcctgcttggcggatttcgccctggcatggaggagatcatcgaactcgcgcagaagacaacagcgtactatcagaacttgaagcgcgatggttcgctgctcgacgacgacgatctgatcgcacaggcactgcgggcactcgagacctcccctgaggtacaggcagactatcggggacgcttcaagctggtgatgatcgacgagttccaggataccgacgcgcagcagttaaagctcatcagctatctgagtggaaccgatgtggagcacctcacaactgtcggtgatgcgcagcagtcgatctatcggttccgtggagccgatgtcggagtcttccggagccgtggagcggggttgcccgaagacaatagagtgcagcttgatatgaactaccgcagccatgcggacattctgtcttttgttgacaaggtctgtgggggagatcggggagtcctcaaggactttatgcgcctgaaagccaatcctgcccacagaagcgatttcccggactcgttgccccgcattgatatcgaactcacctgtggacagaaaaacgtctccaaaattcagggagctgtcgcagctcagggaattgcagcccaattcaagaagtatgccgatgctggtgtgtctccgggcaacatggcgctcttgctgagggctatgacaaacgccgaccaatatgtccaagcgattcgggatgtgggacttgagtgtgtggtgagtggtggatctggtttcaccacgacgatagaggcgcagactatgggcgcgctgctgcactatcttgcaaacgatcacgacagtgaaacggggctcttccccgtactagcctcccagatgtttgggttgggtgccgatgacttcgttagtctcggtaccgggacccatgtgaataccggcaatccgatcaagcgggcgattgaatgtggcctggagaccatggagttcagagaggatgcttcggtctcgccccggctcgtgcgggcacacaatattctcatggaagcccgctctgagatgcgcagaaagccggtggctgaggtgtgtcgggaagtcgtggtagcttccggctggctcaatcggttggaggaagaaggggtaaccggacagagcaaagaggcaaacgtgttagcctccatcgactacatccgtgacctcaccgaagagatggggcttggtcccgcacgtgctgcttctgaatttgacacgtggctcagggtctctaagatctctccgtcccgattgaacggtatcggatccaatgctgtacaggttatgactgttcacgcgtccaaagggctggagttccaagtcgttgccgtagcaggatgggatggaacctcgagagtagaccagatcctccatgggcatgcacagagcagcgagggcaccgaggccctgatcattcgggctgataaaattgaccagagggtgcttgataagctcaaagagattcccgacaatccacagacgttgggggagtggtatccctatctgcgcgatagcgagaagcaggctgatgccgaagaagcgacgcggctgctctatgtagccctcacgcgtgccgaggatgccctgatctttgatattgacggctatacaaccaagaacagtccttcgctcagtcctgatctgaccggtagggtgatgggagcgctcttcggtggtgcagtcccgcaggcagggaccagtgagctcgattttggtggatcgatgccagcagtggttcacacctatattgaaacgaaaggtaagggaaagacatcgtcactggacaccggtgggctgctcccggagcttgagggacagccattacaggatcctgcagatgttgtacggctgctgcacggctcttctgaagataccgctgagcaaatgccgactagctttgacctctttgcgatcgagccggatcccctgacggcacaggttgagatggagaagaaccgcttcgatgtcttcagcttctctgcggctcatgagaagatggcgcacatggtgcaccagccgtatcacatgaagagcgcggtcccggtaggttggcaggccgtgcaggagtcgcaggatgaggctgcagatcctgacagggccaccaatatcggctcggccttccacctgctggcgcagaccatcgtggagtcggggtactatccgactgacgagcacatccgcgaggtggaggactactgggggctgggtgagcgcgctcgaaaacgcgttgaggcggccctcaagcggtggtttgggtcctctatccgcaaggaagtgcttcagtatcagaacttgcaggcagagcttccgttcttcagcaaggcccactctgaattgggatcctatacgaccggcgcctttgatgtggtcgcctacgacgataagcatgaagtgctgctggtcgactacaaaaccggtgacaccaagctggatatcgatcagatccgggagaaccacagcctgcaggcagacctgtacgcgcgggtactgatggatataggctttgcgcgcgttcgcgcacggtttgtgtgcgttgagcgcgaggatcccaatgaggcgggcgagccgctcgtggtggcgtatgatttcgatcagaagaatgcgccctatgcgtggtagtacgcttgttcgcttgtaatctgctatgctagactgctcagtaacaaactgtctgatataagcacaggagttttcatccatgagctttgttcatcttcacaatcactctgacttttcgctgctcgacggcgcttgccgtattcctgatatggtaaagagagctgttgagtttcatatgccggcggtggccttaacggaccacggctacatgttcggtatccccaatctggacctggagtgccgcaagtacaacgacgtccaggagaatatgaagcagtggcgccacgacatcgaatgcttcagcaaaggttgggacctggaagagcccaaacctgatgccccggatgcggactacttccatgcggtgcacgcccagtgggagcgggacaaccagctgtgggaatcctcaggccataatgtggacgcggtcaaagcgaagaagccgcgtgaactgatcaagccgatcttcggctgtgaggcctactttattcaggacaactgcattccgcacggcaccaagcaggtccgctatcacctgatccttctagcgaagaatgagaccggctacaagaacctgattaagtgcatgtcgaaagcggcggggcacgagatgatgtactacaagccccgtatcaccttcgcgatgctcgagcagtaccacgaggggctgatctgcctctccgcctgcgtgcaaggcatcatcccgcagatgattatggccggcgagttcgacgaagcccgggaatggaccaagaagttcaaggacctcttcggtgaggacttctacatcgagatccaggaccacgggctcaagttctctcgcggctggaacgaccgtagcctcgacgagcgcttggtgaagctcgctcatgagctcgatatcaaagttgttgccaccaacgatatccactacctgacacgtgaggatgcctccactcaggacatcctctcctgcattgggaagaacaccacgatcaacgactcctcccgcatgcggatggagggcgctgagttctacctcaagagtgaagaggagatgcgtaagctcttcgactgggtaccgcaggcctgcgacaatacgctcgaggttgccgacaagtgcaactatgagctcgactggacgcacatgtacctgccgcagttcccaggtctgaagccaggggagaccgccgagcagcgcttccgtgcggagtgcgagaagggtctggcacgccgttacggcaaagactggaagcacgtcacgatcaatggcatcaacgtcgaggaccgctacgagcatgaagccggcatcattatcgacaaaggctttgcgaactacttcctgatcgttcaggactatgtccagtgggccaaggaccatgggatcggcgtcgggccaggccgtggctctgccgccggcgctatcgtcgcctacgcgatgaacatcacgaacttcgatccgttggagaacggtctgatgttcgagcggttcctatccccgcagcgtaccgagatgcctgatatcgatatggacttcgacgatgagcacctgcaggatgtcctgcagcacgtgcgtgacgtctacggtgaggaccgcgtctgtaaggtcatcacctactccaccatcaaggcgaagcaggctatcaacgatgcggcccgtgtattgggcttcccggtctacgtgggacagcggctctcaaagatgctctccaacgacgcgagcctgaagctcaagaatgcgctgcacaagaatccggataggccggaccagtactctccggactttgaggaagcctacaacaaggatgcggacgccaagtccattatcgacgctgccatgtctatcgagggcctgactcgtggcgagggtgtacacgcctgcgcaaccctgatcgctccaaccccggtcaccgatcatgtgcctaccaagctggataccaagggcaacgtcacgatcacccagtacgaaggccattcggtcgcagacatgggtctgctgaagatggacttcctgggcttgagaaccctcaccgttatcaacaaagccctacagaatatcaagcgcagctattcgaacgcctccgatatcgcgcggatgcctaagcaggtgaaaaagaccattaaaccaggtgccacctgtgtcgatatcgatatggacaaagtcgactttacggaccctgcgatctataggctcttaagtgaaggcaagaccgccggcgtcttccaggtcgagtccgcgggcatgaccgccacgatcaagcagatgcagccgaccgaatacaagcacatcgtcgcactgatcgccctctaccgtccgggtcctctaggcgccggtatggtcacgagctacatcaagcgtatgcacggcgaagagccggttgtctactacgatgaccgcctcaaagacatcctggaagagacttacggaaccatggtctaccaggaacaggtcatgcagatctcgatgaagatgtgcggctttaccccgggcgagtcagatagccgtatccgtaagccggtggctaagaaaaagatcaagatgctcacgagccaggtcttccactgggaggccacaggcgccgatgagaccatatacgaccactggatgaacggcgcggtcaagaacggctacaagaaggagattgcccagaagatctgggacgatgtcttggagttcgcctcctacgccttcaacaagtcgcactccgccggttatgccattctcgttatgcagaccgcctggctcaaggctcacttcccgaaggagtacatggcctccgtcctctcctcctacatggggaagaccgacaagatcgtgcactatgtctccgcctgtcgccacgagggcatcaacatcctgcctccggatatcaacgagtccggccgtgacttcaccgccaccaaggacggtatccgcttcggcttcgcgggcatccgcggcgtgggcgagtcagtgggcgagaccatcatggctgaacgtacaaagagcggtcccttcaagacggtccacgacttcgtggaccgcgtggacgcctcacaggcgaaccgccgcgtcgtcgaggcgctgatcaagagcggggccttcgatttcacgggctacacgagaaaacagatgatgcacttcgtggacaagaacaatgcgcgcaacattatcgagtccgctgccaagcgccagagggaccgtgcccaggggcaagtctccttcttcgacctcttgggtgacgtcttggattccggctttgaggataagatccccgcgccggacggtatcgagtgggatcggcgtaccaagctcgcccaggagcatgaggtgcttggcatctacgtctccgaccacccactgcgtccgtatgaatacgcgctctccaaggctcgggactacaagatctccgatatctcagcgaccgaggatgccgtcgatccggtgagcggcgcgaccgtcgcccgacacgttatcccggacggcaaagtggtccggctggcgggcatgatgagcgggatcgataagaagaccaccaagaccggcaaggcaatggcaatcgtgcagcttgcggacatggaaggggagaccaccgtcgtggtattcccgaagctctatgagacgtgtcaggctgcgctgtgtggcgagatcgacgagcagaccggtgagaccatcggcgatgtctttctgaaggtccggggcaagcttgagcgctccgatcgcggcgaccagatcatcgcggagagcgtggagcctctgatcctcaacagtgagaccaatacgccgaaggtgctggaggtcaatcttgcctctgatatgctcagcgcagggcacatggagcaactggactccgttttcaaccgctatcccggcctcgactacgtcgagcttaggattgagggagccaactcaggcgacctgacctgcttcgagctgccgactaaagtcgacgcgcacaacatggtgttgatcgcggaagtcagcgacgtcgtgggtaagcacgggaaagtcgttgtagcctaactaataaaatttagttttgattgatacggagacacttcaaacgggtacagaaaatattggacggagaaaacccgtttgagagagaggtatggattatgagtgagacaacattttatctgtgtaaggactgcggtaacctggtagcgctgctgcatcgcggaagctgcaccccgcagtgctgcggcaagccgatggttgagcttaaagccaacagtaccgacgcggcacaggagaagcatgttccgatctgcacccgcaagggtgacaccgtcgaggttcaggtcggcagcactctccatccgatggaggagaagcaccacatcatgtggatcgcgctctcacagcgcggacgcctcgatgttcggttcctccatccgggcgaagagccgaaggcggtctttgagcatgttgcagacagcggcgcgaccgtttatgcttattgcaatttgcacggactctggaaagccgaactgtaacgttgtctgacaaccacagcaagtagtatgtacgcgagactcgaccaaatgcaaagcgggtctcgctctttttgtgaagtggagcaggatgaaagtatcaatcgcgcagattgccacggtggcgggggattttgaggatacggtcggcaagatggtccgctatgcaaagcaggcttgcgcacagggcagcaagctgatcgtctacccctatgcgaccctgaccggctcacagtcacagttcttcgatgaagcagtctcggagcatttcctggacgatgcggtgcacgcactttacgatttctcccaacagatcaagcacttagagatcgccgctttagtgccgctcagctatcagactgagagcagcctgatcaccgacgcagtgctggtacaccacggagatctgaccccgatccgctcagcctgcctggcgcgtgccatgcagcagctgaccgaggacaaggacagcgacagtgaggatgactactatctctcggataacggggtcgcgatctttacggtcgacggtgcgcgctgcggggttgtcttcactgtcgatgagatggatcagcatctggataccgatgagaaactcgacatgctcatctttatcccgtttgacagctttatctattcggatgccaacgcgcagctcgcggtaggtctcggcgcaaatgattactttgaggaggtggatacccttgggtaccccatggtctgtgcctccggcgtgggcggctatggggaggatatcttcccgggctcctcgttcatcatcgccccacaccagaccgtgatcagcatcggtcccttcttagaggaggcgctcgtcaccggtgagaccgcgcagacagagtcgttgccgtcccacctgacctgggagatcggggctccggttgagccgatgctctacgatgcgctcgtcacggggaccactgacctggtacgtcagcagggctttgagaccgtcgccgtgcgtgtggatggctctttggcctcgcttctgctggtgtgtctggcggtggacgcggtcgggcccctcaacgtgcgggcactggtctgcagcgatgaccctgagactaaatcggtgatcacaaatctgcgggtggatgcccggactcccgacttcagactgccgattccgcagccccatgcctgggcacgctacaccgacgagctcctgcagtcagtgcaggaggcgtttctggcggagttggcgcgtgagaatgactccctgatcctgctggctgacgataagacctcgctggcactcggcaaaggctcgacgctgcgttacccctacctgtgggcccccttcggtgatctctttatgaatgaggtgctcaacctcgctcagaccagaaacgagatgtccccggtgatcccgcaggcgtgctttgggcgctatggctgtccatggctcgatgggttcgagtcactcggggcgaatgaccgggagcggctggagcaatttgactcgatcctgcttatgagggttgaattgggtatggacttcgaggagatctcctcttactttgaggatccctccgtggtgcgaggagtcctcgacctgcttgatcaggcaacgatggcgcacttcacggtgccgccgacctttgcgctgtctgaccggatgctgcgcgactatgcgagctcgctgggggttgcctggcacgaccacgcccgtaagaaccagggtacactcgatatccagtccctgttgaagaaggttatcgacgcgatcaatgaagatgactccggcagacagagaccactcaacgagatgaaggccttccaggatgccctcgatatgatccgcgacatgtccgagcgccaggacgacgagagggaagatcaggacaacgggaatgacaacggcgtagatatcgatctgggcaacggactcaatttccgcaccgggctctccggttgggagaatcccttctctgaaaattagttgtcagatccggcgtgtgctagtatgggtaatctagaacgattgttcgggggatctatggtcatcatcggaatcgatcccggcctggcgcacaccggctggggcatcattgagacgcggggatcagagtaccacgcacgggcctatggctgcatcataacgaaggcggatacgcccttggtcgagcgcctcggcaaaatctatcaggacctcaacgatgtgatcatccagtttgagccatcggagctctcgatcgagaagatcttcttcggtgagaattctcgctccgcgatcgtcaccgcgcactcccgtggagcggcgctcgttgccgcagcggagaagaacctgaaggtcggggagtacaccccgatgcagatcaagcaggcggtcgtggggaccggctccgcagataagcaccaggtgatattcatggtgaggaatattctgcacatggaccatgacccgcacccggaccactgtgccgatgcgcttgcggcagcgatctgccatgcgaacctgaggcgcacccagaacagttcccgctacgcgaacggcaaccgcaagaccgcagcggcggtgcgggcagcggagcttgcacaggaagagtggcggcgcaagcagaaggcgagcgagaccgcgcctgcgacggcagcgcgccttgagaagatgaagagagagagcggtatatacgatgatcgtacagctcacaggaaccttgatagagggtacatcgacccatatcgtgcttgacgtcgggggcgtcggctatgagctcggggtctcctcgaataccgctgccgagctcccgcaggtgggggaagccggcgtcaccgtctacacccgcctgattacgggacaggattcgcttcggctatacggctttgcgacgactgaggagcgggcgctctttgatcacctgatcacgatccccaaggtggggccgaaggttgcactctcggtactctccacctataccccggaggcgctcgccacgattgtggcggatgaggacaccaagcggatgtcgcgggtgccaggggtcggcagcaagaccgcacagcgcatggtgctcgagctgcagggcgtctttgcgaaggatgcggagttgagccacctgggtaaacagctccatggctcaggctccgatgccgaacagcccacccagggcagcactgccgcggtgatggacgaggtgaaacaggcacttttgtctatggggttcacctcacgggaaatcgagcttgtgctcaatggatacgatacgaacggagaggcgtccgccaaagatgccctttcctatgcgctaaagagattgggaggacatatctaaatgtggcaagcatctgaagacgatctttttagcgacagccctgaggcggatcacgccaaacgtgcgcgtgaagtgggcggtgagctcactgaggatgacctcgacgtcgaccgtaccctgaggccgaagacccttgatgactatatcgggcaggaacgcgtctgtgacaacttgcgcgtgctgattgccgctgcgaagaagcgcggtgaacctttggaccatgtgatcttctccggtcctccgggactgggcaaaaccaccctggccaacgtcttggctaacgagatgggtgccaagatccacacgacgagcggacccgcgattgagcgcaccggcgatctggcagccgtcctcacgaatctggaagagggtgacatcctcttcgtcgatgagatccaccggctcaaccaccaagtggaagaggtgctctatcctgcgatggaggacttcttcctggatatcgtaatcggcaagggcccggctgcccgctccatccgtctcgatattcccaaattcacgctggtaggcgcaacgacgcgtaccggcctgctgaccggcccattgcgtgaccgcttcggtatctcctaccggctcgattactacacgattccggagctcacacagatcgtcaaacgctccgcctctattctgggtgttgaatgtgacgaccaagccgctgcagagatcgcctcacgcagccgcggtacgccgcgtctggcaaaccgcctgctcaagcgcgtgagggattacgctgaggtgaaatcgaccggcgtgattacggtcgacgtcgcgcagagagcgctctccttctttgagatcgatgagctggggcttgactggatggacgtgaagatcctgaaggctctgacccagacctttaggggccgtccggtgggcctcaccacgattgcgagcgcggtcagcgaagatccggagactatcgaggatgtctatgagccatatttgctacagtgtggtttgatgattcggacaccccagggcagaaaagcgacccgtgccgcctttgatcacctgggactcgtcccaccgagcgactcttaggggagacacaatgcttcagcatgactatatcttgatgctggttacccagtttgtgcaagcgatttccgatgcgatgatccacgcctaccaacaccaggacatgagatcgatcaagcaggtggagcaagccatcggagacctgctacagcttgacccggacaccgccctgatgctcaccccggagtcattggtgacgatgatgaatctgtctgggatcggggacacggtggcaggctatgcggcttatgctctgaacaagctttcgagtctctatgagcgccgtggggatacgggcctggcggatacccgtatccgccaggcccgtgccgtggctgtggccttcggctgggacctgtctgaggttcctgaggccctgaaggatctggacaaacagatctcctaaatactgcactctgcagacgctgaaatacaatttctcaccgctgacagggtgcggatatattttcctgagggaagggcatagtaataaagataccgacacgagaaggagggaaaggcaccgatggcaacatacgttgtttctgatatccacgggcgcctgaaaaccttcgatcggcttcttgataaggtttcgcccgctgaggaagataagatctttgtgttaggtgacatggtcgaccgtggaccggatccggctggcgtcatgcggctgtgccgctcattttccaatgcgaccgtgctcgtgggcaaccacgaaatgctgatgctcgatttcttccagcatccgcacaatcctacctcgacgctcaactgggcgatcaatgggggactgacgaccgcaaaggatctggcgaagctcccgcaagatgagaggactgagctccttgaatgggttgagaacctcccgcggtttgcgctcaccaagatcggggaccagcagtatgtcttggtacacgccggtatctactccgatctgctgccggaaaatgcgcgtgacaacctgcagctggctatgatgcaacaggatcaggaagaacttgtgtgggttcgtgagggctacctcgaccgtccgaccggtttggtggacaaagaggggaagggccctattatcgtcgcaggccacaccccgacggtcttggcggagaccctggcggatgtctgtgaccgtgaggcgctcaatgaggatcagcgctgccagatgctttcgcttggtgctacccctgaaaccggtatggtggcagaccggtgggtcatcgactgcggggcaggatccgttcctgatcatggcaggctcctgatgctgcgcttggacgacaagcatgaggtctatgagaatgtacttgaagaagactgagcgggtcatccatccgcttgatcccattgtcgacactgactcgcgtatcctgatcctaggaagccttccctcaccgagatctcgcgaacagaagatgtattacggcaatcttcgcaatcggttttgggcggtattggcggcactgtggaatgaaccattacctactgacaatgacgcaaaaattgccttctgctatacccatcacgtagcgctctgggatgtgatccattcctgccaaatccatggggcctcagatgcgagcatcaaggatgttgaacccaacgatgtcgcagcgctgctgaagcaggcaccgatcactacgatcttcacgactggcggagccgcacagcgtctctaccatcggtaccttgagaggagctgtggtatgaaagcggttgcgcttccttctaccagtcccgccaatgcgcgctaccggctcgatgatcttattgcggcatatcggccggttcgctcagctgcagaggcagacacggtactatagagcaatcaggcagaggagtttcacaacgtctacgtgcgaaaaaggagatgagcgatgagccttcaagagatgttgaacgacgcagaggcccgcccattacttttgtcggttgacgcagaaaactttctcaaaggtacactgcggacagagcaggaaacgcagggctatgtccgtccctggcgtatgagcgatcggcaataccgctcactgggaagtgtgggcgcctggcacccgggattctaccggcagatggcacagtgtacctgtgggatcgctctagcctttacaaccgatgcgacccgtatcggactcgaggtgtgcttcgacgaggagcctttagcgactcggacaatgttgcgtgagactgatggggagagcccacaaccacccgacggaatcagctgcatcgtcgacgggaagcgccttgtctgcgctccggcacaggcgggcgagcagtttgtcgagtggtacatcgataacgatcccaaacatccgacctggcagcgcttgcccggtttcgggccgacccacacggtgtggctctggttgccttgcctgcgcggctgtgcggtgcggaggctttggggcaccgctacctttttcaaaccgctgaagcagcaagacttgctgctcgtggtgggcgatgaagcctcacagggctttgggggtgaagagccagcggatggctggccggtcgcctatgcgatgcataaccacctcgatctcgtgaatcaaagcattgcgcgacaggtcttccagtcggattttctgctggataccgcaggcctgcgcgatccggcgatgattgtggtggcggtaggagaacaatatcgcaaggaagcctattccacagagcggctcagacaggatgggcgacagttcttcggcgtggtgcagagacgttggcctgatgcccagacactgttgatcgtaccgcacacggcaggcaatgagaactatccggtagcaccccgcagtcccttcccgaagcttgagaccatttaccacagcgttgcccgtgagttcggtgtacgctgcatcgagggacgtcagctcgtggatcctcatgtcggtgtccaacagggaactgaggggtatccgaatgcggaaggcttctcgcagatcgcgcggcgattggcacttgtagtgcagccgcgtgaggatcaggccgtcttgcgccaacgtgccaagaagctgctgcggcaggtgcctgattatgcgttcccgctgaaggcagcgaccaagatagagcgtgcccagtggctctttgtgaaaaagggagcctgcctggtgaagttctcctcagggcttcagatgctctatgctccggatcatgaacagggacaggatgtagctgcgctgttctcaaaccgcagagcactagcggtacagggtgaagcgatgaaagagtgggtgagcaccgagctgggcctcactcacgcgcaaccctaccatgtggcgatctacaaagggaaacgcaagatttcggtcccggagcgctaccacatcgaaacgctgccggcagcaacgctcgacgagcttctgaagcgttatcccaatatggatacctccacggtagacgatctggacacccaaaacgaggcgggcaccttctttgggggctttgtctgtgacaaactggtcggcttcatcggaacgcatgaggaaggctgcatcggctctcttgaagtgatgccggcgtaccggcgccgtgggtgggcgtttgcgctcgaggcgaccctggtcaaccatctgatcgataagggtatcgagccctggtgtccggtctatcctgaatcgaccgcgacgctgcggctgctttcgaaactgggctttgaaattacccctgcgacacaggagtgttacctgtgcacgcgagattgagacgtgagggaggatcgatgagcgatcatatcaaccgcttggctcctgacataccacagaccttgactcctgaggtggaggagggtgtgcgcgagatgctgcgcacgcatcagatgaacccgtatgccacccgtgacggggactgcattcgccgggtggattccccacaggacaaagggacgccgctgcgtccggcattcctgcacgacatcgagaagatcatccatctgccggcttacaaccggatgaacggcaagacgcaggtgtttgcttttgtggaaaacgacgacctgacgcgccggggcctgcacgtgcagctggttgcgcgcaccgctcgcgatatcgggcgggcgttgggcctcaacctggatctgattgaagcgatcgggctttcccacgacctcggacatacccccttcggtcacgccggtgagcacttcttgaacgatatctaccacgagcggaccggacgctggttcatgcacaatgtccagagtgtgcgggtcatggacgtcctctatggacgcaaccttgccctgcagaccctcgatggggcgctctgccacaacggggagttcgagcgacagaagctcaagatgagcgggctcacttcgttcgaggagttcgatgaaattgtcgaacgctgctggaacgaagggccgaagctcgtgaagacgttgcggccgatgacggcagaggggtgtgtcgtgcgcctctcggatattatcgcctacgtcggcaaggatcgacaggacgcgatccgggtcgggttggtcaatgaggacaccttcgacgacgggctggggagcgcctacaatgcctgggcgctacggacctttatcgcggatatcgtgaacaacagcttcgggaagccccagatctgcatgagtgaagagggcttccacgagctctcacgggctaagtcggagaaccttcagaagatcgagatgcggcgtgaggttgacgggcgcttctccgatcaggtccgtgacctgttccacaagctctatatgcaggagctggatgtgctgcagcgtggggatacgagtggctcgatcttcagacaccacatcgagccactcacccgggagctctccttctatgggaggacctacgactggcagcgtgactttgaccaaaccgtcgtggactacatcagctccatgaccgacaactactttattgcaagctgcgagcgcctcttcccagagacaacagagctcttccagcgccgcagctacttccatgatctgtaaggcttcgagaaggtggagatggacacactgttttccgcgcaggagcgggaaaggaatttcaaacgcttacccttggcggtccgcatgcggccgcgcacactcgaggagtatgccggacagcaggaggccgtcggtgagggctcgtggctgcggatggcgatcgagcacgatgtgttgacctccgtgatactctacgggcctgcgggtaccggtaagacgagcctcgctcacgttatcgcccacaccacccacgcggagttcgtggaggtgtccgcggtgagcggcaccgtcaaagacttgcgtcacgaaattgaggaagccaagcgccgctggctcacccaggagagacgcaccatcctctttgtcgacgagatccaccgtttctcccgctcccagcaggatgccttattacatgccgttgaagacaggaccgtagtcctgatcggagccaccacggagaacccgtacttcgaagtgaactctgcgctgctctcacgctcacgggtcgtggagctgcatccgctggaggacaaagacatcgagcagatcattgatcgggcgttgactgtctcctatgggctcgaccacaagtaccaggtggatgaggaaaccaagaaggagattgtgaccctggcgggcggggatgcccgcagcgccctgacgacgttggagcttgcagctcagatcgcccagacggggcatgagaaggcaaaggacgagacccagggacccttaaccatcacgaagcagatggttaaggaagccaacccacgcccgggccttgcctacgacaaggcgggggacatgcactacgacattatctccgccttcatcaagtcaatgcgcgggtctgacccggatgccacgatctactggctagcccgaatggtcgacgcaggggaggaccctaaattcatcgctcgacgtatcatgatctgtgcctcagaggatatcgggaatgcggatccgaatgcgatcctcgtggcagcagctgcctttcgggcggtggaggtgatcggctatccggagtgccagatcaacctcgcacaggcagcactctacaacgccttggcccccaagtcgaatgccgcagtgtcggcgatctattcagccgtgcacgaagtgagggaagggccacggcgggaagtgcccaaccacctgcgggatcggcaccgtccggggtcggaaaactatggggagtataagtatccccacgattaccccacaggctgggtacaccaacagtatctgccggatgggctcaagaagggtgacttctatcgtccccgccggggttgggagagctggatcgtcgaagcgaatgcgcgagaccgcagcgagggaccctctaccaaacctgataaataggttaaactggcagaagtagtgttggtatctatctcctgaaatgcggagggcacaaatgagtgtgacacaggttttggttgcgatcctgattgctgtcgctatatgggcagtcgctgagctcgctattatgttcagaaagacgcgcaagtcgatcgacgaggtgacgcgttcggccaatgaggcgatcgaccaagtgaagccgatcatcacgaaggctgacggcatcgtcgacgatctgcagccgtcagtcaagcaggtcgatcccattctgcggaaggctcaggtgactgtcgatgaggccaaccagagcctgcagaaagtgaacggcatcctggatgatgtctcaagcgtgtccgacaccgcagccaatgtgaccggcgcagtctccacaggtgtcgcaaaggtcgccgaaggggcggcaaacgccaccgcacgtttagcctcacgcatctctggaaagccggcaccgcaggcccgcgagctagaggacggtactgcaaaggagactgagtcaaagcttgaggatgctccttcagacggttacgtcgtgtactccggaaccaaggctgaggagaaaccggctgacagtaaggctgaggagaaaccagccaagagcgatgctgacgatactgagaaaaggggagcgtaggatctcatgcaagaagaatcagtcgtgatctgcgtgccgcccaaggcggacttcgcacgctcagtcagaatgctcgccgcaaacctgggcgtcgtatgtgcgctcagtgtcgacgatatcgaggacctgagaatggccgccgaggaaggcttcgtctatacctgcgctaccaaccccgaaaccgtcaccgtgcatttcacgctctccgacggcgaagtcgcaatcgactacagcctaggcagcacgaaggtaggcgtgcccgatcaggacgaggacgataactcgttggcgtatgccgatctgctgctctccgcgatctgtgatgagcaccatatcgatgaaacaaacaacactctgcacctcgtaaaacatgttggggctacaaatgcctaaagaaggaaatgaatcatcaacgaaagaggccgcgccgaagaaggataccgcgaaggaggcccgcaaagccgcgcgttcaaagtcacgcggacgcgggaaacttgcatgggacaaacggcgtacccgtgagctgtttcaccgctataaggatctgggcgacatggatgcccgccagcagctcatcgtctcccacctcaatctggtgggatttctggcctcacgctttaagaaccgcggagaaccgcttgacgatctgatccaggtcggtacgatcggcctgatcaaagcgatcgaccgcttcgacccgagccgcgggcttgagttcacgacctatgcgacgccgacgatcttaggcgagatcaagcgtcactttcgcgataagggatggtccgtcagggttccgagaaggcttcaggagctctccgctaaggtgaacaagacaactgacgagctcaccaatgagctgcagcgcagcccctcggtggaggaaattgccaaacgcctcaatgtctcggtcgacgaggtcttggaggccatggagtcaagcagcgcttacagctcaattccactggaggccggtggcttcaatggggacgacgatgcgccttccgtgcttgatcactacgcctcagaagatgaaaatcttgcgttttctgatgatcgtatggtgattgaggatgcgatcaaggacttttcgccgcgtgagcagcaggtcatctgcatgcgcttcctcgatggattgacgcaggtagagatcgcccacaagctggggatctcacaggtccaggtgtcacgcctgctgcgtcggaccctcaagaagattcaggaaaagatagatccgaatagcgtgaagcgctcataggcgctagaccctgctactatcagagggtcttcaataacgcttttgggggatcgtgacagatcaggattcaacatatagaagcgcccgcaaggcggcgatggcagcgggggcgatcgttgcctgctgtgtcgcgcttatccctgtggtgcgcgtgttgggcttaactgagctcgccttaggactgtcattgtccggtgtggtgatagggttcttgtgcagtccgatcgccaactggcttgaggaccatgggatgggccgggccttagcggcttttgccgtcctcgtggcccttcttgccacccttatccttgttggggtgcggatcatcccgcccctcctggagcagttgatccacttgctccagagcatcccgggccatatctctagggtccagaccgactgcaccaatctcgctgagcaggcagggcttgccgacaatgggcacgcagaggatgcgctcaatcagatcatttcgggcttgttctcatccgagaatgcgatggataagatctcatcggatttgttcaataacgctgccgactttgtaaacaacactgtggccttttccctagggttggttctggtctattggtttgccaaggactatccggccatagcgcaggaggcggtcacgctcgtgggggagaagcagagagattccgcatccctcatgctggcagtaatgtcgcgctcgatgctcatcacttcagggggcgacggcgtgctctgcggcgtgggtcttgcgctcttcggacatccctatgcaggttttgtcggggccttctgcggattggcgcacttcgtgccggtgatcgggcctctggtttcctgcgccatcgcagtactcttggcgctctttgagtcgcccgcgcttgcaatctggttcatcactgtggtcgttgcgcagaatgtaaccgataacctggtgtcgccgttggtaatgcagtcggcggtcaaggtacatccggtgctttccctcgtcggcatcattgtcgacaacgccttgggcggtatcgtggggatgatactggcgattccgttaacggctgcagtcgtctattatgttgagacgcggaccggacagcagcccgtctcctatgacggggcgatcttcaaagggacgccgtatcacgacccggagggcaatattgtgccttccttcgatgtgctggacgacgataaattcttccagactacctggctgatacagatcgacaacgtgaatgcgcattccgtgcaccggcacatgctggcgcaggcggggcatgcgctgagagagactggcttcctgcggagggaagaagcatgaacgtttggagtgtcatggcacagagcgactataagacgatgacaacgtcggagatccgcgaggatttcctcactttttttgagagcaagggctgcaagctctacccttcatcctcactgattccggatgatccttcgctacttctggccaacgctggcatgaaccagttcaaggaatactatcagggcaccaagacgatgaaggaaatcggtgcctgctcctgccagaagtgcctgcgcaccaacgatatcgacaacatcggcgatgcccgccatctctctttctttgagatgctgggcaacttctccttcggcggctacaccaaggccgacgcaattgcgtgggcctatgagttcatcaccgcgccggagcacctgggactccctaaggaccgtctctacatgaccgtctataaggacgatgaggaggccgtcaggctctgggaaaagcagggcgtggcacctgaccacatctcccgcctgggcgctggggacaacttctgggcagctggcccgaccggcccatgcggcccctgctctgagatctatttcgatcagggctcggagtttgagggtgagaagccgggtgatgatggggaccgctaccttgagttctggaacctcgtcttcacgcagtatgaccgccagctggacggctcgatgcccgacctgccgcaccgcaacatcgataccggcatgggtctcgagcgtatcgctgcgatcatgcagcacaagagctcaaactacgagggcgacgtgatgcgttcgctcatcgctctgggcgagaaactctccggcgtggaatacaagggaagctcacacctggcgagtgacaagagtctgcgtatcttggcagaccactcccgcgcggtgacctttatgatcgccgacggcatcctgccctccaacgagggacgcggctacgtgctgcgccgtctgctgcgccgtgcggtctaccatggccgcctgctgggcatcaagaagggtttcctgaccacctacgcccacgaggttgagcgtattatgggcggggtctacccggagctcgacgagaacaaagccctgatcgacggtatcatctccgccgaggagttccggttcggcaatacccttgaggccgggcagagcatgctcgaggacgagttggacaagctctctgagggcgagaagctctccggtgaggtcgccttcaagctccatgacacctatggcttcccgatcgatctgacccgcgagatcgctgagcagaagggccatgttgtcgatatgggcgccttccagaaggcgatggatgcccagaaagagcgtgcccgcaagagtgcaaaccgcaatgcctggggccacgcgaataatgtctggaccgccctctctgataaactggagaagactgaatttaccggctacgaggatgacaccctcaagggcgccaaggttgtggcgctcgtcgctggcggtcaggaagtcaagtcggtcgaggccggggagggcgtcgaggttgtcctcgacaagaccccgttctacgccgagatgggcggccaggtcggtgataccggagagctacagggcatgaccgcaaagctgcgcgtcaccgatacgagggggcaccacggcatcgtcgctcatgtggcgaaagtcatcgaaggtgcgctcagcgtcggggatactcttgacgcagctgtcgaccacggacgccgtgagctgatccggcgcaaccacaccgcgacacaccttctcgatgccgcactgaagcaggttctgggtgaccatgtgaaccaggctggttccctcgttgagccgaaccgcctgcgctttgacttcgcgcactttgagccgctcacgaaagatcagatcgagcgcgtcgaaggcctcgtcaatgcggagatctttgcggcggaaccgatcgtgaccgaagagatgggcctcgaagaggcaaaggcctgcggtgcagtggcgctcttcggtgagaagtacggcaaggtcgtccgcgtcgtttcaaccggcacctcagacaagccgttctcccgtgagctgtgcggcggcacccatgcgcgcaacacctcagagcttggcttctttaagattgtctccgagagctccgtgggttccaatgtccgacgtattgaggcggttacctccgcaggtgcgctcgagtacgtcgacgagcatctgggtgccctgaatgaggtcacctctgagctcaagtgccgtccggaagaggctccggagcgtgtccaaacactgcagggcgagcttcgagatgcaaagaaccgcatcgaagatctgatgtatggcagctcctccgatcaggttgaggcggcggtcaagaacgcggtgcccctcaacggctaccagtgcgtctttgccaagctgcggaacctgagcggcagggagctgcgctccgcctgggatgcgatccgcgattccttcggtggcaaaccctgcgcctgcgtagtggcctgtgccggtgcaaacggaaaggtgagcctgcttgcggccggtagtgagactgccgtcaagaacggcttcaatgccggtgcggtgatcaagcagatcgccgacaaggtcgacggccgcggaggtggcagaccggcgatggcacaggcaggcggcaaggatgcctctggcatcgatgacgccctgaaggcggcacaggagttcttggcgtgagggcgatggcgctcgatatcggagaagtgagaatcggggtagccctgagcgatacgacagggtcacttgcctctccgctcacggttctgcctgtccaggaagtgctgagcaacgctaagagttttcggcggatcctcgaggattgggagcctgacatcctggtcatcgggcgcccgaagacgatggcaggggaggatggtccccaagcgcagcgaattatggagcaggcgcgtcagatcgccgacgcgtgtcagctcccgttgacttttcaggacgaacggttgtcctcacaggaggcgaaacggattctgcacaagcagggactgtccgagaagaaaatgcgcggcaaggtcgacgcagttgcagcgtcacttttcctgcagacctggctcgaccgtcaaaaaaatgaagtaaataaataaaaatgaattaaaaacataatatttgaattttgtcaaccaatattaggcgagcgcttatcgtacagaaatattttactgagcactatttttgtgagatcccacataggagctaataaagtagagtccttgtcgactaagtggacgaacttgtgaatccgtcaaaggtttgcaggttcgttttttatgttaaggatttataatgtcttgatgtaaatagcatggtggttttgtcatgaatgtagacagacgctgtggttttacggttctgtcggcagcgtgaagaagagttaggaggaagttgaatggttggaatcatcctagcaagccatggcaaatttgccgagggcatcaaacagtcgggacagatgatcttcggcccgcagaaagatgtagcggccgtcgttctgacccccgatatgggcccagatgacatgcacaaaaaattgcttgatgccattgccaccttcagcgatcaagagcacgtcctgttcttggtcgacctgtggggcggcacaccgttcaatcaggtttcccacatcctcgacgaggagaagcatgacgattgggttgctatcaccggcctcaatttgccgatgcttgtcagtgcgtatggttcccgcatgggcgccgatacggccgtcgacgtgatgaaggaaatcttccaagagtccaaagacgggatcaaggttaaacctgagtccttagagcccaagaagagcgagaaggctgcgcctaagcaggcagcagtggcaccgcggggcgctatccctgaaggcaccgtcctgggcaccggtcacatcaactacgcctatgtgcgtatcgatacccgtctactccatgggcaggtcgcaacggcttggactaaggaggtcagcccggaccgcatcattgtcgtctctgacaacgtcgctcacgatgagctcagaaagacgatgatcgttcaggcagcgcctccaggagttcacgtccatgtcatcccaaccaagaagctcattgaggttgacaaggatccgcgctttggtgccaccaaggcaatgcttctcttcgagaatcctcaggatctgctcgaggtagaaaagggcggtgtgaagttccctgaggtgtgtatcggttctatggcgcactccgcaggcaagacggtcatcaatgaggccatcgcctgtgatgagaacgacgtgaagaccctcgaggcaattcgggacaatggcacgcacctgtactgccagaaagttccgactgatcatgtcgaagatatttggaaactactcgccgagaagaacatggtgtaaggaggatctttatgtcgcctattacgatattacttatttttatcgtggccttctttgcaggcatggaaggtatcttggatgaatgggaattccatcagccactgatcgcctgcaccctgatcggcctcgtatccgggcacctcgacgccggcattatgctgggcggctcactgcagatgatcgcccttggctgggcaaacatcggcgccgcagtcgcacctgatgctgcactcgcatccgtcgcatccgcaatcatcatggtgatcgcactgaacggcggtaccaatcagcagaccgcaatcacgacctccattgccgtggctgtgcctctgtccgtcgcaggcctgttcctgaccatgatcgtccgtacgatcgcgaccgctatcgtccacgcaatggacgcctgtgcggagcgcgacgatatgaacggcatcgaccgttggcagatcttcgctatctgcctgcagggccttcgtatcgcaatcccggcacttgccctgtgcttcattccttccgaggcagtcaccgcagcactggatgcaatgcctgcttggctgaccggtggtatggcagtcggcggtggcatggtcgctgcagtcggctactgcatggttatcaacatgatggctaccaaagaggtctggccgttctttgctctgggcttcgtccttgcagcactgtctgagctgaccctgatcgctctcggtatcatcggcctgtccctggcgcttatctacctgggtctcaagcagtatgccagggagcagggtggctccgcagccgcaggctccggcgatccactcggtgacatcctggacaactactaagggaagaaggagtgtgaaaatctatggcagaaacaactgatacccagcaggcaaaggataccaacaagattaagctttcgcttaagacccgtcgtcaggtattcaaccgccaccagtacctgcagggctcttggaactacgaacgtatgcagaacggtggttggtgctacgcaatgatcccggcgatcaaagcgctctacaaggatcctgaggatcagaaggcagcgctgaagcgccacctcgagttttataacacccacccgtacctctccgctcctgtcatcggcgtcaccctcgcaatggaggaggagcgcgctaacggtgctccgatcgacgatgtcgctattcagggcgttaaggtcggtatgatgggacctctggccggcgtcggtgacccagtcttctggtacaccgttcgtcctattctgggcgctctcggtgcatcgctcgcactgtccggctccatcatgggcccgatcctgttcttcgtgctctggaacgtcattcgcctgctgttcctctggtacacgcaggagttcggttacaacctgggcacctcaatcacgaaggatctctcgggcggtatgctcggtcgtatcactgaaggtgcttccatcctcggtatgttcatcatcggtgccctggtcgagcgttgggttaccatcaacttcaccccggtcgtcgcgcagatcccgcagtccgcaggcgcctacatcgattggaatacgcttcctgccggagctgaaggtatcaagcaggcgctcactatgtatgattccatcggatccacggcactgtctccggttagaaccgtcaccctgcagcagaacctcgatcagttgatcccgggccttgctgcagttggcctgacgcttttgtgctgccagttgctgaagaagaaggtttctccgatcgttatcatcctctgcctcttcggcgttggtgttctcggtcgtttcttcggattcatgtaagcgaatcagatcggtacattgagtacaataaggtcgtgtcccaggcggggcgcggccttattttcgatatgaaagtgtttgtaagcatggcagaatcacagaactcagaggtggactacgcctgcaaggcgacttcgatgatggggttgtcgacctatggggacatcatggtgggcgacagagccctcgagttttacaacgagcgtaacccggaggactttatccagatcccctgggatcagatcgactacatctccgcttcggtcatctttaagaagcatatttcccgctgggcggtgttcacgaaagagaacggccactacaccttctcgacgcgggacaacaaagcgaccctgcgggcaatccgtgagcactttgacgctaacaagatgctcagatccccgagtttcttcgacgtggtgaaggaaggcctcatctttatcgtccaagccatctcaaagccttttaggcacacaaagcaggattctcagcaggattgatatttcggagaatgtaaatccgatattcaacttgccttaagctatgtgctcagtctccgctattttgtataacgtggaggaagccctcgtcttttgataaagacgagggctgtattttagataactgacatggtgtcgatcacgagaagataaggtcgtaatctgacagtcaagtaaatggagccggttcaggctgtcctgacagcccaggtgatacaatttcacatgtcaaatggagaatgtgccctggaggccacccggctctgtgtttggcgacggttttgccgggtggcctccagggcgaagcggaatcgtcaggatcatagtacgggagaatcccttccgtacccgcatcgcagaggtcgaagagcagaagatccgccagctggaggaggccacagccggtcgccgctgccgtaagcagacgggcttcgacaccttcgccgaggccacatccctgctgtccgtcatgtgggtccgcgcgcaccaagcgcgacggcctcgcgccaagtggcgcacagagattgggagtgcctcggctgcgggcgcaagtacagctcgcttacagggaccgtcttcgagcatgcccgctgcgagctggcgaaatgggtcccgccaatagtctttcgtactttttctccagctggggtcccgtctcggtagtcgaagctagccttcctgtctcttgagtacctccctctcatcccatccgtccagcaggtcggtgtcaaggtagcgcctggagccccagccgccctcggccacgtacttgcacctcgctgccgccagcttccccgcagcgtcttccgccgggaagctgcccacggcgtcggtgcgcctcttgatctgccggttcagccactcgatgccgttgttggtgcgtatcctccttcaagtgctcgggcgggaagagcacgtagctcagcgtctccttggcgcccctctcgatcacctcggcggcggactcgagcttggactccctgagctccgatgcgacctccctggccttggccaggcacttcgccctcgactgctgagcgtggatcgccttgagggacgccgcgacggccttgcggcgggtcctcggcaccttgtcaagcacgttgcggtagaagtggagcgtgcagtgctgctacatcgcgtgtaggaagacctcttggatggtgccgagcatgcctgcggacttgtcgccggtgaacatgcacatgcccgagaggccgcgctcacgcagcccgagcaggaacgacttccagctcttctttgactccacgtagccctccttacagccgatgacctcgcggtatcccctggcattgacgcctatggccacgagcacggccacgccctcgtaggcgccgccccagttcctcttcgcgtacgtgccgtcgaggtagacgtaagggtagtcctcctcgagcctgcggcatcgccactcgtcgacggcgccgaaggccttgcggttgagcttggagacggtggcgggcgagacgctcgatccccagaggatctctgagacctcctgtatccttttggtggagacgcccgccagctacatctccatcagcgcctgctcgaggaagctctcctgcctgtggtagcgctcgatcaccttcgatgcgaaggtcgcgcccctaagcttgggcatattcagtgtcacgtcccttgaggtcgtcgtcaggctgcgcctgcagtgccccgacctgtacgcctggcgcctgtcggtgcgctcgtagcgcccggcgttgacgatctggtcggcctcctcgtccagcaacgcattcagggcatcctcgaccgtctttctgacgagctctccgagatactcctgcagcttcggctcgtcgaatgatactatctcgtgtggcatggttccgtcccgttcagtccgttggtttgcttggttgcttccaatcgtaccgggacggggccatgcctttctacgcggctatccggttttcaaaagtgtgaaagaaactgtacgccatccagacacgctggtctgccggcctaagaggagatgaccaccatggagtgcaagcagaaagactggttcgggccgcagcgcttctatctcgggatagatgtcgggaggccatctcactgggcagtgggcctgaaaccgggtggcaccgacgcgatcagccgcaggcaggacaggtgccaggaggatgtcgaggctctgctcgacgaggcgggcactctggtcagcgtggaccagaagaacaacatcggcttacttatcgtgtacaggtggtgcgcgaaaaggatcgatgtcggataccttccggggaaggccatgaagtacgcctgtgagatgtttccctggaactgccaagagcgaccgaacagatgccgagtccatcgcgcagacgggcataggcggcaggacggccatcaggcccatggccgagaccgacgagctcagcacctgcgtctcgctggtgtccttacagctctcatatgccgcgagtggcgccggcccgcaacaggctccatgcggtgctgcttaagtccgatcctgccgccgagcccgcagcgacctctcgagcgcatggcagctcgcggccatggtcgaatgcggaggggcgaagggccttgccgcagcgggcaggaggcgctactgcacgctgtgcgccaagcacggagcctgcgcccgggcaagggatgccttctggaagctgtcccacgctcttcccctcctcgtccttccatcccgatgcaaaggacatgctggcaagcagcctggccagggagatccttgcggccagctctgagagggcaaagctctccgccgagctgggacgcctgctccaggacgataagacctaccgctgcctgctcaccatcttgggcatagggcctcagagtgcctcggtgctcgccacctcgatcgacacctcgctcttcctaagagacagcgagcttgttgcatactgtggcctcgtacccgcagaccatgactgcagatcctccataaagtcgcagaagagcgtccgtaaaggcaacaaggccctcaagaacctcctcatattcagctgcaactcgcttgtggggacgaagaagcgcttcgggaagcactacaatgcttggcaccgccaggggcatgaggcacagcaaggcgctcaaggcagtggcccgcaagaggctctgtgtcatctatgcaatgatgcgtgaccgggtaccgtacgtggagccgctggcgggcgatgtagaaaagtcacctgctatgacttgacagaactatagggacaccccctcctgtccatcgcaatcacgagacagataatggggtatttcacaacttctgacaatcaagataatgagggccgccagacctatgtcgagctgcggagacttgcatcggacatcatcatatggcggaccacccttgcagtctcgggtcacctgtcgcttacctggttgacaccgaacaggtagacgtatcaattgagatagcttttgcatgttggacatgggacatgcccgtgaagcgccagaggtatctcttgagccaggagcagaagttgttaacgagctccatgctctcaaggtattccgggtctcgggtatgattcggagactgctccggcatcgcgtatgacccagctgtgggcgcgctcccgctcgtgcacaacgagcgcgcctttggctatgtggccgccgaaggcgtccctgatccttctcgtggacggcttgccgtgtccgcagactacggcataggggttcttgaagacatctatcccggcagctatacagagctgctgggaggagaggccacgcttccttgcctggccatatccgtgcggaaggtccgtatccacgatgtaggtctcgtcgatccagatgcgcttcttaaggacgatgcggtcctgatagccatcccacggtgataaacacccggtgctgccactcccaggcgctctggtgagatatctggagcgtctcggcgatacagtccaggggcacgttgtagcgcatgagccggatgggcgacacccatttcgggatgacgtacagtttctttcgcacttctgagaaccggatagccgcatagagaaacatggccccgtctcgctacgattggaagcgaccaagcaaaccaacggaccaaaggaagggtggattagcattctaagtgcaacacaatgacccactggatgcaagcgtggcacactccggaaggctacgatgttggttgtccacatcaacgtcgaaagctggaaggaatgtgccactacaagcatcttagctctcaggagagggactgcatagccacgctgcatgcacaagggaaggtcaattgcctatatcgcggcagagatcggcagggacagctccagcgtctgccacaagctcaagaggaacgcacggcacggacactttagggcatgcgctgcccaaaaagagggcggatgagcgccgcaggagatgcagggcgaaaaggcggctttcagaccctgcgctcgcacggaaggtgcgcttactcatcatggacagacactggtccctggagcagatagacgacatctcaggctcgagggtggcggcaggtgcatcgttgagcctctcgactattctaccgtgaggtccatagccgccaccctcgagctgccggaagccggccccgaaggcaagatgcggcaccacctgcgcaggaaggggaagcgaatctgcagcaagaggcctaagatcaggggtaagatcgagatcttacacaccgtaaaggagaggccaaagcaggccgatgcgagatctcgcctcggagaggggggaggacgacacgctcgtggcagcaaggcccgtgtgcctgcttgtgcttgccgacagggcagtgaggctgcttgccgcggaaagagccaccacgacagcgggagcgtctctaacgtctctaaggccgaggtcgggcttttgcagggacgtcccctcgagacgctcactccggataggggcaagcagttcgcagagcatgcagatgtcacagatgccctttgaggcgtgcagttctacttctgcgactcccaccatctctgcgacccccaccatctatggcagaagccgacagttaagaacaccaacgggctcctgcgggagttcttcccctaagagcagcgacttcggtaaggtcacaaacgaggaggtgcagcatgtagtggagctaatctgtgacagagcgaggaaggtcctgaaatacaggacagccaacgaggtctttaggaagatgttgcactcagcttgacaatctgccggtcctaaaagctcatccatctatccatatctgccttttggatatgctggaatacgtagctataccatatccagaagacagataggcatctatgtggatatgggcactacgtggttcgagacattttgagccggcggcatacagcgtacggctccactggcctcatcgaggcgaattattcatcgtttccctagaataacgcgacaacttcctgagatattacgatgattagggtcttcccaatcaccagttcgatagctcaagtatgcgtttagatagctcctgaactgtgaagaacggtctctttgttgagcggctccgaatgtcagagtttgtgattgcggtcttgacaatctttggagtgtcatcgatcgcttttgccatccaggtgaggtccgacttcgtttcgtcgcagtagtccccctcgcctccgtattgatttcgatagtgggtaagctggcggaacacgtccgctctgtcaacggagccggattgcacgaaatgctgaagcaggtacatctcgaactggggggcggagaaggccagccggacttcaagcgattccgcgtagtgctctagcttagaatagctgcagggcatttggtcttcatcacatacggcccagcactccacctcctcctctggtcgctccaactccttacacagttcgccccgcttggtgacggcattgtcgatgagagccagatgctgtccctgttgaccatagacaacgactttgacgaatcgtggggatcgaaaaatgtcgctgagaatgtcgaagtacgccttctcggtctttccctcacagacgattagtaggacgcgcggcaacctccgccgcttcttcggcgccatctacctggtcctgactcgcggaactgaaccgtacaacccccggaggtatcggtcttccaatggttctgtcgtgcgcgccccccggtccttgagcgaggcgacgcgcgactcctccgccatgttcttgtcaacgaggagaatatcgtcacgttcggcgacgtcccccatgagcgatgtatcttgtgtgttcacgatgaggcaggcgcccctcttgttctccgcgctcttgaagagggcgacaagcgctttcgcgaggctgggatggagatagctgccgtattcgtcgagatacagcgtgtatccattgtcgagtgcgtcaacgatggggacggccatctcgaagaatttcctcgtgccgtttgactcgagcgaccagaagtccatcgctcccatccccacgatgctcagctcgtcatcgcgaaccgcatggagcgtgctgaaggtcgtgtaccccttaacggcaagcgcctgccggatttctgctgggagaggaagcgccgacaagtcgtcttcggagaaccttgtctcgccaatcgcgatgtcgcgtattgtgaagtcgcaatccctaaggagcttgagaatctttccgcgaaggtcctcgtttcccttgagcatgtcgacaaattgtggcgtgcgatctagaccccgatctagcattattggggtggattcgacgagggagaagacagcagctgagaaggggttgttgtcctcgtgggcctttgtgacaaggagcgtctcgggccttgtcctctcctgcagtgcctttccaaagccgttcttgcttgccgactttgagtcaacgcccctgtctccacgatggaacacgaggttcatgcggcctgtcttgggggattctgccctcagggtctcttcggttatgcgcttggagacgtatgcaaaggagtagctgtagcgtctcccctcgaaagtgaatattgcctcgaactcggtcggcttgcccgttgccccctgacgcagcatgaacgggatgtatgggagatgccagttggcgcttgatgagttcactatgcacgccctaaagtcttgcagggcatatgcgctgttcgatttcccgctggagtttgggccatagatcacggtcagtggtcttggctgaccgtccctatctgcgaagttgaaggattgcggcgtgtagaaagaccgataattggcaatcctgaacgataacagctttgcgtttcccattatcgctccctccttctagttgcacggacctagggaaacgatgattaattcccaataatgtgccagaaaggactagccacgtggcctttcgcggccggaataggcattaatcatcgtttccctaggtcaatagtgttctcagacatgaccattttagtctaatttcgttgtctttctacgaaatcgtcaaaaaaatgggttctgtcaacgaacaatttga

SEQ ID NO: 305 - DNA, 23852 bp, Unknown
  Metagenome-assembled genome
taccgcgatgacgccagtccctccgcacgacgtccatgcgcatcaaagtgacgtacacagggcgggacgcaaaaatgaaaaatcaacgtgggtggacagcgacacaccaacagatactgtgactttatcgcgatgaaggtgttcgccagattgtctgggagattcgcccgcaggatgcccaatgcgattgaggccatgctggagcgtgtccccaacgcctaatctccgactgccaccaccgtgccgcgagcgccatccaggtctcacgcacaaacgggagcagcatctgaacgcttccccgaatgcgccctacaactacttcctggcggtgctcttcccttccaatcagctcaatatcctgccctacgaccgcgtggtgaaagataccaacggactgtccacaaaggagttcctgtccaaagccaacgccgcaggctttgcgacggtatccggaccgtccagtgagctggcttctctggcacagcgtcacgattttggcgtgtatgtcagcggcagctggtacactctccgctatcaacccaccgaagcggaggagcacgatccggtcaaacggctcgactgctctatcctacaggaccgcctgctggggccgatcttgggcatcagaaatgcacgggaagatccccgcatttcctttgtcggcggcatcgaaggcacgaaggcgctggtatccgctgccggtgagaacggtatcgccttctcaatgttccctacctcaatggacgaggtgatggcagcagcggacgcgggcaagctgatgccgcccaagtccacctggtttgaaccaaagttaagatctggcctctttatcaggccgttgggcgccgtctccacgaagcattagctcgacacaactgaacgcttatagccaaggagcaaaggtactgagtacccccgttttttgtatccgtatgggcttgagtgtacccctttagacgcgccacacgactttcctgatcctgtgaaggtgggggttagagcgtatagtgaaggctgcatcgacaccctatcaggagagatttgagagtttgactatggcagacatacacacgattctcgttgggcaatccggcggtcctactgcggcggtcaatgcaagcttggcaggtgtgatcagcgcggcacggaaagcccagatccacattctcggaatgcgctacggaatcgaaggcctgctggatgggcacgagccgattgacctgactgagacgctccccacgaagcgtgatctggaactcttggcccgcaccccctcaagctacctcggcagctgccgctacaagttacccgatatgtatgagaatccctcagactacgagcagctcttcaaatacttcgatgaacgtcaggctgatggagtgctctacctcgggggcaacgattcgatggacacgattgacaagctctccgcctatggagcgcaacatcagctaccgcagcgctttgtcggggtccccaagacgatcgacaacgatctgatggagatcgaccacactccgggatacggctccgccgcgaaatttgtcgcgacctgtgtgagcgagatcgcccgggattcgagcgtctatgacctgaagagcgcaaccgtggtcgagatcatgggacgcgatgccggctggttggcggcctcagccgcgctcgcctcagcccctgagctcccctgcccggacctcatcctgctaccggagcggccggttacggccgaagcactctgcaagcgggtccgagagctcttagagcggaagaacaccgtcgtgatcgcctcaagcgaggagctacatacgcctgaaggggtacccttaagcgaagcgggcgcagaccccgtcaccacggatgcctttgggcacaaagcttccctttccggcacttctcgctatctcgcctcggccattcagaacaagctacacgtgaagacccgcgcagttgagctgtccaccttacagcgcagcgccagccactgtgcgagcgcctgtgatctgaaagaggcctacaagctcggagccgcaggtgtcaacgcagtgctcgcaggcaagacaggggtcatgactacgctggtgagggacagcgatctcccctatgcgacgcatcttgagactgtcgctgtgtcaaaggtggcaaacaagatccgaacaatgccggatgcactgatctctgaagacggaatgaacgtcacccaagcctacctcgactatgcgcgtcccttgatctcaggcgaggtgagccaactcaccatagacggtatccccgcccacattgcggcgctcgatccgctggaagcctaagccatctgcactcagttccccagattctcctgagcgtgctcgaggctgactgcaatgagggttttgacatgatcgtcagagagtgagtagagcacgcgctgcccgtctcgttgtgagaccacaagacctcggtcgcgcaacaggcgcaactgatgcgagatggcagattgggacacgtgagtgagctcctgcaactcacttacagaatgctcacagatgcagagcgcacagagaatctggaaacgggtgtagtcagacagagcatcaaagatctgtgtggcgttgtagataatatcgtcgtcctgcattgccttttccattgctttaatctcagacatcgatgctccgtctccccttcttgttctggcgatatcatattttgattgctgtgattgtagctgtgctcttctgttcttaccccatttcgggtatattcattgcagcgatagagtctcccctaatccacgtcgaatcgaagacaaagagaggattactgctagattttccaacagtggccttttcgatatgagatcctacattcacggtgtctgtactatgagcttgggtattactcacccctcatcctgtagagtgaactgttcttcgacgctactaaaatatttgctggagcatttgagagacaaaccacgctgtatcgggcaggctgcctccctgttcaggcttgttcgtactaccttgttcccctcttacagggatctatctttctgattggtaatgacccaaaagggtaaacaatgcatactgtagagaaactatttgtggcgtggggagagaataatcggcaataggagctacttgatggatgaagagaataacagagacgaatcgttgcgcctgagctccgtgcacgatgatagaggtgaaacagggaaactcgtcgatacgctcaccatgcgcatattggagagcgacaatgcaatcgctgagctgaaggcgcaggtcggcgatatcaggacgcgtcaggcagactccgccgaggagctcacggctgaccacttgggaagaagcggcgtaagacccccgagcgagctggaactcttctatgcccgtatgctcgaggaagccggcctcttctcaaaggacataacccttccttccctcacggtgatcaagttggagcgcagccagcttctgtatttacggacgcaggagccccgagtctcctatggggcaaagcttgagatactgcggcttgaggccgccctcaatgcgctgcagtttgcactcaactacaccaaggacccggagcacctgagcgaagctgatgcctatcagatcaaccaacgggtggcacactcgatcacctcacagatccccacgatcggcgacaaagggccgacgcagggcgaatactttactgacggagaatgggcagtcagaaaaggcatagcaatggagatggagagcttcaagctcccctaccgcctcgaagctgactaccgcgtcaacatgcaggacgggaatgtcgcctttgagctggagaccacgccggcgcagtgcttccccaaatccgcctgggtccagggcctcaagcgcattgtccccacgaccgcgctgatgcgcaaacgtggggcgagccagtatgcgatgcgcgtcgggatcctcctcgctgccgcggcgtttcgctgcacccccaaagtcaaacatgtctttgtggctgcagtgcacacctccggcaacaaacgcgagtgcctgtacagcatcgagttcaaccgtgcccaattcgcacagctgaacctggacgagattcaccatcccctcatgatattcgcgcagttcaatgcccacatggacccctacaacgagacgctgaacccgatcccccaggacctcttcctgagcgatgagcgcttctgcccacccttccgctatgagccggttgagacctcgaagcgaaacctgcaggattccttggcctatgccctgggcaccgacagggtacgcaacctcggtatcaacgaaggcgggcagcgtgtccggctggcggagaccatcggccgctacctcggcaactccacctcgcaggacgtgaacaccctgctcacctacaccaagaaccagaagaatcaggacatccaggaagcggcgaagcgtacgatctccaagctgatcgacgggacgctctccccccatgacccgctggcgattgagcgtgagttcaccgacggcgatgtcttgacgcaggcgatccacaaagcgcagcgtatggagactgagcagacccagcaggcatccaatatcctggaggaggcgctcgacgactacgagagcgaccatctgttcctggacagcgacgaggaggtctaccgcttcttccgcagctattccgaccgcgtcatgtacaacaagctgaaggcgaagccgaatcagaaggtcacgctgctccctgactcctactaccagatccatctgatgcttgcgactgataacctggagctcgggcagaacgaaaaggcaaagcagttcggacggcgcatcatcgagtttgcgcctcaggatcccaacggctttctgttggtagcccgtgcccaagcctcccaacagcacatccactccgcgatcaacaccctctcgaagctcttggagatcgcctacgatccgcagaccgtgggttccacctatgctgcactaggcgcgatctttgagcagatcggggacgacaagactgctgcagcctgctactcacgcagcatgcagttcgcgtcgagcacctatctgatgtcctccttcgcgctcaaccagatcatgcagaagcatcccggcacctacctgtccctcaagaacaacaagggcgtcgactatcagctgacttcacaccagatcccgatcgcaccgacagaggagatctcagagatcttctacaatgcgctcagggcctcttttgacgctgaggtcttcccggttgcgaagaactttatcgacaccctctcgatgctctcaggcgacgatgtggtggtcgatatcgaccactcgatggaaggcgaaccggatcggtgacaaaacaaaccgtgcaaccattcgaattgttacaacaggggccctcctatcacacggtgcaggcccctgttcatatcctctgtcatgcgttctcagctacagatcgacgctgcatcaggcgcgcgatctcaggatgtagaccttgagtgccagcttcagttggtccttcctcgatgtgccctcgtccggcccgtgctcgatgccgacccaggagggatcctcaacgcgggagtccatggggaccgaggctcaggcgttctttgaagtggccgggcatagttccgccccgctcgtgaacgccttcaatcgtggcgtccggtgttaatcgtttgtagggcgcccaggagcgtctgatctccgggttccggggtccgtatcgaaagggccatatcctccaacccagcgtatatgccacggccaaaagggcgcagcggtcttcgtcagcgccgcgctgatcgtatccatatcggttgagttgggataacggatctcgcggtctgggtgaaggctctccatcctgttccgcatggtgccgccggaagcgccagcttggccccgaaggctcatgtttcagaggtgatgcccagctctgtgccttcacccagtccgcaaagatgtggcgctcaaactcgaagactgcttctcagcaccttccacaaggctcttatccaccatgttattttgacgagaatcccgatcgcgttctgggcatcccacggcattgaggcgtgcccacctttgccgtgcgcggtcagcttcacggtgccgtcgtcctgcggttccatctcgatgttgtcctgcttcgggagcttggtggcatccgcgacgatcgtcatatgcgccaggccggggattgcgttaacgaccgtgcctgcatggaagtctttgattgtgtccgcaattgcgggagtggtgaattcgacgagcatacgccctttctcaccgcagatcagcggaaagtccgcatccggggtgaagaggaagtcgggctgtgggtagtggtccagataccactccacatccctcatgtgggtctcctcgttgcagcctaccagacagcgcagcgtgtacggcagtttctttccggttttctgtacctgcttcacaaagaagtgggcagcatagagcgaaaggacaaacggtcccttatcgtcaagcgtgcccctacctaagaggtaaccgtcccggcgcgtcacctttaaaggatcggtatgccagccgatgccagtcggcacgatatcggtatgggcgatcgtggcgatctgtctttctgactctccgggtagatctgcaaagccgatatagccctcaccgttgtgcggctcgagcccgagcttctctgcaatggtgagaccctgctgcagcgcctcataggacttggggccaaacggctttcccggttctgcatgggggatgtcttccaccgactcaatgtgcaccatcgagtcgatatcgttgacgatggactcccactcttcgtcgacgtagctgtctatctgttgtttcaaggcctcatcagccatggagaactccttctatctcgtatgaacgttatatacacttgtcctatcgtatcccttcatatgtcccacacgctgagcgctgtgctaaggtagccgttgtatttgattgaggagaaaggcaactatggcagaaggacagacaacgcttgcagcggattcccccaattttatgtggccaccccactttgggggcgccatcttcgacttcgacgggacaatctcggataccgcaagcctctgggaggatatcgaccgaaaattcttagctgaacgtaacatcccatacagcgtggagttccctcgcacactttctgccatgggattcgatcagggtgccaagtacaccgtggagcactaccacttgaatgaggacccgaaggacatcgtgaacgagtggatgcgcatgagccagaacgcctatagaaccgaagccgtgctgcgtccgggcgtcgtaccctacctcagggccctgagatctgcccacatcccctatgcgctcgctacgaccaatacctcagacctgttggactccatgcagcgcatcccgatcagggagctcttccccatccgcgtctttggggcggatgtggcgcacacgaaggaccacccggacatctatctggaagcagcacatcgcctcaacgtagcgcctgaccgctgcattgtctttgaggacctcgcggtcgcactgcgcgctgccaaccaggcaggctgtatcacctgcgcgatcgcctcaggggatccattgcagcatgtcactgaggtccaggagatcgccgacgtcttcctctccgactggaaggcaattccggtcccaaagcgataagcctacagatatgccctctcccgcatgggagagggcaccatttcgtttgatatgaaaagagatacctgctaagaggtaaaaactttaaatcttgcgaacgttggaagcctgaagcttaccattctggccagtggtgatatcgaactccacacgctgcccctcatccagggtcttgaagccatccatctggatctcggagtagtgtacgaacagatcgtcaccatcctcacgagagatgaagccgtaacccttttcaggattgaaccacttaacagtaccttgagccatgacgtgcctttctttcgttagcccccctgtggaagctataacgcaaatgcgctttcgcgcgttacctgcgttcttgtgaacgcagtacctatcatactctaagcacaatgtgcgcgatcgaaaaatcttttacaacctgcctgataatttgtttgaggctttaagatctctccccctgtcgagcacggctgtcggtaccgcttattgctccttggccggctcgcctgaaaagttgagtccacctgtgagcccttcggccgccgtctcgtcaaacccgtctgacaggtatctgtcgatatcgtcacaggctctgctgtaggcttcgtcgtagaggtccacgaaggagtcatgcgaaatttgcttcgtaaacggattcctccaggccttgtggtcgcggttgtcgaactcggaggtctcagaggctctggggcggtgtgagagcgctacatcgatggagtagggcttcttggtgaagagctcctcgatgttgcccaaaagctgggccttctgcccgcgctgcgagtagagcagatgctggatgcggcggaagtcatggactgctttctggtagagcttctccgggatcgccttgttgtaggtctcaaggatggttgccacatacatgtgggagattgcggagagcgccacctcgtcgagccttaggatctcctggtagggcttgtaggtcgctacagtgcggtgcagcttgctgtagagcaccatctcgtccaagtcacgctcgatctccgcatggacatagccaccgacactgcggtccagcccctctaccccggcatcgcagtaggcgtactcctcggcgtagacgaaaggatgcagcgtcgagtcgagcagatagtggcacagaaagcccgcggcataggcacgcccgatcgcctgatcctcaggtgagagctcagagacgctgttcttcatcgataccagaagggcgctgggatgccgcgtatgcatcatcgtcgagagatgggtatagggcctaagcttacggtccagaatgatatataagagtggatcgggcccctggttgccgagcagaaaagcgtcgcggtcatccgcggtaaagccaatcgacttgaagcaggcgtcgtagacatcccgcccaaagaagtcatgcgtcatgattgctggcatagtgccacttccttttgagaaaaggccccgaccacgtcagggccttaaatctttattcccttaagtcactacgtttatatcctaccgcttagactgagacaatcctgatagatcaatacttacaaatttgttgcactactctgatcgcagcgcctctaccgggtcctcccgcgctgccttggaagccgggataaggcctgccaggaaggtcaacagaatggagataccgatgaggatcagcgccgacgaccaggagagcctcatcacgtttctcaccttgtaggtggcaagcacgtaggcgttgacggggatcgtgatgatgagagtgatgatgatacccatgacaccgctcacaaagccctcgatgatcgtctccgcgttgaagatcgagcggatgttgcccttgcttgcaccgattgaacgtaggatgccgatctcctttctgcgttccagcaccgagatgtaggtgatgaccgcgatcatgatggaggagacgacaagtgagatcgacacgaaggcgatcagcacgtagctcaccaggttgatgatacgggtgatcgactgcatcacggtacccacgaggtcggtataggtgacccgttcagtggggtcgctctgctgatcgttgtaggtgttcaggatgtttagcaccgcctgcttgtcatcgaagtctcccggatagatatcgatctttgagggggacgcctcatccgcatagcccaactgctgcagattcccctccagcgtggaggagcgctgcgtcagcatcgaggtcaggatctcattgatctgctgctcatccatattgagcttgaaagcatttcggatctgattcggatcgactgagatcgcctgcgccatgcccgcgctgagtttagcggcattctgttggagctcctgagtgagctgtgcctgcagagactgtgagagctgctgcatcacggaggcgaaggctgcctccaaagtctgcgtcaggctctgtgtgatctgagcggtgatctgctgcaccatctggctcgtcagctgctgcgcgatctgcgagcgcaacgcctgagacaaagagttcgtgagtcgctcgtcgatctcaggcgccagggcatcgcggacctgcgtctccagatcgttaaggtcgaccatacgctcgaccccctgccgaatcgtctgctgtccctggtcggagaggaagtagtccgtagggctcgcatcggggtggtcgctcatgtactgctgatattctgccatcacctggctcatcagggcctgcgcctgggcctggtcgatatccacatggatctgtgaaagcaccttagagagatccacgtcggagagatcaggcatcagctgctgcagctcttcctggttgaggtcctccaccttcacgtccggcaccatcacctgcgacaggtcgatcgaggagaggtcgagcttcggaacatccacctcaggcatctgcatattggagaagtcgagggaagagaaatcaaggttgagcgctgaaggatcaaagtggaaggccgcctgcagcgcagtcccatccaccgtgaagaggcttgtgaagtcgaagtctggagcgtcctgtccggaagcctcctcgaggaagctccggttgctgaagacatcgcgctcagggtcggaaagctgttgctgtacgatatcgctctgttcagcgtgatccataatgtcatgcgtcacggctgaggtgtagtagagccccggatcgagcgcagaggccgtggcagagtcagcctgtttgacgatgcctgctacgtgcagatccttaccgttcgcgatcaggttattcataaagtcggtgtcatttgacttgtccgtccagatgttgtaggtcccgtcgtaggtatacatatcgctcggatagaccatcttcacgtgggcgttcaggatatcctcatagctatacacgcggttgtcatccggctcaaagtcctctttggtcttgtcgtcctcgctgccactcgcctcagacaccacgagcgagaccatgccttcgagctccaggtggtccctcaagcccaactcataagcatcgaagtcactcagggttccatcctggttgagcacgaccaaaagctcatcttcctgagtcggccaggagcccgccaccagatcgaacttgtctttgaccagatctgtatcgtcgagcagcatgtggtaggcgctcgtcgagctcaacatgcttgcgctcgaagcggagccaccgaaccccaactgtcggaagctcgtctcagggttcacctgcacgtagctgccatcagagcgcgtcgcaaagaactgcggtgtgacgttgtaggagtactggatcgagcggacatagttgttgatgttgccgccgtcagcgtcaaggtaactcttcaaggatttcagatcgtttttgccaacgctctgaaacatgttgtggaggctctccgactccgccaccgtatcgggctgctcatcggaatccttgttatcccgacctgcattcatctcggacatgatgcttgtgacgtccacattcgtcgcctggactgacagcggatataccgtcatcatctcctcctcgacgtcgtggatgtagccccgcgcgccgcttgagagcgcgaggatagcggcgataccgatgatgccaatggaaccggcaaaggcggtgaggaaggtcctccccttcttggacatcaggttcgagaaactcagagagagtgccgtcagcggcgacatcgaagtcttgcggggcgaacgcgccttacggtgcggcgccgcattcggattaaaggggtcgctgtccgcggtgatctcgccgtcagcgagcctgacgatgcgcgtggagtagcgctgtgccagatccgggttgtgggtgaccataaccacgaggcggtcgttggccacctcttttaagaggtccatcacccggatggaggtctgggagtcaagggcaccggtcggctcgtcagccaacacgatctcgggattgttgaccaacgcgcgggcgagggcgacgcgctgcatctgcccaccggagagctgggaaggcttcttgtccatgtggtcagccaaccccaccttggcgagggcttccttggcacgctgggtgcgctcctctttgctgacaccgcttagcgtcaacgccagctccacattgcttaaagcagtttggtgcggtatcaggttgtagctctgaaacacaaagccgatgcggttgttacggtaggtatcccaatcgcgatccttgtacttcttcgtcgaggttccatcgatcagaaggtcacctgagtcaaagtggtccagcccgccgatcacattgagcagcgtagttttgccggagcctgagggccccagaatcgagacaaattcgcagtcacggaaggcaagactcacatcgttgagtgccgtttgtgtaaaagagtcggtagtatacgatttagcgatatgagaaagctcgagcatctgccgcctttcaaatgaattgatctcatacgcccggtgagatgaggtatttgggtggctgcggttacgcgcgggcggagataagacgtgaggctctgttatctgcacacagattttcacgccccaagaagatacaagtataataaatcagcgatgataaaaaatcagtaaaccggtgttagggcgaaggagttatcacgtatgccagcgatcatgacgcactatttctacggtgaagacacctacttcacgacggccaatacgctgagaagccacactggagaggaaaagcaggcctacctgctcggatgccaggggcctgatcccttcgaatcactgcagctggcgccccgcctccacgaatacaagcgcttggggctcaagctccaaacggaccagatcgaggaatgcctggcaaatttcaagggctcgctcgcctatctctccgaccatgaacgccccacgggccgcgcttatgtcgcgggctacatcgcccactttgagctcgattcccgcgtcgaccccttcatcgccgcctggcagcagcagctctgcgacgccggcattgagggcctggatgagcgcgacgcgcgcgtcgtgaaagctgaagtcgagcgcgacttggacgagatggtcctctacaccaagaccggcaagaccgtcgacagcttccacccggtgcagtgcctggaggcctccgaccgtatcttctcgatcgtcaaccgcatgtaccgctacatgctcttgaagacctacaacgaagtgaccccgcataacctcttctccggtgcgatcaatgcgcatagaaccatgatgaggatgatgcgctctccgcacgtaacggacttgcagtctgagcttgcctccgcctttgagatcaacatcctgcaccgccgccactccctctaccgggcgatggcgcaccgggcccgcaaggaagccacgagcgagttcgacaacagcaagcacgaggtctggatcaacccctacaccggctccatcgacgaggcgagcttctgggacctcttctacgagacccaaggcgaggtacagactgacctcaactgcttcctgagccaggactttaacgccgagaaggcaaaactgatcactcacggcctcgacttcgacggcaaaccgacacaagagtcaaaaaaggatgaagacactgaggctgaacctgagaaagtcgctgcagagtaggcgctatctctcttcttcctgctccacccggatgcggcgctcctgcgcgcgcaggaggtcacggtattccgggaagggatcaaagggcataaagatcttcgcccgctcctccattggcatcgccggatgcccatagcggagaagcagctttttgttagtggatgacgtcgtggggtctgtctttttcatcgccacttctgtgccctccaatctgttggttgcgctctcgtaaggtagcttgcgggaggtagtccctccctttcagaatggcattcttgccgaactttgccttgatatcactcaaagcacgctgggtgttgcgctcctgttcctcagctttggggtctgagaacaggctcagctggatgcctggggcttcctcgtcgcacacctgccacaccccgattcccaaccgcttgattgaacggtgggggtccactttctcgttgaagagctcggaagcagccttcaccaaggtctttgaggagttggtgggatctatcagctgtcgggaagcggaggtactcgggctcagacggcggacagtgagacgcgtgtaaccccgtacgcgcatctcggctttctcctcacgggtcatctcgtagccgacatagatggagataccaccggccagctttttctcttcaacgaggcgcagcgcggtctgatctgccatctcctttaagcagagcagcgtatccttatagctgtatccgtggacaaaaacctggttggagctgtacgagtgctcctgcggcttgtaattcttgatatcttgcatcgtgagcggctcaatgccccaagcgtgatcgatcagaatctccgcatcgaccccgaactcccgatagaggggctcggtcggcgcatgggcgagctgccccatcgtcgtgatgcccatgcgctcgaggcgctgggcgatgccagggccaatccgccagaaatccgtgaggggacgatggttccagaaggtcttctcaaaacagcgctggtccaattccccgaagaaatcatctgtatgcttggcggtgatatcgagggcgactttcgcgagatagagattggtgcccaacccacaggtcgcggtgatgccggtctctttggctacctcggaccgtaaggattctccgagctcccgtggcgtcatgttgtaaagcttgagataactcgtgatatcaaagaaggcttcatcgatcgaatagacaaagatgtcctccgcagagatgcgcctgaggtagatcccgtagatctcgacggacttttccagatagtagcgcatccgcggtggtgcgataatatactttatgttcttggggatctgaaacaggcggcaccgtccgggcacccccagcttcttgagcgcgggggaaacggccaaacagatggttttgtcggtacgtgtcggatccgcaaccactaaattggtagtaaggggatcaagcctgcgggcgacacattcagcggaggcatagaagcttttcagatctatacacagatagcttctcttcgtgtgcgccatgcttccccctccgaacatatgtacccattgtatcggaatgcgcaagcagagagcgagtgcatacagaaaggaattctatggctatcaagcagcatgtctcatcgtcaccgctcgataggtgcgtccactacgataagaagaaccacccgatctactacaatgcgcacctcgacaagagcttctatctgactgaaaggcaactccacgccctctcctggtacgtcacccgcttcggcatgtgcttctctttggcattggtcgtcggcatcttaagcgagatctggatcggactcgtgctctttggggccacctacggcatctcctcgttcatgttctaccagatcttcatgaagcgcttggaacccgctccaaaccgggaactctccaaagaggataagatcgtcgagcttgcccgccagcagcgccatgagcgcgccggcgtcggttatggagcgctcgcattggtctttgcggcactcatctacctcaatgctacgtctcagaacttcgggggcatcaacctctacgcctcgtacgccacgatcatcctatcggtgatctacggattctaccagctcatccactacttcgcgcgccattaaaagaaagcgtggataatcccgaagaccaggaagatcaaaaagacgatgatgcacacatagaggatccggttgaggatcacataggtgtggcggatgtagttcaggtggtcgatctgcttttggatctgatccgcctgccgctccttgcgagcgatcaccgtgtgctgttcttcgtcgttggtcttgtctgagatgacatcgttgacataggcacgcatcagcgagacatcttcaagctcgatatcgaggtcctcgatattcttactgtgcttgctgtagctgtcttccatcgactcgatgttctggtaggctgcagcctgcgattcgttgaaggcgagctccgcattctcaagattcttgtgagcctcgtcgtaggcgttctttgcatctcgttggtcccgcttgagttgcgcgatcttggccttcacatcgtcctcatcctcgcttgagtgtgaggcatcgacatactgcttaagcgctgcattcgcggcattgagccgcttcaggctctgccgttccgcattctgttctttggtggtcgccttatcccgctcccgcttgagctcatccttcatgctctcgaccgtgtttttgaccatcttcagggtgtcgactagatcctgttcgtggctcttcgccttctctatctttttggtcttcgcttcatagctatcgagcatctcctggtagttgtccctgatgtgttccctcagtttgagctcctgtttatccagatcgatagaacgtttgcagctttcgagcttctttgtctgttcatcaatatccttgtcaacgcttttggatgagatgataggcatgaacatcagctcctcggtgcgagaacgaatgtacggaaggcatatttttataataaagcatctttatcataaaaacagcaaaagtgctggcatttctgcttttagctcgatgggctaatcgggtaagcagacgggcctgcggtggcaccgaatcggtaatcggttatgctcagatcaatcagtaattaaagtatctatcgcaaccgctcggacagccgcaccacgggcaccggtacccgtatacaaacctgctaccccaatccttctgagatatggctgaacgttataccacagggattttaatggcagaggttcccacagcttcgtgtgattcgatgcgtcaaaaatttattgcacaaacgttggaattatcggtgcagataagaaaataacattttagaaatgtctctaagggtatgattatgtgaggacagaagtttcagatgcgcacaggtgtgtcgattgtacgacttgacactacgcgcgtgtcatctgaagcacgatgcacgtacatatcgacaaaatgggaggatccctatgtatcgcgatgcagtagtgctccacagtaaatctgtgggggacgatattgaccttatcgtctacggagagaagggctacccggtcatcgtattccagacccagaactctcctgccaccaactatgaagacttcggtatggtggatgaactttccagctatatcaacgatggcaagattcagctcttcagcgtcggcaatatcgacgctgagtcctggatggcaaccgacaaggacaagagcaagcgctctcagcgtcaggaagactacttcaagttcgtcaccgacgagatggttccttatgtgcatgagcgcaacaactctgagctccgtccgctgaccaccggctgcgcgctcggcgcaacccatgcggccattgccgttatgcgtcgtccggacctgttccagggctgcattgccctctctggtgtctaccgtaccagcttctactacggtgactggatggatagtaacctatatctgaacgacattatcgtcagcctgagaaatcttccgcaggatcatccgtacgtcaacctctacaaccaccgtcagctggtcttctgcgtgggtcagggtgcctgggaggacggtatcgatgacctcagaaccctcgattcggagttcaagcgcctcggcatccaagcctggtgcgacttctggggcttcgacgttaaccacgactggccttggtggaagaagcagatacagtacttcctgccgatcgtcctcgaggacgtgaaaaaggaactcgcttctgaaaaacctgccgagaagaaggcagaggctccgaaggccactgcgccgaaagagactccaaagcctgaagcaccgaaggcaactccaaagcctgccgtcccgaaaccagagccgaagccggaaccgaaagcggagcctgccaaaaaggctgagccagcaaagactgctgctaaacctgcagagaaaaaggcagcacccgctaccaagactgtaaccgctgctgcggctccgaaggctgagaagaaggctgcacagcccgcgatcgcgacagcaaaggcaaagccgtccctgacgactcctgagcctgccaagaagatcgctggcgcagagaaacatgcagcacttgataccaccgctccgaaggcttcactcacctctttcgctacggcagctcctgagaagaaggcagcagagccggagaagcatgaggcggctgccaagaaggcacagccagctaagcgtgcaagtgtccataagagcactcgtagccgttccaagaaaaagaaccaccgcaagtaatgagctttgaaccataacttgtaaagcaattggactgtctacctcggtaggcagtcctttttcacagcgatcagtgccaggaacagctgcatttggtcagccaaaatgtgtgtagatgatcaaccttccccacaggtactgcagggtgtttgatgtggcggattagcattctgagtgcaacaggatagtcccgctccacagatacgtggcacacttcggaaggctacgatgttggttgtctcaatcaacgttgaaagctagaaggaatgtgccactacaagtatcgtatgcccacaggagaggaactgcatagccgagctgtgtggcagacgggaagctccatcggattcatcgcacacaagacaggtaaggacagatccagcgtctgccacaagatcgcgacaaacgagcggcacaaacgctttagcgcctgcgcaatcccaaagaagggcgcaagcctgcccacggcagggaaaggccgaaaaggaggcactcagactctgcgctcgcttatcgtaagacgagcgctggtcccccaagcagatagatgacatctcaggctcgagggtggtgtcagctgcgccattgagcctctcgactattctgcaggcaggtccatgccgccaccctcgagacaatcacccccgagcgggacaagcagttcgcaaggcatggcgaaggtcacgaaagctcttgggggcgtgcagttcttcttctgcgagctgcaccactcctggcagaagccgacggttaagaacaccaatggggctgctgcgggagtccttctcgaaggggacagacttcggcaaggtcacagatgaggaggtccagcatgcagtggagctgatctgcgacaggccaaggaaggtattgggatacaagacagacaacgaggtctttagggagatggtgcacttagcttgacaatccacctgctaatgatagaagggaaactacgctagatgtcccctaccaccatgctgcttgaaacgatattctcgacattcccgtaaactaaagtttacgggattccggcgtgacccatgtcttaaataaaaaggcgagccgcttgatacagcccgcctcttgttacgttacttcagttcgatacttgggctaacgctgcgaaacttactcctcgttatctttcacctgatacggcttgagtgcttcgatcacgatatcgtcggccttttgacacagctccttctcaggagtctcagagaggacacggatcagcggctcggtgccggaagcacggacgaggacgcggccattgccttcaagcaacttctcagcttctttagtcgcctctttgatggcaggatcctgcatgacagcgtctttatctttaacctcgacattgatcagcagctgcggatagcgcttgaccggacggcagagctcagaaagcttctccttctcagagcgcagtacctccatcatcctcaggctggtcatgactccgtcaccggtggtctcaatgtcgccgaagataatgtggccggactgctcaccacctaaagagtagccgttctttctcatgcacgcgtacacgttcttgtcacccacggcggttgcctcgtacttgatgcccgcagcatccagtgcacggaacagcccgaagtttgacataacggtcggcacgatcgtgttgtggcgcagcttgccgtgcttcttcaagtaggtgccacagacgtagaggatcaggtctccgtcgaccacatcgccgttttcatcgaccgcaatgcagcgatccgcgtcgccgtcgtaggcaaagcccacatcgaggcagttgtacatcacgaagttctgcagtgcctcaatatgggtggatccgcagttgacgttaatgttaaagccatccggagcgttgttgataatgtaggtatcggcaccaagcgcatcaaacaccgggcgggcaacgctggaggcagcgccgttggcgcaatccaagccgatgcgtctaccctgcaggctgaagccacaactggaaatcagatgtgcgatgtagcggttgcggccctgcatatagtcaatcgtgcggccgatgttgcggccggtagccaggggtacctcagtctttccgtcgaggtagtcctcaatcttcaaaaggacatcctcgtccatcttgtagcctccggcatttacaagcttgataccgttgtcggtataaggattgtgggaagcggtgatcatgatgccgcagtcaaactcaccatcgagcgtctcgtgacagaggcccggagtcgggatcacatgaagcatatagacgtcagcgccggaagcgacgaggccggagaccagagccgactcaaacatatagctggagcggcgggtatcctttccgagaacgacgcgggcctggcggtcttggttggcgccgtagtaccagccgacataccggccgatcttaaaggcttgctcaacgttgaggccttcgtttgctctgccacggaacccatcagtaccaaaatatttcatagctctctcctgcggttagattggtctgtcgctccatacccgaattccaggttgtcgccacagtaggacgctccttattctatcaattgtgcgatagcgtcccaaatgatagtgtgggcggattagtattctgagtgcaacaggatagtcccgctccacagatacgtggcacactctggaaggctacgatgttggttgtctacatcaacattgaaagctagaaggaatgtgccactacaagtatcgtatgcccacaggagagggactaaagcatgcagttcgtgaggtctatcctacatcgtcgtggcaacggtatccagcgcgtgatgtgatcagcaaagggaaaaccaaagagaagtgcgctcagatcgcagcagtcatctctaaggtcttcgaggagaaagacccggatatggtgtgtggttcatagcgtgcagcacaacgataagctttcaggctatcagctcttcagtaaccgggtgtttagagaaggcaaaaaccagatgtcttgacgtatttgtggatctcccctcagccttcaggaagcgcatctataccaacaacgtcctccgatagtgtgtatcagcctgcagagtgcaggctgtatggcacaacatgcggcatggtgacacctcaaggctgtccttctgtcccatgttgtacagccgtgtcccgccgacggtgtggcctgatagaagcctggggacaaactgccagctgcaaaagctgcaccctcccatcgaagcgctgttcatgcagggctttctggcagagaaggaaggccatcatagatgtcgattacgaaaatgtgcccgaaggggagctctgggctggaggcgacacgcatgcagatacaaactggctctccgtcgtcgacatccgcggcagaaagctgtgcttggagcagctgcctgcaacagcgaaaggccgaaaaaaaaaacaaagatccgcgcgattaatccgatcacgattgtcaagtctatatcgttccacactactaacttcttacgagtgccgcagcgtacgagatgcaaaagaccaggccaaagatgggcagcatcggcaggatcaacacctagtcggagtgtactactctcgcaattctgtacccgacggtcgcaaacagcgaggtgaccttcttctatttcggccagtatcggtcgcgatggacgctcgaagggcacgctcgccctgctcagaagcattcgcgcgttcggacccgacaggatatctgcctgcgcccgccccacttcgtcagtgcttcccgcgcatggggccctcgcgaggctctacgatatgaatcgttcctctccttcagatacccggtctgaagatgttacacgattcgctcttcatgctatgtcctcggagccggaccgtcgtcgactcgtgcttggcgaggtggccacaacgggccactgatcggctcgcgcttcctgcaccaactgtgctaccgataaggatacaggctctaaaactcaggctagcccagctcagcatacttatgcctactacgtgcgcagcgtcatgccgttgctgtcgcgcatgtataaggattggcccgcataggcgtctccgtagggatctctttttggcgcgcgtgctccacttccgcgaacctcttacagcaggcgcatatccagtcgacctaccctcagcacatggagaggggcacgtccgatacacgcaaggagaagctctattggattctctgccctactgtgcgtgactgctgctgccatacttgcccggggccggacgcccatgacaatattgtcgctatctacataggcgctggtccatcgagacttctcttcgactactcttcataaaacgtccagggggcggttgccctcggccatcaggacactattactgcagcgatcagggacttgtcgttcgtccggctcctgacgcgccctcatcatgcgggaggcctcacacgccgcgcaggcatcggggctggggatgtccgtcggcgactcctgctcggatgccaggatgtcaaggcatgcaggcgctcggaaaaatgggaggcgctcaactgcaagaagaagaaacgggctcgagctcttctcgaagatgatacaggcctgaaggtcgtccccaggcccgagcacatacactagcaatccggattgttgtggctagtggtgcccgagctcgagaccagagagtggagacaatcacgccgagggcccctgcagccgccttctgcgcggctgtttcaccaagcctctccgccatgcctgcctcctttaaaagagcgagtgggtgtgagggggcggttatgccttgcgcgctatgtacgcttcaggcagcgggtatctccctttcgcagggccttctttgcgccttctttgtgcatatacgatggttctcggatcgatctccatactgtggaaatcacgtgcatcatcctgttcgcgcacctgtcccttccatggtagagcctgtggcgctcgctcccctcgatgccttgaggggtgatgcagccacagtgctggaaggtcgccttcgagcgcatgcactttggtttccccttttgcgattgccacgtcgctggcagtcgacggcacctccgacgaagcgtacatgtaatgatgctggctgtgcccaactctgcaaaggagatgtatgaccacacgaggctctcgtgtactcacatagagcgcctcagcgcagccctgaggcatctcgcggcatcgccttgctgcagatgcgttttgtgcctgggtgtgacgatcttgtagcggggtatgccccttcggcaagctccccgccattcctggcgctcacgatccgcgcaaccacgcctgccgacaaatcgggatgcttgtggcaaagatcctgtctgaggcctttc

SEQ ID NO: 306 - DNA, 37560 bp, Unknown
  Metagenome-assembled genome
cgatacgaggtgacgccgagctcctggcgtgcctccgtcttcgtgcggtactcgccacggaaccacttcgtgacgagggccttcttctcgtcgtcgccctcgatgcttgcatgccaaaacatggtgagaaggcgtgcaaagtcatagccatgcacgagtcctggatctggcccatcactgccatgatccgcttctccatggcagcctcgaagccaggagcatctggcgccagccgtcttccatcgtgacctgtgtggatgttcgagacccagcggtcgagcacgaggttcagcgctccgccatcaggccttgtcttcgtcgagaggttgcggatgagctctctataggtagcaaggccctgaccgcccgtccctggaagcggcgctcaggggagaggtcggcatcgcagacgacgaagttgttgcccattgcatggttcctgatggtctgcaagaggaagctcttgcccgagcatagcggcccacgaggaagcggaaggaggcgcctccctccttcacgagctccaggtatggagcaatgcggcaatctcgcgttcgcggccgaccgtgatatagggaggccgacacgcgggacgacgcgcctttgagggaattgatgatgacagcggcaatgcgcttcggcacgcgcggggtgtctggttgtatcactcatgcacaagagcctttctgagatcttctgcgtagtcttctatcggtacggtccgtcatccgagaactcgaagcatacatcgccctcgaggtcgaagagcttctcgttcatgctgtcgatgagcatgtccaaggtagcgggcgtgcggacacgatagctgtgtagtccctgccatccagcatgccagggcaaggtcgtctcggtatccgtgagcccgaagggatgcgctgcctctgcctgtctggcagggcagcagcctttgtgccttcctgcggtacggtgcgtttctgcagtgggagctgggacaggggctggcgtagctgctggcgggcagcaggagcgggagcctctgcaggcaccggtgcgacagcaggcgcgtgacgggactgcgacatagccttcgcgctcttcgtcgacgaggagcgctcctgcgttacgtgcgcagcactcctgatggaggagagcttcgagaggtcgaccttgaagcgccttctctgcccttcctttgccttggcagctgctcctcttcttccttctgcggctgctatcgcatctcgatcatgcgcagcatgtacttcgggaggttgcggtcagggcatggccaaagtccaggcaatgcgcatcttcggtcaagctcgggaagatgcgggcaagtcgcggctttgtccgggtagctgcatggctcatgcacgaccaggtgccccgctcatagacaagataggttccgggtgctgcatcgaagcgccttccctcggcaccaagatcctgcttatgggtgcgtggtagaaggggagcacgatcgagcggtaggggatgcctaccgtgccatcgatgaggttctgcttcctcctctttgcgcagtggagcacatagcatcgaagagtcttcttgtcacggctgctgcagttcctggttcttgcggaagaacggggagcgggtggggtcgaaggtcgagatgccggcaaaggcctcgaggagctctgcgtcagagggcggctctatgcctattccaggttgggagcctctcgcccctcctttccatagaccgcattctgtgccctgcggagggtggccacatggctgaagaaggcaagcgcatcatccgagaagtaggacttggggtcgatgccagagaatattgcatagtcatgcccagagactcagcgcgtctcttgtcatgttccagatctctttgtcgctgaagagcttcaggagctggtcaagctcagagaggatctcttccggtccatatcgtggcaccgacgatgagctcataggcatagagaagggcgcagcagccggggcgcctccctcatgccctcacgccagagggtcctccagcggaagtagtcacggagctctgtattgttgagggagtataggtggacggtagatctgccgccagctatggtcagggaaggcgcgctctccgtatagtccttcgcaagcatgattgcttctcgaagacctcagggctgtcctggttcctgcctgttcttctgagggcacggaggtccctgagcgctctgtgagcggtgcgggcgcctttcctgtggcttgtatccgcatagctgtcatagtagctgctgcgatacgttgctccatagctgctgtagccgctattggccgaccctgatgccatcgtctctgcgctgaaccagtccgggctctcgagattggcatcgaagtcgtcagcttttgcgccatagccgaagtatcggtatcgtctgcaaatccgcagacgcgaagtcgattgcccccgtgtcatatgccgtgctcggcgatgtgtgggctggaacggtcctctggcgggagctcatcccttgaagggatagcttcgtctgcgcttcctcatctgcattcacgaagcgtgccgcttcggggaagaagcgctcgaacgtgcggaatcggtgaggtccgccttcttcgatgcttcgatgagctggcttctgcgttgcgggtggggtctatggggttgagggaacagcggactcttcgttctgctgcaggttcggcaggctttgaggggtcagctgctgccttcttatcaggaatcggagccacgcatgatgagaggctcatcttcagcggtctgggcaaaggatgcctcgccgcggagctgcctgcgcatgtcttccagaagaccgtccaaggtattgtcccattcctctctggaacgttccttgccatccgctgcacctcctgcacagacccgaattttcctatacagaatgcattctacacgcttgcacgcataagaacgtcttgacgtgaaaccttacggattcccgcaatccgatatgccgcattccggctttcatgtggccacatcccggagaagggggaaagaggtttctgtctcctttcagcgggtatatagccggcgaaagcgagagatgagggcagggaaagaacgcatgcagagaagagcacgaccggaaggctcaggcggcatcttgcaagctctttcaacgtgcgtgaggcagggcttcttcgaggagatccgccgccgcttcgtgaatggctcgcgtcttgatggtccccatctctgcatcctcatcgttgcaatgctcatcgcctcgtcggcctcaacacgaactcgaccgaagcattgtcggtgccatgctgatttgcccgctcatgggctcggtttggcatctcctattcggtggcaacgctcgaccggcacacgctcggagacgcactcctgggtcttgccatacaggttgccttctgccttgcgacctcgaccttacttcgtgctgacgcctctttcctatgagacgaacgagctcctacgaactcgacgccccaccgtctgggatgtgctcatcgcccttgccggcggctttgcgggaggcctgggaaactcccgaaccaggagccgacgacactcattgcaggcgttgcggtcgcaacagccctgatgccgccgctctgcgctgtcggctactacctctccatcagaaacatcgtccaggcattgagtgccttcttgagtttgcgctcaatgtcgtctcatcgctttgcggcagagattgttttctggccctgcgtatcccgctctgtccggctgcgcggcacgtgccgattccgagcgctctgccaagcgcatccgccgtaccctcatcatcgctacggcgctcttcgccgtgccgtgcatattcatgacagcagacatggtgaggcaggctgcagctaccaacgagctgctacgtgagctctatggatacctatgagacgcagctcacggcgcaggagcttcaggccgcgtgccctgccgtcactgagtaccacgtcggcaccggtttgtctccggaggcgataccgcgtcccagcaggtcgtagccacagtggaagcagaccgtgcactcacgacaggcagaggcagcagatcaagaacctcatagagatccatgtgcctcagtgaagtccatcaatttcatcgacggcaccgattcagagtcgtagggtaggcacggaacgactcagagaaggggcagaacatgaaggtacagatttggaactcgtgagggtgctaagaaggcagaaggcctcactgtcgtgatcgatgtgttccgtgcctttcgctcgagccctatctcttcaaccagggcgcagagaagatctatccgatcggctctctcgaggatgccctggcgctaagcgcgagcatcggagtatgtgagcttcggcgaggcgggggagcgcaggtcgaagcttcgagtatggcaaactcgcccgtccaggtagcgggcgtggaccttacaggcaagacctgcatcacacgacctctgctggcacacacagggcatcgtgaatgccacaggtgctaccgaggtcgtctgctccttcttgcgaatgcagcggcgacggcacgctatatcaagcagaagaaaccctgagacagtctccatcgtcgcaatgggcaatgccggcgtggcaagggctgatgaggatgtgctctgtgcccgctacatcaagggctcctcgaaggggaagaccccaggtggcacaccttgctgccagagggaagcgataggcttcgacaccacctgcgtgccaagttcttcgacccaagcgtccagagttccctgtaaggaattcgcatactgcgtcgatgtggaccgcttcgacttttcgatttctgtcggccatgatgcagaaggcaggctcgtgaatacgcccgtcaggctgttagagcagaagacagagcaggaaacgcagcagggcgcccggcagatgccggacgccctgcgtcatgtctgtgtgtatggaacctacttcctgtccgaatccacgttgtagccaccgcccagcgtgtagcgctttgcagcatgcagcatgttgacctcggcaagttcgagcttgccgtcaatgtagggctgatacatcgtgtcgattgatgccacacccatggagcagccgctgagttctcgcagctgccatcggcacagaatgacagacccttgcggatgatctctatccgctcttcgcggaaaacgttatcggcgacgatgactggtatgactactaaggtctttgccacgttatgaaggctgcaggaatgaggggcctcatcatcctgatcggatgagctcgtggaacctctacaagaattccgaatgacgtgagccgcagtttacaactacgcgaagattcctcacgctgtacaacgacacgctccaagggcaaggcccattatctcggccatcatcatgggcgcacaccccagacggatcgaggacaggagggccggcggcctctaactcctacgaggcattgcgttcgaggcttcagcaggggcgcctatcgcgcagggcggcctctggacctgctggccccgagtcatccatctcgagccgctcaccacgaggagctccttgtgctcgtggagaagctagcggacattccacgcaggcctcttcggtatacgaggacacacacaggggaggggcccctcgtgcagttccttgatgcagagttcgagcgcgtcggtgctacaccctcgggacgccgcggaggtcatccgacgattcatcgagctctggatatccgcccgaaccccggcatgaaggaagacgactcatccagggcgactttctgaaggcccggtggatgctcctgtcgaggctgcgcgaagaagaagcacgccgcctcgtctgcagcgcctgacgaagagctgccgctctcggaattcgagatctagtccagtatttgtcttctcgcgctatgcaccttcatccaggactacatctatagctcgaactggcagaacctgagagctgtgaaggagccgctgccaagggccatcttcgacaccgacgagaatgtgctcttggacgcttataccgcctccggcaagaacgagcagccttcttcccgatactcacagagttctgtgaagaacccctccgcctctgtcgggtgcatctttacataggtgccctgaaggccttgatcaaacaccaggttcctgcgtattgactcctgatgtgctgaaggcggcatccccgtcggccacggcacggcgaggtctcgcagtcccaccaaggcagaagatgctgagcaccctcatgcatcctccgatcacgccgagttccttggaggccatgctcctgcataggcacttctgcctccccctatcttcggagaccccgctatgtggtgatcgatgaggtgcactcgctcctcagaggagatcagaggtgaccagacgctgctgcatcgagcgcataagccgcctagcccagtgaaccccagaaggatggcctttcggtggggtggtcgtgggggggcggggtgggggggggtttttttttatttttttttttatgcgacgtagcgaccctacgcgacggaaggtatctgtccttatgggaacaggcaggactgcgtgatcccgaaggtcgaaggcccaaggagcgtggcgccttttcaatggagcacttctactctcagcgtcgaggcaccagagcgtggcgaagactgcctcggcggcgtcacgaaagaccgaggatgagccgcctacgaaatgctcagatcgtggcagcgccgagcacatccctgccaagggaagacgccggaagacgcagcgcccgagccaggcttccggattgcagaggacaccatcagacaaggcccagtctttgcagacacaggcatcggctacatcttcgagcacaacaggaacaggaagtgctggtcttctgaactcgcgcgaggagtgcgaggccggacgacgacgcttcgccgagtactgccgaggcagcagtagagcccgaacgttcctcctccatcatggcaaacctctcgagctcatcagggaggcgccgaagacctcatgcgcgaacgaggagacaaagctctacgacctgcacgactgcaaccttggagctaggcatcgaatcggccgaccttcgagcgcgccttccagatcgatgcgccgttcacggttttcgagctttcctgcagcgcatgggatgacaggcagcgaggcgaggggccttccgaggatggggttcgtcatgcgcgaggagcagccagaagccagagccttgtgcctgaaacacatccccggaagctccttcgggctaggccttgggcagctctatctgaggatcgctgggtcgagccgccgagactgatggctcccctataagccttctcacattcagaccatggcgggtgcttgcaatgctcagcgagattggcaccgcagggagctggcacgcgaggtgctgaccgaaggagttccaggggatggttaaggcatcaaggctctggcttctggcttgctcctcgcgcatgacgaaccacatctcgaagggctcgcctcgcatgccgtcatgccatcgctgcaggaagctcgaaaccggtgaggcgcatcgatctggaaggcgcgctcgaggcggccgatatcgatgcctagcccaaggtgcagtcgtgaaggtcgtgagttttctcctcgtcgcgcatgaggttcttcggcggactcctgaatgagctcgagaggttgccattgatggatgagaagcggtcgggatctcctgcgcatcgcagtaacatggcgaagcgtcggcgtccggcctcgcaatcctcgcgcgagtgcagaagaacaggacttcctgttccttgttttgtgactcgaagatgtagccgatgcctgggttctgcaaagactggcgccttgtctgagtgtgcctcctgcatccgggaagctctggctcgggacgctgcgcttccggcaggtcttccttggcagggagttgctcaggcggatgcccgatctgaggcatcatttcgtaggcaggctcatcacctcgtctttcgtgacgccgccgaggccggcttcgccacgctctggtgcctgcggacctggatgtagaagtgctccatggaaaggcgaccagcgctcttggggcctagaactcggggatacgctagtccctgccctgtccccatggacagagaccttaccggcgcgtagggttcgcctatcgtcgcagaaacgccaatccttctggggttaacatggcgaggccggcggcatttattgcgctcgatgcagcagaggtcggtcacctctatctcctcgaggagtagagtgcactcatcgatcacccacatagcggaggtctccgaagaagatatggggggatggcagagtgcctatgcaggagcaggtccaaggactccggcgtgctcaggaggatgccgagggttgcttcagcatctttgcttgtggggactgaggagacatcgccgtgccagttgccagacggggggattgccgccttcagcacataaggagtcaagacgcggaaaggaaaactggtcgttgatcaagcgccttcaagggcccttgtagatggcagccgacagaggcgagggaggtcttcccagaactctgtgagtatcgggaagaagggcggcccggtcttgccggaggcgggtagaagcggtcaagagcacattctcgtcggtgtgagatggccttggcagcggctacatgcacagctctcaggttctgcagttcgagctatagatgtagtcatggatgtgagggttgcatagcggagaagacattccatggactagatctcgaatccgagaagcggtcattggctattctgcaggcgatgcagaagagcgggtgctattcttcgcgcagcctcgacaggagcatccccaccggggccttaaggaagtcgccctggatgaggtcgtctgcattaatgccgggggttctggcagaggatatccaggagctcgactttgaagtcgcggatggacctccgcgcgagcgtcagaggggttgtcctgcaccgacggcgctcgaaatcgcagcaaggaaacgcacgatgaggctctcctgtgtgatggtcatcgtatagcgaagaggcctgcgtggagtccgcgagctctccacgagcacaaggacgaggcactgagaagccgccttacccagggtcgctttgcccaggaaggcttggcagatatgctcgccccggtcatccacttggagcctttaacccacgaggagctcctcgtcctgatcgaaaagctcgccgatatccatgccggactctttggctataagcgcaccatcacccaacaggagttagtggccttcttatctgcagagtttgatcgtgtgggtgcagattcacacctgaccccgcgtgaggttatccgtgactttattgagatgctcgatatcctctaccagaatccaacgatgaagatcgaggatctgctgcagggcgacacctttaagaagcccgtcgagacacccgtagaggagcaggcagccctacgttccaagaagacaaatgccacagctcagacaggtgacagcggcaccgatgagtttgccgaatttgatatctaggggtgccgatggatacttttgaccgttatgccccctttgttcaggacttcatctattcccacaactggaaagatttacgcgccgtccaggtcgctgcggctgatgtgatcttcaacaccgacgacaacctcctgcttaccgcctcgaccgcctcaggaaagactgaggcggcctttttcccgatcctgacccagttctatgaggacccacccacgagcgtgggctgcatctatatcgggcccttaaaggctctgatcaatgaccaattcttgcgcttggaacccctgtgcaacgaggggaatatcccggtgtggcactggcacggggatgtctcacagtcccataagcacaagatgctaaagcatccctcggggatcctgcagatcacaccggaatccctggaggctatgctgctgcaccgccacagtgcgatacctcgcctctttgcagatctgcgctatgtggtgatcgacgaggtacactcgctgctcagaggggaccgcggtgaccagacgctctgctgtatccagcgtatcagccgactcgcgcacgtcaatccccgccgtatcggcctttctgcgacgatcggtgaacctgaagaaaccggtgtctacctctcctggggcagtggccgtaagtgtgcgatccctaagtttgaggcccctaaagagcgctggcgtctctccatggagcacttctacatctcaggtcctcaggcacccgagcgcggtgaagatggactcggtggttccactcaaactgttgagaacgacgtcgcctatgagatgccctacaacgagcatccacgctcagagcatatcccaccgcgcgatcagcacaccgaagatgtcatagacgtcactgacgctacaccacaggcacaatctcccgacaaaggagataccccggaacccgcctcagataccgccccggtctttgcggatcctggcatcggctacatctttgagcacactcggggacacaagtgccttgtcttctgtaactcccgtgaggagtgcgaggcagtcaccacatccctgcgccaatacgctgaggcaaacggggaaccggaccgcttcctcatccaccacggcaacctctcggcgagcttccgtgagtccgctgaagatatgatgcgcgacgaggacagcaagctcaccacggtgacgaccgccaccctcgagctcggtatcgatatcggccgcctcgagcgcgccttccaaatcgatgccccctttacggtctctagcttcctacagcgtatgggtagaaccggcagacggggtaatccctctgagatgtggtttgtaatgcgcgaggagcagccagaggccagagccttactccctgagaccgtaccctggaaactgttgcagggaatctctctggtacagctctatatcgaggagcgctgggtagagcctccgcgcttcaaccggattccctactctttgctttaccatcagacgatggcaacactggcaagcaccggtgagatggctccttctgagctggcacgacaggtactgactctgacccccttccaccgggtgagccaggaagattacaaggtattattgcggcatctgattgagatcgagcatatccaccgcactcctgaaggtggccttattgtgggtcttgccggagagcggcagatcaatgacttccgcttctatgcagtcttttcaaccgatgaagaattcacggtccgcagtgaatcgcaggagttaggtacgatcgtgcagccaccgccggtcggagaacgtatcgcaattgccggtgccgtatgggtgatcgaggagatcgactacaagcgccacctgattgaatgcactaaagtcaagggcaaagtgcccgcctatttcggtatggtcgcaggggacatcaacacccatatcctggaacacatgaaaaaggtgttgcaggaggatacggtctacccctacctcagaagaaatgcccgctttaggctggcgcaggcgcgccacgtgtgccgcaacgcccacatcactgaccaaccactgatcaacgtgggtggcaggacctactgtctctttccctggctcggtacctatgccttcttggcactagagcgtttcctcaagatcaaatgtgcagagcgcttaggcctcaaaggcctcgactcctcccgtccctacttcctgcagtttacgatgaaggtggacggctatgagttcttcaaaatcgtgaaggaagaagctgcaaagccactcgatccgatagatctgctctatccgggtgaggttccctactttgacaagtacgatgagtttgtcccggaagagctgattcgcaaaggctttgtcctcggcgtcttggacgtggatggaatgctcgagcggatccgctcgtggccgggaccgaatcccgacgaatctcaggcactaccacacggctactctgggaccctggcatgaggggcacacagggcgctgcagtatttcgatcgtgcaatgatcctgaggagatcgcgactgctacactccccacagtttgagccaaccctataattgcagggagtttaagccaggagcacctagtacacaaggaaggatgtcatggatcgctggatggcctttggaagctttattgcccgccacatgatcgtaattgtccctgcctgccttgtgtgtggcatctgttttccctggctctttcagggctttgtcccctttgtctccccgatctttgccttcatcaccttccaggggtcactgaccaacgacttctcgaatctgaagaataccttcacccatccgctgccgatgtttgtggctatcggcatctcacagcttgcaatgccgttgcttgcttggcttgtaggatcgctcttcttctctgaccccaatgtcgtctgcggtatcgtcctggagtactgtgtaccgatagcggtcacctccacgatgtgggtgtcgatctatgccggggatatggcactgaccttagggattctcttaatctccacctgcattgccccctttacgatcccggccaccttgcagctcttactcggtgccaccgtcaccgtggacgcccgagctatgatcctacagatgctttttatggtggcaatcccggccctgcttgctacctggctcaatgaccgcaccaagggagcagcaaggacctatctctccccacgattgatgcctgccgcccgtattcttacggtcctggttatcactaccaactccacgagcctttcgaccttcttcttcaacctcaccccggagttgatcggcatcctcttctttatcgccgctatggccgcctcaggctatctgtggggatatctggcggctggtgctctgcacgtgcgtcgcgcgcaggcagtcagcatcatcttctgttcagcactgcgcaatatcgccgccggcgctatcatcgctcaaacctacttcccgcctatcacggtcttcccggtgcagaccggcacactcttcaaccagttctttgcagcactcttcggtaagctcttaggcccccactttgagcagatgcaggtagcggaggtacgggaagctgccgcgcagcatgaggctactcggcgttgacccaccttccctactgcatacccctttcttatcgatatcaatttcttatatgtgaatatattgtgtacagcttaattgtgcgcaatatatttactcaggaggctatagcactaagtatcagtaaaaagtaccacacgatgaaaggatgacacatgagctactacgactacaccgtcaccaaacaggacggtacgcagaccaaactcgaccagtacaagggcaaggtcctcctgattgtcaacaccgctaccggttgtggcttcaccccgcagtacaaggacttggagcgcatctacagggagtaccacgatcagggctttgagatccttgacttcccctgcaaccagttcatgggtcaagccccgggcagcgatgatgaaatcaacaacttctgcaccctcaagtacgacaccacattcccgcgtttcaagaagatcgatgtcgatggggaccacgcagagcccctcttccgggatctctccctcgaggcaccgttcaagggcttcaccggccctaaggcagcctctctgcgtcccttctccaacgagaacgccaagcagttcggggacaaggcctatatccgctggaactttaccaaattcctgatcgaccgcaacggtaagcttgtgaagcgctttgagcccacggaagacatgaagaatgtagaagccgcaatcaaggagcagctctagtggcaacgcaaccacccagcacggataagtcacgctaccctgagcttttgcttcaaaactagctctgcttctccctctatgcggcctcaaaggccgccaccaggcactaccttctagaccctttggagctcacctacatgcaatatatctgcatgatggtgatgtggggggaagcaggctacgatattccgcatcggtgagcgcctcttcttagattccgggacgctcaccccggttttgcgcaagctcgagcaatggggctatatcaagcgatcccgccctgaggaagatatgcacgaggtaatcgttacactgacccaaacgggcgaagtcttacaagaacgcgcccgtcagatacccaaaagtctcgcatgtatggttcacctggctcctaaagagacgcgggagctgaaagatctgttgcacacaaaatgttggagggtttcgacactcaatgttagagcgcatatagagccgcaagtccgtaattgttcggacctccgccaccgatctctgcgccaatgcgggccttacaatcatgacggctatcatcagtgtccccaccaattcaatcgaatcatattcgatgcaatcaataactcctccgacactctgttgtctacaatcacgatcgtaagcaccaagctagcccatctgtcaccggataagaaacacccgttcggctatggccgcatcgagtacctcactgcctcggccgtctctatgatcgttttgtatgcaggtatcacctcgctgatcgactctatccaaacgattactgcgccggaagcacccagctatactacagtgagtttgactctgaccgcggtgacgatttccgtaaagatcttcttggatcgttttgtcaaagcgaccagtgagaaagtaggctctgacgctttggtagcctccgactcagatgcccttctcgatgctaccctttccatctctaccttggcgacggcgttcatctatatcgctttcggtatcagcctcgaggcttgggtcggtaccgtgatctctgctgttatctgctaaggtggcatcgatatgctccatgacgccttaacacagatcttaggtgagcgcatcgatcctgatctggcagagcgagtcaaagcgctggtcaaggaagacctggatgctttaggcgcgtacgatctgcttctgagctcctacggcccaagcttcttgtcggcagcatccatgtgaaagttagagactcaatgagagtagaagaaattgacactatgatgcgcagggttcaacagaagttccagcacgccaccaacggcaaagtgatcctggccacagtgggcatctatgcccaaaaccaaggtggcaagacggctgcccatgcccacggtattacgatgcatatcgctaccgaagagtcccatgtactacaggctcatggattttacatcgatgaggagtggcagtccatgaacttacacatcgtggtcaattttgagacccctaaccgtgaggcagtacaccagaaggtcctcaccaaccgcgagaagcgcttccctgcctattagatccacctcacgatggactcagctgtacgtggttagggttatcaatacttgctctctaagtacaatagagcccacatacgcgggctctattgttttttgttagtccatatcctcgtcgagcagcgtgagaccggtcgctttgatcaggcgttctaacgcgtcgttaacctgttctaaactcaaggtgccgtactccccttgaatccaggagctgtaggaggaaagtattccgtggacaacgtagtcgacggtgatcacaatgagggcgaggcggtgtggttctctgtccgcataggttttctcgattgattcatagagacgcttttctatgctttgctccagcgccaccatgaagggattaaatgaggtggaacgggtgatcgaggtaatcagcttccggtgcatctgcacgaagctacccaactgaaccaacatgggacggggattctttaaaaaggagatatcgtaccagttagaggcaaagtcaataaagcggtcggctagatgttctaatacatacttttcaagatctgacatcgaagcaaagtgcgcatagaaggtcccccggttgagacaggcctcccgagtgatatctgacacggtgatcttgtctactggcgtcttcataacaagcgtcagaaacgcttcctccaaaaggtgcaaagaacgcaaagaattcctgttgctgccctctggactacgctttgagacagtctttgtgggctccatgtcttccatccttcttgctcccttcggcaatgacaccaaccgttatggttcactatatcttcacaagtaaaaggttatttaaacaagtccttacaatctgtataaattccccgctcttctagatatacatttttaaattgtggtaaaaacccaacatgtgttcaatttcggtcacttgcctcattgaacacgcgaacggtaggacgcaacagtattgaggaggagcccatacatggaaaaattcttccgtggtgtactcaagcacagaaggatcgtcattaccgtatttctgattgtgaccgcgatatgtctgacgttgatcccacaggtgaagatcgatgcagacatgtccgattaccttcctgcatcggccccctcctctcaggacttacagctgatgaaggacgtatacggcaatgatatccccgatgcgcgtatctatgtcaccggtatctcactgcccgatgccaacaacttcaagaaccaactcgagaagcaagcgggcgttatctccgttacctggctgggcgatcaagccaatattgctctgccccttgaagtgcaggatcaagacacggtcgatagctggtatgacgggaagggctatctcttccaagcagtcttcagtgaagatgtcgaccagagccagatagaccacatccgcgcccttgcccaccagatcccgggtgcccagactgtggcaatggatggctctgctgtatccaacgctgccagcttggcagacatcaacaccgatatgagccgcatcatgttgatcgcagtgatcacggtcctcgtgattgtgatgctcaacactacgagctacctacacccgatcgtaatgctgatcaccatcggtatcgcaattgtcctgaacatgggcactaacatcttcagggggacaatctcctctatcacccagttggtagcctcggtcctgcagctagctgtgtcgatggactactccattgtccttttgaccaacttcggcaaacagcgagaaaagaatccagatcagtttgaggctatggtccaggcaatggctgtatcctttccggtcatcctgtcctccgctgccgtcaccttcttcggcttcctgtcccttgctgccatgcagtttttgatcggtgccgatatgggaatcgcgcttgccaaaggtatcgtgtgttccttcttctcaatcacactgtttatgccgtgcatcctctacgacatgagaaacgccgtggagaagaccactcacaaaccgttcttcaaatccttcaagggcatgtccaaggtctgccatgcaggcgcaatccctgccctcatcatcgcaatcgttctggccatccctgcttatctggcatccgactccgtaagcttcacctacggagagtcctccaacttggctccgacctcacaggtgaagatcgactctgaccttatcaataaagccttcggcgagtcccagacctgggccatcatggtccctgagggacactgggccgaggaagaggacctgatcgacaaccttgaggatctcccgaccaccaagtccatcctctcctggtccacaatcgcaggtaccgcaatgccgactggcgttggcccttcctctcaggtaagccagctcctgaatggcggctactctcgcatcgtcttaacttccaagatcccagatgagtccaaggaaggcttcgacctcgtcgaacatgtccgtgacctcctgtctcagcactacgacggggatacgcacctggtcggcaataacgtgagctactacgatatccgctcggtcacctcctccgactccatggtcgtacgtatggcttccgtcctcgcaatcggtgcagtacttttgatcatgttccgctcgatctcgatcccaattctgttggttaccgcgatcgagctctccatctggatcaatgaagcggtcccgtactttaccggagagaccatcaacttcgtggctttcctggtcatcgatgcagtccagctcggcgctgccgtcgactacgcgatcatctacaccgaggattacctgaagcgcagaaagatcacggacaagacaaccgcaagcgtcgattccgtggagcacacagcccagccgatcatgacatcaagctcgattctgatcgtcgcctgcctaggtatctacttctcggtctcaagcccgatgatccagcaggtcggtatgctgatcgcccgtggtgcactgatctccgtcattgagatctttttcgtgctaccgctactcttcagaatcttcgacgggtttgtccgtcacaccacatggcacgccgggttctatatgccgggacagaagaaagttaaagagccccgtccaacccgtaagccccaacagttaaagtcccgctaatgtaagcattttcccagttaggagttttaggctatgaaaaaacagacagcaacggtatcagccggcaaacgtatcgtcgtgggtgctgtgggtaccgccctcgtcatgagcacgtggcctaccgcggccgtgcaagcactcgctgaggacaacaatcaggacaacaactcagacgaatcttctgagtcacaagatacgcaagatactcagaacaacagcaccaagaagactgaggtcgtctactccaagcacgacgccgccggcgccactgacggcatcttcgtcgtcaacaccttcgataccgataaggcaactgacgtctccgacccaggaacctatgagagcgtcgagaacctgtccaccaaccagcaactgaacaacaccgacgatcggactgatctgacgacgctcgccaaagaaccgacctactatcagggcgatctgaacgaaaacaccactctcccctggagagtttcgatcgcctacaccctggacggtcagcagatcgacccggatgagctggcaggcaaagacggcgagctcgatatcgacctgaagatcgacgggctggatgatgactctaaggaagccgacttcgccaagagcttcatgctccaggcacagggtactttcgcaaatgcgaacttctccctcgaggaggccaacgacgcaacgatcacccaggccggcaataacaccatcctcacctacatcctgcttccgggacagaacggtgactggcacatccgtggtgatgcaaagagcttcatctacagcggctggcagattgcagctatgccgatcaacctcgacctcaatgtcgatgactacgacaccagcgacatcactgatgccgcaaacgaactcgaggatggcgcaaaccagctctctgatggcggcaatgctctgagagatgccctcgatcagatcagcaatggcgcaagctctgccttcacgggttcctctaccctcacctcaggtgcaaacaccttggcagccggcaccagtgccgcagccagcggcaccgcacggctctccagcggtgcgaaccagctctcctccggcctcaaccagattaacgacggcgcaggtactgctgctgacggcagcgcaaccctcgcttcaggcactgatcagctgaaggtaggcactgacgctgcaaaaactggagctgcaaatgctgcagcaggtggtattggcgtagcacagggctctagcgatcttcagaatggtttaggccaactcaagagtggtactggtcgcttaagcaaaggtgcacaaggcttaaaagaacagcttaaggcgcagaacggtggtctcgatgcccttacttgtggttctcagcaagttgctgatggtgctgctcaggtcaatcggatggcttctggtttaaaagatcaggtaggtgcagttaataatcaaatcaccgcagcaaagaactctttgactgacatccaaggtagattaaacgacgtcaagacctcttcagaccagctcaaaacaggcgcagtaaccgcacaaaatcaggcgaatacagttaaaaccgatctggaaacgattcaaagggagatttccagcgtatcgcaattgcctgacgctttggctgcaatcggaaatgcttctacaggcgctgcgcaagatgcaggtactgcggcaggggctgctacgcaagctgcacaggaagcaggcacagctgctgtatctgacgctgctgtatccgattccttgaacagcctcctcaatgcagacaacctgactgaggatcaaaagactcagataaaggcggcacagggttctctgaaaaattccaccaacgctgcaacctctgccaaagatcatgcagccgctgctgcaatctctgctacttcctctgcacagagagctacaacctccgctcaaacagcgcagcaagttagccaatctctgcaatcagcacagaagctgatgcaaactgctcaacagttgaatgccgatgcagatgcacttcagaatacgctcgattcgcttagcggtgataacggcatcggctcagtcttacagaagtctcaagatgcattaactgctgccaatgatctcactcagaattcttcagagtatgtagatagactcaagaatcaacttcctactgagaacaaattggctagtattgcacaactcgccgatggggcttcacgacttaacaaaggtatcaagaatcttgccaatcaattaacaaaaggtgccgatgccctgattgaaaacagtgccaagcttgatgatggagcaggtagtgctcttgatggatcagtaaaactcgcgcagggcgcgaatactctgagcgcaggcctcaatacgctgagttccggtacaacacagcttgataacggggctacacagctacagtctggtagccattcgctgagcgacggtctcaacaccctgcatgcagcaactgcaaccgccgcaggtggcactaacgaactgagagctggtgttgatgcgctctactctggtactatgcaactgaatgacggtgctgaccagcttgctgccggtactggagagctcaacagtggcttaggccagcttgctgacggttctgctcaggcagacgatggctcccacacccttgctgatggcttgaacgaactacgtgaccgtgtaagcggcttagaccagaaggtcttggatcaggtacaggatacaatcgacgataagctggggcgcaactaccagctgcactccttcgtcgccccgtccaacaccaatgtccgtgaggttgagttcgtctacgttgtcgacggtatcgaagagcctgaggacaacaagaactccaatagctctgatcagaacgacgaccagaaccaggacttcctcgatcgtctggcagcgctcttctccaagaatcaggatgactaagagacttttcgataactttgtcttcccctttttcgggtggcacacctgcgtgtgccacccgtttttcggctcttcgacgtccctagtgggtagcacaggctagctgtctctggactgagaagttgagtttctcagtctgagaaagatccttgtcttaaagtaggcgatgttcctgaagcccctggcagcgctttttactgactggacgatcgagttcagcccttcgagaaacaaattggtcaaactcctctcccaccagttcaagatcccctcacgctcttcctaagggtacctgccaccctcttgatcttagccacggcagagtgcatcatccacgagcagagccggtctggggctttggctgtagattttctgtcagggcagccatagacatcctgtatcgcctctgccatctgtgcctccctgagaagtgagctgtaatcttttggtggacagctgggcgccagcagctggaggcaagtatcctttgtccagatgcccacccaacaccacctgtagctttaagccatgagatgtcagtgagtgcaagtaaggcggcagattagcattctaagtgcaacaggatagcccactgaatgcaagcgtggcacactccggaaggctacgatgttggttgtctcaatcaacgtcgaaagctagaaggaatgtgccactacaagcatctcaagcctacaggagagggactgcatagccaagctgcgtggcacaagggaagctccatcggctatatcgcggcagagatcggcagggacagctccagcgtctgccacaagctcaagaggaacgcacggcacggacgctttagggcatgtgctgcccaaaaggagggcggatgaacgccgcaggagatacagggcgaaaaggaggctttcagaccctgcacttacgcagaaggtgcgcttactcatcatggacagacactggtccctggaggagatagactatatctcaggctcgagggtggtgtcagctgcgtcgttgagcctgccgactattcttacaggcaggtccgtagccacgctcgagctgccggaagccggcccggaaggccagatacggcgccatctgcgcagcaagaggcctaagaccaaaggcaagatcgagatcttacacaccgtaaaggagaggtccaagcaggccgatgagagatctcgcctcagagagtgggcagacgacacgctcgtggcagcgggacccgtgtgcctgctcgtgcttgccgacagggcattgaggctgcttgccgcggaaagagccagcacgacagcggaagcgtctctaaggccgaggtcgggctgctgcaggaacgtcccctcgagacgctcactccggataggggcaagcagttcgcagggcatacagatgtcacaaaggccttgggaggcgtgcagttctacttctgcggtccccaccatctatggcagaagctaacagttaagaacaccaacgggctcatccgcgagttcttcccctaagggcagcgacttcagcaaggtcacaaacgaggaggtgcagcatgcggtggagctgatctgcgacagggcgaggaaggtcctgaaatacaggacagccaacgaggtctttagggagatgttacactcagcttgacaatctgccggatcaaagactgagaaggcagacagcacactgtgggaaagataaggggccttacacttgtcggcaggaagcacaagatacctaagcgctacctcttgcacagacacatacagcacaagctgtagctaagacaggaaagcttgctgtatctggttgccctgtcaagaccagcacaccaaagagagacaaagagatctgcacagcacagagatgtcacacagacactgaaagctgagcttctcttctgtctgccttatcacctgtgacaaaaagcgagcgttgaaagacagctatggccctatctaagagtacctcccaaagcgtacaagctttcctgataccaccttatctgaagtcagacagctctatacgaatgctaccaacctaagaccgaatagatgcctcgctaacaagacaccctgagaagtctttcactttcagacgttgcagtcggtagggggattcgaggcacaatattcactacggcgggtatccgctcttggcttacgggatggcaagaagagtagtgactggagcgctgcgcaccacacgtcacgatctctaaccaccaactcatcccctccttcaaagcggcaggcatcccacttgggacgcctgccactgctcgcatcgctaccccgcatctctgctatcactcaccacatcaggtgtaaccctactggtacacttccctctatgaaatgagggagcacaccgtctggcatgttccccccctctgaattattgcgttctatattagcgatgtcccttcttgtggtgcagctttgtcgcaagcacctcatcaatctctttgcgcgcctggcgtataaagatcaccatcagtaaactggtcacgaagacgaccgtgctggtcagcatgctgccaatgatacctgcgatgattagtccgatgctcgtcattaccaacgtaaagaccgtcatgttccagaaggtattgatcgagcgggcatccgagatgatcgtgatccccatgaagcctgagattagggcagcaacgttaacgataagctcgaccaccagcatgatcctcaaatacgttatcgcctgttcaggctgtattcccatagcttcagcggctccagcattaaccacagcactctgtgcatcagggttattcaacgccaagagagtcataatgaaatagatgatactgatggatgcaatgactatctgcacaaccactgtaggaaacagccgagcctgccctttagtctgttggatcgtaatatattctctcttcttcttgctcacagtatctcctcgtataaatattatcaaccagggcgctgagagatatagccatttattttttaaagtttaaaagctaaactatcataagctctgttgtattttgtgatgctcaattgtaattctctcagtagatttatactggcaagaatcgctttccctctatttaatttaggcacctgttttaaagagccaacgctcagatgattctgtattacgtcaaattcatttttatgcgtcagcctatgaactaaaagagtagcaacttgtccaaataattcatcaggaacatcttgtggactcaggcttgttaaaaaataaatatattcctttctttcctcccttgcaatatatgttaatgcctgttgaaattggccttcagagggtgataacgattttccgtaccatttccatcgataatcctaagctgccagggccaagcccaaagccttcctgaactccatcgggctcacgcctttgagcgagcgcttgcgcctgaccgtgttgtgtctgacgatgtagcgatcgatgcgaccctccaatttgcccaagatgatgccgtctcacttgcgcttgcggaatatctgcgctacctcggtctagcgcgaaggtacagattttcaaggaaggaaaaggataccgaaggttctctcgcaaagctcaaggagcccgcggacgaagcgcacgatacagatggtctcacggcgcttgtctgcgatacgtctgcccgtgctcactggctcggaacgcaacttaggaaatcggcccgcgtcatggggtagacaatatcctgcctctgaggggtgttgtcgtcctcgatctctctcgccaaggggctggaattcgatacggtcatcgtccccgacgcacagacagaggtctatcctgcaacgctgcttgtgagacgttgcctctataccgctatctcccgcgtcatgcacaaggtcacggtcgtcggccagggaaccatcaccgagcttcttgctcccctcgctacccagatacaggaggtctgatccatgggaattcgctatgaacaagtccactaccttgcctcgtatggcacggtcgagcagctgccgcagccgaaggctcccgagatctccttcgtcggccactccaatgtcggcaagtcttccctcatcaacaggctcttcaacaggaagtctcttatcaaggtctcaagcaagcccggcaagaccgcttacaccaacactgataatgacaccacagttgattcgacagaggatttcctgcagagttggctgtagggcatacgccctgggaacattggcttgcgacagggcgctggcccatataccaaccgtcgtcgcgcagactggcctgcagctgccctgtcgcgccctgccgcgggcatcccgaaagcctgccatgacttcacaggagcatgggcactgccagcagaccggactctcctgcttctagcgcttctgtcagtgttgtgtctggcctgccgataagatgcccacaacggatggaggtcttgcatgtctggttccggaacgctctgcactggcgtcgacacacacaaggacaaccatgtgctctgtgtgttagatgccatgggcagaagtggccttcagcggggagtttccggcagacagggtctgatacgaatcgctcgtagaggcgatgcagaatcgtacggtgtctccatcatggaggtcctgcggcccaagcgagacaagaggcaccgcagccgacaaaggcacaccggtgccaaagtcgagggatagccgggccgaggcggcaaggaccctcgtacgtgtgagagagatatgcgtgcgaacgtcgacggctgcatccagcgccgtgaagcccctgcacagaacagctccggaggagatccgctcgaagtacggcagggtgggaacttccgaaatgatgaggtcgcttgccaggaagaggccaaagggtgctgagctggtcgccaactcgctgcttgtgctccaggcgcttgcgaagacatgggtagccgagctggaggcgctcgtggtagagcttgtgcaggacaatgcgcctgtcctgctaaagatatagggctgcggcccgctgctctcggcatcgctgtgctgtgcgcagcggcacccatcgagcggcaagcctgtcagataccggctcaaccgacaggctttccgggcgctgtataccatcgcgatcagctgcatgtgctacgacgagcgggggctggcctacgtcttcagaaggacagctaaaggcacatcgaagcgcgagatcacaagatgtttgaagagatacataaccagacaggtcttccgtgctcttttgaatccggatgccaaaaagcacgagtgcaaagagagccttaaagtcgaagcggctgtcggcacacctcacccacagggagaccgctgtaaggctttaacaccgagcccgtcaggatcagcgagatcgagcgcgaagcgaggaagcactgcgagctttaggacagatactcgatgctcctatccgaaatatgcaagagccgtgagatgactcttgacacaccataggagcgtccttgccgaggctgacgacatctacttcgtgggtcttcccggctatggctttgcgcagcgttcccagacagagaagcagcgttgggctgatttaatcgatgcttacttcacgagcgaacgcagccacaatcttgtgattgcacttgtggacatcaggctcgatgcccaggcactcgacctccagatgatcgactacctgaaaggggctggccttcccttcatcattgccctcacgaagacagacaagcgtgcccaccagaaacagcaggcccagctgaggaattcggtgggcggattgtcaagctgagtgcaacatctccctaaagacctcgttggctgtcctgtatttcaggaccttcctcgccctgtcgcagatcagctccaccgtatactgggcctcctcgtttgtgacctttccgaagtcgctgcccttaggggaagaactcccgcaggagcccgttggtgttcttaactgtcggcttttgccatagatggtgggggtcgcagaagtagaactgcacgcctcccaaggcctttgtgacatctgcatgccctgcgaactgcttgccccactttaggcgtgagcgtctcgaggggacgtccctgcagcagcccgaaggcggccttagagacgctcccgctgtcatggtggctctttccgcggcaagcagccttaatgccctgtcggcaagcacgagcaggcacacgggtcccgctgccacgagcgtgtcgtcctcccactcgccgaggcgagacctctcatcggcctcttgggcctctcctttacgctgtgtaagatctcgatcttgcccctcatcttaggtctcttcctgcggattctcttccccttcctgcgcaggtggcgccgcacctggcctaacgcgtccggatcccggcagctcgagcgtggcggctatggacctcacggtagaatagtcggcaggctcaacggtgcacctgccgccaccctcgagcctgagatatagtctatctcctccagggaccagtgtctgtccatgatgagtaagcgcaccttctgcgtaagcgcagggtctgaaagccgcctcttctgcctgcatctcctgtggcgctcatccgccctccttttgggcagcgcatgccctaaagcggccgtgccgtgcgttcctcttgagcttgtggcagatgctggagctgtccttgccgatctctgccgcgatataggcaattgaccttccctctgcatgcagcgtggctatgcagtccctctcctgtaggcttaagatgtgtgtagtggcacattccttttagctttcgacgttgactttgacaaccaacatcgtagccttccggagtgtgccacgcctgcatccagtgggccatcctgttgcacatagaatgctaatccaccgtgtgaacgagatagtctgcatcatcacctcaacacagataggcttgggcatctataccctgaagcacttcatcgaacaggcctgctaaagcaaacatccaaagctaagcaaggaggctctcccggttatcccgggagagccttccttttgtctatcggctatacgagagactacttgtcgttcctgcacttcccgaagcgcatgcagacggcaatgccgatgaaggcaatacccagagcagagagtgcctggatcgtcgcgatggaggcggtatcggacatatccgggttcatctccttcctctgctcaggcttctgctttgcaggaggctcaggcgcggcaggggcagtgtagctgttatcgaaggagcagagctcagccttaccgacctttttgccggaggtatcaatctcgtagacgaagaccttgggcgtcagcttctcggagttatcattccaaaactgcaccgtcacctggtaaatgcgggagtcataggtccagttctcggcgtttcctacggtctgggtgaccttgtaggagtactcgactggctcagaagccgtcacagcgaaagaggctttgcctgctccattgaagaagagcgtgccttcggccagtgccttgtaacttgcatcgttctgaggctttgccgtgacagtgaagccaggaacagactcggccttgtctccggagagtgtgacctcgacagggatatcggcttcagccttgtcataagcgaatgcagggacagccgtgccagcgataacggcgcagatgagacccagagctgccacgaacaagctgagtccgcgaacacctttcgtgcggaacgatccaactttgctctgcctgatcatatccttgtgtccttctctgttgtagccgggcactttgagttccggcatcctgtatgactcatgcctgcagatgagcaagcacagaatcgctagtctcctgcattgtcctcgtcgtaccggtcgaccaccttgcagagcacgatagtcctcgcatccgtcgcattggaagagcaggtcgaaagagagatgatctgaacttccgaagagagactgccttgtcggtagtgcacagccgaactctcagccttctggactacctccgccacctgtcctgcttctgcaggcgtcccgaagatgacctgatcgtaggcattctccgtaagcaccgcatccacttcaagctcgagcgtctcgtgtggcagatagagcttggccgacttgttcgaatcgaagaagctctgatccagaaagaggtcgagatctccgaacatcttgtgggataccatgtggtgtcccatgatgacctcatagggttcggtgaagttccggtcacaggcactgtctaggaagagagatcctgacgcagagcttgctcccgtcgcatccttgtcgaggtactcgaaatcatccgatccctggaccaccggatagtcgatgcccgtgttgtctaccgtgagccaggcaactacatcgggattcatcgcgagaagctcgccgaaaccatagccccctggacgatactgcgtgagatcggtaccttctaccacctgataggaatcccaaagggaatatcctgcaaggcccccaatcaggagcaggacgatggccatcacccacgtaacgacatggtcaaagatacgggcagcacgggcaccagctgtctggtgcccgtaccttccatagcatccgaaggtgtctgctaccgcacgcatcaatctttagaagtcctcgccggcatgacgacgacgggagataacgagggctacaccgccagcgacagcaaccgtagcgaccgcaatgaacgggagggtgttcatcgtaatgccggtatcggaagcgaagcccttcttgttcttgaaggcaacagcgtcaccacccttgctgatggtacccttgccgatcggggcgttgcctcccttcacatctgccaaggtgacgttatctgccgtcgtatcatcctcgtccgtgacatcagtgctgtcataggactttgtatccgtctccgtgacggtataggtagcgccgtcagggaggttgttcacgacgatatgctgaccatcctgcagagtgaaggtatatgtcgttccagcagtaagcgtgtcagaagtaccatccgacttcttgacagtgtattgtccagtagcacctttgacatcgagggtatagctgaaggtatctgcgatgttggctgcagaaccggagacgttcttggagacggtcaggttgtcgtttgcggcagcagaattggtgaaggatgcggtttcggtcttgttgttgtccttgtcatgaaccttaatgctcttgataaccggcgtcttgctggttggatagtcatcgggccaggcaacagtcacgtagatgtcatactcaacatcactataagtgatattggggttagagcctttctcctccttcagatggaatacataggttcccggggtcgtgaaatcagtcgtaccaaagagatcagctgctgagagattagcagttgcagaggttttgccattagcatctttcttccaagttgtggtgacgtcaactttcttggtaccgaagtcagagaaatcggtcagggtgttggtgccctgctgctgtgtcttcgcactatcgaaggtgagatcgaaggtaaacttctcggcatcgttgagctgggcattggaagctgcaacccacgtcttactgacgagattgttggtagacgttacggttgttgcaaacgcagttgctggcataaatgccatggttcctgcgagcaccgcagcagtagcgatgctcccaaacttcttcgagctgaacttcatgatggatcccttcctctaagaatttacctatatctcacggagcctgaggagcgctatgagctttcccctgacctcgttaagcccaaccggaccaagctctctcgagtcttgggtagaacttctgtcgtcgttgaggatgaagtattgtccatcccttagggcgatcgggtatttgaaggaacccgaacctttcaccgtggttccttgcgtgaccgaagcctgcaggttgccattgactagtaaatctccgtcatcgtcaatctcgacggtatctcctggctgtgcaaccacacgtccgagctgaagggctcctccgtgctcgtacaccaccagatcgttcgtctcgagcgagtcgaagatcctcgtcgtcagtgccagatccccatcccccgccgtcggccgcattgcatttcctacaacacggaagagcccgaaggctgtggtgaagaccaagtagagcgctccaatgaagatcaggagcttgagcagggtacccgctactgacctctgcgtctcgaagtgacctctgcgtttctcgatagcagctttcgtcggagcttggaggagttctgagtggaaagcttccaaccacgaatcctttgcagatatctggctacgagaagtttcgtatcgtctgcgggggatggcgtcaggtgctactgtctggcttcttggagaagagcctcgtagcggacttcctgttcgcgatagagctgccggtacatctcgtccagcctccctattacgtgccatacttcccgttcgtccacccccatgaggctgtgccgccatgtaagctggtcgagcttctgcgctatgagctccagggatagctcctgcggatcttggggctcttgtgctgtctggccctgacgcccagtgctttgccgtctacttctcctttcactcgccatggttcttccttatggccgctgctgcgagcgttgctgcacctgctacagctacaccgagaagcacaccttgagatgcagtgaagatatcaagaccagtgtcaggaacaatctcagcctggttcgtgtagaccacatcagtggtcccgccatctgtaaccgtcgcattgacagtcttgggttcatccctggtaaaggtcgtagtggtatcgccgaccttcgcggtcgtcgttgtcttagcattaggagtagtggatgtctccgtaatgacaatggtcgtgtcagcaggaacgttggtcagcgtgatagtctcgtcattcgacagttcaacttcagctttaccagttccatcgaatgcaatagtcttgtcctcgcttgtgaatgtcttgttctcgaggccagcacaattcaactcaaacttaaacgaatcacttgtgttagcagcattacccttagtcatcttcttgagagttagtgtgcccgtcctgtaggtattggtgattgcctgagtaccagtctgtgcggtaagaccagtaagcttcactgcattaggaagaccctgcgcccacgcatcagtcgtattctcagtcacgctataggtgttgccaccaggaccagcagagacattgacagtcgatgtccaattgttcgctgcattcagcgtgacagttctgtaagtatagttggtctcacccttagcattcgtctgcttaacggtaactacaagggcatctggaagaagagatgaatcagcatcagtgccatcgctgttcttccagctcttggagacagtgagcttggagactggaaccgtcacctgcgggttgtcatactcgagggtctcttgatcggagtactttggttcctgaccagtcaccctcgtaatctttctgtatgagagcgtgccagtactattcgtatagaccttgaagatatcttcagcgtttgctgcgtcgtcatacgccttctggttcagctttacattgaagctcacggcataggtaacacccttctcaagctcaatgctcccgagatcccagctcaccttgccatctgtaaaagatgcggaaggaatgggagacgtcggcgtatagtcaacgccattcttcttgtagctgtaggtgaattcggggaccgatgcgtttgtcggcagggcgtaatccacatacgttgagttaagagtgtcctcaatcttcacgttcgtataggaaatattggtcgtaatggtgttggcgatattctgaaaggcctgattcagggaagtctgatcgcttgcactgtagtagttgcccgcctgtcccgcatcagaagcaagctgctgcatcctcgagacgttgccgaaaacgccaacagagaacagaatcttgtctgcgtcagtaatcgaggatgctacctgtgatgcatagtagtagttcttcccattgtcgtcagagttgcccgatccatagtaggtatggctgccggaggtactctcacgatcttcgcggtaatcggtataaccaccaagagtatttctgaatgtcggattgccgtcagagacgaagacgatgtaagtatggcttgcatcacgcgtttgcatgctattggcaactgtcagggcatcttcccagttggttccgccagttgcgctcagtccatcaacagtatcctggaaatcgtcaagatcggtagtgaattctttattcacagttgcataatcgctaaaggtgacaagcgaaagacgaacggcgtctggattatcgatggtattgttcgacagcagttcatcggcaagagagttaactgcactcttcgcaactgacaggcgcgacggtctggtatagtaatcaccccactgaccatagttcatagaacgcgagagatccatgacaacaatgacatcagcatgtgtagtcgttgagctctggacagagttgccggtcacgctgagcgtgatcttataggtaccatcaccattatccgtgacagtcttctcatgagtcggagccgtaaggtctgtcgttgaagcatcctcagcaaacgctgtcacaggcgagacgaacagacctactgccacgatgatggcgacagcagccacaagtgccttctgaacgagatgcaatgctggatgtgtccattcaagcgtcttcttcatgagcagcctcatatgctttcgttattgcctgtgtgtggaccgaactggaactacttctaacagtaaactgtttcttgaaagccactttggcccgaatgacttctcaaagcggattaaaagaacccgaatgaatcaatgctttcagataacctttaaacccgttttccgcagcttttctgccagaaataggccatctgcctgcagaaatatctctgtgcagatgaattttccccgacggcacccttgcccaaaagatctgccttgccttcctgtagagcaccttgatgtccgaggcgcgcatccatttcctcggagcctcctcgcttgcgagaacgaagatttcgtcggtgaaccctgtcaatataatggacagcggaatcgttgtattcggcagagagctcgtctatgaacctgaaccatacatgatgtctcgtttgtttctgcctactactcatggtgacccatttctacctagatgccgacagcccaaactcggcgagttgctgttcctatattgtgtatattgcgaacgttgcgaacacgcatttctttattgagatgctctgaagtctacccccccccccccgaaaatgcaagctaaatctcgcgtattgagggagaaattttttgatcacatggcagcgggctttcaaggagataggggttttgtatatgatcgatagcaagttcacgaaggaagagtgtatgaggcactcgtgggaaggtaagaggccaggtggggatccctgccttccttgccggctataagcgcatcgagcgggcgatctagcactagaaggaagccagcatgaaggggcgccctcacgaagatggatacaccccaggccaggcaccgtggcaaggcagagggcctccatgccgcgtgagaaggccgagaggaaggccctttaaggcgcaggtgaaggctttagaggctcttgacacaccggcgagcaggacccgttctttaacgtgagcgcggcctgtaaggcgctcgaggtctcgaggcgcggctacttacgagtgggtggtcacagccctgaagcgggccgagcacgaggatggcgacctcacagcgaaaaagcaggtgcaggtagccttctccactcacggcttcgggaagggctcgcaccagatcaccgacaaccttgttccgagcagaaggtcaggatgaggtgcaagaaggtgcagcgcatcatgggcaagttcagcatcgtgtggggcaggaagtgcaggaggccctaccacccgatcgggcaggacagcaagccccgggtagcacccagtgccgtggacagaaacttcaggagcgaagatcccttgaaggtcgtctccaccgacaaacacctacctcctatacagggacgagagctccctctacatgtccgacatccttaactgtaagagcgatcgtgcttcttgcctacaagtgtttagcctcgatggaggagaagctggtgttcgatacataccgatcaattcaaaaggttcgagcttcccgacgacatctgggcatattcaaaccagggcatccactataccgcaagggcctacagggcaagctcaggcagcttgaggcccgcctgtcgatgtcgaggcggacatgttgctggggcagtgcctgcatcgagagcttctgggggcagatggagaagcagatgagatacacagcgcacctcttggcaagcgaggtaatggaaagggtcgacaactatgtcagctactacaacaatctcacgggacaggaacgcctgggctggctgaccccccttagggaaacgatgattaatgccccataacgtgtcagaggggaccgaccacacgacgtttcgcggccggtatgcgggaaaggcagggaaggatgcccatccagcatgtacagaagccgccatccttacatctgtcctgtcccatgcatcgcaagaaggctccaagacagatcaagcgactctgggagccgggaggtgcagcctgccggcaaaagatgcacatgggtaaggtttgcaagggcgagagagactcgagcatacaggagctcttttctatccttctgtagcacttccttaaggggtcgaagcgccgcttcacgataaggaagggatgctctacctttgagcggatggatgccttcctggactcgatgcctttctcggacaagagtgcacaggcaaggccctctctagtcgaaggcttccttagcaacgctttagcgcacagatgagaggtgtgggtctttatgcgtccttaagggcgcttcgctatacctatatagcctaaagtctgcgcagcagaacctatcatctttccttacgagtacgtgtgccacaggatatgtcggatacattctaggcgcttggtctttacaccatgcacaaggccacctgcggcatccacgccgatatgcgccttgtatcagatacgccaggctccccctttcttggactggtgcgccttaagggtcgcgtgcatggtctttgttcttcgttaagctttagggcccaggtgaaggtcgcatctaccatggagccgccccgcgccgtgatccatgccttctcaagcttctaagtccaggcgtgaagcatagccttaccgagtccctgccgctcgaggctatggcgcatcttcgcaagtatcgttgcatctggcacctgcgcctgcatgaggtctgcgtgcacagaagcgctgccaggaccggcaatccaggatagcatctttaagttccctcgtcttaagagagcaaacataacctaaagcaggatacatcctaaagctttgtctttgcagcgcgcacatgcctgacaagagcctgtcagtagtagctggtatctaccagtgcaatccagctatcccacacaacgattgcatccatccgctccaggaatgcctctcgtctggtcttcttccttagaccttaggatttaaggtcttaaaagctcatctgtctgtccatatcttccttttggatatgctggaatacgttgctgtaattataacatatccgcaggcagataggcatttatgtgggtatgggtactgcgtgattcgagacattttaagccgatgtcatacagcgtacagccccactgacctcatcgagccgaattaatcatcgtttccctagaggaaagaagtgcagggcaacccctcgcggagtcgctcttcccatatctgaatactttctgtaccgtagctggcgctatgccgaataggtacccacatgaactaccgaagagttttttcatacggcatacggtggaattcggcagaggtgtgaaacactgcatgctcaggtctctttgagcgtctgccacaccagagttgagataccaggcctctcttcagaacaggctactgtgcacgagagcggcccaatagaaaggcccgcattgtggtctctccagcattggggatctcgatcgccacacgtttcatgcaatcttccaacgtacaggggccttcaaccgtcgtgagcacacagtcgatccccgcactgt

SEQ ID NO: 307 - DNA, 15462 bp, Unknown
  Metagenome-assembled genome
tcgtcccccgatcatccggatgcatcagccgttcatccagatgattgcagcgggagcggcgacaggaatcatgcggttttatgcggaggtcccagccattttcggatattatagcgcaggaagcttataggtagcgatagataactcgttagttcatattgcaccgattgatgggatgatgcatccattcagacagcagaccctgatggaggcagcatgagcattgcatatgacaggaagaccccaccgcttcgacgtcgtccggaaagctttcctgcggccagagaggctccaacgacgcgcaatatgcctggaaggcaggaaggaaaggatctcctgcagagagaaagagctcaaggccatagaagacgagtgcatacgagaccatttgtcgcgaagggaaaaggccaggcctcgccgtgatcacagacggcgagttcgccgcgagacctggcatctcgacttcatgtgggcctttgacggcatcgccacaaagcctgccgaggcaggtcttccgttccacccgacgaggtggccaaagatcgacgatacgtacctgcgtgggcaagatcgcctacaagggcaacccatccccttcatgacacttccgcttcgtccaggcgcttgaggcgagcgtccgttgcaagctcacgaattccggcgcctgccccagttcctcgcagcagtagttagcgattgccgttcaacaaagggagaccgacggaaacaaggtctagaagccattgcagagcttgcagtgcagacgattatcgggcgggatatgctgcccttcatcaaggactctatgcagcaggggctgccgcaatctccagcttgatgacgctcgtggggcatgttcgtcgatccgcatgcacgagcagttcttcggcgtcgatgaggcgggacttgagaaggttgaaggaagacgctactcgaggtgaaaacggtgcttgctgcctgtcccgaagaccttcggtcaatacgccatatctggccgtggggccaacttccaattcgacctgggcctgcgaagggcggctactacgaaggcgtggaagacttcctgcttgcccgccgagaatgggcaggccttctcctcgagtacgaagcgatgcacgctccggcagcttcgaggcgttgaccaaggtgcccgaagacaagcttgtcgtgctggcatcgtgacgacgaagcgccccgagctcgaggaccgcggatccgtgatgcacgcaatccatgaggcagcgaattatgtgcacgctttcgcgactctgccctctatccccagtgcggctttgctccggcgactgcgccggcaacaagctcaccgaggaagagcagtggcaaaggttgccctcgcgctccattgcagaagaggtatggggctaggatcttcccatgcaaagcagcggcccccgcatacttatgggtttcaggcgccgctgcctgtctctaggagtctgcctagtcgagctcggcgaaagtccgctcgaagatgtcggcgcagctgaaggtatgggcgccttcgtcgtaggcgaatgtgaagatggagaaggtcttgatgccgggatggtactggacggacgttcgcgtccttccaggagcggatgaagagttcgcgcaggcaggctgcctcgtggctcacggccagagccaggcggggacacaccgggcgggacatggatctcttcggtcgccttccgcatgcgtgcgacgagcgtctcctgggagtccccgccatacggcacgaagaaatcgccgaagggaggggcaggatcaggaaattgtcttccccctcgtaggcgccgaagtttccattccttgagcacggagcgggcgctagtagggattagggatctctccatagcctcgagacaggacatactcgagagttatccaggcgcgttcgctagtgctcgagaagaagtggtcggggggtggtaaccaactggcagtcggtttggcttgccgatagattgtttgaatggcattctttgctctctgagagccagggaatgggcggagcgagagaggccttcaacgaacaaaccgggtggaagtggtttgccgcgagggcaagatgccggtcgcccgtcgagcggagacggcgaccggcgtctggctcgtgccatgacacgaaagtacgagctggcttccacgcccctagcgggtttcgcaccgtctgctacgccacgcgttatagctctctgaccagagtccgaaagaggtgaggcgggtccgtcaaggcatagactgaacgagccttggcagttctccagggagtgggggggagtcccgaggttgtgtaagagtcgtgagcggcatgagcgacagagcgcaagctcagcccgcctcctcgcggaccccacgcgtcaccaccatcatcgtggagccaaagagaaagacgagaaacgcttacctcctatatttcctcgtactccttatttaagaggaggaaagcggggactagtcagacgaggcgagatcacgacaagggacggccgcgcgtcgtgggtggacgaaacggagctagacgccgaccttgtgccgcggaccatgaccgaggccgagggtgctcactccttctgcgcgaggctctacgggacggagacgtgccgccaggccccgcgccgatgggagagcgccactcgaggcggcgagccgcgatgattgaggccgtcaaggtcgcgctcgaccacacagccaaggcagggcacgattgctcctggtcgccaatgagggtgccgaccggttcgcatacaaccgcaggccttgcccacgtcaaggtggcaaggaagcaaaaaggaaaggcccgcccccgcacctctcgccaatacgcgctcaggcgctggtggaatgcagcaagggacgccttgccccaggtgggccgagaactccaaggagggctactcctacggcctcgagtggcctgtccgcaggcgcttcagtccttcctcgactcaaagcgcgggcaagcgcaaggggaaggccgtcggctttcccaagttcaagagcaaggcaagatcaaagcagtaaaattagcctttacaccgaccggctcgttcggctcatcgacgcgacccaaggccctcattgactccgggacggcgagtccactgcatggaaggacgtggcaacgccgggtcggaggggtgccatgttgacgcgaatatggaccgtttcctgtcatgcggtcgtggtttgcctccctcacggctcgagcgggcggacgtgacctcttcccagccaaagggcccgcggtgggggggtggactcggcgtcttccccctccgccacgctttcccgacggccacggtcatcgggaaatcaaggccgactacagggcatcgcttagaagcgccaaggaccagagaacggaccaactctcgcgaaggcagagaggggtcagggcgtcgcgccagggcgaggcacgcagtccagcgcaatccaggccacgagtcgccagccagcgccgcgaagcctcggaagctcacacccaacctgccaggagctactccggaaatatcaaatcgaggacctcaacgtcgcgggaaatggtgcaagccacaggcctcgcccagccgttcgaggacgcctcgttcggcgagtttccgccagcgagctcgagagtacaagtgcgtcacgcacgggcaacccacttgcacgtaagaccggttggtacccaagcagcaagacatgccgggattgcggggcagtgaaagccaagctgccacctctccgctgcgcacgcgtaccgctgtggaggcctgcggttctcttcatcgaacgcgacctgaacgccgcgatcaacatcatggtcgccgggagtgccccggaagacccaacgcgcgtggacggggacgtgagaccggaggaacccatggtgcccgaggcagagcccagcaagcgcgaaccgggcgggcgcaaaagcgccgcaaggaccggagctggcggaatgcctggcaaaccccgccaggcaagctgaacaacttagttttgcaacggcgtatgccaagctccctgaaaatgacgtcggcgatgcgtgcctgggcatgggccccgcgttcggtcagaggcggagagtcgacaccagccctggttcttgtgtggacatgaaggcgctctcgcccgtgccgcatgacagatagagcgccttcatggtctgtatttctcctggaatggggtcatgccatgagcatagcaggaagccgatgtctgtctgagaccacggctttcaggtgcgcttctgcctgcgttcagctggttttcatctctcgtcaaaatgtctcgaagcattgtgcgctgtctgcatttgcgatgcccacaagcgttccggcaggcgtgacacgcggtgattctaggccaacagcaatcgagcttatggaagggaagggggccgtcatgaagcgaccgagcagcagaagaggcggtctgtgcagacaggacggaaggcccgttccggaaaaagatctcgcacgagttggtgcattcgcgcggaaaggggttctcgtttctcgtatgagctctgtatgcctttgcagaggggcacctgcagcaccgagcggaacccagtccagccgggcgagccgcgacaggcggcgctggcggcaggggccagaggtgccggagccgatacgagggactacgactacacagggagatttccggcatcctcgtcgctgggacggcacggagagcgactcggaccagacacgaccgtgagcacggcgaaggattgtgaaatgctgccattttttgtccagaaggcgcacgctcacgcttgatggcgacgtccagaagtccggggtgacgatacgggatggaacgctcctgcaacgtctacggccgtgaactccgatcctgcttgtgtgggcgaaagatcgactgccaccggttgcagagaagcacgctttctttttcttcgactactccgaggggtcgaacggcatctttgcaaccgatggtgcgaccggtccttgcctattgcaggatgagatcgcgaccgacggcaggggggaaactcggctggtctcgatgctaccatgggaggtaagatccctggctcggagctctcgatctcgaccgaaggcgaccattgcggcgcgcgcttgcaaagacgcgggcttggcggcacggtaggtcggtcacgacgcgcctcagatctttcgaccggcaggctctggctcgcctctgcttctattcgagggcaggcgatgtcgaagtctcgggcgtcacggggaaaccggccacgctcgcagacgccggcatggaaggacctcaacacgattcctcatcgaggactcggacctcaccgagtacggaagagaagcgaacgcgtccgaccaccatggcagatgccgtgtgtcactaccgtcgaaccctcaggcgatgcggaggagcacgacggagacacccagttccaggcagcggactcgcgctctcggctcgatccagtccaggctccttctctatctgacgaaacacgtcggccgatatcggtgctttcgaacacgacgctcgattttgctccgacgcggcggcgcgccgctgctgacagcagagggcaacagcctcgacaattggggcaagtcagggccggactcgaatggttgcgacggtttgagcttaccccgctatcgtgcgagactacgctgttccggaagatctctgagacacgatcagctcgctgacgtctatctaacggcccggacacgacaggaccgggctgcggaacatacgagaagaggttctccggctcgacaaccgagactcctctttcggttttcagtcgatggggacctcttcctggggccgtgacacagactcgacagagtctcgacctaacgccttgaagatgtgccaccgttgtggacagctcgggaaaacgcgtccagatcgttgatgcttccggcaaggtgctcagatcggcacctctgaggtgatcggacggttcgaagggagctatggcacggcctacgatgcctcctctgctggcacccattgcgacgagcacggcagaccgcgagcgccttcgattgagcattcggtaccgatacatccttcacgatgtggcgaatcgaggcgtcaatcaggcaagctatgtaccgaataccatccggctctttccgagcgcttcctgatgccgaatccagcactggagagcacgcaggcaatcccttcgtgtgggacatcatcgtgaacttctcaagagcaatcttcggataagaaagactgcacggccctgaggcttctctcgggccgtgctgctgtgcgaggatgcccgatccaagcacgcgcacgagcgcctcggcatcctcgtctttcgtggcccgcttgtcgcgagacacaatcgtgtgatgctcgtcggcttctcccggaagcttgcaagcgccacttcgccgagacgcttgctgggagttggagaggatggggaagacctggttcgtctctggtggatgggcaagcgcgatgccggcatcttcgaaggcatgagagatctcgtgcgcgtgggcgatggcaggcctgccgatgcgctcatagagcccatcctcgaagaaggcctcgaattggacgccgagcagacgtcccttggcaaggcgggctccttgctgcttcacgaacgtgaagaagtgggggacaagctcaggcttcgggaagacaagcgcctcgccgaagagcgcaccgcacttcgtgccgccgataaagaaggcatcggtgagatgtgcggggtcttcgagcgtgtcatcgttttccggtgcagcaagggcataggcaaggcgtgcgccgtcgcagcagatcttgagatggcgggcatgcgaccgaacgcagcgcctcgagccctgccttcgtatagatgaggccatactcgtctggctgggagatgcagagatggtgccggctggaccatgtggccacggttgccatccttctcccagagcctcatgaattcgtcgacatcccctgctgcaagcttgccgtcgtggccggggattgcgggcaccttgtggtcgcctgcttcgatagcgcctgcctcatgcacggcgatgcgtcccgaggtggcgcagatgacgccctcccagggagcaggcagggcacagatcgcgacctcgttcgtctgcgtgccgccgacgaggaagaagacctggcgggagggcgccttgcaggcactctttatgagctgctgcgcatggaggctgtgctcgtcagccatagcctgcgctcttctcgtggttcgttgccacgagacggtccatgatggcatcggcaaagccctcgagataatcggaagagaaatcgagcttctcctttgcggcgcgacgcttcctcccatgggtgcgctctgcatagatcgtgtggcgggcggtctggaaggcggcaatacgagagggaccagtggctcaacagccgtgccgtcgatctctgcttctgcgcgaagccttcccagggcacgtactgcgactggaaggcactctatgaggacgagatcgtgatgtggctgccggaggggcatccctatgcagatgctccgagctatccgatccgggagctcgaacatgaagtattcatccatacccttgccgactatgatacggaccaggaccgcctcatccgcgaggagaagctccatatagaggaccactacgggacgagcaatggcttcacgacgtacaacatggtcgaagcgggcctcggcgcgagcttcaaccagcgcctcatcaaccggaagtggcaagggcgggtgaaggaggtccccttcgaggaaccccgccatatctctctcggtatcgccgttccctcgcttgccgaggtatctcctgccgctaagcgcttcatcgcctgcatagagaggacctcatgccgcgccttgcggcactggcccagggctgcgcctgatcttcccgcatgcaggggccattctgctcgttcgcggagccttacagaaagctgcacatagataagattctttcctacgagaatggcaggtgtctcatgatatgcatgccgcattgcgaatatgagaggcatgccgtatcattttgacggttgcagacagggcgttctgagggggcctcgacctgcatgcatagccaggaaggcatctggccatccatacgcagggagccatccctgccacgagagaagggttctgctgtgggatatgtgctcacgcgggacgggtttgacgagttcatagcgaagctcggcgagacctatcgcatctatgctccggtgctcaagaagggggagggacgcttcaccgacgtcgatgtcgtgcgctatgacttcgcggcgtccggctccgagatggagctcgagaagaagtccgactatccggcgaaggagattctgagcccgctttcggagacgctcttctacttcacggaggattccgtcaaggaagcggatatcgatccgcgcgacgtgatcgtgttcctgcgtgcctgcgacctccacggcatccgccgtcttgaccagatctatctcgacaacggcccctcgaaggactacttctacaagcgcatccgtgaccatgtgcactttgccctcatcggctgcacgaagagcttcgccagctgcttctgtgtcgatatgggcacgaatgtggcacctgatggctggatgttctctgtcgaagaggtgggggacatgatcctgtctgctgtggcagagaaggacctcgagccgctcttcgctgcctgcgcagctaaggaggaagacgtcacgccggcctccgtcactgagaacgaggtgcacgtcacgcgtcccgagatcgtgccgaatgcgatctatcgctccgacatgtggaacgagtacacggaccgctgcatcgagtgcggccgctgcacgattgcgtgcccgacctgctcctgctacacgatgcaggacgtgttctacacggagaacggccgtgtcggcgagaggcgccgcgtgcaggcaagctgcatgatcgacggctactccgatatcgcaggcggcggctcgtacaggaagaccgccggcgagcgcatgcgcttcaaggtgctccacaaggtctatgacttcaggcgccgcttcggctacgacatgtgcgtcggctgcggacgctgcgacgatatctgcccggaatacatcagcttcgctgcctgcgtgaacaagctcaacgatgcctgcgaagcctacgagaaggaacaggaggcgcagaagaatgcctagccagaccgtgacattcgacgccgtgaacgacgcggccgtgaacccctatattccgttctcgtccgagatcctcgatgtgattaaacacacgaagaaggaatacacgttcaggatggcgtacgagggagaggtgcgcccgggccagttcttcgaggtctctgtcccgaagtacggcgaggcaccgatctctgtctccggcatcgtccctggcaagtccatcgacctcacgatccgccgtgtcggcagggtcacgagcgaggtcttcgagaactatgtcggccagaagctgttcctccgtgggccgttcggcaatggcttcgacgtgagcctctatcagaacggcgaggtcgtcgtcgtggcaggcggcacgggcgtctctccagtccgtggcgtcatcgattctctcgccgcgtctcccgaccccgagaacaagtatgtgatcgtcggctttaagagcccggacgacatgctcttccgtgacgaccttgcccgctgggacaaggcgctgaacctgacgctcacggtcgatggtgctcctgaaggctatgagggcaacatcggcctcgtcacgaagtacatccccgatcttccgctcaaggacccgaagacggcacaggctgtcgtcgtcggtcctcctccgatgatgcgcttctcgatcaagggactcctggagctcggctttgccgaggagaacatctgggtcagccaggaaaggcgcatgtgctgcggccttggcaagtgcggacattgccgcatcggcgagcactatgtctgcctcgatggcccggtcttcaactacaccgtgtccaaggacatgctggattaggagggaacgcatgattcaggacgtgaatgtcaaggcgctcaagaagaatgccttccgctacagcaaggtccgtggcgagacggcaagccgtgtccgcattccgggtggtctcgtctcggcaaagagcatggcaaggatcgtggggattgccgaggagttcggcaacggccagatctttctgacgaacaggcagggcgtcgagattcccggcatcaagctcgaggacatgccgaaggtgaacgagaagctccaggccatcatcgaggacacgaagattaaccaggaagatgcggcagacggctacctggcatccggcacgaggaatatcgttgcttgcccgggaaagaggctctgccccttcagctgctatgatacgacggccttcgcgcagcgcatggaccagacgatcttcccgaacaaccgtcatgtgaaggtcgccttcacaggctgctcgaacgactgcgcccatgtcgctctgaacgacttcggcatcattggcatgaccgagccgcagtacgacccggcccgctgcatcggctgcggccagtgcgtcaagtggtgccagcgcaggtccgtgtcggctctcgagatggtgaacggcaaggtcgtgcgcaacgaggaccgctgcatcggctgcggtgtctgcgtcgtctactgcccgacgcgtgcctggacgaggagccccgagcactacttccgtctcaagatcctcggccgcaccggcaagcagaatccgcggatggcacaggactggctcaggtgggtcgacgaggattccatcgtcaagatcgtccagaacacctatgcctacatcgaggagtacatcaatcctcaggcaccggaaggcaaggagcacatcggctacatcgtggaccgtacgggtttcgatgagttcgtgaagtgggccctgaaggatgtggagctcccggagaagtgccagcaggcgcaccgcatctactggggcggcgagcactacgatcgcgacaacgagctcaagtagcatctgctcgatagctgcatatgaaaggaggcgctcccggggcgcctccttttcgtatgtcctatgcccgctttccgccatggcctgccgtgcgcgataaattcagattcgtgaagtcgagtcccgtcgcatcggctacggcctcgaggatcgagttgctcgaatacgtggcaccggacaccgtgtcgacgtcgaggctctgcgccgagacgatctcttctgccatgcctgagagtgccttctggaaatagggggcatcatcctcgtaggagatggccgtgatggaggtgaccctgccgccttcgaccgtgccgctcaccgtcgtcgtgccgcgcaaccccgtgccggaaccggtgtaggtgccgtctgccacgtctgcgaaggcacctgctgcactgctgctcttggtacttgcagaggagctctcctgtgcatcgttgctcctggtgtctgctctttcggtgatagcgccgctctcgagggcatcctggactgccgccatgatgccttcgctcgagaatgtcgcgccggatactgctgcgacctcggtgctttgtggggagaggatctcggtgatgaccgtcgaggaagccttctcgaagaactggcggtcatctgcataggagaggacctcgatggaggagaaggcgctgctctcgaccgtgacgctcacgcttgtcgtgtccttgtagccctggtcgcttcccgtgtaggtactatcctgatagaggccttgagaggaggcagcgctcgtggttgctgctgcctctgctgccgtctcaggcacgggtctctctgctgcaatcgtgccgatacataccatgccggtaaaggcaagaggagctgccgtggctgctgcagcttcgcaggaaggggccatgaggttggcgcttgggcaggcatcggcgcagcggaagcagtcgatgcattcgcccgaagtcacaacgctagagccgcccgtgtcgatgcccataatgaaggcgtcggtacagatatggcagcgccgcagcgggtgtctttcttcctgatatggaagagcgatcttcgagatcacaaagacagcaccaagtggacagaggtagcggcagaaggtcggtcgatgaaaagggaaaagatcgctatcgcaagcaggagcgcgcctcctgctgagaatatgaggctcttcggtagtttctttgggcggattcgctcaagggcccagatgagagcgcgatatcaaggggcggattgtcaactgagtgcaacatctccctaaagacctcgctggccgtcctgtatctaaagaccttccttagcctgtcgttgatcatgccgaatacgcgctgtacctcatcatcggtgagcttggagaagtccgtgcccttaggggaagaactcacagatgaggacatcggtgttcttagcatgggcttctgccataggtggtggggatggcagaagtagaactggacaccgccgagcctgtcgccacctccgcgcagagggcaaactgcttgccgcgctcaggggtgatggtcttgcggtcacggcctaacagagccgtgagctcgacctcgtgtgcgcggcgcccttgccacctacgagtagccgcgactcacgatccgcgattgtcaccaggcagggcccttccggcttgccgacgagcgtgtcgttctcccactcagcgagccttaacgctcgtgtgcctgcttgggcctttctgagatgccgcaggagaccttgatcttgcctctcctctcctttgttccctgtgcgtgcacttccccttcccgcacagatggtggcggagctggtcctgtggggggcgcaccggggatatcgagctcgcctgagccgacggcgcgctagatagacgagccgccgtgcttaagaacaagccttttgtctatctgctcgggcaaccaccgctcgtccatgctccctcacctcctcgccaacgctgggcccgagagcctcttgtgcgttttgcaccttgtgtgcctgccgttccttttcagcttacagctgagcgcggagctgtccctgccaatgtcgctgaccgccttgccctcggcgtgcagctcggctatcctgtcgcgctgctcacgctaagatgtgtgtagtggcgtatgctccctgacttgcgacgttgattgagacaaccaacatcgtagcttcggaggtgcgccatgacctttgcctggcgctattctgttgcactcagaatgctaatccgccaggcaaataaagggtagcggccctcagggccgttgccgcgtcgggcaaggtagggctacgtctgctccaacaacctgcggaaaggccctggcgcatgaacggggtactatgctgctcgctcacgttggcacacacagtgatcgaatacgtacgcatcgaaggcgatcgagtcgtgattagggtgaggcctgtgctccgatctgcaacaggaaatgcgattgctacgacagatcgccgaggccctcagctcgtagcgggcgatggacctggctcggtcgatgtgctcatctggatacgcgctgcacagggtaaggtggccagagtacggcgtgctggagagtcaatgccctgggcgaggtgcaaagcgcgcttcacgcgcactttaaggagtgggtggcttgcctggtgctgcgcggatccggccacaccgtcgcggcgctcgcacacgtgagtggcacacgctcggcgaggtgttgcgcgtctgcgctgatctgaaggccgcacgcggcaggggccttcgagggcgcaaggcgcatcgggatcgataagacctcctacaagaaggaccacaagtacctgatggtcgtcgtcgactacgacggggatgtctgatatgggcccacgaggggtacggcaaggacgtgttgaatctgttttcgacgagctcacctgagagcagaggcgcgctatcgaggtcgtcaccgccgacggcgcgaggtggataaagacgctacttcggcgccgttgcccgaatgcgcgcggtcatggacccgttccatgtcgtgcaagggataaccgatacgctcgacgaggtgcgctgtaagaatggcaggtcgcgaagaagcagtgcagaccgatggcgaggcgcgaccggccaggccgcgccgcgcaagggcgagaagccaccgacgcgatcaagggcagccgtttcgcgctcgtcaagaacacctgaggatctcaccgctgcccagcgcgccaagctctactctctggagaagaaggcagcttcgcgcctgttcagagcaagacggcctaaagccgcgcgctgctcgaggagtggatgtgcgatgcgattattgtaggatcaagccgctcgtcgccatcgagaagaaggtgcgaagacaacaaggtcgacatcgcggcggtagtcgagctcggaatcggcaacggccgcgtcgaggcgatctttggtggtgctacatgcacacggaaagcccgctgccgccggcagatatcatcccgtcatgccgaccgacacgaggtcgacggcctgttcgcgacagtatcatcggacaagaaacgcgacgacggcgcgcccgaagaatacggcacggggatagtctggagcgagttccacatgcccacgaattacaggcggtgaataatcaatcggacacactttttgaaacataaccccatttccccagtaaactaagccgctttttctggtatagtttttcggttaggaagtggaacacagatatcagaacatacgagatataccatatctacatgtttctgtatattccgaaatccataggccttgcgacacatcagcttgatcttgttgttggttgtcctcaaccctgccattgctcagccccaatcggatcgtattcaggatatgatccttgtggtgcttgatcttctcatacaggtcgtagagtgccgctatcctgctgtggcttgtccacttgagcctgtttttaggtcggttttgcctgtttgacatttcccgattttaaaggaagcccaagactccttcatgcgtacgcccaatactgagctctgtcaatataatagacagaggaatctcagattttttatgcggtctgcatcgcctttggatcgtatgcaaggcctctctcgaagcgctcgaagaactcctgcatcacctctgcgggtacgcgatcttcatggacttatgcgggcgaaagcgactgtagtacgactcgattaactcgtgtgccttgtcttggtcgtggatgcatctaagaggcgcttaaggtagtaccacacgttcttgagcgtggcgaaaaacgattcggcgagcgcattgtcgtggcagcttccggttctcccgacggagagcctcacgtcgggtacggctgagcaggcggtcagctctgagcttatgtactggctgcctgggctgcttagaatatggcccctttggccactgtatccgcgcgaatatgccatcttcagggcaaagacgaaggccgccctc

SEQ ID NO: 308 - DNA, 7746 bp, Unknown
  Metagenome-assembled genome
ggggcctaccatgaggacatcgctgaccgacatgccagccctgatgcctggatgctgtggtcttacctcgcactctataagccctgcaccagcatcacgaaggcgggccctgctggcggtagtagtcttgctgataggcgcgtggccgtcttggcacgttcttgagtagtcgaagtaggtctcgatcgaccagccctcttgtacagggcgaacaccgctcggcgtcgcaatcctttgggcagcgagtctcgaggacatagagccccatgagcgcggagagatctcgagtctggcggatgtgtagcagcccttgccccgcgactgcatatggcgccgagttggtctgtggctcgagctgcgtcgagcaggtcccgctagactatgacgcgcactggccggcgagccgtctctcggaaaactgcaccagcgtcggcttggtgccgcgctgccaaaggaacgtatctggcagctccaggtcggccactgcccgcctgcacctggcgtgcgtgctggcgagggggaatatgtagtggttgtcgccctcgcacagcagcctggcgttgtcgtctgcgttgaagccgcggtctacgacgaatatcacgcccgagaagggcacctggcacagcaggtcgcgcaccgccagcctgtcggtggctcgcccctcgtagaagcgcgagcatatgggcgcgcccgtcttggcgtccactaccatgagcaggttgacctgtagctcgccaagccacaggaacttgtagcccttgcctgtaaggtcattgccgcgcgaccccgatcccactgcgtggctatcgatcgccaccacacccgagcaccgacttgcaagcgccctttgcagctgcaccacggggccgtcccttcggcccaggtcgtcgtagagcgctgccatggcatccgggcccaagcgcagccccggatagcacagcgacagcacgctcatctcgtagagcccctccacgaagtggcacagcgctaccacatacaccttgtcggcgtcctcggcattgaagaacttcctgagcagggcatgggttcctctggagaggtcgtctgcgacggcccattgtccgaactcgagggtgcgccactcctggcgtcgcagggaggcgccattggccacgaatccgcgctcggggtcgatcttgccgatgcaggcgcccatcttggtgtgcctgactagtaaacgcccgtggtaaccgctgtcaggtaatttggtaccacgggcatcttctgaacggtaccgcaggcaatgcggggcggtaccgctacagctcgggcatgtccttcgcgaaataccttcgcatgtcaggaccgtcgaggtcgtagcgcctcgctgcggatgcgacgcgacccaggatggagtcggccatcgacccgccctctatccaaagataccattcatggggctccagctgggaggctatgagcgtggccaccttctcgttgcgcccctccaggatctcgaagagatcgactgcattctgcgtggtaatcggagtggtgaggaagtcgtccaggatcaggagctggacgctcttcaggtcatctatgaagctatagtaggaggcggcatcgaatgccctcgagcggttaagcctgtcgaacacgtcggcgaggcgcaagtagcgcgtggggatgagcttgctgcatgctgcgttgcccagcgcctggcacaggaagctctttccgcagcccgtcttcgatatgagcaggaccacttcggcccttcccacccacctgcaccccgatcagccttgcgacacggtccctgctgagctttcgccccggcaggtagacgatatcctccacgcaggctgccggcagcttgaagcctgccttccttgtgagcttcgcgaccttgcacccatgccttgcggacagctttgcatccagcaggatcttgatgcgcttctcgaaggccatatcgtcgcattcggggtcgtctatcatctcgcggagcctgtcgcccatcgccttgatgcaaaactgcctgaacaggtcgaaatcctcctctgtcagcatggctcgccacccctgtcctccaggcgtcggctccccggacatggccggcatgcttcgtgcgcccctccagctcctccctgcacctgaccggaggcgctttctgcgcatgcggcctcgagctgtacgggcgaagagcgcttcgagagggcgagtatgttgcggcaggagaggaaggcctgctctaccatgggcctcgaatcgagcaggcggacgatggccttccccgtctcgggcccgaccctgcctgcccagctctcgaagcgctcccgcgaccacggagactcctgccggtggctttccggcatgtgctcggcgaaggtcgaatactgacccttcctgcccctgagcctgggatgggtcgcaaccacggcgccgccgctcatgaccagagcctcgtggctgtgaaactaacgtccatctgcatcccgatcagcctgtgcgggaccgaatagtggccatagtcgaccacgatatggtagtcggggccgaccttcgcgctgcgccactcacagcgctcgtacggctggacgggaagcggcagcatgcagccgcgctccttatcctcgtagatggagtccctcgagccctccttggccgagaagctgcatgcattgagccagcgcaccctctccaagcaccattcgttgaactcctcgagtgaatggaactgtatctcctgcgcaggggccacgatccactgctccgcaatcccaactgcagtctcgcaggtactcttgtcacgcggctccctcacccttgccggcactatcgccgctccgtagtgctcggcgaagcgctcgtattccttgttaatcagggtcacatatatgggatgggagagcgctcggtcgcggttccgccgctgtcggggacgagcatgtgtggcacgcccttgagatcgcagaaggcatgcgcctgcccctcctgccagaaatcctgcttcatgtccaggaagccttcggcccagaacctccccaaaaaggggagcgccaccacgatcagtgagctgtaatcttttggtggacagtaggattcagggactggcaacagatatgctctgtccagatacccacctaccaacaccagcagattgaagagatgagatgtcgctaagcgcaagcgagatagagaaggcaaagtcccgcacgaagccggaaacacccaaacactacactgaagaagtattgcctcgaggctatcgactactacaggaaggcacgtaaggccaacccgaagaagagcatcagagaatgcgccgcaaagcttgaggccaacgacaagaccttaaacgactggatcatcaagcactcaaagaccaaaagggtgacccaggaaaggaccgaggagcacaagcagctcgacagggccaacaggcgtatacacgagctcgcaagcgagaataagttcctaaaaagtggcagccttcttcgccggaagcctctgttgaaggacaggtttcggctcatgctggccaagagggcgacctacagcgtattgatgatggcacgcgtactggaggtgagcagggctcacttctacagatggctcaaggccaaaggcggtgaggacctatggggtcctatcaaggaagctatctgcgcgatatgggaggaaagcgacaggcgcttcggcttccgcaaggtctgatccaagctcacaggagatccgcagttacgcaaaatttacaggcacgacccgctaccgcgtgcgcaggtgcatggctaagcttggcatctgcggcatctgatccaatgcctccaagagaacgatactgcccgcacctgataccctcgagcgtcccgccctcacccggcgcggcttttcgtgtcttgtgccgacagccaagcttatgggcgatataacctatcgcaggaccacggcaggctttatatatctcgccgtcgcacaccatctgtgcacacacatggtggtgggctgaagcatacaggacaacatgagggcaggccttgtcgtctttgccctgaagatggcatattcgcacggatacgtggccaaaggggccatattctaagcagcccaggcagccagtacacaagctcaaagctcgccgcctgctcagccgtacccgacgtgaggctctccgtggggagaaccggaagctgccacgacaatgcgctcgccgaatcgtttttcgccacgctcaagaacgtgtggtactaccacaagcgcctcttagacgcatccacgaccaagcacaaggcacacgagtttaatcgagtcgtactgcaaccgcttccgcccgcataagtccataggagatcgcgtacccgcagaggtgatgcaggagttcttcgagcgcctcgagagaggccttgcatacgatccaaaggcgatgcagaccgcatagaatctgggattcctctgtccattatattgacagggctcacaggtagaccttggacggcttgcctgtgagcctgtcggtgatggatgcggtgtctcccgcccagtcgatgtagcatttggcgcccggctcgtgcctgaagtgctgcaccgccccctgcctttcgcctcaggaggcctggtacgaataggcgcgcttgccggctgccgcagccgcatcgcagtattcgccccacatgagcttcaccggaagcttcctgctgcgcttcttgtgggccacgagcgcctccaggtcgaactgcaggtacgccggaaaccggccccgaaggcaaggtgcggcgccacctgcgcaggaaggggaagagagtccgcagcaagaggcctaagaccaaaggtaagatcaagatcttacacaccgtaaaggagaggcccaagaggccgatgagaggtctcgcctcggtgagtgggtagacgacacgctcgtggcagcgggacccgtgtgcctgctcgtgcttgccgacagggcagtgaggctgcttgccgcggaaagagccaccacgacagcgggagcgtctctaaggccgaggtcgggcttttgcagggacgtcccctcgagacgctcactccggataggggcaagcagttcgcagggcatgcagagctcacaggtgccctttgaggcgtgcagttctacttctgcgacccccaccatctatggcagaagctaacagttaagaacactaacgggctcctgctagagttcttcccctaagggcagcgacttcggaaaggtcacaaacgaggaggtgcagcatgcagtggagctgatctgtgacagagcgaggaaggtccttggatacaggacagccaacgaggtctttagggagatgttgcactcagcttgacaatctgccggttcagtcctgaaacctgtgggcagatgcccatggcttgatgctcaaagggacagaaaagcggtcatcctctagaatcttgcatcgcaacaagaagatcccgaacaaggatggagcgcgatgacaagtgtagcatcgccatcagcccagctgcccgctatttcccatgctggagaagactctgtcttcttccggatcccctcccatctcgtgggtttcgtgcaggcaggagatcctaaggagagcgtctgcacggaggagctcggcacatcgggcaggagatgcaggaaggtggtacagatcctcactgtccccggcaggctgatatcgaaggatgcaccctcgtgcccctgctgcggaaaggcaatggagaaaaacgggaaggcccccatcgcactttggcatctccctctcgggatggagaggcaaggatagagatatctcggccaagatgggcatgcagggagtgcggggcctcctgcatcgaggacgtcccccttcagggcttcaggccagcgcatcacgctgttgctgcttgccttcgtgtgtgacctgctcaccctggggcagaccctcaaggcggtgtcgcccacggcaggcctgcctagaaacgtcgtgaaaaagatcgagcgcgcgaggctctctgagctctacacggaaggggaaggcagcaagcgaaagctgcgcaagcccaagcggcagggaaggtatctgggtgcagatacgttcaagcttcacggcgggcaccgctgcgccaccgtgatcatagacctcaagatgggacatgtgctgtggcttgtccattcgaagggaaagaaggtcctccatgccttctgcgaccacgtgggcgaggagtggatgtttgcatgtagaggccatcgcctgcgacatgaacgccgacttcgagtgcgcctttcttaagaggttcccgcacatcgtctacgactgcttccatatcgtgaagaacttcaacgagaaggtcatctgtaaggtcaggaaggacgagcaggcaaggcttaaggaggagggcgacgccgaggccgcgtgtgcccctcaagcactccacatacatcctcatatccagcgaggacacgaggaagaggaaggagcgctatgcacgtgccggcaggctcgtctccaggggaagcgccctcttcggcaagcaggaggtcctgcagaagggaggggccaggaagcgctgcgaggagctcatatcccaaagcgagctgccctttgcctgcgacatcgtagatgagatgctcgcgcaggcctattcgtgcaccgatgtggatgcgatacgcgctgccatagagaggatcgtggaggtcttccgcggcacgaaagacaggcacttcgagtggttcgcctgcctcgtcgaagggcacaggggagggatcgtcgtgcacgccaggcaccagatatcctcggggaaggtggaatgagccctgtcaatataatggacagaggaatcccagattttaatggacagaggaatctcagattttttatgcggtctgcatcacctttggatcgtatgcaaggcctctctcgaggcgctcaaagaactcctgcatcacctctgctggtacgcgatctcctatggacttatgcgggcggaagcggttgtagtacgactcgattaaactcgtgtgccttgtgcttggtcgtggatgcatctaagaggcgcttgtggtagtaccactcgtttttgagcgtggcgaaaagcgattcggcgaccgcattgtcgtggcagcttccggttctcccgacggagagcctcacgtcgtgtacggctgagcaggcggtgagctctgagcttatgtactggctgcctgggctgcttagaatatggcccctccggccacgtatccgcgcgaatatgccatcttcagggcaaagacgacaaggcctgccctcatgttgtcctgtatgcttcagcccaccaccatgtgtgtgcacagatcgtgtgcgacggtaagatatataaagcctgccgtggtcctgcgataggttatatcgcccacgagcttggctgtcggcacaagacacgaaaagccgcgccgggtgaggtcggggcgctcgggggtatcaggtgcgggcagtatcgtcctcttggaggcattggatcagatgccgcagatgcccaagcttagccatgcacctgcgcacgcggtagcgggtcgtgcctgtaaattttgcgtaactttggatctcctgtgagcttggatcagaccttgcgaaagctaaagcgcctgtcgctttcctcccatatctagatgatggcttccttgaggggaccccatagatcctcaccgcctttggccttgagccatctgtagaagtgagccctgctcacctccagtacgcgctccatcatcgagacgctgtaggttgccctcttctccagcatgagctaaaacctgtccttcaa

SEQ ID NO: 309 - DNA, 30358 bp, Unknown
  Metagenome-assembled genome
ggcctgcaaagcgattcaaagtaggctggcggtcctgtagcgaagaccggcaggggggttgccacctgcgagccttacatattcatcagaaggcgccggagaatacgtttaccgtccgctaagacggtggaatcgtctcatagctcgcatgcagtgaacttgtgcggcggtcaggaccgcttaggcggtcgggttcctgcaggcgtcacgccctgctacgcagaggtcgttgacagccgggtacctatctgcgcagctgctccacccctcgttggatagtcggggagatgtagtcgccgagaacgatgtgtatccagcaaggactgacatctccgtctggcaaatagagcctgaataggttgcggagcaaatagtctggtggagatccatacaggatttatcgaccggacgcctaggtcttgaaaggtttggtcgggtcgcgtaccatgcacggcgttgggtaagcctgtgcgagctggtttcacggcccggtgtagttcttctacagcgttgtggtttcgaagatcttgcttgccccatctttggtggtgtgtcccttttcgatctgggcgaatgagttgagaagttcagtgccaaagtcatcgactagcatcctgcacgccggatgctgatcgtgccacaacacgtctatattaaaaaaaccgcaatcaagcagcgatcgagatctactgattgtttcacctttgccacatacagatcgttggaaatatgcgcgccttcatctacccatgcgtagggcatacaaggatccatttttgcggtggtaatgccagctaaaacggtaagaagcaggtgtagagttgagtggcctctcagaaacacacttcaagatagtgaccatataaaaataacatgccaagataaaattattcgtcagaatagcacaataatcgagtgaaatgtgtaatataagttactttaaaaggaggtgtgggcgcgtgttaaggttggagaaatatgttgttacacgcgggcaaggcgtctgcgaaatacgaagtataggatggtggggaccggcctttacatgctttgtgcacgaggaaccgaggccgagcggatcacttccccgttatcgggcccaaggatctgctcgtccggtactaaaacatctcccgccaagagccagagaatctggaatcgccgagtatcccaaccaggccggtttgaagcgctataaggaccgaagcaccgcacaaaataatgaggaagagcacttcaaggcgtggaaatcagaacggcagctgcactaggatactgttaggattgtaaagaccggacagagcgtaatcgcgatcatataaggaaaggacaacaacatcaacaaggatccccacatagaaatataggttcctttgagcggattttcttgaaaagtctctgaacgtttcactgtgtgagatggcagtggctctggataaactccgacgctgtggcggaacagtccaaggatagcgtcgacaacgcccaaactgatgagaaaatcctagagcatggaagctgtggcagtggaatactctctcgttggcaatcgctgagaattccggccttcgctgcagcaaacgtttcatatagatagctccctctttccttacgagcttctcagtcccttgagaagcgaaactgggtgcaaacttatgaataggccaagaagaaaaccagaagtgttgagctggcggaagtgtgcaagacgcaaagatgtgaaggcggaaagtcaaaaatcatctatcatcccaccaattcgggaacgtgatctgcagactgcgtcgggcagatgaacgggattctgactgtaggagtgtccttttgtgcctgttggctctgcgtcgcccctcgatgatagcggttctgcacgatcccccgctgcacatagaggtgcccaaaggtggccgctgatatcatctctatgcgcaaacagggagaatcgatgtcagcgtaagtgcggatgcccttctcggaggatggcttggaattggggcgatgtcgccggcagagcgatggcaccgggatcactgcgtatccctgtgacagagaacaaatcgacgccctgatgctctcagagctttccaacagtctctcgtgtaataccgaagctacgaggagattgagcagatcgtgagactccaaactgcgtctccctggttcttgcgcggataccgtgaaccgagcccactatcattgttttgttatgggtagtgatcatgggatggtggcccgttgtcgggaccgtatccgccatctaacttatccaccgcgattgatcccacgtgtggacccggtcgatccgtgatgcggtcctgctataacttccacgttcgagctgttgataacgctccgcgtccatggaagtggtcatcgctaccattgtatccgctgccacgctctacagccttcgacgaaaagggagacctcaaacccttccgctccttcgtccaggcagagaccatcaagacctggcgggcaacggtgaccgaagcctacgaatccgagaacagggacaaataatcagcccaaaaatccccattgtctccaacaagcgatggggattagtttctctatttttctttctccctaacagtcaagcaaatgagggccgctagacccatgccgagctgcagcagcctgcatcggccacaagcatatggcgcctttacagcttcaacccatctgtgccttgcctgtttggcacaaaacagctagacctaccagttgaggtagcttttgcatgttggccttggacatccctgtgaggtgtcacaggtatctcttgagccaaaggcagagattgtccacaagcgccacgctgcccagatagtgcggatcgcgcacaactggccttgtaggatttagcgacagtccctgaatccctcatcagctctactgtgagcgcacttgcgccttcagctcagtggtcgcaaagtcctctgatcctttccgtggacagctctttgtggccacagaccacggcataggacgtctgtgccaacctgctgacagggcatacttgctcgcctgcccgaaggcgcaggagaggtgcgcatcagcgatgtaggtcttgtcgatccagaggcacttccttaaggacgaaagacccaatgccaccatctccaggcgcttttgatgcgatatctgagcgctttgtctcttgcagttaaggggcacactgtagcgcatgagcctgatgggtgatacccacttcggcagggtgtgtgcctggtgtgcttaaagacttgtccctgtaagcgagctgtacgtgcgcctgcagtcaggacactcccatcttggcacttagcttagcgaaggtagcaaagcctatgtgcttacagcagcagcactcagctgtggccttcttaggtcggcagatcttggcatcttcagccttggcactgcgggtgtggaagggactttcccataccatggatcctgacggttccactttctctttgaaggctagcctaagaggttgtcaccaaacacagagcccgctgggtttccaggcacagctccctttggtatggaaagttgtatcacctgggctgtccggccggcttgcatcagccctcatatacttgactgtcagaatctctaataaagtgcgcgcaccgcctgcacagtgcggatactgctgttgctacccaggatcatcgagatggaagagattccatcagcgccggttgcaagcacggattttatattctgttctgtaatgccgccgatcgctacgatcgggtggacactctgttgcctcagcgccttcagttggtcgagccccaacgccgggtccacatcatccttagaattcgttgggaaggccggtcccacggcccagacagtcgactccggagagcttattagcctctacaacctcctcaggggtattgcaggagtaccccacgatcaatttgccagcagcttgatcaaggaccgactgaatcccttcgtctttctgtccgacgtgcacaccgtctacatgtacctgaagtgccagatcgacgtcgtagtcaataaagtacgggatcccatggtcctgcgaagtttcctcatctgctgtgtcatattcagcctctgagcctcagagagcgttgtggaccccttctcacggtactggaagacgataataccggcgcacatagcctcagtaacctttttcagaaacaggtccggatcatgatcggtatcctgtgtgccgccgatcagatagacgtgcagcatctcacttctgaatctcataattcccctcttccagcggagcccagtggttgagtggtccatggccgtggccgacgttgatcgaatgcttgatcgtcccctcgacgtaggctttgccgatcttgatcgcctcttccattgtgtgaccttttgcgagctctgaggtgatgcaggcagagatcgtgtctccggtcccgtgagtgcgcttggtatcgatgcgctctgacaccatccagaagctgctgtgatcttcaagcagtacgaagtcggccacctgctttgtacctctcagatgcccacctttgaccaacacgttcttggagccgagctcctgcagcttctctccggcggccttcatatcctcacgagtctcgatgtgcatgccggtgagctgctcagcttcaggcaggttcggggtgaccagatccgccagaggtagcagtttatcgtggacgaccgcgattgcatcgtcactcaagagcttggcaccgcccttagcgatcatcacggggtcaaccgtcacatacccgaagtcatacttcttgaggttcttcacaactactttgacacgggcggtatccgccagcatgccggtcttgcaggctttaatgttgaagtcatctgcaatcgaggcaaactgttggtcgatcagcgtggtcggcatcggctgcgccatctgtaccccgtaggtattctgcgcagtaactgctacgaccaccatcgtcccaaaagtgtggcgcatctgcatagtcttgacatccgcagggatcccggcaccgccaccggaatctgtccccgcgatcgttaaggcctgaggaaaatcattgagcattgctgtatccctcctgaatcgctgcgctgtcaatcgtcgtcagctcatcaaagaaccgcaccatccagctccctaagctgtgagaatactgtacagccttcgccccggcacaggtcaggatccgtgctgtcacgatacctgcagaacaggaatcgctgcttacggctaaacaggctcccagagtgctcgagagaatgtcgccggatcccacgttgaccgtgagcataggttcactctgctcattcttcaacaggtttacgccgtcgctcacataatcgattgcccccgagagcatcaccaacgcgtgatacttctgagccaccgtctgggcgagcgcttccacatccaccgaaccggtgcctgcgtcgatgccacggctctcccattccgcaccgacgatcgcagcgatctcacctgcatcgacgtggattgcactgaactgatacttaatgagcagcgtgaggttaatcttctttctgctcggcgagcctaccaccaccgggtcgagcaccaatggtttgtggagctcattagcaaagccggctacggcttgcacccgcacaaattcgtcccagggtccaggtaccggtgttgatcaccacagcgtcggtgatgctcaccatctctttggcctcgtcaatgccctttgacatgatcggtgaagcgccgatcgcgctcagcgcattggccacctttccgatcgttacgacgttggacaagtttaaaacaatgggctgcttttcacggattctatctgcaatgccccaatcgatcttcattgtgctcccccttcgatcactcgctaccttctgattacttcaggagaatcacatcgttgaacttccagtcctcctgcttcaaggcctgctcctagaatctccactccatctcgcaggatttgaggaagtactgctgtgtttctttcttctgcacagtgtttgcttcctcggttaagttatcgagaatgccgaagagtttcttcggctcttcggtagtttctatgggtgagattcgctcaagggccccgatgagagcgcgatatcacggcagataaagggtagtagccccatcaggggccgttgccgcgtcgggcaaggtagggctacgtctgctacaacaacctagcggaaaggccctggcgcatgaacaggatactacgctgcgcgctcgcgttggcgcacacagtgatcgaatacgtacgcatcgaaggcgatcgagtcgtgattagggtgaggcctgcgctgcccgatctgcaacaggaaatgcgattgctacaaaagatcgccgaggccctcagctcgtggcgggcgatggacctggctcggtcgatgtgctcatctggaatacgcgctgcgcagggtaaggtggccagagcacggcgtgctggtagagtcaatgccctgggcgaggtgcaaagcgcgcttcacgcgtgactttaaggagtgggtggcgtgcctggtgcggctgtggccagcgctgtcgagaagctcgcgcgtggagtggcacacgctcggcgaggtgtgtgcgcgtctacgccgatctgcaggccgcacgcggcaggggccttcgagggcacaaggcgcatcgggatcgataagacctcctacaagaagggccacaagtacctgattgtcgttgtcgaccacgaccggagatggctgatatgggcccacgaggagtacggcaaggatgtgctgaacctgtttttcgacgagctcacctgagagcagaggcacgctatcgaggtcatcaccgccgacggtgcgcgctgggtcatggacccgttccatgtcgtgcaagggataaccgatacgctcgacgaggtgtgctgtaaggaatggcaggttgcaaagaaggcggcgcacgacgcgatcaagggcagccgcttcgcgctcgtcaagaacccctgaggatctcaccgctgcccagcgtgtcaagctctactccctaaagaaggcagcttcgcgcctgttcagggcctgggagcaaaaaagaggacctgcgggccgtgttcagggcagggacggccgataaggccgcagcgctgctcgaggcgtggatgcgcgatgcggcgtattgcaggatcaagccgctcgtcaccatcgagaagaaggtacgaagacgcaaggccgacatcgcagtggtagtcgagctcggaaccagcaacggccgcgtcaaggcgatcaacaacaagatcaaggtgacggtcgggatgggctatggctttcgcaacaccgacaacctcatcggagtgctcatgttgaggtgctccgacagcaggccgacgcttccaggaagggccgaggaaagcacgaagaagaaggctgcttagatgaacttctcacccacagaaactaccgaaggctctctttttgttggttttacttggaggaacgcacactgtgcgcgatacggtctgataccgagacgttcttacgccgatctggtccccagaagcaacaggacagcatgccaggaccgacatggcagccgatcgtcggcccgatcgtggagatcatcgggatcgccgagtcgttaatcttcgttacctcattagccatgcgctccgcatccttaggacagtccgcattgccaatcgccaccgcggaggagagcatatcggtgctgtgcagcttccgatagaagttagccatccgtttgatgcccttcttgcgtccccgagagacggcgatgatgctcagtgcaccgtccagatcaaaggtcaaaagtggcttcacgtccagggcaccgccgactacggcgacgctcttcggaattctgccgccccggtgcagggtatccaggttatcgaccataaagatcgtgtgtacgtagtagcgtgcttcctcagcccaggcgaccatctcctgcgctgtgagccccttgtcgcgctgccggatggcttcgacgataaagagatactgggaggtggagccgatcttgcagtccacaatgtagatcggcaggtgcggctccccgagctcatccttaacgcgctcaagcgcggtgcaggcgccctcatagcatcctgagatgccggagctgaacgcaaggtacaccgtcggcagatccgcctttgcgcgctccttaaaggccttctcaaactccatctgggaaggctgtgatgtcatcggctgcgccccatgtcgaattgcctcgtagaactcatgcggcgtacgggagacaaagaggtcatcgaccccgtggaagcccccatcggccttgccggcctcagtgtaggtaaagtgaaatatcccgatcccggtttccttcaccatctcgggcgagaagtcacaaggggaatcagtcattaagtaaaacttagcttctgccaagattcatcctttccttcagcaagctactgttgttctcaaacactgttaagtgtgccacaaatagcgcttccctgctgaacatacgccgttcagttcccagggacagttcttaagaagctatccggggcacccaccgtcacacgatttgcttccctagtccaccgacttcaaggactcgaccatatcgatacggctcagctttggggtgagggcagccattacgatcagggcaaagaccatcgtgataccaagcgcctggaagtaggaaatcgtatggatcgtgcggccgaacatcacaaggtcgacctcaacggtcacgatgacgaactgctccataaagtagcccccaaccaagccgattaaggcccccaacagcgtcagcagcagcgtctcacggaaaacgtagatctcgacttcccgatgtgtaaagcctaagacacgcaggctagcgatctcccgcacacgctcggagatgttgatgttggtcaggttgtacagcacgatgaaggcaagcattgcagcggagataacgaggatcatcatcacctgatccaccgtcgacatcatcgaccggtagctcttgatcgtctcatcgttgaagaccaccgtgtcggtgccgtcacgcccatggagatcctccatgatggcctgatgctcgctttcacccccaccgacattggcgtagaggtggtcgaaggtcggatcctggctgaaggcagccttataggcatccttgccgacatagacgtagttgtagatgtagttctcgacgattccggtcaccttaagcggcgtcccatcgcccgtggcattgccgatctcatcctgttgatagacctgtacggtgtcccccacgtgcagccctaagtttgtcgccatcttctccgttaccaacacggaattgtcatcgaattcaactgggcgtttgctcacgcgctcgcgcatcgtgatctgctttgacatctcggaggtatcctccggcacgatcatctgcatctgctcagggtcgtgcccatcggtgcccgcctgcatgttgtagctcgtgccccaagcggagctattgtagtgccccgtgtcctcgaggtactggatcgcgttctgtttgtcctcgtcggtcgcatcgcttctgaacccgagagtcaggttgtagtgcatgatgtcaccgaactggttgttgataatgtcctgcacagcgttgcgtacgctcaaaccggtgagcaagagcgcagtgcagccagcgataccgacgatggtcatcacgagtcggcgcttgtagcggaaaatgttcctgagcgtcactttccacaggaagctgacatgcgcccataggggcttgatgcgctcgagcaagatacgcttgcccggcttcggggcctccggcaccatcagtgaagccggagtctgcttcatctccacccacaccgcgacgagcgtcgcaatcagggtgataccgacacctgcgacacccgcgccgaacccgagccccggatcgatcggtaagggcaacgagggcagtggtaccacgtacatgatgccgtaggcgttcataataacgtagggcaggaactgcgagagaaagaggatgccgataacggcaccggtcgcggaagcgagcagcgcatagatcaggtacttgcttgcgatcttcatcgtcgaatagccgagcgccttgagggtgccgagctccacccggtcgctctccaccattctcgtcatcgtcgtcaacgcgacgagagccgccaccaaaaagaagaagagcgggaacacgcccgcgatgcggtccatgcgggaagcgtcattcccatagctcagctgtcccacgccctgattccggtcgagcacatagatattcggcgcctggatggagttcaccgcgttttgggcattctgcaattgttgtgccccatcggcgagctgctgggcggcattcagccgttgatcggccaaggtggtcaagcctgtgaccgtatccgcatagccctgcgttatctgattggaaccgtccaggagctgttgcgttgagtctgacagctgctgctctgcggcggcgagctgccgggaggcttccatgctctgctgcgtgtactgctcccagccctgtgcgagctgtattctcccctggttgatctgattgagggcggactgtgcctgatccagttgatcttgccttactctaagctctgcctcagcggagtcgagctgtgaggttccctgtgccagtccctcgtcgagctgatttaaggttcccgggatgatctcatccacgatggtctgggctgcctgacgtagctcttcaacaaggccatcaccactgcctgaaaggtcaatgtcgccgagggctgtgcgcacctgttgggcgacctgtctcacctggtcctgtacgtcctgtgaggtcggatcgatcaagtcagttctatagaggtcatcggcagccctaagggcgctctgcgcggtgctccgcagttgttcgagctcttcctcagtggggattccggtctgctgcaggaagccggagaaggcatcccggctcgccttgatcacaccgagatcagcccgagcccgctcaatcgtcgcacgtgcctgagcagtctgcgctctgccctgcgccacctgctgttcataggaggtgacatcgtcctgggtgattccaacctgtgcctgcgccgcatcgagctgagcctgggcatcgcttaactgttggcgggtttgatcgagctgtgccagcgcttcggcgcggcgctgctcaagctcttggcgtccctgcgccaactgatcctcgcttgagcgcagctgatcactgctctggctcagggtatcgagcgcctggtcgagctgctgctggccttgatccagctgatcctgcacactttgcgcctgctcgttatacgtattcctcgcatcatcgacctgcttctgcgcttcggcttggatctctgaaagccttgaggctgcaagctccggggactctgtcctgagacggtcttcaacctcctcgactgccttgtcgtagccatccgagtacgcctgctgctggtctgccccctccacagtcacatagacctgggtatagggcatcgagtcagagaatgcctcacgcgggacatagaggtactgctccagggagccaccgccgagtgtggtagtaccgagtacggtctggtccacatagtccgcatcacggacgagaccgactaccgtgaaggtcttctgggtcagaacattgtccagatcggtactgccatagaggatcgtgatcgtgtccccggtgtgtaagtcttctcgcatcacgcggtcgtaagacatcacgcactcattgggggcctgtggccacctaccctcgatcagatcgatctggttgaggtagcctttcgcattcggatttctccccaggggtgcagcttcgggcagtgcgctgatgcgcaccacatattggtcggagttcagggatgccatcgcatcagtagaataggtgggcatcacgtccttgacgccctctacgtcttgaatcatatcaacctgatcctgggttaaccccatcgaggagatcaggcggatatcgtaaagttgggtggcatcgtagtagttatccgcgctatagcgcatatcccggccggtcatattgaggccgacgaagaagccgcagccgagggcgacgatgcccaagatggccagaaagcgccccatcgaaccggtgatcgagtggaagagatcctttgcgaatgcacttctcatgactaccaaaccaaggtcgaggcgtcgaccggatgctcgttgatttcattgcccgtcgcctgcccatcgtggatcgaaatcacgcggtcggcgatgtccttaaaggccgcattgtgggtgattacgatcacggtacggccgctgttgcggcaggtatcctgcagcagtttcagaatcgccttaccggtctgatagtccagggcgccggtcggctcatcgcacagcaacagctttggatttttagcgatcgcgcgcgcaatggagacgcgctgctgctcgccgccggaaagttgcgccgggaagttgttcagacgctttcccagcccgacatccttcaggacttccgccggatcaagcggatgtttgcagatctgtgaggctaactccacgttttcaagcgcagtgaggttctggatcaggttgtagaactggaacacaaagccgacatcgtagcgtcggtagagcgtcagctcccgttcgttcatcgaggagacaaccctatcaccgactgtgatggtacctaaggtgcaggagtccatcccaccgagcatgttcaggaccgtcgtcttgcctgctccggaggggccaataattacgacaaattcgccacgctcacaggtaaaattcatatctttgaccgcagcgacatcctttccgcccatgttatagattttattcacgccggaaaattcaacgaatgccatgcctcactcgcttatagaataatatgaagtatagataacttgtcattatacacattcaaaaacggacacgaattccaggagatgagggagaagtggctgagaacaatcggggaacctccgatactggtggtcttcgccgtatcaaagtccatttcaccggacaggttcagggtgtcggtttcagatggacttcacaaaggttagcaacacagctcgggctcgccggctgggtgcacaacgagtgggatggcaccgtcaagatggagctgcagggccccaacgagaggatcaaacagtttttcggactgctgcagaaccagtacagccgctggcacattgactataggatcgcaaacatcgacgatatcccggtcgatccggacgatcacgactttatcgtgcgcctgcacggagtagagtagctgccatggaaacaactcccgtcattatcgacaccgacccgggttgcgacgatgcgctcgcgctgatgcttgccctcgcctcgcctgagttggacatccagctcatcacctccacggcaggcaacgtccccatcggactcacgattcacaatgcccgtctcatcgaggactttctcggaaccaaggtcccgatcgctaaaggcttttccgccatgagcgtcactgaagacgggcatgacgactaccaccacggcgccaccggccttggggcgtttcagtgtgatatcgacgtcaccggcgatggattgctcctaccggagaccgccgtgcaggcacaggtagatctcctgatgcaggcacagaaaaaggtcacaattgtagcgctcggccctcttaccaacctcgcggtactgctcagggactacggcaacgaggtccgctcccacatctctcgtctcattatcatgggcggcgccttcgggcgcggcaatatcgccccctacaccgaattcaatatcggatgtgatccgaaagctgcggctaccgtattttcctcagggctgccgatcacgctgctcccgcttgaggctgcgaacatggcgctcctgacgctcgatgacctcaacgagctgagccagctcaacagagtcggcaaagctgcctcagagctcatgtcgagtccgaagggccaggcccccgaagcgaccaaaccgctctttgacccttcgacgatcgcctatctgatccacccggagttcttcaagactgattcataccacgtcgaggtcgaatgtgagggcacctatacccagggtgccacggtgatctatcagggagagaaacgggagccccagatggataaaccccctatcaatgtcgcatatagcgtggacgttgggaaattcaaagcttggatcagggagaccctcacgcgctggtcaacgcttggagcatgatcggtatgaatgcacaagctttagcacagattaaggccgggcatctggagatggcagtatgctgcacgttctacctgatctggtggatcatcttcttttggcccaaaatctacaatcgggttgccacgggcgctcctagggtctttgggatcatctccattatcggggcggttgtcttcggtctgctcggcgcagtcggtatcgcttcaggcgcaggtaaactgaatacgcccgtcgctggtgtcgcgacgctcgtcagcggtatagcgctctatatcttgttgctctttatcacccatcgcctctttcaacgcaaccccactacggagctggtcctgtttgtcgcgtggatcgttctggagctcttttgtgcctatgggcttcaggcagccggcctcgccggtcaggcagtcctgttgatcatcctcgcactcgccggctttgtgattagcctcatgtgctacgtcctctactaccacttagacccaaagccttcctttatcgatgggtgcttaccgctcgccgcgatcggtgcgatcagtctggttatggggctcgtcctctagggaaatgatgattaattcgcctcgatgaggccagtggggccacacgctgtatgacatcggctcaaaatgtctcgaaccacgcagtgctcatacccacatagatgcctatctgtcttctggatatggtatagctacatccacacattcctgcatatccaaaagacagatatggacagacagatgagcttttaagacctggcggattgtcaagctgagtgcaacatctccctaaagacctcgctggtcgtcctgtatctaaagaccttcctcggcctgtcgttgatcatgccgaatacgcgctgtacctcatcatcggtgagcttggagaagtccgtgcccttaggggaagaactcacagatgaggacatcggtgttcttagcagtgggcttctgccataggtggcagggatggcagaagtagaactggacatcgccgagcctgtcgctcacctccgcgcagggggcaaactgcttgccgcgctccggcgtgatggtcttgcggtcacggcctaacaaagccgtgagctcgacctcgtgtgcgcgtgagccttgccacctacgagtagccgcgactcagcgatccgcgattgtcaccaggcagggccctcccggcttgccgacgagcgtgtcgttctcccactcaccgagccttaagcgctcgtgtgcctgcttgggcctttctgagatgccgcaggagaccttgatcttgcccctcctcttcttgtgttccctgtgtgtttgcttccccttgctgtacagatggcggcggagctgatcctgtgggggcgcaccggggatatcgagctcgcctgagccaacggcgcgctagatagtcgtaaagctcacgacgcacgagccgccgggcccaagacaaagccttttgtctatgtgctcgggtgaccaccgctcgtctgtgatgtgctccctcaccttttcggccaacgctgggcctaagagcctcttgtgcggtttgcaccttgcgtgcctgccgttcctttccagcttacggctgagcgtggagctgtccctgccgctgtccctggcgatgtcgtggaacccccttgccctcggcgtgcagctcggctatcctgtcgcgctgctcagcgctaagatgtgtgtagtggcgcattactccctgacttgcgacgttgattgagacaaccaacatcgtagccttcggaggtgcgccatgacctttgcctggcgctattctgttgcactcagaatgctaattccgccctaggaaaggtcagctccattgctcttgatgatcttctgataagcgtagaagctgtctttgcgactacggctgagggtacccgtgccgtcgtcgtgtttgtcgacgtagataaagccataccgctttgcaaactcaccggtgccagcggagacgatatcaatcggtccccaccaggtgtaaccgataagattgacaccgtctaccaccgcctcacgcatagcagcgacgtgctttctcagatagtcgatacggtacgtatcgtggatggaaccgtctgcttccaccttgtctcgcgcacccataccgttctcgacgaccataatcgggatttcataacggtcatagatctcgttcaaagcataacgcagaccatcagggtcgatctgccagccccagtcagtggagggcagatacggattcttgccacctatggtcatattaccctgagccttttggagatccttatgcgtgcctactacgttggacatatagtagctgaaggtgtaaaagtccactttgcccccagcgatatcgtcgaggtcgcccggctccatcttgagttcgacattgttttctttgaagtaccgacgcgcataggcaggatagtagccacggacctggacgtcggagcagaaccagttggacaagcgcatctgcgcttcgttcgcgaggatatccttcggatcgcaggtggcaggatagctcaagatgaagcagtccatgttgccgaccttgaagtcaggatacttctcatgggcaagctgaaccacacggcctgaagcgacaaactggtgatgcagcgcctggaagcgctgctgtggggtagtcttgagtcctgaaatcggaccattataacctttcaccatgctagtggagagcagggtgcccatatcagtagtgccggtgttgatctcattgaaagtaagccaccaatgtaccttatccttgtagcgcttaaagaccgcttcacagtaatgtacgaagcagtcaatggtctcacgtgattcccaaccgttgtatttctcgactaagccccaaggcatctcatagtggctcagcgtcaccaaaggttcgatattgtgctgatgcatacaatcgaagagagaatcatagaaggcaaggccagctttgttcggctccttctcatcgccattcggaaagatacggctccaggagatggagaccctgagcatattgaagcccatctcggcaaaaagggcaatgtcatctgcatagtgatgataaaagtcaatgccatcgtggttcggatagaacacaccgggcttgatatcttgtgtaagcatacgggaaagcttgaaactaccacccgttaggtggtcatcgaccgagggtcctcgcccatcagcatcccaagcaccttcgcactgatttgctgccagggcaccgccccagaagaaaccgtcgggaaactgtttgctcatgtttgtcctttctcgaaggcggggcctaccctgtgtggaccccgcaacatttaaacatccctctattaggccacgattgacctgagaagggtccaatgttgtccgggcttttgcctacaatgtatgtcgccaaacaaagacatcgagaaacggaaagacccggatagactcaatgatactgcagtggatcgagaagatgggcatcgtggaaaagcgcgagctcttagagaggctcaaggccctcatcgctaagaagatggcaggatctaccctcgcaggtaagcccaaaagatacccgaggcgcacatctgcagacctcttctgtaagggacactctgcacaaggctattacagatggaagtgttgctcatgtggcaggaccttctcagcgaagatggaatctgccctgaagtctcccaggcacatccctttctgtctgctgccaggcagatgttctctccctcgatgagtcgcttgcgggcagcagggcaaggtcggctgtacagatgcgcgatagcacacaggccacggccatactgtgcactcaagcggcatatcaagtctgaaggtctgcaaagagtgctaagcgagctggggagcgagtatacaacacttcgcgggaggtccaccgagtcgaagctaaaggttaccctttcaggcatcgccgacagctcttgggtcgcaacagacaaccatgcaagatatagcgtgcatcctttccttactcggcgttgttgagtacacaccaagcgtggtgaaggagtccagggacagcgagaagcggccttgtcaatgcgatgcagcgaaggctcaggcaagttcttgctttccttctacaaggtggcaacaaagtggcttggccactgcctcgcctgcttcctgtggacaaagcaggcaaagcattcgaagcaggacagcaaggcgatgctctcaggacagcccacagaaggcagctacatacacacgaggcgcacttgtcaacatgccccagtctctctgggactggtggaagacaagggccgaggtcaatggtggtcttacagagagttaaacattaagaacttatgcagccgctggtgcgggctccggcacgttgtccttgtacgtcgccatcgttgccgcaaagccgatgaccattgcgatcacgcagccgattgccgcagtgaggacacttctcagtcctgtgctgccgatggtatcaataaacgacgcgaaaccgatgacgcctgaataacccatgctgaacatggtagtacccgtagcgccgatgaaggcaccgccgatagcgcctgcgatgcatgagataacgaagggctttcttctcggcagcgtgacaccgtagatagcgggctcagtcgtaccgaagagaccggtaatgaacgcaggcaggcacatatctttgagactctgatccttggtcttgatagagatagcaaggacaactgcgatctgcccgaatgtacagcagaactgaggagccagaattaggtcataaccctgcgttgccaggttggcaagcgtaataggaaccagagcccagtgaagaccgaagataacaagcacctgccaaagggcacccaaaacggtaccggcgataaggccaccgacctgcgggatgccatacaatgtattgaacataagtgtaacgaggctcgtcagtatgcttgcgatcgggccgatgaccaggtaggtcagagggacactgataacaagggtcactagtgggacggtgaagaagcgaatcattgccggaatattcttgcgcagcggcttctcgatcttggaggcaacccatacggccaaaatgatcggcacgacggagctcgtgtaaccggaagctggcataatgatcgggataccgagaaacgtcatcgagtatgccatctcaaacggggttccctggaagacatagcccagtgtccgtgcggttgcaccaaccatagacgggttggagttgaccatattcggatagcacagagaggcaccaattgcgatgccgatgaactcgttgcacccgaattttttagcggaagtgtaacccaagataatcgggaagaagtagaaaaagccgttgccgactgaatagagcacctggtaggtgccggaatcctgggtgaataatccaaggaaggtacacagggagagcaagccctggatgaggccggcagctgccagtactcctaggcagggctggatgatgccggagatcaaatcaatcaggacaccaatggcgccacctttaacggtatcgacacccttatccccttctctataatcttccggcacctcgccagcgccttgaataccacctattctgagtacagcttcataaacatcgcccacgtccgggccgatgacgacctgatattggccgccagcctgcataattgtaagaacgcctttggtgtccttcaaaacgtctgtgttggccttcgactcgtccttaagcttaaaacgtagtcgtgtaacacagtgagcggcggagataatgttgtcctttccacccacgttttggatgatagttttcgccagatcatcgtgtttgcctgccatgagcttcccttccacgtaaaaaactagcccttcctactatctgcatgccctaacaccagggacgtttgaaccattacaaagacagtgcaaggcgactgatatacatcaacggatgcgaataatctttattctcacagatcctatgattatttctctctatgttaggccacgattgacctagctccttgcttcccaccaatcccagaggggctggggcatgtcgacaagcgcacctcgtgtgtacatagctgccttccgcaagctgtcctgagagcatccgccttgctgtcccgcgcagcatgcctcgcctgctctacccacaggaagcaggcgagacaagcgctgcagccatttcgtcgacacctcatggaataggagcaagaacttgcctgagccttcactgcatggcattgataaggctgctctcgccgcccctggacgtggccgcaggctgcgtgatcctgagtaagggaaagatgcgcgccatatcctgcatggttgtcggctacgacccaggagctgtcggtgatacctgaaagggcaacccctagcttacgcatcgggtaggccttcccctcccgtgaagtgttgcatattcgtctctaaggtcgtttgcggcgcactcgatgcagtgaagtggtcgaacctgtaagatagggaaagcctgatcctttctgaatcccttcccgtccgaacaacaccattgtagggctatgcagcctcgcagacgatgctcctgtaccattgtgccggcgtgtcgcagctaagcgcatagtggattcgctcttcgttgtaccatgtgacgagcttctcgatggtcgcccttaagcttcgcaggtgtgctgtactcctcctgccgcaggcatttgcccttgagcgtcttgagccatctttgcatgagagcgttgtctctccatctgaccctttctgcttaaagttcatgatggagaagtggagtaacaacccttcttggaacatcttcttcagagactgagtcccgcctttctgaaactccaccgggctcatgtagtccagcgtcaagggcagcctctcgttgttgtaccaccacacctaagcgccaagcttcacctgaaggtcgcagagaccctcgaagcgcttgtggtgggcaaactcagccttgggcgtcttatttgctctactcgtctatggcactgttgtagtggcagcccttcatgcatcgcaacctcactatctagaaggcctccagaggctcgtctatggcggctccagcgatcttaaagccgcacttcgtgtggagctcacccttgtcgaagagcgaaaacaccacacatacgaatactgccttggccagcctcgtgtccttcctcgccccagacgtgtggctggctatctttcagctgtgcggatcgacgagcaggaagatgtagcacccacactcccagcacacagacgtaaggtaagaactaaggcttctctgggcctgtcggggtacgccttgaacttcgccttggtgtggcagactcgaggccacactcccttatggctacagcaaggtgcctgctgctggagcagatcctgcgcccccttgtgcgctgggtgctgtggtacccggtacttctttcctcgacggcaccggcgagagggtctttgtacttctcaggctcgggtgtgccgcacaagcctgcagtaggtcgacctcagagcggcgagctgcttacatagcgctgataagcggatagcgtctggtactttcttctatcgcgactaccttagtgcgactatcggtacagccgtccttaaaatgtcgagctctatctttaaggtgcttgttcttccttgtaagatcggctcaatcctaaaacctgtgtgcagacccatcacgcaccagctccggaagccttcgagtagcgcctggtggcaatcgaatatcttgaagaagaagcatccatcgttagggtatccctagcctgccctcctgagcgtcttgatcatgcagttggtcccttcgactctgccgctgctgatatggcggcgggcataggcgacgatcccctccatcgctgcgcgcatgtcctgctcctgcgtgcacaagtaggcctcaaagagcatctcatccgcgattgtcgcaggcgatagcctctacatgcaaacatccactccttgctggcgtggtcgcagaaggcatggagaaccttctttcccttcgaatggacaagccacagcacatgtcccatcttaaggtcgatgatcacggtggcacagcggtgcccgccgtgcagcttgaacgtatctgtacccagataccttgcctgccactcggacttgcgcagctttcgcttactgccttccccttccgtgtagagcccagagagcctcgcgcgctcgatctttttcacgacgtttctgttgaagcctgccgtgggcgacaccgccttgagggtctgccccagggcaagcaggtcgcaacgaaagcgagcagcaacagcgtgatgcgctggcctgaagccctgaagggcatatcctccatgcaggaggccccgcactccctgcatgcccatcttgaccgagatatctctatccttgccttcccatctcaagcaggagatgccaaagtgcgatgggagcctttctcctccatcggccttccgcagcaggagcacgacggtgcgtccgacactgccggcctgcctggaacggacaggatgcgtactggcttcctgcatcttttggacgacgtttcgacctcctcggtgcggacagcttctctgggctctcccgtctgcacgaagccctcgagatgcgaggggattgaaaggaaggcaggagcttctttagcatggcaagcgggcggcagctgggctgctggcgatgctacacttgtcagcgcgctccatccttgttcggggtctacatattgcgatgcaagactctaaaggagggccgcttttctgtctttgcgggcactacgtttcgggcaccggcccacagcttttaggattgaaccgtaagatcgaaaatgcactcctgcttaggtgtgcagttgtttgaggcacaagtggagccgctctcgtggatcgcctttatctataggtgcagggtcaagctggcgatatcgttatcggcgcatatctctgtccgagctcttgttgtcatcgttaggctcaacgatctggcgcttgaactcccctgaaaacttcctggggtgcttagggtccaccatcgcaggccttctttcccaagcgccccagtccctcgtgggattgtccctttcattgtagccactccacttgaatgcgaactcagacatgtacctgtctccctactgcccctgctcggcgtacttgcgctcggtggcctccttggcagggcgccaccagctttcatgcgtgcggtaccactctatggtctgggcaagaccttccgcaaagtcggtgtggacgggcttccagccgagttctcgctccagcttcgtcgggtcgatagcgtatctcctgtcgtggccagggcggtcacgcacccagtcgaaggcatcctccggctggcccatgagggagaggatctcgcacaggacctctatgttgctcttctcaccgttggcacctatgaggtaggtctcgcctatcttccccttcgtgaggatatcccagacggcgcgggagtggtcctcggtatgtatccagtcgcgtacgttctcgcccgtgccgtagagcttggggcgtatcccacagaggatgtttgtgacctggcgcggtatgaacttttccacatgctggtagggcccgtagttgttggaacaattagagattgtagcgcggatcccgtaggtcctctcccaggcacggaccaagaggtcggaggatgcctttgtggaggaatagggggagcttggcctgtacggatcgtccggctcgaagcggcgcggctcgtcgagtgccaaatccccatacacctcatccgtgctgatgtggtggtagcgaacatcgtacttccttgccgcttgcagcagcctataggtccccacgacgtttgtctgcacgaagggctcagggtctgctattgagttgtcgttgtgggactccgccgcatagtggacgatcgcatcgtgtccggagaccacctggtccagcagctccgcatcacagatgtcgcccacgacgagctccacctgcgatttaggaagtcccgcaatgtttgcagggttccctgcataggtgagcttgtccaaaactgtgatgtggcactcggggtggttcttcaccacccagcgcacaaagttggagcctatgaagccgcagccgcccgtaacgacgatgttcctcggctcgaagatatctggcattgatacatcacatcccacgggttgcatgactgatgatagctgacgaacaagggcatctagtcgtccctcgtgaactggatacggcggtcgagtaccttccggagatgctggccataggggttgttgccgtactcttcggctgcagcatcaagctgctcttccaatatctagtcgcactcatatacgatctcctcgatcctcgatgacggagatcatgatgccctggggtatctcgatggtccgcacgaagttcgatgcctcgtagagcgactccatcgtgccggtatcgagccaggcataaccgcaccccaatgtcacgacatcgggatcctccaccctgaggtacatctcgttgagcgacgtgatctctagctcacctctcaccgaaggcttcacttcctttgccatatcgcacactctggaatcatagacgtagaggcccgtaacggcggagcttgacttcggacactccggcttctcctcgatagagacggcatggccgtcctcgtcgaactccacgacaccgaagcgctcggggtcgtccacatagtagccgaaaactgtggcgccgcctgactgctctgctttgtccacggtgtggtgcagatgcctcgagaagccgttaccgtagaagatgttgtctcctagggaaacgatgattaatgcctatgccggccgcgaaaggccacatggctggtcctttctggcacatcattgggaattaatcatcgtttccctaggatgagggtgcaggggtcgccgtctatgaagtcctcgccgatgatgaaagcctgtgcgaggccatcgggagatggctgctctgcatagctcagcaagatgccgtactgggatccattccccagaagggcctcgaagcacggcaggtctgcaggcatcgagatgatgaggatatcccgtatgcctgccagcatgagcgtggacagcggataatagatcatcggcttgtcgtagaccggcaggagctgcttcgagatgacccgcgtcaaagactagagacacattccggagcctccagcgagaatgatgcctttcatagggcgttccatttcctttcgaaggaagccttcattcaccaaccgtctattattctaacagccaagtaaatgaggggcgatagacctacgtcgagctgcgaaggcttgcatcggccaccatcatatggcaaaccactcttgcagttccaggccacctatcacgggcttggttgacccaaaagagctaggcctgccagttaaggtagcttttacatgttggccttgggtatgtctgtgagatgccagaggtagcgtttgagccacaagcaaaagattgttcaggaaagcccatgttctcaagacagatacgctctgccacatcggccctgtaggccttaagaagtcttctaccaagccactgtgagcgcgtggcctgtcgtagaggatcgtggcacccttctgagggttctaagggcaatcctttagttcttttcgtggatagcttgccgtggctacatgctacagcgactgggttttgtgggcatctatcgctaaagcgatacagaggagctgcgcttgctcgcctgtctgaaggtgtggggaagatcggtgtcagcgaggttaggtcttatcgaagcaggcgcgcttgctgaggatgattctgtcttagtagccatcgaccgtcgtaaagactctctgcctttactcccaggctgtctggtgggtgatgcctgacttcctcggctgtgagcccagaggcaggctgtagcgcatgaggtggatgaagaagacccatctcgctagctcatagcaggtgtgcttaaagacagctcccgtaagcgagctgtagctgcaaccgcacgcagggcacttcggatgcatcctgaagctttcctttcgcttcgctgagcgtgcctcatgccaaatcgcatcttagcagctgcgttctcctacggcttggacaagaagcttgaagttgtcggcagacagggcgccggcccgcttctgtgaaggaattctcccagctctccatattcggctgccccatctgccataagcctgccgcccgagacttgtcgccaaacaaagcagacggcaaaccctatggcaaacgctttattcggcagggcgaatcttcagagcaagtacaacgtaaccccgcagaagacctccagcgggtacttccagcccaggcgcttgcaaggcctgcggttgagggtatcgtatacctcctgggcctactcgccgcccacgtcgtccaggggtctgcccttcgagaaaggagcccgttggtgttctcatcggtgcctctctcccagggatggtgcggcaggcagaagaagaccgggccctgagagcctcccagagcccctcggtgtacgcgaactgcttgccgcgctccagcgtgatcgtctccatcggcttgccgcaaggcgcctcttcgattgttggctccacccgcacacacatcgtgcctttggcgaggatcccgctcttgcagtcccgtgaccaggcacgcgtcgtcctgggggagcagcgctgctcgaagatcttctcgcagacgatgcgtgcgcttcggggtcgccagcagctttttgtgcctgtacctcctgcttttgcgctgcgtgctcgatagcgtaggcgacactgtagcggctgcgcttcctcacatgccataagttgcgcttgatcttcccggagacggtcgacttgtcgcagccgatggagcgggcgatggtgtctgggctgtccttgtcgtggagcatgatagcgatggtcttgcgttggtagatgctaagatggtagtagcggcccatgagatcctcccagtcggtttctttcgcaagcacccttctaggagcccgcaggctgtggtcttttcaggggcgttgcactagcaatgaataatcacctctggaacgtcgttttgagtggaggagtcagcatgcccaaagcctcaatcattatcccctgctataacgccgagaaatatcttgctgacacgcttgcgagcgctcagaaccagacagagcgcgatatcgagatcgtctgcgtcgacaacaattcgaccgattcaacccgagatatcctggacaaagcagcccagaaagatagccgtatccgcatcctcgaagagacagtgccaggagaaggcccagcacggcaggctggctttgctactgccacaggtgaatggctctatttcctcgatgcagacgatcttatggaaccgcagcttcttgagcgggccatggcaatgggcgaaagcaagaacgccgacctcataatcttccgcacgtataccttgaatgacgtcacgggagaggtcattcctatcagctattcatatctgcgcgattggctgcccgggaatatggatgtcttcgacccgcacgaatggccgaagcacatcctcaactccttccagaactgggtgcacaacaagctgttcagagcatcctttgtccatgaacatggcctgtccttccagccactccacaggacagcagacctcctcttcacctgccgtgccctgacagaggcgcactgcatcgcactactcgatgagttcctgcacaagtaccgaatcaacaacgcaagcagcacaatggcaacaagcgacagctatcctcttgacttctatgaggcactcatagccctgaggaataccctgaaagaacaggggacatgggatctctaccacgattcctatatcagctgggcggctatcagtgtcatcgccaacctggagacagcccgctccgtcgacggctttaccgccatagccgacaggatgaagcagggaggactcgaagcgcttgatctggcaaagacagatatctcgtctctcgaaagcccctggcatcagcagcgcattcaggatatcctccatcttcctctgaccgatcttatctttgtccactatgcagatctcaagatcaggcgcaacggatgcgaggaccatgcttcgcgtgtacggatggagaatgcagatcttcacactgaggtgaagcagctcaaggaccgaatcaccggactggagcatgaagtagaactcagggataaagcaatagagggcttcgagcattccatatcatttaagataagccgttgcatcacagcccctgttcgcggactgcgcgacaggatgcagaagcgaccataggcatgttcctggccctcggccagattgcatacccatatgctgaagggccagccggacctcttgcatccggctggcccttcaggacagtactttatgcaccgtgccaggtagggagctatatgccatgccatcccttccccgttccagcctatggtctgaaacgatgcgtattcagaagagctcgtcgtatagagatagtcacctgtatagggattgtagagacggtagacctcacttccagaggtcagtacataccaacctaccccctcgtaattccatccgatcgacctcaggttgtctctctcgtttgaggagagggtatagagatgctctccagaatacgggttgtacaggcgatagacctctatagatggtcatctgagcctgaaatcgagacccacattgcctgttatcccatcgacgcttcctttggaagtgcactgccagaaccaatagtctcctgtataggcgcactggtagttgtactgtgttacccagcgagaccagctctcgaagcaggaatccgtcagatagttgttccaccagttgagattagcatagacgcctgacgtatatcctgcgtcggcaatcttctcgcaaaactgggttgtaatcgtcgcaagcgcagaagcgctcttcagcagggagatatcctccaagtcataatagacaggaagcattgaatgcaggtcagagatggcattgagcccatattccgcctcgcaagagccagcatcagaagagatgctgaggtttgcataggggtagtgatagattccgtaatggatgcccaggctctcacatgcagaagcattgcgcttcagataactgtcgtgctggcttgcatccgtcgtgtcgtcgagccagccgtagctgctacggatgatggcaaagtctatcccatcggcagcgaccgcttcccaatctatcgccccttgatgtgaggagacatcaattccctttgccgcggcattccggatcacaggtctgctgctcgagatatagccttcgcttatcttggaccagtcacccgtcgaagagggcatccgctcctcctattctgctgcattcgtatctggctggcttaccgcttcgcccatgtcataccggaagctctcaggcagatcgaccttcatgcggtaaacgatattctccactgagctacccgtcccttctgcctcttccgcctggactgcagccggaatggcagatatcggcacagcggcagcaagggcaaagaatgaccgtcgggtcaatctcataactcgctgttagaccataattgacctgagaagggcccaaaagtgtccgggcctttgcctacaatgtatgtcgtcaaacaaaaacattgaggatcaaagggcccggatggatccaatgatactgcagcagatcaaaaagatggggatcgtcgagaagcgcgagctcctggagaggctgaaggcgctcatagccaagaagatggcaggctcggcacttgcgggaacacccaagaggtgcccgaggtgcaaatcgctcagcttctactgcaagggccacggcgcgtgtggctcccagagatggaagtgttgctcgtgaggcaagaccttctttgtaaagacaagatctgtcctggctatgtccaagcccacggccgccacatgggccgcatatgcaaagggtacgcttggcaggcatgacgcttgaaggagcttgcgaagagctgccatgtgagccttaaggacattgtggttttatgcgcatgaggctcttcgaggtgatgcaggcagcgcttggcgccttcaggtatggacccaccgtctcctgccaaaagatcgggatctacatcggcgagtcgcttgcaggcaacagggcaaggcccaacatc

SEQ ID NO: 310 - DNA, 28456 bp, Unknown
  Metagenome-assembled genome
gttcaccacatattttgaatcggaatgaagcttcaccgcacagggcaccttaagagcctctagtgccacgatcaccgccagcagttccatacggttgttcgtggtcagccgatagccttgggagagctcgagcgtgtgttccttccctcttccatcgatatagatgagcaccgccccatacccgccggggcccgggttgtgccgacaggccccgtcggtgtagatcgtgacacgtctcagtggttgtgatcctaccatagccctacttagcctcagcccagttgtcaccgtaggagacctctgcgatcaggggtaccttcagctcgacgatgtgctccatcgtgtctttgacgagcgcagagagtgcatcgatctcgtcgcgagggacctcaaagtccaactcgtcgtggatctgcaggatcagctttgacttcagaccctctttgcggatgcgctttggtacctccaccatcgccatcttgataatgtccgcagcggtgccctgcatcggatggttcatcgccacacgctccgcaaaggagcgcttctggaagttggagcttgcgatatccggggtatagcgacggcgtccatagagtgtaatcgcatagccctccctatgtgccaacttgatgcaccggtcgaggaaggttctcacacccggatagacctcaaagtagcggtctatcatctcctgcgcctctgagcgcgggatcttgagcgagttcgccaggccataggcctgctggccgtagacgataccgaaattgacagctttcgcgcgtctgcgctggttcggtgtcacttgctccatcgggatattgaacacccggctagcggtcatcgcgtggaagtccgccccggatctgaaggcttcgatcaggtgctcatcctctgaaagatgcgccagcagtctcagctcaatctgagagtaatcgcaggtcagaaagacatggctctccggcgcggtgaaggccaggcggacccggtggccaagttcagaacgcgtaggaatattctgtaggttcgggtcggagctggaaagtctgccagtcgccgccacggtctgattgagggtggtgtggatacgtccgtcggtccggatatcgttcgggagggcatccaggtaggtagatttgatcttgttgcgctcacggtaatcaagcacttcctgcactaggtcgctcttcttcgcaagcgagctcatgacctccgcattggtggaatagaaaccacttctggtcttcttcaggcctgccgtcggcaatttcagaacatcgaagaggatgtgggagagctggcgcggggagtcgatattgaactcctcgcccgctttcgcgtagatgtcctccaccacctgctcgatctcaccgttcagcccctctgactggctcttaaagactgagcagtctacgtagagcccggtgcgctccattccggtcaggacaggcaatagcggcatctcaaggtcggtaaagaggtcaatgcactgttgctccttcatggccttcgtcagcggatccacaagcgcacgggctgcaaaggcttcaagcgcagcttccggataggcatccgtcgcatccaggagcactgaattggggacgtagcgtccatagacgtctcgaacctggtaggacacgccttcggagcgcaacaggtaggcggcaactgcaatatcaaagatatgggtcggatctacctcgtaggcatcgattgcagcgggcagcttagaatccatcgggcaaatcagatggagaagctccttcacattgccagcggcaaacttatggttgttcacaatttcggtcagcgcgttcagtgccgccttgccagagagcctgattagatttttgccggtggaaaaccagagcggcgtctcctcttctttgtcgagtgccaacttcagctgtttgccctcagtctgttgctcaagcgcgacaccgatccagtcatcctcggaaaacgcctgttccagggcctgttggcctttctcattgttgaggaccttcgggagcttcatcgtggtctcggtcttccccactccggtctgtgccccaacaccgccgagtttcaccaagcgcttcacaatgccggtaaatccgagtgagccgaaggctctctcgacctcagccgcgtcaaaggtcgggaactttgcatccgcgagattgacgtcgatcggagtatcggtacggatcgtcgccaccttgcgggagagcagcgcgtcgtcgacgtgcgcccgcaggttctcccccatcttgcctttgacctcgtccttatgtgccagcacctgatcgagactaccgtacttgacgatcagggctgcagccttcttgggaccgatgcctggtacgccgggaatattgtcggaggagtcacccttgagcccgtagaagtccgggaccaaatcaggagtgatcccgtggtacagatcatccactgactccggggtcatcacagagacttcggagacgcccttcttggtggagaccacctttacatggtcagttgccaactgatagatatcacgatcgccggtgacaaggtacatgtcatagccctgctcctcaccttgcttagcgagggtaccgaggatgtcatcaccttcccagccctctgcctcatagaccgggatgtcgagcgtcttgagcaactctttcaccatcgggaactgctcgtagagctctttgtccatcggtgggcgctgcgccttgtactgcggcagtatctccatccgcaccttcggcttacccttatcgaaggcacagatgatcccatcggggtggaaggtctccaccatcttgataaacatattgaagaagccaaagagggcgttagtggctctgccgtcaggcgccgacatcggctggcggatcgcatggtaggcacggtgcataagcgagttgccgtcgattacggcgatcttcttgcgctgcttccctgcctttcccggcatagcggttgcagtatctgtatcggacatggttttgcctccatgaaattagtttctcgcccccctattgtacccaagagtctcgacatcctgcctaacaagcaaacctggcacgcgcacatcacgaaagaaccctcccgcccttgagggcgggagggttcgttgctgccgtataatgggcgtttaccgttacacgtagaagagcatcttgttgtagctcgggaccggccaatactcatggccgcacactttttccatactgtcgatgaggctgcgcagcttcttcatagccggaatcacgttgtcacggtaagcatagtcttcgtcctggatattatcgttggccttcgcttcactgttgaccttttccagctcgttgaccgtgtcggtgatctgggcgatcttgtcggtcgcatcttgcaccatgttcttctcagtcggcgcatcgatcccgatcgcccgcttggcctcgacggacttggccagatcggaggagaagcggatgatcgcgggcagatacaagtggtgcgtcatgtacaccatcgtattcacctcgatgttcaggagcttcgcatactgctccgccttcgcggagtagcgagcacggacttccttctcgctcaggacatcgtacttcttaaagaaatcgatgttctccttcttgatgatgcagggaagtgcatctggggtggtcttcagattcggcaggcctctgcgctctgcttccttctcccactccttagaatagccgttgccctcaaagaggatccgctggtgatcacggaaggtgtggcgcacaaagcgcatcgcgatatagacgaagtcctcttttttgactcccgccatgtagtggacgaagcgatcgcactgctccgccaccgcagtattcagcactacgttggggtcagagaggttctgttggctgccacacatacggaactcaaacttgttgccagtaaaggcgaaggggctcgtacggttgcggtcagtgtcgtcgcgcaagaagttcgggagcgccgggacgcccaagtccatcatctcgcgggtcggggattcaggttcttccttcttgatcagcgcttcgacgatcgggtgcagcgcatcgcccagatataccgagatgatcgccggtggcgcctcgttggcacccaaacgatggtcgttcccgacagaggcaaccgaggcacgcaacagatccgcatggttgtcgaccgcggcaacgaggcacgctaagaagaccaggaactgcaggttatcctccggatcatcgcccggctcgagcaggtccttgccgtctgccacgagcgaccagttgttgtgcttgccggagccgttcacgtagtcaaacggcttctcattctgcaggcacgccaggttgtggcgcgaagcgatgagcttcatcttttccatggtcacgaggttgtcatcgattgcgaccgggccgcgctcatagatattggccagctcgtgctggcaaggcgccacctcattgtgcttcgttttggcagggataccgagcttccagagctcatcgtccagctccttcataaaagaggagacggcggggcggatcgcgccaaaatagtgctcctcgagctcctgaccctttgcgggctcacagccgaagagtgtgcgtcccgtgaggatgaggtccggacgggtcttgtaatcttcctcagtgatcaggaaatactcctgctcaggaccgacggtcgtatggacgcgtttcggagtctgtccgaagagcttgagcacccgcttgacctgcttttcgagcgctacctcagagcgcaagagcggggtcttcttatcgagggcctcaccggtataggagataaaggcagtcggaatgcagagcacttcgtctttgataaagacggggctcgtcggatcccatacggtatagccgcgggcttcaaaggtcgcacgcaaaccaccggaggggaaactggacgcatccggctctccctggatcagttctttgccagagagtgccatcagcaccgtgccgtctttgcgtggattgataaaagaatcgtgcttctcagaggtaatcccagtcagcggctggaaccagtgcgtgtagtgcgtggccccatgctcgagcgcccactctttcattgcgtgcgcgacctcgtttgcgatatcgaggtcgagatcatcccccgtatcgatcacatgcttcagcttcttgtacgttggttttgacagccgctcctgcatgtctacatcggtaaagcgcaggagaccatactctgacgtaaccttatcctctgccatcgctcatcccccttaggtgtcttaaaagcgcctgtcggatttgctaacaataatattcagcgtacacattttgaagtggtattgcagaattttcttcagagtaccacggaacatgggcgcaggttcaaagtgggaaccgagacgaaaaaggctcttgtttacttatgggtggacagcactcctcgcatccccgtgagcacgttggtacccggaaaagccaaagattttggcgacggatgcgacccaaaggttttgcgatatagatgcttttaggcaggtatgctgacaaggctctctaagagatcccaggggccgtagggacgaaagggggggctcttcgactttgttggtttaaggggagcgcagatggagtgaaggaacatcctgcatatgtgagggtggttacacgtcaggaccaggtaagtggttgtgagccatgccttgccacaggcgctgcggcacctgctgaccgacgcaagcggatcttgtgggcatctcgatatctggcaatacgagacgattcgtcacggcgcgggttagcatgccctaaggacgcgtgcatgccgccaaggtagttgccctgaaaggtgttcccgaacgacgcgtcacgggctctttgagcccgctgatcatggcctttggtcatgagcgttggggccataacgccctgcccacgagagcccacgttcatagaggctgcttgggaaggcgacatgaaggcgagggatgcagtcggactattccggagccgtgcgtggtgggtacaggcgggacaccgcccaaaagggtgcggaccaaaagctgtatcaaacatcatggccgacctcgcccgcctgcggcaccattacggaaggccaaagggaccaaaaggtttgacacagggcaggcctctgagaccttgttttttgagcttaaggcgcatacagggggtggcaacaggggtaaaggtcttcgcaggtcattctttttttttgtttttttttttttttttttttgcgcgacattagcccccaaagtctaactcccttttttggtgtgtgggaggtccaccgcagcgattgccccagggggcgcccagatctgggcagcttacatgtagtggagcttttcacaaaggcaggcgacagacccattgtgaaaaggtacaacgcagaggcgcgagtcggcgaaaagaagcacaagatgcttacccatgacgggaactttacgcatgggctaaagagaggagaatacgaaggagcctcaacagagtccggctcttatgaaagaaggagctcggacccaggcgaaaggaccacaatctcaggggggcgcgtgcctgtcaggatggccaaagctgatgcagggacgtctatggggctggcccccgacaaaaaatctaccggccaaagccccaggggaccgggctctgtttgtggatgatgcactctgctgtggcttaaggataaagaggatggcaggtacctttatgcaagggaggtaaggggaattatatgaaaatggtggaggggcgggggatccaccaaaattagtttctcgaaaaggctcaactcccccgccccagtcagcaaaaagcaaccttgccaagcggcttctagaagcatcgcctaccaacagaaccgataatcttcttcagactgggggaaactcaaccttctcggtccaggaggtagcttgcatgccgctatccactagagacgatcgaagaggtttcccgaacaaagccctgctgctgaaagcagcaaggcctaggaaataagaaataacactgttagagacgctagtcttcaagtctgttgtccgacttatctgacttcatcttaatgccctcaatcaaaccgacgatacccgtgtacaccagggcgaccccagtgacgatcatggacacgtccgccatcatgaacggcgaccacatgaccatgaagcccaggataatcatcaggacaccgccgaagatctgccagccggtgtgcgtagcgccaaacgcgcgcgcggcgttcacgaagtagaggaagttgaagccgaagatgatcaagtcgataccgatcaggatgaaaatccaggcaacaaagaactgcggccagttgacgatcatgaggcccaggaagaagtccaaaagtccttcgaagagctcaatctgcgacagcaggatactgaagtgggcaaaggaactgatcagagcgacgataccgccgatcagcagaaaccagccggtagccaatgtgataaacatcgtggcgccggtggggtgcgtgaaggcgaggatgcctagaacgatcgaaatgatgctgctgacaatgactgacaatttggagcgtcttacatgtatatcaaacatagttgctctccttttatcgatctgtatgagaactatcgtctaagcgatagataatctacccacttcacacttagatttcaatcagaatacgttctttttaccttatttgagataataccaggctgctcgagctctctgtcagtctacgggcaggcggtagagtatcacttcctataaaaatcgtgcagcatgctgtgtgccacgcgatatttcatgcacggtattcttgtcgcgcttagctgttctggaagcgggaatcttttccgccgccaagggcatccataatctcccctacatattctttcgtgttgaggcgggcatcctcgaagtcgtagtcgatcgtatcatccggattgagatggtgctttgagatttcgctcggctggtgagcggtgtcgatcacaagggtctggtaagagccgtttttagccgcaagctccacacattccggtgagagcgcatattcaagccagagatgtgcagcattgggatgcgcggtaccgatcagtgccgccgttgcgccgacctcgtaggaagccccagaggtaggtatcaccagtccgatattttcgtagccgttatcctcgatctgggcaactccgtcatggaggaagccgataccgatgacgcactcaccggagccgatgttctccgccgggccgcccccggtcttggtgtattcctgcacgttcttatcgagctgagtcagatactccagaccctgctggtggccgtactcctggatgactgtattgaggatcagccgcgcggtgccggaggtctggtagttcggcatccagatgagccccttgtacttatcgtcaaccaggtcaggccagtccttcggggcatcgatgttgagtcgctcgatctcatccttgttgtacatgaaacctaagagacctttgtagataccgaaccagtcattgcgctgggaaagatagacatcgttcatcaggtgggaagagttcgcgggcgtatagctagcatccaacagcccctcatcggaaagctcgttatacggatcggtagtaccgccgaaccacacgtcgaactgagggaacccattgctgttctcgatcagagtctgcccctcaatggaggagatacgcttgtagcttacatcgagcccgtagagctcgttgaagtgtttgcaggctgcacccagataatcctcaccgcaggagcccaaaacttggaggcttccttctccttttgctgcatcaacgaggtcagagtccgcccccacagcgctttgaccggaggtcctgacactcggcgtggagctttcgttcgagcaggcagcaaggccaaacccgagtgtccctagcccagccaggcccaagaaattcctgcgtgtaaggttgctcattgtcttctcccttaaatgtctgctcttaagagcagtcgcatccctctagtcatctctagggtagtacaactcactgaaggtaagctgtctcagcacgtgaaacacagcaattcgctccgtttgccggtaccaaaaaagcgcagacacgtgaaggtgcctacgctttgacagacaatcaatcgttttagagagcttagtgtttgatcggatcgttctccatcgccatcgacgccgcaatctcggtgataccggcaaccagaagagcgatgccggagatgatcgtcaccacgtggatgaacgcgaatggcgcgattgccatcagcacgcccaggatcatgtcacagacgccgcagaagacgtcgcgggtgctcgacttctctttgccctcatcgaaggcggtgatgccgataccgaggacgacgagaccgaggataatgaagacgatgttgatgaaggcatccggagcaagcatcagaaccaagccgacaatgagcgtgacgataccgacaccgacttgggtcttgtcgcggtcgttaccgacaatcgcatcggtgatgcggcagataccgaggatgatcgcgatgatgccggcaaggcggaccagccccaaaacagtctcctcaccgtaggcaaaggagatgatgcccagaagcgccagcagcacgccgcttaccatcgtgcttgtcttcgtgtgtctaaaaacacgttccagaaaattcatcgtatgtccctccctgtgaaaagggtttcagcttcaagctctaagaattttttctacccaacacaaatgggcggtataacccgcaaaggttaagtccaccacactcacatttttcatcatactatccccctgccgtatctgtccgacaaaaccctgcccgaatgccttttatcgcgcgttttatgggataccttgggtaaagtgggtaggtaaaacgttatatatgcaagcgaccgtaaaggaagcgagaaaactacatgcctgccttgatagttcattacctctatgcaaaggacgtggagtctaccctacctccggataccctctcaagtgaggaagagactctcgcctttcgcctcggtgcccaaggccctgatccctactttgtccgctaccgcggcatcatccaaaatgaccgcacctgccacaagttcgcgcacaacatgcatgcggaatacatgacgaaagcgctgacctgcctgagggacaatatcaaaacgctcccccaggatgaacagcgcattgggagagcctttgcgctcgggatgctcgcccactacctcaccgattccgccgcacatcccttcatctatgcggaggaatacgcgctgcagcacgcggatccgtcacttgccgacaccggcagcgaaatccatgcggtgatcgaggcagatctcgattcctggctgctctgggagaaggagcaggaggacgcctcctcaggggatgcatcgctcagggccctcgagcacacccgccgtatcaccgatgccgccggagcactcctttcacaggttgcctttgaggtcttcgacctcaatgtggagcctacacagtatgcctctgcaatcaaggactaccaccacatctacaacacgctcgagccgagcggcaacatggtcgagcaggcctattccggcattgagggcgtcttcagggatcattcaatgctgcaggcgctgtgccacccgagtatcaagactcaagagtgcacttctgccaacaccgcgcaccatacctggaaggacccgaacaccggcaaggagtcaaccgatagctttggtcaggtctatcagaccgcggtcgatacgttccctggggcagctcaggccttcctgaccggcgaagacctcacagaggttacgcaccatatcaactacagcggcatccatctcaatgacgaggagaccgagcctgcacgccactagcctgaggacaggcagtagacctgcagatatggctgcaccatatacagaaaccgcaactgcaaagaggagcacactcacccctctccgcatcttttaatccatagatacagtcagctacacacacaattacgcctgagtggtcccctcaggcatccgtccagttgcaatgatcgtctccagatcctgttcattcaaaatcggaatgcctaaattctgcgctttggtgagcttggagcctgccgcgacaccggcgatcacgtagctcgtacgcttcgacaccgatccggaaaccttggcgcccaaagccctgagttgcgctccagcttggtcacgcgtgtagttctgcaggctacctgtcagaacaaaagtaagtccggtcagggtctgtggcttctcaggttcttcaccgaaaccaggctgcgtgagcatgacccccgctttacgcagccgctccaatactgcgacattctctggaatggtaaagaactcgtgaatgctcttcgcgatcttcgggccgatgccctcgatctgggcgatatcctcttcgcctgcaagcattaccttctccagtgaaccgaagtgctctgcgatcagcgtcgcgacgctgacgccgacgtggcggataccgaggccgaagagcacacgggcaaggccccgtttctttgagtcctcaatctgttccatgatcttgtgcgctacggtcttgccgacgacgatgtgatcaccttctgcatggtgcttgtcggaggtctcatacactctgcccgtatcgacgtttgcgagcgccccctcagtcaggtggtcgtagtagtccgcaacatccttcacaatgcctcggtcaacgagttttgagacgatctcttccccgagaccgtcaatatccatcgcagtgcggcttgcccagtggatcaggcgctccactgcctgcgctccacagtcaattgagacgcagcggtaagcgacctctccttcttcctgcaccacggggctaccgcagctcgggcagaccttcggcatctcccagaccgggcgcgctgcatgctcggcagccagctccccttccaggaccggtcccacgacttctggaatcacatcaccagccttgtggaccaggatcgtatccccttcacgcacgtctcttctgtgtacctcgtcgatattgtgcagggtcgcacgcgcgatcgtggagcctgccacgcgtaccggatcgaactccgcaaccggggtcaagacaccggttctgccgacctgggcccggatctttcttaaaaccgtgcgcttctgctccggcgggaacttgaaggcgattgaccagcgcggagcacgggcggtgaagcccagttgctcctgctgtgcaaagtcatcaacttttacgaccaccccgtcgatatcgtaatcgaggctgtcgcgctggtcgagcgcacgcttgcagtactcgcgcaccgcgtgtgaatccgtggcgcgcttcgcgttggggttgacggagaatccgcaatcagagagccagcacaggaactcacgctgcgtggtgatagtgagcggagttctgtccgctaccgcatagataaaggtctcgagatcgcgggcgccggtcaccttcggatccttttggcgcagggaacctgccgccgcattacgggggttcgcgaaggtcttacggcccgcttcatcgttctcctcattgagccgactgaagctgtggcggggcatatagacctcgccgcggatctcgattgactgtccgaatccgccgtttcgaatcttagagagccccagcttcgctaagacccgtggaacatcgtgtatcgtaaggacgttttgggtcacgtcttcaccggtggtaccgtcaccgcgggtagcagcccggatcagctgtccatcacggtaggtaagtgccacaccgaggccgtcgatcttgagctcgcaggtgtaggcgatcggatggcctttagtcgcgcctaacgcctcatcggtatgctgtaaccactcatccaactccccgaagtccatcgcatcgtcgatggagtacatgcgccgggcgtggcggacgggcgcaaattgggaggagataaagccaccgatccgctgggtgtaggagtcaggggtcacgagccccggatgtgccgcctcaagtgcctgcagttcacgcaggtaggtatcgaactgggcgtcagtcatctccggctcatcgagcgcgtagtaggcataggccgcatggttcaggatctggttgagctcacgggcacgctgcgcaggtatctcatggctcgtcggctgcggtgctcggtctccaaaaagagaagtctgttcacccatgtaaggaactccttcggatgattcttcaaaacatgcttatcttagcgcaacgcagggaacgtctgacacggaggaacccgacaaagtccaaagacacgctaaaacgagggaggccccacctcccacaagcgatgaagcctcctcaaaccatggggtaccaatggtcctatctgatgctggtaacctcgtagcctgcatctttcacagccttcttgagcttgtcgtctgaggcaaacatgcctgcgtcaagcgtggcagagttggtgtcaagtgagacgtgtacgttcttgacgccgtggacaccctcgagggcctgggtcacatgctgcacacagtgatcgcacatcatacctttaattgccaatgtcttgtgagccatagtgaaatcccctttcgtagcagacggttctgtattctctccactgagtgtaacggttgttgctttcttggctccagtggactttgcctcactcggcttccaggcgaacagacgcagcgcgttggaaaccacgaacacggaggagaagcccattgcagccgcaccgatcatggggttcagcgtgatcccgaacggactcagcacgcccattgcgatcgggatgcagatcgcgttgtagaacagcgcccagaacaggttctggcggatgtctctcattgtcgccttggagagctcgatggcggttgcgacatccttcggatcggagtgcatcaatacgatatccgcagagctgattgccacgtcagtgccggcgccgattgcgataccgacatccgctcgcgccagggcaggagcatcgttgataccgtcaccgaccattgcgaccttacggccccggctttggagttgtgcgatcttctcctccttctgatcgggcagcacgcctgcaacaacctcatccacgccgacctggttcgcgataacctgtgcggtcttcggctggtcgccagtgagcatgattgtctggatacccatatcacgcaggcggttgatcgcctcaggtgagctttccttgataacgtcggcgatagctgccagcgccactgcttccctatcaacggcgacaaagagcggggtctttgcctgtgccgcgaggctatcagatagctcagccagcttatcgatcgcgacgccgtgctctttcatcaagcgggcattgccgatcaacactgagctgccagataccgtagcggagagaccgccgcccgggatctgctcgaagtcgtcaacctcgtcggtatagtgcacgccgtccttctttgcataggccacgattgcctgtgccagcgggtgctcagagcggctctcaaccgcagcagcgaggctttccacagtgcgcttccgtgcctcgcttaccactacaaagtcagtcacttcaggcttgccacgggtgatggtgccagtcttgtcaaggacaaccgtattgaggtcgccagcggtctcaagggactcggcagacttgatcaggataccgaccttagcgccacgctcggtgccgaccatgattgcggtcggggttgcaaggccgagtgcgcaggggcaggagataacgaggacagagactgcgaagttaaaggcacgggagaactgacccggctcgaggaagatcacccacactgcgaaggttgccagcgccgcagcgatcacgaccgggacaaagacgcccgcgatcttatcagcgatacgctcaatcggggccttagagtttgtggcctcatcgaccaggtgaatgatgtgggacagggtggtgtcgttgccgacggcggtggccttcatcttgaaccagccgctctgggtaacggtagcacccgtcaccttgtcgcccctcttcttctcattggggaccggctcaccggtgattgcggactcgtcgatcgaggcttggccttcggtcacgatgccgtcaaccgggacggactcaccggagcgaactaccaggatgtctccggtgacaacctggtcagccggaatctgtatctcttggccgtcacgctcaacggttgcgtttttaggagctaggtcaatcagtgcagagatggcactcgtagtcttacctttggcgcgggcctcaaagaatttgcccagggtgatcagcaccaggatggtgcccgcagagtcaaagtagaggttgttcatcatgatttgatgggcagccccgacgtctgctacaccgagtgccgatgccatctggtagaccccgaccatgctgtaggcaaaggaggccgaagaacccagagcgatcaacgagtccatattcggtgcgccgtggaagagcgacttgaagcccatcgagaaataggagcggttgataaagatcaggcacatcgcgagcatcagctgcgtgatcgccgatgccatcatcccctgcattccggcaaggcccgggatctcaggccagctgaacatcggacccatggcaaggtagaacagcggcacgccgaagatgatcgacccgatcagctgcctgcgcttggcgtccacggccttctgcgcagcgatcgcgggatcgacgaatgccaaagccttggtgttgacctttgcctggcgcatcttcgccccgtagcccgccttatcgatcgcctctacgaccttctgcgcggtcttgggctttccgtcgtacacgagctccatcgaattctttaagaggttcacgttcgcttcctgcacacccgcaacggactgcgccgccttgtggacatgcgcctcgcaggccgcacaggtcatgccggtgatatcgaacatgtccttgtgaagtgttttggtagccatacttccttctttcaatatacccatatggggtatataccgaccataccaatcccctgcagtcattaaaacagcaggaatggagtgctctgatccactcaataaaacttcttgaagaggtccatgacctcatcgacgatctcagtgttgccttcctgcacctgttcgaccacacaggtctcaaggtggtcgcgcatcacttcgcgcgagatcgccttcacggcgctctccaccgctgcgagctgcgtcagcacctcgccgcagtagcggtcgctgtcaaccatgttcttgatgccattcagctggccgattacacggttgacgcggcgctcaacgtcctttttcagggcatccgaacggggcgtctgtttatagtgctctatcgcatgcggagcaggttttgtagcggtctgaggagcgcccgtcgtttttgttgccatactcatatctcctcatctctcgttttattctcacgctcagtatataccccttaggggtagtattaatcgagaatctgagattctatgagcatgtgccgactatgtggcgggcactaccgtatggttactctctaacgctattcgattgaatccggctcaaccggttcgtcgtccccctcaagctgcggatgcacagaggtgtcctgcttctgtgccttacgcgcttccttaaacttctccttcatcgtcggattcttgtcggtgagtttgcgaattgtcagttcgtctgccttatcgttggctaacctcagctggcgttcagaggaagtgaggttcttcttcactttattcagatggtcgatcgtcttatcgatctcatcaatcgcggcttcaaacttattggctgcagtctgatagttcttcgagaacctgttcttaaagtcatcgagcgaattttcaaagttggtgatatcgatgttctgctggcgtatttcggaaagctccttgcgatcagcgagggagttcagggctgcgttgcgcagcagcgtgatcatcgggataaagaactggggacggatcacgtacatcttcggataggcgtaggacacatctacaatcccctggttgtagagctcactgtccggctccaacatgctgcacagcaccgcgtactcacacttcttattgcggcgatcccgatcgagcttgctgaagaagtcctcattcctatgtttgtttttccgagcggatccctcgtcctcattcttcatctcaaacatgatggagacgatctcgatgccgctttcaggatccttctcacggtagacgaagtcccctttgctgccgtcaacgacgtcgttgtccttgtggaactccgcgtttctgaaggcggtcgcacgccacttgttgaattcgttgaggcaatgctgctccaaggtctccccaatcagcttcgtagagagatgtgcgcgctggttgcgcaaccgctcgatctcatcgtccttgtcgcggatgataacgtccttaccctgcatcttctctgtgagttgctgcttgagggaggcctccacctgctcccgttcgagcttggcggccttcacttccccctcaagggaagtgttcttctgtgccaactcaaaggtggctctgttgactgccagctccttttggttctgatagtctttgtcacgggccgcggcctcagcttgaagctttgcgatctgctctttgtagtctgccaccgacttcgtcaggcgcgtctcgctctcagcgttagcccgggcagcatcctgtttcgtcgaagctagatcattcttcagctgcacgatctgcgcttggagattggcttcacggttctggcgctcagcttccgcccgctgcttttggctctcgagctgctgtttcagaagctggatctgctggtcgtactgggaagtcaacttttccagctgcaccttcgactcggcctccagggtctcctgtgcgctcttctggtttttctccatgagctcctcgcgttccttgagctcacgcgagaattcctcgtcacgcacctgttgcgcaatatgggcgtagtcgtccttatcgacctgaaagacgtgtccgcagtaggggcatctgatctctggcatagtagcctcctcaaataagattctcatacctctagcctaccgtagggaggctagagaaataccaaaaaggcgtgtcttacaggataccctgcaagacacgccttcaatcagttgtatggctgttagttctggtagtcgtagctattgaggctgccaaagccgtcaaacgggtttgagctgctactgccgttgtcgccaccctggccgaagccgaagatatcgtttccggagttgttctggttcttctgattctgggttgtcatcttcccctcatcggatcccaacgtgacggaaaccgtctgctcccgtccatttctcacgagcgtgatctgtaccgtgtcacccacattgtgcgagcggatcgcgaggatcaagccgtcggcagaggtgatctgctgatcgtctacggcggtgataatgtcacctcgctggatgcctgcggaatccgccgggctgccggaagtgacgttcaccacgtacgcaccgctcgtggtgccaagattatagcgctgggctgccgcagaggtcacagtctgcatcgtaaggccgatgtaggggtgcaccacggtctggccagagaggatcgtgtttgccacttgaatcgcgtagttggccgggattgcaaagccgatgccggcgttagagccgctctcggactcaatcagggtgttgataccgacaagctgcccctggtcgttgacgagcgcaccgccggagttgcccgggttgatagccgcatcggtctggatcaggttcgtgtagatcgtgttgccggaagtggattgcatcatcgttgaacggtacagtgcggagacgataccggtggagacggactgctcaaggccgtagggactgccgattgccatgacccactggcccataacgagctgagaggagtcgccgacctcgatcggggtgaccgaggctccctgcaggtccgcacggatcacggccagatcagaggactcatcggagcccaccacagaggcggtatagctcgtgccctcgatcgtcaccgagatggagcttgctccgtcaatcacatgatagttagtcaaaatgttgccgtcggtgtccagcatgacgccagagcctaagccggaggcattgtcgctggtcgcatagatcgagacgaccgacgggaccgccttggccgctacggcctcagccgttgaggtgtcttcggaattcggcgtgatcgtgatcgtctggttggagccggaatttccgctgttcacgcggatcgtgcggccgacgaatccacccaagcgcagaactaggaagagcgccagggcgccgactatgccgccacagatcgcaatcaggaccgggtggttacggtgtttctttggttcctttcccggtttcggatctggattctggtttgtgtccactaccggggatgggggtgtcaccgggctttgacgcgtcgcggcgtcgttcccgtccacacctgggacaggaggccgatccccattgtcaatttccatctggattcctttctcatagcgcacggaacttccatgcgcacatcgtcgtggccgccttgctttggttcatcatgtgaatattgttacccaatgaagctgaaagaagccggaatctaaaagtaaatcctgttttaacacgtcggtgatacaacacgttaagcttcctgaggtaccgtgttcccctcctgctacctgcacgttcagggagatttcagttcagggtagtgcgggtaaccgcagacaccgtgcacacctatctctataaaaagagcatccctgccgccagagatgcccgaactcgcctacatcttaaacagatagccgacgccacgcaccgtcacgatatggtttgcgatctgcggtcccaccttcgagcgcacacgacggatgtggacatcgacggtacgggtaccgccacagtactcaaagccccacacccgatgcagcaaggtctcccttgagtacgcacgcgaggggtgcgtcaccaggaaggagagcagggagtattccatcagtgtcagatcaaccggcttatcgtcgatatagacctgatacgttgcgaggttgatcgtcatattgtcaaccgacacaatatccgccggtccactttcctcgttgggccacagcaggcgggaacatctgagctcatactccgcttcgttggcggttgcgagggtgaagtcacactttccctgtaccgggagatggagggagttaatcttatccgcatcggtgacaaagagctcaggtatgaacccattgtccacgacataggtgtcaatagcgttgaaatcgtcctgtttcaggccgacgacatcgatgatcagcaggtcaaactcgtggcctgacttaatcgcctcatcaaacgtttcaggcgttgcaagcaatatggagacatcgagctcacgctgcagggcacgcatgcgctcgtgggtacgaggggtctgcgctatgaggagtatgttcttgtggtgcatagaactccccaatccaaaagagaaatgaacttttaaaaatactctagttcagattagcacacatctttcaaagaaaagagacaagatccccatttgattgaaggttacgcagatcgtactacaccccccagagataccctctggggggtgtgacagagatgccgaccaattctctctatgccttgcttagatgacctggccgaaccacttggcctcaaggtcatcgtgtgttccgtcgtcctgaatctgctgcaaggcgtcgttgagcgcattgaggagcgcctggttatccttggagaccgcgatcccgtactggtcccctgtggggatctgcaggctcacatacagatcgtcgtaggagttcgagcacaggtagctcacgaccggcagatccgcaatcgccgcggtatagaggcctgaggagacgccggtcagggcctgcaccgggtcatcgagcgccacgatcgacgcttggttgaggttctcctgcgcccacgcttccccggtggtgcccgcctgggctgcgatcttgttgtcagcgacattgagctgttcgcgggttacctcaccggcgctcttgggagtcacgatccccaggtttgcatcgatatagggatctgagaaattgaccagctgcttgcgctcatcggtgatcgtgatgtttgcgacgcctacatccgctttgccgcccgcctgaatcgcaggaatgatcgtgtcgaatttggtcggcgggagccaggtggattccagtcccatcctgtccgcaatcgccgccatcagatccacctcaaaccctacgggttcgttggtgtccgtagaaagtgagctgaagggtgggttggccatatcggagacgcaggtcagcttcccctcttcgaccagatgcagatcggaagggtcacaggattgatcggcgccttggggctggttattgtcgctagaacaagccgcaagggtagccgctgctagccctcctgtgcccataagaaagctttttcgggagatgtttggtgacgccatagttgcgcttccattcttgcctaagtgtgccagacatatctatttgatattgccgaggaacgaggcagtccgctcgttttgaggatggtcgaaaacattctcgggaagcccctgctcgacgacgacgccgccttccataaaggccacacggtcagcgacctcacgggcaaagcccatctcatgcgttaccacgaccatcgtcatcttcgaattctcagcgaggtcacggataacgtcgaggacgccgcggaccagctcaggatcaagggcgctcgtcggctcatcgaacagcaggacttctgggtgcatcgccacggcgcgcgcgattgcgacacgctgctgctgtccgccggaaagctgcgccggcttgaagtcagcacggtctgccagccctacagcatccaactgtttcaatgcctccttttcagcctctttcttcgatttcttcagcactttgactggcgcaagcatcacgttctctttcgcggtcagatgggggaagaggttgaagttctgaaagaccatccccaagtgttgccgtagtttcaccacatcggtctcatcggtgccggtaatctcgttgtcattgatcaagatgtggcccgcggtcggtacctccaagaggttgatgcaacgcagcatcgtggatttgccggagccggagggccccaagaccacgaccacctcgcctggccacacattgagattcacgtcgcgcaagaccggaaccacgccgtcgaaggtcttgttgaggtgctcgatgcggatgatcggatgctcaccttcagtgaactcatgccgggtcagagacttatcatgctcatagccctccttggctgccacatcggcggaaagcgcatcaggtaccgccgcgatcgtcgcagttgctgctctatgtctaggcatagatgccaccttcttcgtggatcggatgcgagcggaacggacccgtcagcgtagcgaggacgtctgcacctgagagcttgccctctgcgtgggaagcgacaaactccagcttggtgtccttctcagcggttgcagtactcgtcgtagcacccttcttacccgcattcggacgggggccgtcaccgttctcggcgcgcgccaagttgcgctcgatgataccgacaaccttgatcagtggcagtgtcacgatcaggtagtagattgcagccgccatgtacggcgtcatgttgccggtcacagtcgtcaggttcttggagtacatcatgagctccatcacgccgacagaggacagaagcgaggtgtccttgtaggcggtgatgaagtcggaagtgacggtcggcagcactctgcggatcgtctgcggcagaatgacgctcatcatggtctgtgaatggctcatgccgagggaggctgatgcctcatactgccccttcgggatggactggatgccggcgcggaagatctctgccaggtaggcggaggagttcacagccattgcgatcccgccgagcaggtagttgttcacgttgatgctcagcatcggcagaccgaagaagaggatgtagatctgaaggaacagcggcgtaccacgcaggatattgatgtagatgactgcgatcgcacgcacgaccttgtactttgagagcttcataaatgcgaaaagcatgcctagaagcagcgcgaacgggtagcacaacaccgtcaacagcaggcagacgatccacccattgaacagggaggaaaacgatgtcagcaagagctgggggcgcaggaacatgttcaggaacggcacggagttccaggcctgcacccaagcctgtccgttcaggaaggtcactgcagactgcagcggcgtattcgcgatcgttgagatcgtcggagacgcctgcaggtcctgggtaccctgatcggtctcgtaggtaccggtgatctggacgtcgccgccgtcgctcgggaacttcatgccctcgatctcgaggcgcaggagtgatcccgaggggattggattatcaaagctgatgttgatagagctgcccgaaggcgtcgcggttgcactgaccgggatacgggtcagcccatccaacacggtcacgcgtgtggtggaaccctcaaaggtgccatcgctcggcagcgtcaaggttacctcgcagacctcttccccgtcgtctacggtgccttcccaggtcaggcgagttgcgatgccaccgattacggatgagccgccatcctcattcggacgtgcggttgcgtttgagactgtgatcgcctccgcctgcgttggtgtaatgaccacgctcaggcctaggagtgccacgcacaccgccagcagcgccataaaaaacacaggtctcctatgcgttggtgtcatactcttcgacttcatcgttgtcttaagtactcctcaatcgaagaaggctccgcattcggtgccttccaaacactatcgtgcagccttggtttcatgagatcgtggtaccgaaccacttgatctgcaggtcatccatcgtgccatcgtctttgacctcctggagcgcctggttgagggccttggtcaggttcgggttatccttgctgacgccgatgcccatctgctcacccgtggggatctgctgtgcgatcacgaggtcagtgtaggaatttgagaccatgtttgaggcgaccggcagatcgatcaccgccgcatcgtactgtcccgtctgtacaccggtcaggcactggatgtagtcatcgagcggcacatactgcgcatttgacaggttctcctgtgcccagtcaccgccggtggtgccagactgtgcgcagacgcgtttgccatccgcattcagatcgtcgatcgtcgtgccggatgctgtgcctggcaccacgatcgcctggttggaatcgaggtaggggtccgtaaagtcgatctcctgctcacgctgatcggtgatcgtcatgcccgtgatacagcagtcggctttgccgcctgccttgatgagcggcacgatcgtatcgaactgctgggacgggagccactcggactcgaggcccatcttgtcaaccagggcagaagctaagtcagggtcaaagccctggatctcaccggtgtttttgtccatggattcaaagggtgggaatgtggcgttgcagacgcaggtcagcttgccgtcattgaccagggtataggagccatcgtccgcagcctgctgctggtctgagttggactgcccgcagccggcgagcgcagaggcgccgacaacgccaacgccgagcatacctgagactttgaggaaatttctacgggaaatattgtagataggagtcatcgtctgaccttccttttatagcgacgtgtacgtgggagaaagcctatcccgagcatatcttttgctcattgtttagagtgttgtaacgctaaattagataaaacaaaatgtttgaggcccgttctttaaccgttttgtcatgttttgaactcaatatttggccaagccatactctacattattgcgtgaaatatgcctcaatagtcatttttgcgcatattagtacagaaaaacaatgaaacgttcgggtagcggtatacccgttttcgcctcaaggttgtcactcatacatcactgtaaaaccactgtttacacatacggggcagctctgcgtccgccccgtttctgtctctctgcgcagttaatccccgctaaaaaccggcgtagtagtgcttgcgctcccagtcggttaccgtggtgttgtagtcgtcccactctttgcgcttgctggagaccaggtagtcgcagatgtggtcgccgagcacctcgtggcagaactctgactgctcaaagaactcgatcgcctcacgcagatcatgcggcaggcgtctgacacccttcttcgcgagttcagcctctgaggcgtagatatcctcggtcgtggcttcgctttggagcttcatctccccctcgatgcctttgacgcccgcagcaaaggtgagtgccaatacaagataggggttgcaggtgggatcaggtcccctgagctcaactcgtgtggactgatgcttgcccggcttgtgcatcggcacccgtacgagcgcggagcggttccggtgtccccaggtggtgtagcagggcacctcagagttggggcgcaaccgcttgtaggagttgaccgtcgggttcgtaatcagcgtgcactccggcgcatagtgtaggatacccgcgataaagtggttggcaagctcggagaggtgatccggatacttggagctcggaccccagaagaggttgttcccgcccttgtccatcagggactcgtagaagaacatcgcggagccttcagtatcggagaacggtttcggcatgaacgacgcaaagaagccgttggcaaaagcttcctgcttgatgacaaggcgggcagtcatgatgttgtccgcacagcccaaggcctccgagtaacgcagctcaatgccgttctgtgagggagcctgggcatggaaggagtactccacagggatagacatccgctcgagcatgagggtggtatcgcgtctcaggtcatgggcagagtcccacggtgtcagatcgaagtagctcgcctgatcggagagcaccggatcctgcgaatccttgaaatagaagtactcgatgcgaggtgcggcgaaaggcacatagcccttagcgtcaagactgttgaccacacggttcagtacctcacgcggatcgccctcgaaggactttctatctggggtcctgacggaacagaacatcctggcggcgccgttttctgactgtctccatggcagcacctggaaggtatccggctccggaaaagcgagcatatcggattcctcgagcgccgcaaacccgtcgacggcagagccgtcaaaaccgacgccctccccaaaggcctcctcgaggtcttccggtgagatcgcaaaggacttgaggtttcccgacacatcacagaaccataggcgaacaaagcgaatattgcgctcttcgacggtgcgcaaaacaaagtcgatatctttctggctcggcatttgtttccctctcgacacttaggcagccgcacgtgatacacgcgcggctgccttctatacttttttatccggtttcacttttgcatacccgtgtttcatgcgtgtttcaaaacatcgacgccttcgcgactgagagaaaccgcaggattgcacaccattcacacgccgttcacctaccgttcgcgggtacgcttttgacccagcttgttgcaactcggtcgcggtatcgcatacggaaacccaccggtcacgcggacttgtgctgcgtggtctcaccggcccccttagccttcagtgcatcctcgacgtctgaaaccatggttttagcgaccggacactcaccgcccgtatacgcagcggtgcaggtacctgacgcagcgcaaccgtcacagcccttttttgcgttttttacagaggaacggatggcgaaaataaatgccaaaccaactgcggctatgattacaatatctagtgcgttcatagaggagacctcctctggttcgaccttgaagtgttattgttaacctatggttactatacccttcttggctatcatgtaagagacgctccatgcgtcttttacaaaattatataggttagtcacggcaaacgaaacggaagggaaagctatggcagacgatcagaacatgcacctcgttattattcgtcacggtgagtctgagtggaacaagctcaacctcttcaccgggtggactgatgtcgacctgacagagacaggccgtcaagaggcagctgccggaggcaaagcactgaaggaccaaggctatgatttcgacgtatgctacacgtccttactgaagcgcgcgattcacacgctgaacatcgtcctcgatgagatggaccgcaactggttgcctgtctacaagacctggcgcctcaacgagcgtcactacggcgcactccagggcctcaacaaggccaaggccgctgaggagcacggtgagaagcaggttttgatttggcgccgttccttcgacgtccagccgcctgcactggagccgggcgatgagcgcgacccgcacatccagccgatgttccgcgacgtcccgaaagaggacctgccctacaccgagtgcttgaaggacaccatcgcccgtgcatggccgtacttcgagcagaccatcaagccgcaacttgaggccggcaagcgcgttctgatcgccgcacacggcaacagcctgcgcgccctcgtaatgcagctcgagcacctcaccccggatcagatccttaaggtcaacatcccgaccggcgttccgtgctcctatacctttgataaggactggaacatcaccgacaagcactacatcggcgatcctgagaccattgagaagaagatccaggctgtcgcgaaccagggcaaggccaagaaataaggcttagtacctgataggccgggggctcgcgtctccggccgctttattgccgctagtcgcgatccttcgcagacagaatctcgatgtgctgcccatccggctccacgatgaagtacagccccatcttcgaattctctttctgagtgcaccccatcttcatatagcgttcgtggtaagcgtcaatatcatccacctcaaggcggtgtgggtgtcattgccgccgttgtcatacggctcagccctccacggttccaggtcagctccagctcatatggggagatgccgttttccataaaagtattggtccagggtccgtcggccggaccggattcccgcaccacatgaaatcccagcgcttcctgacaaaacgcaatctaacagcctagataccaggtgatagtgtacctacgtcgagctgcggaggcttgtgtcggccatcatcatatggcgaaccactcttgcagcttcaggccaccggccacgagcttgattgacccaaaagagctcggcctaccagttgaggtagcttttgtatgctgaccatcgacatatctgtgaagcgccagattca

SEQ ID NO: 311 - DNA, 17684 bp, Unknown
  Metagenome-assembled genome
gggctcttcaacaggcgggccggcagcagcgccaaaaaagcgccaatgcgggcacaaactcgactcggtcgagtatatcgtgatgagccacgatgcgcggctccgccgagaatcagagcaagccacatagccaaggttctgagggcatacatataaaggaaacaaacgcccgctaagggattgcccgtcgattcttgattgcgggctgttttgcctttatgcgaactccggtggaggatgcgggagaccgcgctcaaagtgtgtcccatgttgtagggcgggtggatccgaatgttggcatttgtgcggggggtgggggccgggctgcgatgagggagaagggaccaggttttgtctgagttggttggtcaggcatgattgcggagggcaactgtcccatcggcgtttcgcatcaggatacgttctcctgcccacacagaagcccaaccgaggcgagtctcgcttcgagcaggatgttctccacagccaggctccatgtcctgtggagacatctccggcattggtaggttggaggtcttattacaggtgattggacgattacgagggagcacgcccgcagggtttgcgccgtagggggagctgttggcgagcaaggctctgcgatcagggtctctgacaacccaaaactcccacggcttgtggtttattgcggatggggcggccattccctgcagcgaggaatccctcacgctgattccgacacatcctcgtcggtataatttcgcacgcttgtgcgcgcaaaaaaaatgattgttttgtcgctgtccccatcttgagaagctcctttgtcaattatagtgaatttattgtattccaccggagataaaagatacacaatatcgattttcttaccgggagtttctcagggttgaagtgtattataggaggatgggatgacccttcagcagcttcgctagtgatcgagattgctaggtcggtttcatgtggcgtgtggcggcccatctctattggtgcagccttcactttctaagcagtggctgagctggaagcagagatgggtactacgatctttgaacgctcccagcgcagcgtcaccctgatgaagaggggactcggtttctccctatgcccggcaggtggtggagctcgtggacctgttggagagacagtaccagcctggggcaaagctgctgtgtcgggtctttgcagtgtctgcacagcactacgcctttgtcgtgaatacctttgtagttctggtcaaagagtactgacattcccgcctcgaattcccctaccaactgcaacgtctgaaagtgaaagacttcccagggtgtcttgttagcgaggcatctggtgtggtcttaggttggtagcattcgtatagagctgtctgacttcagataaggtggcatcaggaaagcttgtacatgttgggaggtactcttagatagggccatagctgtctttcaatgctcactttttgctacaggtgataaggcagacagaagagaaacttagcttccagtgtctgtgtgacatctctgtgctgtgtagacccttttgtctttctttggtgtgctggtcttgacaggacaaccagatacagcaagctttcctgtcttagctacagcttgtgctgtatgtgcctgtgcaagaggtagcgcttaggtatcttgtgcttcctgccgacaagtgtaaggccccttatctttcccacagtgctgtctgccttctcagtctttgatccttaaagcgctcatctgccttatcgggtctgtcagcgacatcgtggggaacttgatacgtacaaggccaagctatctttaagtgtgcgatcactgatagctctgcagagcgtggcacaggctacaggagatgatcccttctttagtgtgggtcttcctgtgatctgttgtggtgatagctgacagttgacaggcttgtcctgtacacaggcatagaggctctttgagacttcactgcctgtgcctgttgcagtgcccctgtacaacagatgcctctgtatcgtatatcggatacttcctggttgcatgagtttgctgcagacttacaagctatggtcgacttgttgcaatgtagctttctgacaatcttgggatgtgtctttgccttcagtgtgggaaagcaggacatcttctcgcttctctaagctaagatgatagtagcagcccagggtagcctcctttgattgttttttcgcggataccatcgcattgcgagaaggcatctctttctcttagcacaccatccgctgacacagcgggaaagtatcatcctggaggacttggctttctatccccgattcatctacgatcagggcatcaagaactccttctcctttgcggaggagcctcatgtgactgagccggtcgagaaggcgatcatcgtgagcgaccgggcaagcctcttcaatctgctgatcgggctctctgattacgcgatctcctcggggattctgagcgtagatctaaatggggaaaatattgtagcggtgccgtttatcccgggcgggaccacggagatcagctacatccaccaggcgtatctgtctttgacgccgttagcgcagcgctaccgtgcaatgctcaggccctacattgacttttatttctctgagcatgatatcggtggcgaggcgatcgaacagtagtgttgcaacctgttttcgcttttcggcgtgtataccgctttgaggatgcagtaacctacaacaggtatatccaatgttgcgttttggaagaagggatcacttatgccactcagcctcaatcacagtctttcggcgcttgaaccctctgagatccgggtgttcaacaggatggcggcacagacgccagggtgtatcgcattgaccttgggagagccgggtgaaacgacccctgagccgattcgagctgaggtcacatgctctttgcaggagggaaagacccactacccacccaacaatgggacgcaggagctcaaagaagcgatcagcaagtatatggcggatgagagaattggttatgacccggatcagatcattgtgacttcaggcgctactgaagcctgttttgcggcgctcatgacgatcgtaaatccaggggacgaggtgatcgtaccggtcccgaacttcttactctacggtgccatcaccacgatcgcccggggaaagttcgtatccctcgataccgctccggaccatttccagatcgataaagagagattggaggcaacgatcaccccgcgcactaaggcgtttgtcttagcatcgccgaccaatccgacgggctgcatcctgagtaaggagagcctcgccgcgattgcagaggctgccgaagcgcatgacttctacgtgttggtggatagcgtgtatgagaagctggtctacaccgatgagtatatgagcttcgcagcagcctaccctcagctcaaagaccgcacgattgtggtgaacagcttctccaaaccctatgcgatgaccggatggaggctgggatggcttgcggcgcctaaggagctgatgggtccgctctcgatggtccacatgtacacaatctcttcagtggtctctttcacgcaggatgccgccgtgaaagcgttagccagcgatgtggagccgttccggcagagctatcagaagcgtcgggatattgtgatcaaggccctcaaagagatggggcttgaggtcaccgttccagaaggggctttctatgcctttccctcaatcaaaggtttgtgcgacgaagagggtaagcagctgagtgcccgggagttctgcatgcggggcataaaagaagtcggggttgccctcgtccccggaaattgcttcggggcagaaggcttcgtccggctgagttacgcgactgacgaggataccttacgtgaaggcctcaagcgtcttgccacttttgtgaaaaagctgcgcccctaaggaatgcggatcagtttctcgtaggtatgcaaaccgacgagcaggatctcctcgtcgaagttgaaggtcgatgaatgtagcgggatgtgggtgcccgtccccaggagcaggaagacgcccgggagcaccttctgataccaggcgaagtcgtcggagatcaaaagtggcttgtcgatggcatgcaactcgtcgccgagcgccgtcttggtctgcttaaagagggcaggatcattgaggaccgggggatacccctcgttgaagtaggtctcctgagtgcacccctgaatctgtgcgacattctccgcgatagcagggacctgctgtctgatccgcccatccatctcgtttgagaaggtccgtaggctgccttcgagtacagcccgtccggcgatctggtttctcacttctccggcctgcatgtggccaaacttgagcaggcagggttcctgtgtggcgcatcgattgaggtaggcggcgcagtcgttgtagaacatggcagcgctcgccagggcgtcacagccctgctctgactttgcgatatgggaggcttttcctatgaaggtgaccgtagtttcgtgggaggctgctaagagcgctcccgggcgtgaggcgagcattcccttagggagatcgggccacaggtgaaatccgaagatccggtcgacatgcagatcgtcgaagatcttggactgtacgatgttcttggcgccgccggtggtctcctccgcaggctcaaagacaaggagcactgagcgggggagttcatcggcgtgctccgctacgtggtgtgccaacccgatgagcatcgccatgtgcccgtcgtggccacaggcgtgcatgcgtcctgtgtgttttgaggcaaaggggaggtcggtctcctcggctaccgggagcgcgtccatatcggagcgcagggctgtggtatgttctgagcctcggtcgacaaagaggcacagtgccgatttacagggttttaagatctgagctttttgtccgttgtcgtggagggtgtcgatgacctcagcgagctcatgttccacataggcgatcgtctcagggagatcgaagtcggtctcgggtatttgatgcaggtcgcgccgccagcggcgcaggtctgctacagttggttctgtcataggtacagcccgcccttcgtgttgaaataaacggttctatcctttcattatagggtggagaagtgctgctcaacgttttccccatgcatcaaatctgttacggatctgtggagccttgtgccatactttcgtataatggctacgttctgtgcaaacgcgacaacggatggagggctacatgacagccatcagacggccattttgcacgaaagagcagctggagacgatcgcaaagaagtatccgacacccttttatctctacgacgagaaggggatcagggatactgcgctcaaagtcaaagccgcattctcctggaacaaaggattcaaagagtattttgccgtgaaggcgaccccgaatcccataatcctcgcgatcatgcgcgaatacggctttgggtttgactgctccagtgaagcggagctcatgctgatggaagcgatgggtgtccccggcgaggatatcatgttcagttccaacgataccgctgccgcagactttgcctatgcgcatcggctgtacgcccagatcaatctcgacgatatcacccatatcaagactttggagtcggtgatcgacaagcttccggacttcatcagtctgcgcttcaacccgggtggggccttcaaattcgccaatgggatcttcggaagtccccaggatgcaaaattcggtttcaccgaggatcaggttatcgaggcagtccgctacttgcagagcaagggggtcaagcactttggactccatgcgctacttgcctcggcaacgctcagcgatgactactatccgacggtagcgaagttcctgtgccggctggcggtgagactcaaacaggagctcagcgccgatgtgaccctgatcaacctctccggcggcgtgggtattccctataagcctactgatcccgccaacaacatcgaggtgatcggcgagaaagtacatcaggtcttcgatgagatcttgaaacctgctgggatgcaggatgttgcgctcgcgaccgagatgggccgcttcatgttagggccttacggcgcactcgtgacccgcgttatcaacctgaagcacacctacgacgactatgtgggcgtcgatgcctgtgcggcagacctgatgcgcccgatgctctacggcgcctaccactacattacggtgataggaaaagaggatgaacctaaaaaccacacctactcggtgacgggtgggctctgcgaaaactcagataggtttgcgacgcatcgaccactacctgaggttgagatcggtgatcttcttttcattcacgactgcggcgcccacgggcatgcgatgggctataactacaacggtaagctgcgttcggcggagatccttctgcgggaagacggcagcacgatgctcatgcgtcggcgtgagacaccgatggactactttgtaacgcttgactgcctgccgatctacaggagactacaggcgatctacgacagaaaactcgaaaggggagaacactgaccatgcgtgaagaaatggatgctcagcacattatcgactacatcgcgacggctccgaagaagactccggtgaaactctttttgaatctgaaggaaggttccaagatcgactggggagacgcccatgtcttcggcgacgggccttcgcacatcgtcttcggggattggtctgagctgcagccgatcctggcggcgcacgaggatgagatccaagacctcgagatcgagaatgaccgccggaactccggtgtcacgctgcttgacctgaagaacatcaatgcccgtattgagccgggcgccattatccgcgagaaggtctccattggagacaacgcggtcattatgatgggtgccgtgatcaacatcggcgccgtgatcggtgagggcacgatgatcgatatgggcgccgtcctcggcggccgcgcgatcgtaggcaaacactgccacatcggggcgggcaccgtcctcgcaggtgtcgtggagcccgcaagcgccaagccggtcacgatcgacgacgatgtgatgatcggcgctaacgcggtcgtgatcgaaggcgtccacgtgggcaaaggcgcggtcgtggctgccggcgccgtcgtaatctccgatgtgccggagaatgctgtcgtagccggatgccctgcaaaggttgtcaagatgaaggatgccgaaaccgagagcaagacggctctgattgacgccctgcgcaatctgtaaggtgcttgcttcctgtcgagctcaggatagatgaactcgacagggacaggtgccaacagacatacaaaaagtgacggcccccacacctgaggtgtgagggccgttgcctgaatgcccttgttctgaacctgagccggttaattcgtgctgctcattgttgagtttgaggaaccactcccggttgaggaggaagtgttgttgcccttgttcgaagagccgttgccattctgtgaaccggaggttgaagaaccggtgccactggtgcccgtggaggagctggaactgctctgtcctgaggtgttggagccggtgtttccactcgttgtagagctgctgttcgatccggtgctactctgggagctgccgcttgtgctgttcggggtagagccactcttgttggttgtggcacccgtggagctgcttgagccggtgttgcccgatgccgtgttgtcggtactggacgtcgtgccactggtggtatcactggtcgtgcccgtgtcagtgccggttgtgttctcctggtcggctgcggatgcgttctcattggcggtctcgtcgttggtgtcgttctcatccgcacggtttcttctgtcagctgtctgattgccggtatccttgttgaggccagagccggtggtctcctcctgcggtgcgggattgaggatcgcggtcttctggcctaagccttcaccggcggtgacggtgttgataatgacagccgtgatgataaccgcgacgacagccgcgatcgtcgtgacgatcgcgatattgcgcttcgtcttactctggcgctgtttctccttgttcaggagtttcttggaagcgatgcgggtgccgtccgggccgatctcgtagttgtcgagttcggaggaatccatcacgccttggacttgctcattgccgtggttggagaggttctctttgatcttgcttgcggagcgggacaggatgttcttgtaaacgctcgtgacaatcgcagagataccggcgccgagaccgacaccgatgagtgagcctgcgataccgatacggccggagagcagggttgaggtgactgctgagagcccggttgccaggacctgggcgaaggagatatcggagaagatgcccttgtcttttttctcaggctgcgccgcaaccgcctggctgttgctgaccacctggtagggattggtctgcggctggtagtaaggattgtcggcgtcctgatagaaacgggtggtggcttgttttttgaaataggttgagtgctgctgtgtcgggacgcgctgggcgcgcctatctgtcatgccgggctcgacgaccgttcggtcagcctcgccttcggtggcaacgcgggcacgcttggccatgcccgggtcggctacggttttgtccacatcctctttgaagtgtgcggcatcatttctttgttcgggcgaaaagtactgcgtcttatcgctgtctgtcacaggagattcccccttgagtatgtatcagacgtatatatcggtgaaatcgaatcttacagtatagaagttaggtatggctctgatgtgtgtcgcagagattgatttttgatccttcacatctgtgtggaaatgctgaaagcaggcatatggaggcggaaggatcgctcggttgctctactcaattctacacattttaggcatctaacggcgcagagggccacgtttgccgaaaaaatctctattctgcctggttcagatagtgaaataatccggtaaaagtgtaatactcagctgagtacgtgcttgtcaaaaccgtcagacggaggttttaagatgctcgttaatgcaacacacatgcttcagtcagctgagaagggccactatggtctgggtgcgttcaacaccaacaaccttgagtgggctcaggcaatccttacggcagctgaagaggagcagtcaccgctgattgttcagtgctccatgggcgctgcaaagtatcagggtggctacaacgtcgtttacaacattgtcaataccctcgttaagaacatgaacatcacggtaccggtagccctacaccttgaccacggcaactatgaggcatgcttcgaggctatggacgcaggcttcacctcgatcatgtatgatggctctcacgagaagagcttcgacatcaacgtcgagcacaccaaggagctcgtcggcatcgcccacaagaagggcatttccgtagaggctgaggtcggcggtatcggcggcaccgaggacggcgtcaccggcatgggcgagatcgcagacccgaaagagtgcaagaccatcgctgatctcggcgttgacttcctcgcctgtggcatcggtaatatccacggcctgtatccgaagaactggaagggcctgcagtttgatgtcctcggcaacatcaagaaggaagttggagacctcccgcttgtccttcatggcggcaccggcattcctgttgaccaggtcaagagggcaatttcccttggtatctccaagatcaacgtcaacaccgacctgcaggttgtcttctccgcagcaaccaagaagtactatgaggagaagaaggacgagctcgagaagggctacgatcctcgtaaggtcttaaagccgggaaaagaggctatcgttgcccgcaccaaggagcttatggaagagttcggctccgtcggcaaaggctgggagtagtcactaataactacctatagtctgagctaggttgtgtcctccgtttccgtaaggaagtgggggacactgcattgtaacgggcgtttgtgcgttgtgtcctgctcattgacagcatgcgtaccctttggtatccctgaaagtgcactgagaggctggggtgccacgaacgtggctgagaaaacccatggaacctgatctggacaataccagcgcaagggagcttccatttggatgcaggcgttgctgagcgccgccgatgcattctgacagcccctcgaacaatagagggagtgatcaaacgtgcagaccatcgatcaacaaaaacgagggttcacgatccgtgaagtggtgttcctcgcgatcatcgcgatctttttcgggatcatctatcagctctggagctatgtctactatcttctagccgcaaccccgcttgagccctttgcaaacgatatcaccttgggtgtctgggttatggcaggcccgctggcggggatcctgctcaagcgccgtggcgtctcaattatcagtgagttcctggctgccgcagtcgagatgcttctcttctcgagttggggcgtcggcgacctgatcaacggagcagtccaaggtttgggctctgagctgggcttcgctacctgccgctacaggaactgggacaaagccggactcttctggggtgccctgtggacgacgatcatcactttcgcttgggacttgctgagaagtggttatgcggagtacggcgtaggcatgtgcattgccctctttatcatccgcttcgcctcaatcggcctcttctccggcgtgctggtctataagatcgccgaacttgtcaacaagacgggcttgcttgacaaatgacgctttcccttaaaacacaggatctgagttttcgctaccgcgacaccccgatcttttcccatcagaacttcgaggtgccgctgggcgaattctcagtcctgagcggcccttccggcagcggcaagtcgacgctgctgaagttgctcgccggcctctatccgcgctacggcggcaccatcacctccggtaacgtctatctggagggacaggtggccgggatctgtatgccttttgagcgtgctcagcgggtttcgatgctcttccagcatcccgcccggcaattcagtatgcgcacggtcgcacagcagatcgactttgcttgcgcgaacctgcaggtacctaaagaggaagttgcagagcgtcgacaggaggtcctgaagcgtctcaatttggagcacctggctcagcatattgtgaccaccctctccggtggtgagcagcagtgcgtggcgctcgcttgcgtgctcgcgatgcgctccaagatcatcctgctcgacgagcccttctccaatgtagacgtgcatggacgcgcctatattctgaaagtcttaaaagggctacagacacaggaaggcacgaccatatttttggctgaccacgagctggaaggctaccgggggattgcgactaagctcttttcgctttccggggaaacccacgagctcaccgagaagccgctcgacatgctgccggaggggaagtccggtgaggagcatagggttaccccgcatcccctgagaccggggttgttctcctggtctgatctcagctatggggcgggggagcggacccttgtgaaggacagccgcttcacccttcccaaagggcaggtcggacttttgtccggagacaacggggtgggaaagtctaccctgttcaaagtgctctcctgccaacatgactacacagggacgctcacctttgaggggcaggatgcccagaactttaagcccaaggagtgggccatgaaggtagggctgacctttcagtcgagtgaggatcagttcgtcacgctcacgatggaagacgagctttccctctctgcacagcactcgctgcagcctaagtattgggacaagaaacgcatcgccagcgccgttgaggaattaggtctcaccggacttgagagacatgtggtgtaccggctctcgggagggcagcagaagaagctgcagctcttgagcatgctgattatgggacagccgaccttgctggctgacgagccctttgcagggctcgacgccgcctcggtccgggtggtcctgaatctcctttgccagacggttgaggctctggagcccgcggtgctcgtggcctcccatcagcgtgcgcaggtcgcagaggcctgtgactacgagctcaggcttgaggatcaacacctgaatctgttgggggaggagcaatgagcaacaaccgcgtagaccgtctcacggaccgtatgggatcgggacagcagggctctgagctttggggactcaatgcctccgtcctctttgtgtcaatgctgggggtggggattctgatcggcttttcccagtcaatcatcctcaacctgattgtgatagccttcggattcatctacctcgcagcgatgcgtgcacgtctcaagaccgcgctgatcgcgctagcagtggcctttccgttggcgttgggtacctggtcctcattcatgttctttgcggtcaatcatgcgccgcacaccgcctggctctatgggacgcgtgtgtatgcctatctggcgttaggcatgatggtgacgatgacaaaaggggcagaggaggtcttaaccagcctccaccagcacctgcacctctccaatacctttgtgtttggcttgctcggctccttcaatctggtgaagagcatccacgaccagtacaagcggattatgtattccgcgatgctgcgcggggatgagtaccacctctggcagccgcggctctatctgcgcttcattatcaccgcgctcaactggtcgggggatttggcgcaggggatgacgtctgaggggttcagcgaaggggccccgcgcaccgagcttgttgaggacgtgtgccccatctggcagtgggtcttagcagttgtactcatcgcgctcttcgcggtgggcgctttcgtgatccggccctggtagggctcccaactctttacatatcggtgtcgttttgtgtcacactctcagatgcggagggaattgcagtggaggggttccacagcggcgcagagttcccaccggtgagctgcccgtggcaacagttgaggtcgttgacgatgcggttcacgaggttggagtctgaagcggaatcggtgcagacggcgatcacgtagggaccggtgtcggagaagacgatgccggcgtcgttcatcgtgggcgaagcgtcctctgtctcatcggagaaccaacctgccttcgaccagacttggtaggtgttgcccagcaccatatgcaggggtgagttcggagtcgttaagaagagctgtgagagttccttagcgtcgtcggtgcctgaggtgaggtagcggtaaccctgcttccaggcgaggacaaactcgcgggcggacatgtccgcgtaccagttgtagtcaaaggggatatcgtggctgtcggtgtcgatgccggcgtcggcgagccacgctgaccagccggactcctctgacatcgttctcaggcttgcatagtcgctgttggaggattggttgattacgttcttgacgaccggatacactgtatcgtggttgagcttgcctgtctccaccaagtcctgatagacaaagatactgtaggggcctttgatagcggaggcagagtagacacggtcttcgggttgataggtgattcggcttccgttctctttatcgatatcgtgtagatcgatcgagacagtgatgtcgttgtccctgcactgctgcagggcctcttccaggtcctcaagcgcggggctgccgtctaaggaggcctgcccggaataggcgataccggagtcggtcactgtctcttcgcttgaagtcccgtcctggttgtcccgctcctcttcagagattttttcctgatcttcactctgctcctgggcttcaccgggatcgccttcacctgaggcggtgacgagtgagtggatctgaactgtgagaacgactgcgagaatgatgacggcgatcgcgacaaacgcacgtagctgggccgcggtggtgtaccgtggagcggggacagtactgcgtttctgtgcttgtgcctgcagatgccaccgacggccccaggggtgcttcgaacttgtactgtgtgctggtcttttccaaggaggacgagcaatatgtctgtacggttgggggctggctggtcgcctggaacctgtgtgtctgtcttctgccaagaagcgctgccctcccaccatatagattgcatccagcgttatcgctctatatatagtacaccacgtatcatatgcaacattcttcctgaaagataagacattaacctcaaaagtgtggtgtcgggtgtgtatggaggcatgggtcctgtatataccgtttaccaatccgcttccattcagccgatgcgtggataaagtttttacccaacgtgctacgctttttaaaaggctcttcgctacttatggtgggtagcactcctgcatccccttgagcgtgggacgcccggatggaaggattttgccagcggaaggcttcggttctaaggtgcgatatggatgcttaaggtaaggcatgctggcaaggctctttaagagatcccagggggcttagggatgaatggaggtcacggacgtctggttcgagaagcgcagatgagcgcaggacgtactccctgtgagggtcgcacacatcagggccaggcagtggtgatccctgcctgccacaggcgctgcggcacctgtgacagacgggagaggaccttgtggcatcttaacatctggcaatacgagacgattgtacacggcgcagtgttgagtgcccctaaggacagcgtgcatgctgcaaggataccctgggggtccagccgaagacgcatcacggcactctttgaggcccagctgatcgtttgtcatgagcgttgtggccataagcctctgcacgagacagcccacgtgcatatggaggctgctcagcagagtcgtcgccgaggtgagggatgcagcagactattccggagtcgtgcgtgtgggtacaggcgacaccgctaaaagacgcaaccaaagctgcatcaacatcatggccgacctcgactaccagcgcgcccgcaccatcacggaaggcaaaggacaaaggtgacacaggcaggctttgagatgagcttaaggaacacacagggaccagacgaaggtcttagaggtcatacgcgacatggcaaagacataactccctaggagtcaccgcagcgatgccccaggccgcccagatcctggacagcttccatgtggtggcagctcttcacgagggcgacagaccctgtaaggtgcgcgaagaggcgcgcctgtcagatggcagaggcgatacaggacacctatggctgccctgacagaaaatctacagccaaggccccagaccggctctgcttgtagatgatgcactctgtcgtggctaagatgaagagggcggcaggtacccttaggaagagcatgagggaatcttgaactggcggaaggggagtttgaccaattcatttctcgaagggctcaactccctcgtccagtcagcagaaagtgctgctaggggcttcaggagcatcgcctacttcaaggcgatgatcttcctcagactgggaaactcaaattctcggcccagagacagctggcctgtactacccactagagacgtcgaagagccgaaaaacgggtggcacacgcaggcgtgccacccgaaaaagggggaagcggtatggcaaaggtaacgctgaaggatatagcgcgggcagtaggagtctctccgtctgtctttcggtctgtgactgcagcgtagctttcctggggttggtctgctggttgtaaggtactgcttcctgaggattgtgcgttctgattctcaagttcattcttcctgggaattgaggttagcctcaagctccggagatcgaatcaatctgcgctgttaaattcgactacccgcacctgtgtgccgcgtagtaacactgtcccgacgaaggtcacgagctttcggatccaaccaagtggaagaaggctcacggagccgtcctgtccttgtgttcgggagacgcgcttactggaggcgttcctgtgcccccaagctcactcgtgcttgtggacgatatcgttcattcagagaagtgcaatcttgctctgcgtatcgctcactgaattgcgtgacccttgactgttcctgggatgcagcgagcgatattcacatcttcgcattgcgtgtggtcgtcctcagctgctgctgtgcaagtgagcttgaaatccctcggctaaggcgtaaactgagactacccgaccctcaagggttcctacgccgaaggcatagtacagaagcaattgccaaatgcaactgttctttcataccggtcatagagtctctcttcagctagccatatttttattttgttaccctgaaactgctcctttgtccagccttgctatatactttttgtatgttactaccagtcctagattgatgacaactattgagtgataacaacccacattgcctgcgtccctctaaccgctaacatcaaatctcataagataacaaccacacatacaagagtaaatgctaaaacctgttagcctactaacacttgtacaccttatgacacatgacacttcactaacagatgctgggagcactacgcaactgcgaaccagacgcctgttttttggagacatagtttatgttactgaataggctttcctcgcccacactacgcagccgataattccctcgttgtcagggacatgagcagaagccggattgatgttctgacggaagtccgtgatctcccaacggggcttcagaacccgctggggtgatatccccctgcgccggacatccttgcccgcttacgcgcgccatcgatctccacgctttctcgagttctgcacatctggcgtcatcgaatcagggcccggctcaagatggagtcccgcacgctgttatcgtactaacgaccgagatgtccttcggtactgagacgccttcccatgatctcttttaaagccctaaggcaatattgtcggagctgggcaacacgttcggagaccccgctcttcacacatcagcgccgcgtaatagtgcatctggaatgaagtaatcagtctcgaagacgagtgagccctcgtatatgagtcatgttccttccgtggcacctgctagccgtatcagggggtcacggccggtagtcgattcaggtttgaggcattcgccgctatgtggatcgtgcccactgttcgcgatgtgtttgactgccatggaggcacccatctcattgtcgtagcgaccgaatcacatgcgagtccttcgataaaacggtcgaccattaactagggacgtggcagcttctctataggtatcgaccatctggtccgcctcggattcctctgaggcacaaaacgaacccgtcaactccgcggctgtacgagaagcgccaactctgctcgtttttagcggtgcctcagagttctgagcagaacatatagccctgcttgcggcaacaaggtctccaatttgtgcgctaagtgaagtcgaagaaacgctgctcgatgtttggaatcacaaccgaagctggtgggacactgagagacccaggctccgggcaatctggttgtcggcacatagcgcttctgcaccgccacgctctttgatcttctgttcgggtctgcaaccgtttggcgtcccgtacagggtcctgccattaaagcaccaacgaaccgtctgtaa

SEQ ID NO: 312 - DNA, 13668 bp, Unknown
  Metagenome-assembled genome
tggcaagcgaggtttacttcactgcggactggagcattgcacggacttgttggaagtctcaagctgcaataaccttctcagcagtgcgtcaagcctctttcttagtccactgagcgatgtctacgcgttctcaggatgagcccgcggagacagagaaaattaatgaggcgaggagatcagagcactggtaccatcaagcgggttcagctgcaacctcaccggacacataccgaccctaattggccggcctattgcctcacgagaggatacgagttgagcgataacgccaaagcggatgaataggagagcacctcgcattaacagcggggcgctctctttgtattaagtagagggagacaatagtcgaagagaatcctgtatgcctatacaataattgtgaagaggggtgacctgtgtcaatatttcggacggcagattagcattctgagtgcaacaggatagcccactgcatgcaggcgtggtgcactctggaaggctacgatgttggttgtctcaatcaacgttggaagccggaaggaatgtgccactacaagtatcgtaagcccacaggagagggactgcatagccatgctgcgtggtacaagggaagctccatcggctgcatcgcacgcaagatcggcagggacaggtcaggcgagtccgagatcgccgcagccggcacgctcttctcctatctcgccgagcagaagaggcagaagacagtggacacgctgctgcgcctcagcaggctgccatcgagggagccgaagacgtttgagggctttgacttcacaaggatacagagacgcgatgcgcagacactcagaaagctccctgcgctcgtcgatctttatcgcacaggaacatcgccttcataggcccgagggcatcggcaagacacacctcgcgcaggcatatgggcgcgaatgctgcatgaaggggctgaagacctactgtctcaaggcaagcgagctgcgcgacaggctctccggggcagccgggcgcgggtccgtccagcgcgaggtggcggccctcgtcaagccgtcgtgcctcatcgtggacgagattggcaggtgcacattcgacagggcatgcactgacatgttcttcgacatcgtcgagcgccgctacgagaaggatggtccgagcacgatgatactcaccagcaacatgtccccgagcgactggaagggctcattcacgggcgaggatgcgctgctgtgcgccctcgaccggctcttcgacgatgcctcggtcttcatgatgcggggccccagctacaggggatacgggctcgacacctactttgtggaggcagtaccccaggcagtgaggcagaggggctccggcacgatggggctctagcgcagaggcttcgaggccccttgcgcagtcatagatagcatttccggatgccggcacattggcgaatatcgtccggctggaaacggccagaatcgcccggcgctagggaaacgatgattaatgccccataacgtgtcagaggggaccgaccacacggcctttctaggccggtatgcgggaaaggcagggaaggatgctcattcagcatgtacaggagccgctatccttacatctgtcctgccccatgcaccgcaagaaggctccaagacggatcaagcgacgctgggagccgggaggtgcagcctgccggcaaaagatgcacatgggtaaggtttgcaagggcgagagagacttgagcatacaggagttcttctctatccccctgtagcgtgtccttacgtgtttgaagtgccgcttcacgataaggaagggatgctctacctttgagcggatggaggccttcctggactcgatgcccttttcggctgagagtgcacagttaaggccctttatggtcgaaggtttccttgcgacactccagcgcatagatgagaggtgtgggtcttatgtgaccttaagggcgcttcgctataccggtatagcctaaagtctgcatagcagaacctgtcatcttcccttacgagtgcatgtgcctgggatatgtcagatacattctaggcgatcgtctctacagcatgcacaaggccgctgcccgcatccacgccgatatgcgccttgtatccgaaatgccagttcttccctttcttggactggtgcgctttaagggtcgcgcgcatggtccttgttcttcgtggagcttaagagcctcgatgaaggtcgcgtccacaatagagccaccccgcgccatgatccctgccttctcgagctccgaattcaggtcgtgaagcatagctttaccgagtccccgccgctcgaggctatgacggaatttcgcaagtgtcgttgcatctggcacctgctcagacatgaggtccaagtgcatgaagcgctgccaggaccgggaatccaggatagcatctttaagttccctcgtcttgagagcccaaacatgacctgcagcagatacatcctaagcatcgtctccgcaccgcgcacatgcctgccacgcgcctgagaatggtagctgggttctaccagtgcaatccagctatcccatggcacgatcgcatccatccgcttcaggaatgcctctcgccgagtcttcttcctaagaccttaggatttaaggtccccgaagctcatctggctatccatatctgccttttggatatgcagggatacgtggatgtagctataccatatccagaagacagataggcatttatgtgggtatgggtactgcgtgattcgagacattttaagccgatgtcatacagcgtacagccccagcgacctcatcgagccgaattaatcatcgtttccctaggtggcgattatctcccggcgttaacaacgcctatgagcagaagagaactcatgggttataggtgctacttcataaacttatgtcatgtttatcagtagctcgtggatccgcgtgtcttcatcgagttccggatggaaggagacgccgatttgattgccgtcacggaccgctacgatgtgattgttgacgcggacgagaacccttgctgttctatacacttcagtgatgaaaggtgcccgaatgaacgtcagcggtatctcatcattctttccatccttggagggtaaccctgcacagggtgccgtggtgtggaagcttcccaactggcgaccataggcgttgcgcctgacggttacagggagggtagcgagcgccccgggagcggtggctcccgatgtcacatgttcgctgtctccgggcaccggtatgccttcctccacgttctcagccaacaggatgagtcctgcgcaggtgccgagcactggcagaccttcctgtatgcgggaacgcaatgtgtcgagcattccgagctcacgcaacagtttcgattgtacggtgctttcaccaccgggcagcaccaaaaggtcgaacggttgattgagatcggcagcctgacggagttcgatgtaggcacagccgaggcgctctagcatatgctcgtgctcgataaaggctccctgcactgcaagtactgcggcggtcttttgccgctgtgccatggttatttccctcgttctgccatgagcagatcgatctcatctgcattgataccgaccatagcttctcccagatcctcagagagtttggcaataagctttgcgtcggcgtagtttgccgttgctttgacgatcgcctgggcacgcttggcgggattgcctgacttgaagatacctgagcctacaaaaacaccctcggctcccagctgcatcatcagggctgcatcagccggggtagcgatgccaccggcagcaaagttgaccactgggagccttccatgatcgtgtacgtagagcactaagtcatagggtgcctgtaatcgtttggcagcttcaaagagctcatcggtccgtaagctctgcactcttctgatctctgcgttcatggtgcgcatgtggtgcaccgcctgcactacatcaccggtacccggctctcctttggtgcggatcatcgtggcgccttccgcaatacggcgtagggcttctcctaagttccgtgctccacagacaaaggggacgtcgaacttcgtcttgtcaatgtgatatacgtcatcggccggggtcaacacctctgactcgtcgatatagtcgatatcgattgactgcagtacttgagcttcaacaaagtggccgatacgacacttagccatcaccgggatactcactgctgcctggatgctcttgatcatcttggggtcgctcatacgacttacgccgcctgcagcacggatgtcggcggggatccgttccaaggccattacggcgcaggcaccggcatcttctgcgatatgagcctgttcgggagtggtaacgtccataatgacaccgcctttaagcatctgtgccaactggcggttcagcttggcgcgctcggcgtgattctcagtggtttgtttatctggcatttttaattccttcctgtaactaggatatgagcgatagaatagggcaagtctggatatacgcctatagtcaaaaagagtttattttgtaaggtcagattgaagagttggcattctgaataatggttagggggagatcagcatgctcacctatgatatgactcagcgcggatcacatagcctctatgagtacctgtacctatgtatccgccatgatattgcccatggcaccattgctccccatgaaaaacttccctcaaagcgagccttggcagatcacttggggatcagtgtaatcacggttgaggctgcctacagtcagttggtggctgagggatacgtacttgcagaaccgcggcgtgggtactttgcctgtgaactcgcgccagcactgcaggcgaaagaggtgacacatcaagagtcgagatgtgctccagtgacagaaaaccatggtagagatgcgggtgagagtcgacagagaggaatacccctgctggcagatttcactatgcaggcaactgagaccgatctgtttccctatgatgcgtgggccaagataatgcgccgtacccttgcggaagaatcagcggcttcactggtaagcgaacaagcaccggcaggatcctggcggctgcggcgtgccattgcccactatctgcagggatcacggggtatggaggtggcgcctgaacgcatcgtggtaggtgcgggcactcaggcgctctattcctatatcgtgcgtctaataggacatgaccgaacttttgcggttgaggatcccgggtatccatatttggtgggtacgtatcgggcattgggcgtcacagtgaagcctgttccactcgataaagagggcatgaacatagaggcgttgcgtgtgagtggcgcagatatcgcacagctgatgccagcgcaccagtttcctaccggcatagtcacttctgcccaaaggagacgtgatcttctgaactgggcgcgtgaggataggactgatcgctacctgattgaggatgactacgacggaaagtttcgctttgctggatatcctatatcgacgctctataccatcgatgcggcagaccgtacgatctatattggtgcgcttgagaagggcctggcggcagccttctgtatcgggtatatggtattacctgtgaatcttgcggaccgctttgatcaggacgctgaagtctatgccaatacggtgagcccgttagaccaagtggcgcttgcatggttcctcgagacaggcgcatatgagcggtatatcaatcggctgagagtccacgcccgaaaagcccagcatgcgtttgtgaaagctcttcggaaaagcagggtgggttcccgtcttttctttgagggtcttgagggaggcatgcattttatgatgcgggtccattgcgatagcgattgcagagttgctcccgataaaagagagcgtgctattgccaatgaagcctgtcggcacggcgttgccttgatgcccttgagtgactgctatgtgtctcacgctcataccggtgattccgcctttgttatgaactacggcgctctggacctcactcgcctcgatgagatcgctgatgtcattgccgatgcgattgcatgtgttgtaggggagtcttgtagccagaagtgacgcagcgtttccttatagttttattgttggtcctcattgttggtagtgcctacaggtatagtgaaagtaactcaaaggatacttccttgataaaggtctttgtacgggggccgacgagctgtgaggggatcgcagcgaagatggaaataacgataatcgtatcaggtatggttatgctcgcgtattttcttcccctctatggtggagcaggtttatccaggatgattctaaggaaacgatgattaatgccccataacgtgtcagaggggaccgaccacacgacgtttcgcggtcggtatgtgggaaaggcagggaaggatgctcatccagcacgtgcaggagccgccatcctggcatttatcctgccccatgcaccgcaataaggttccaagacggatcaagcgaagctgggagccaggaggtgcagcctgccggcaaaagatgcacatgggtaaggtttgcaagggcgaaggaaacatcgagtatacaggagttcttctctatcccctagtagcgcttccttaaggggccgaagcgccgcttcacgataaggaagggatgcttctacctttaagcggccggatgccttcctggactcgatatgatatggccgccgattctgagacaccgatttgaccatccttccgaatcccgcaaagatgtgtccgaggggacacggattgcgaggaagagatgtccaagacgacgaggaagacatacagcgcgagcttcaagatggccgtcgcgctggaggtcgcgaaggagcaggagacgctctcgcaggtggcagccaagcacggcgtgagcccgtcgctcgccgctgcatggagggacgagctccttgcaggcgccgacagcatattcggcaggacgaaggaggagcgcgagagaaaggagcaggaggaggccgcgcagagaaagtacgacgaagccctgaagacgatcgggcagctcaccgtcgagcgcgacttcctccagcggttttgcgacaggaacggatacgaccccaaggcgtgaggctgcggcaggggaccttccggaggggctcacgaggcagcgcgcatgcgagctgctcggcgtgagcagggcgagcgcctaccgagacatggcaggcgcaggagcggcggatggcgcagatgcatggtccgataaggacgagcggctcgccgccgagatcgaccgcatccatgtggagagccccgcattcggcgcgaggaagatctcgaagatgctgcagaagcagggcgaggggcgcgccacccgctacagggtggggaagctcatgggcctcatggggatccgcccctgctgcccgctgccatctctctcgaagcccagcagggagtcgaggaggttcccatatctgctgaagggcaagagcatcctcttccccaaccaggtttggtccacagatatcacctatgtccagatagggggaaggcacatgtacctcacggcggtaatcgactggttcagccgctacatcgtctcctggaggctctttgacaccatgcgcgcccaggaggtggctgcatgcgccaggcaggccttcgaggagcacggcacgccctccatcatgaactccgaccagggaagcgtgttcggctcggaggagtatgtgtcgctgctcgcatccatgcatgtggagcagagcatggaggcaagggccagatggagggacaacgctctgatggaaagatggttcaggaccctgaaatcggagtgcctgcggcaggaggagtacagcacgcctgcagagctcagggcgatcatcgcgaagttcgtgacgtggtacaacgagaagcgcatccaccagtcgctcggctacgacacgccggcggagtggtacaggagcggtatctgcgaggctgcataggcctacaatgctgctgtccggcaggaaagggcttcggaaggatcgggccttcactgtctcacgagttcggccacttcaatacccttctcggacaagagcgcacaggcaaggccttctatggtcgaaggctttcttgcaacgctttagcgcacagatgagaggtgtgggtctttatgcgtccttaagggcgcttcgctatacctatatagcctaaagtctgcgcagcagaacctgtcatcctcccttacgagtacgtgtgccacaggatatgtcagatacattctaggcggtcgtctccacaccatgcacaaggccacctgcggcatccacgccgatatgcgccttgtatccgatacggcaggtcttccctttcttggactggtgcgctttaagggtcgcgtgtatggtccttgttcttcgtgaagctttagggcccaggtgaaggtcacatccaccatggagccaccccgcgccgtgatccctgccttctcaagcttctaagttcaggcgtgaagcatagctttgccgagtccctgccactcgaggctatggcgcatcttcacaagtgtcgttgcatctggcacctgcgcctgcatgaggtctgcgtgcacagaagcgctgtcaggaccgacaatccaggatagcatctttaagttccctcgtcttaagagagcaaacataacctaaagcaggatacatcctaaagctttgtctttgcagcgcgcacatgcctgacaagagcatgtccgtggtagctggtatctactagtgcaatccagctatcccacacaacgatcgcatccatccgctccaggagtgcctctcggcgggtctttctcctaagaccttaggatttaaggtggtggattagcattctaagtgcaacacaatggcccgctgaatgcaggcgtggcacactccggaaggctacgatgttggttatccaagtcaacgtcgaaagctggaaggaatgtgccactacaagcatctcaagcctacaggagagggactgcatagccacgctgcatgcagagggaaggtcaattgcctatatcgcgggagagatcggcagggacagctccagcatctgccgcaagctcaagaggaacgcacggcacggacgctttagggcatgcactgcccaaaaggagggcggatgagcgccgcaggagatgcagggcgaaaaggcggctttcagaccctgcgcttacgcagaaggtgcgcttactcatcatggacagacactggtccctggaggagatagacgacatctcaggctcgagggtggcggcaggtgcgtcgttgagcctgccgactattctatcgggaggtccatagccgccacgctcgagctgccggaaaccggcccgcaaggccaggtgcggcaccacctgcgcaggaaggggaagcagatccgcagcaagaggcctaagacgaggggtaagatcaggatcttacataccgtaagggagaggcccaagcaggccgatgcgaggtcttacctcggagagtgggtagacggcacgctcgtggcagcgggacctgtgtgcctgctcgtgcttgccgacagggcagtgaggctgcttgccgcggaaagagccaccacgacagcgggagcgtctctaaggccgaggtcgggctgctgcagggacgccccctcgagacgctcactggagtggggcaagcagttcgcagggcatacagatgtcacaaaggccttgggaggcgtgcagttctacttctgcgacccccaccatctatggcagaagccgacagttaagaacaccaatgggctcctgctagagttcttcccctaagggcagcgacttcggcaaggtcacaaacgaggaggtgcagcatgcggtggagctgatctgcgacagagcgaggaaggtccttggatacaggacagccaacgaggtctttagggagatgttgcactcagcttgacaatctgccggtcttaaaagctcatctggctgtccatatctgtcttttggatatgcaggaatacgtggatgtagctataccatatccagaagacagataggcatctatgtgggtatgggcactgcgtggttcgagacattttgagccgatgtcatacagcgtgtggctccagcgacctcatcgaggcgaattaatcatcgtttccctaaaggcgttgcaaggaagccttcgactagagagggccttgcctgtgcgctcttgtccgagaagggtatcgagtccaggaaggcatgcggccgctcaaaggtagagcatcccttccttatcgtgaagcggcgcttcgaccccttaaggacacactacaaagggatagagaagatgcctgcacactttagtctctctcgcccttgcaaaccttacccatgtgcatcttttgccggcaggctgcacctcccggctcccagtgtcgcttgatccgtcttggagtcttcttgcggtgcatgggacgggacagatgtaaggatggcggctcctgcacgtgctggatgagcatccttccctgcctttcccgcattccggcctagaaaagccgtgtggtcggtcccctctgacacgttatggggcattaatcatcgtttccctagcgggctgtggagtcgggctcactcggctgcgagcttgccgaccacctcaagactgcaaggctgcttaagcaccatggcaagcgcaggtgcaggaagggttttgaggagaggcagggtaaggtcaagatcacccacgtgctcgccgagcttttccttatgctcgacggcggagttgtgagaagtgccaccctggatcggggcatcaacgagaatactaacggactcctcagggactggctctccaagggcaaaagcctcgatgacgccacaggtgccgaggtccagaaggcctacgattcactcaaccgaaggcctcaagcgtctgggttggaagtgccttgggaggtccactaccacaagacgttgcacttgctctgaggattcgtcatggaaatggtagggaaaaccgttaccaccctcgtaagaggggattgaaacgcgcctttcggtaccatacgtatataatggaatggaaaaaaccagccaatcttgcgatcgactggtttcatattctatggagcggcgaacgggactcgaacccgcaacaattagcttggaaggctaaggctctaccaattgaactatcgccgcattcctggtcggggtgactggattcgaaccagcgacccactgctcccaaagcagttgcgctaccaagctgcgctacaccccgtgacgcgttgtttagtatagagaactacgcgctttcttgcaattgaaaactagaatgagtaagtatcttcaacaatctgagcgacttggttaaccgtatcagatggggcctcagcggcaacatagcggatcacgccgttgtcgtcttcaagtacccagcagatcacgcgggtaccgtcaccgtagttgatggtgagctgggtggcaggatggttgatgagcttggagctctcctggatgatgttgtcgtctgtcacatccagagatttggcatgtcggataacggcctttactgcatcgtcgaccgtaatcggtcctgactcttcggaagcgtttccgttgttgttttggttggcgttgttgtcagatgaggaagaggagctgttttgtgtactgttactactgttattgctgttgctatttgagtcagcgttggagttagaggagctctggccgttctgatctgatgtagaaggagcattagaggaactatttgaagcagcggcattctctgctgctttagagcttctgacgtcggaatcgtttgaatccatgatcttcatcgtaatgatctgggttgcagagagatcgcagaactcgacatccccgctgccgctcttggtagcaagagagatccagtcagaggggacggatacatagccgacaccggccttcccgacgcgcttcgtctgagactcattggaatcggtctgattggttgcctgagagttttcagatggggaatcatttgaatttgacgctgaacctgtttgagcctggcaagcaggtagggtagtaacaatgcatgctgcgacagcgagaggcataactagtttcgcgatagatttacgcattgcgtctccttgagcttcttgtataggtgtccggcgttacaggtatatatagtttatcgcagcgcagatacttctgggcattattacttattttacggcatatagaacacaaaagaattatccgagagtagggaagcgtgtggataggatctctcacctgtaaccctgtggcgctaccattggcgttgccaagtatagatttgcccaagtggtcatgtggacctatgtttggcgacattcctgagcggatggccgcctgcgtggataggaaatccgccatggttgctatcaaacccctacaaggacacagtgtcgtccttcggcgctgcggttgtagaacgcagatgtcgcaagacggataggcgcagaaacgctcaaagaggcgaccgagctgtggtggttccatcctgtttgccacatttgtaggtttgccgaaagctggaaagacaagcagacaccaccggggcgtcaaaggtacacagcctagctcttagcgctgaaatacgctaaaaaggaacttttgagctggaagtgccccatcacctgtatgtgctacaccacatccttcgacctcatctttgagatgtgtgacctcacccacacgagcgccttcgagtggcaccacagcatctttgccaccgccgatggctactagaaccggctcgtgttgtgcggccacatctggacagacaagccctacctcaccgactccgacatcgtgcagaagagcgggccctccaagaacaagatctgcactgtggcaggcatcgacgcactcaagagtgtcggcgtgatcttagggcatggaaagccctcttccaagcgaatcgaagatgcactgctttcgtatagagcagaaggttcaatagtcgtgcacacataggtctcatctctcactcgtgaaggcaaccaaatgcactgacgaggcctatagggcagacatcaccgacctgacacacctgcacaaggccatggggcttgcaaacaagctgtgctgctctacctattcaggttcccagacacaaagaaatccagcctccagtcttgcctgaataggttcgtgtcgctgttctgtgtctgtcaggacgcaaagaggtagcccaaagctgcgagggtacttcgccatttgcgactgacgcacatttccgcaactggcggacccatctttatccacacgcttttctattctcggaaagaactatcgaagattgtctattccgcagtgcgatctgccatctcaagggatgtactgttgacgtcgggagattttcagccggcagattagcattctgagcgcaacaggatagcccgctgaatgcaggtgtggcacactccggaaggctacgatgttggttgtccaagtcaacgtcgcaagctaaaaggaatgtggcactacaagcatctcaagcctacaggagagggactgcatagccaagctgtatggcacaagggaaggccaatcggctatatcgcgggagagatcggcagggacagctccagcatctgccgcaagctcaagaggaacgcacggcacggacgctttagggcatgcactgcccaaaaggagggcggatgagcgccgcaggagatgcagggcgaaaag

SEQ ID NO: 313 - DNA, 10565 bp, Unknown
  Metagenome-assembled genome
cccggcagggcaagcttgcaaaaggagcggtagaacatggacgattttcaggggcagattgtcaagctgagtgcaacatctccctaaagacctcgctgactgtcctgtacttcaggaccttccttggtctgtcacagatcagggtcaccgcatgccggatctcctcgtctgtgaccttgccgaagtcgctgcccttaggggaagaacttgcgcaggagcccgttggtgttcttaactgttagcttctgccatagatggtgagggtcgcagaagtagaactgcacacctcccaaggcctttgtgagccctgcatgccctgcgagctgcttgcccctatccggaagtgagcgtcttaaggggacgtccctgcaaaagtccgacctcggccttagagacgcttccgctgtcgtggtggcatcttcttgcggcaagcagcctcactgccctgtcggcaagcataagcaggcacacgggcccggctgccacgagcgtgtcgtctgccaagtcttcgaggcgcgagcctacattggcctgctttggcctctcctttacgctgtgtaagatctcgatcttgcccctcgtcttaggccccttcctgcgcaggtggcgccgcacctggccctgtgggccggatcccggcaggtcgagggcggcggctaaggacctgccggtaagaatagtcggcaggctcaacggtgcacctgccgccaccctcgagctgagatgtcgtctatctcatctggggaccagtgtctgtccatgatgagtaagcgcagggtctgaaagccgccttttcgccctgcatctcctgtggcgctcatccgccctccttttgggcagcacatgctctaaagcgtccgtgccggccgttcctcttgagcttgtggcagacgctggagctgtccctgccgatctctgccgcgatatagccgattggccttcccttgtgccacacagctcggctatgcagttcctctcctgtaggcttacgatgcttgtagtggcacattccttttagctttcgacgttgattgagacaaccaacatcgtagccttccggagtgtgccacacctgcattcagcgggccatcctgttgcactcagaatgctaatccgccgtctcatttagctcatttcacgaggttgtaccatgcttcttcagataatcagtgacgagtgcctggcaatactcctccgatttgccgcgagattcgacgtagctcgcccgcgttcctgtgatttccgcgatggaggcagcgactctcacatggggtctccgaccctctatgagcttctttcgccgcaacctccgcaaggcagcatcgggaattggaattcctttctggactcggtctagggcgagcacgtcctcgaaaggcagctcgctgtcacgcatgagcatcctggtatatgactcgtcgacgacgcttccgtatatcgtgagcttgacgaggccaggctcgctcaggtcgtagtcgggcagcggcaggtagcgttctgcttgggagcggttcatccgctctatcccataccctaagtggtcgatcatgttcagctgagtcattgcctgcacgagtgttgggttgcgatatctcatagggacgtggccggaaagggcgtagtcatcgggttttccctcgcagaatgtgctggtattcgtaaactcaatcctgtctgggcgctcgacaacgctaacgcgggagctcttggtgtggtcctggtgtgcaatgcagttgtgcatggcctcgaggacgctgcgctggtcgtacttttcaacctcgcactggacgagtttaccgggagggaggagacgcatttttacgttgcgtatgtgtttgtacaagtctgtagtggcaaggatgaacgggatggtgagatgttcgtaggcttcgccctgtccgagcagctttcatgttaattcggccatgagtgggttcaggatgtatgcggactcgggctttcccaacagcaagattgcagctctcgtcagaccgtgctttgtctcgagccctacatgtgtcaagacctggtcgtcatcccagccttcgatttcttttcgggggatgcgcgccgagttccgctgagtgaaggcctcgcgcgcgacggcgagagccttgggagagaggtcgtcgacgctcgcatcttccagtgtctgtcccgtccagtcgagcatggagctttcctgtcgtatagcgtcctgtttttcgatagagagtggctcgagcgattcgcctgctcttgagtagaaatgccccttccaggatatcggtatcccctggggtgcaggaggaatctcgaagatgatgacacggccgttcgggcggtcgaacacgcggatgctccggagcgttaggctcggccctgtgccatcggacacctgcttcttgaggccgttcagcctctcagggtcccgcctgtactcagtcccgactacgcgccaagtactgtttctcacaccgaacacaagccagccggccgtgctccccgctagatttgccttgttactgagcgccgacacatacttgccaattttagagccttcggtagtttctgtgggttatgggtgagaagttcatctaagcagccttcttcttcatactttcctcggcccttcctggaagcgtcggcctgctgtcggaacacctcaacatgagcactccgatgaggttgtcggtgttgcgaaagccatagcccatcctgaccgtcaccttgatcttgttgttgatcgcctcgacgcggccgttgccggttccgagctcgactaccactgcgatgtcggccttgcgtcttcgcaccttcttctcgatggcgacgagcggcttgatcctgcaatacaccgcatcgcacatccacgcttcgagcagcgccgcggccttatcggccgtccctgccctgaacacggcccgcagatcctctttttagctcccaggccctgaacaggcgcgaagctgccttcttcagggagtagagcttggcgcgctgggcagcggtgagatcctcaggggttcttgacgagcgcgaaacggctgcccttgatcgcgtcggtggccttctcgcccttgcgcggccggcctggccggtcgcgcctcgccatcgcgtcgtgcactgccttcttcgcgacctgccattccttacagcgcacctcgtcgagcgtatcggttatcccttgcacgacatggaacgggtccatgacccagcgcgcattcgggcaacggcgccgaagtagcgtctttatccacctcgcgccgtcggcggtaacgacttcgatggcgcgcctctgctctcaggtgagctcgtcgaaaaacaggttcaacacgtccttgccgtacccctcgtgggcccatatcagacatccccggtcgtggtcgacgacgacaatcaggtacttgtggcccttcttgtaggaggtcttatcgatcccgatgcgccttgcgccctcgaaggcccctgccgcgtgcggcctcaagatcggcgcagacgcgcacacctcgccgagcgtgtgccactccacgcgcgcgagcgccgcgacggtgctggccggatccgcgcagcgccaggcacaccacccactccttaaagccgcgcgtgaagcgcgctttgcgcctcgcccagggcattgactctaccagcacgctgtgctctggccaccttaccctgtgcagcgcgtattccagatgagcacatcgaccgagccaggcccatcgcccccccccctgcgagctgagggccttgcaatctgtcgtagcaatcgcatttcctgttgcagatcgggcagtgcaggcctcaccctaatcacgactcgatcgccttcgatgcgtacgtattcgatcactgtgtgtgccagtgtaagcacacagcgtagtatcctgttcatgagcccacggccaccagcgctcctttgagacccctgcgtagtggacggcgaagctcttcggcgtgatcgcactttgccaggagggcgccactctctcttcgagaggatatggctcgacgagacgtagtggccgctcgacccagaagaccacatgcgcaatgctgatggcagtacgatgtggggcctctcaaggaacaaggtctgcatcggcgttgccgtggacgtccacgagacatcgctttgcctggacgaagggctcggcaagacgagccggaagaggacatgggatgccttcggaggccatattgagcggagatccgagcacatgctcgacaaggagaagtcgcacgccgtcctcgcaaagcgcctgaatctcgagagtaaggcatacgacgcgaagaagtgctgcacgctccctgacagggacaattgcctggacatggtcaaccaggaatgcaacctgctaaagagtctcctgaggtcccacagcggcttcagggtcgcagacattcagagatggctcgacctctggtgggtcttccgcaacatcggcgataacatggacgagaaggtggcatgggtgctggaccgcaccatgcgctgccgaaaagtgccctgatacagggacttctatgcgaaaaagaccagctagcagggtatgcgggcagcacagctatgcaaattgggcttgaaataaaataaaaaaacgttacttgcacacggtgcctgaaactactaccataaagccacttcaaggaggtagcaagcttgtccagacacggaaaatcacgtaagcaaaccccatgggatggtggagatgatctcaccccaacacaggagtttttgaagatgcattataaagcacgttacgatcaacgacatcccaaaataagcgaatccggcgaggcagctttgatcaactcttatgagccatctaaatgcccctattgtggttcggaaagcttcataaggaagggtctcgacccgaatggcataagacggtatcggtgctcttcttgtgggcaaacatttcgccctaccactggtaccatctttgattctcgaaagattccaatcagtgaatggatggaatattgtcttaatatctttcgctacgtcagcctgaatgccgattcatggaataatcgtaacgcactttctacatcgaaatactggcttgaaaagctgtttcttacgcttcaaggctctcaaaacgatattctccttgatgatacagtatggttggacgaaacttattatgctgttctgatgagagacagggaaaagaaagaggacggcaactttgttcgtggcctatcacgtaatcagatttgtattggtgttgcaactgacaaaaaacatacggtctgcctcttagaagggtacggaaagccttctcaacggagcagttatgagtgctttaaggatcatataaggcccggctcattgctgatacatgacaagcaaaccacgcataagaaactggtagaaaagctgtcattaacaagcaaagcctatgcgtcaaaggaccttaagggacttacagacagcgaaaacccgttggatccagtgaaccgtattcaggtgttgctaaagatgttcctgaatgctcacaacggatttaatagggatgatttacaaggctaccttgacctgtatgcatttgtaatcaatccgcctgcagaacagcttaaaaaagtcgaaaaaatcatcaaaatggtttttgaagatcccaaatcgcttagatatcgggatcaatttggcttaaatcaagcatcggaaagcaccgtgtgcaaataacgttttataaaataaaggttggaatagtaacattccaacctgaaaattcgtggtggagatggtggggatcgaacccgcgacctcaggcttgcaaagcccgcgctctcccagctgagctacatccccctgataataatcactccagcggcgactcggcaagcgctggggtgattattctcaaaaagaagtggtgggcctgacaaggtttgaacttgtgacctcccggttatcagccggacgctctaaccaactgagctacaggcccaacgtagagaaacatattatgctcaaatctatctcacgtcaacaactaattgaggagttttctgattttgagtcccatgctctgggaatactatggatacagagtgcagaatagagcctctgaactctgcagtacatgactacttccatggtgatgtagccgctcagtaaaaatatcgtttacagctctttgatatggtacatacatgggtatgattgccataatagagaagcaaggtaaggtttgatagtcatggcactcattcgattagacatacagacgatcgtcgttggtggaggtcccgtctcctcactgatgattctaaagacacatgcatctgacaacatccatacgaaaaatcacaacagaggacgccttcccatccagatcggccctgtcgaagctatgtcaatcggcaccggcgtcaatagcagcagcacccaaggcggacgtccgatgacgcacgacctgctggcgatgacaatcaaagcactcggtgccacgctcgatgcggtggtgatcaacgccgtggagggaaccaccttcttcgcgcagctgagactcatcaagtcggatggcagcatggcattcgtcgattgccgtccctctgatgcggttgccttggcggtccgtaccggcactccaatctacaccacaaccgatgtcttgaatactgcatcattccctgatttcgaggacgtcgaggaggaagagaagcaacatgagttgagtgagttccataaatttgttgaggggctctctccggaggacttcaacgagagcaacaaacagagcaataagcaataaagaagagcgtattgatagtatcaaagcctcatgtgcttggacccttctgatcctgcatatgaggtttttagcacctctacagtggtcctcttggagaggcggtctcttcaatctgctatggacacactcttgtgatttctcatatcaagtgcaacttttcagaatatagatcgacgacgctggcgcggaacgattatgtaagtgactgaatagccatagttacagtgaatctcttttgtaagggtttgttatcagtcctaacctgtttatactgaaaagagcacttttttagtaaacctgagcgtgtctatagaggtttactaacattattcagatcgaagcatgcgttcaaccaagaggtttgactgtctaaacggaggttagctcgtgagaatccttgcgatcattcctgctttcaatgaagaggaatgcattaaagctaccgttttagagcttaggcgcgtttgcccagaggttgactatgtggtaatcaacgatggatccagggataaaaccagcgagatactcgatgaaaataacttcaatcatgtaaaccttcccatcaacacgggactcacatcaggctttgtgacaggtatgaagtacgccgctcgacacgggtatgacgcaacagttcagtttgatgcagatggacaacacagacccgggtacataccagatatggcccgtgcgatggagcagcaggatgcagacattgtgattgcctcccgtggtgccgccggcagtggagcggtgggggctcgaggggcaggtgcaaaactgctcaccgcattgataaagggtgcaactggacaaacgattcaagaccctacctctggcatgcgtatgtataaccgtaaaatgattgatctcttcacgcatgcattcgatgtctcccctgaaccagataccatttctctcctgatgcgcaaaggcgcaaaagttattgagataccggcggaaatgcgtgagcgtcaaggtggcaccagctatctgaggttctggagttccatctcctatatggcccgaacctgtatctccctcatccttttccaatggtttaggtaaggaatctatatgtcaccagtcttacgtgttgtgctgattgtcggttctgtactagcactcgcgatcgtcatagacaaagtcaagaagtctaagatacgtatcaaagattcaattttttgggttatatccgcagtgctgttagttattctggctgttttcccgggcatcgccttcttcttttcccggctcttggggtttttgtcaccgagcaacttcgtcttcgttgtcattattgccctgatgcttataaagcttttcaatctctcctccgacgtatcccgtctgatagataaggtcgaaagcctcgctcaagagatagcgctctgggaacatgaccacaacgatcaaaacaacgctaaccaacactaacgcacaaaaggcagggtaaatatatagggcgaatcctcaaagcaagtgcaacgactggtaatagtagacctcccagagacacttccagcccaggcgcttgcagggtcctcggttgagtgaatcgtataccttttgcacctttctgtcggcgacatcgtcgagacttttgcccttcggaaatcagtctcggagaagcctgttggtgttctcattggtctctctcccaggaatggtagggatggcagaagtacacggtcgcccccagtgcctcctggaggccttctgcatccgagaactccttgcccctgtcgaatgtgaccatatgcacgctctcgcctgttttctttggttcaactgtgatgcctttctaattgtcaagtcgttttcagcatgcaattctgtgcgatgatgtcgtaatagagctcgcgtgtgatgtatcgcttgacacatcggatcacctcgagcttggagtgttgttaatggcgatctcgctgttagaccatgattgacctggcgcccctgtccttccaatagctccagaagggctgctccatgtctatgagcgcacgcctggtatggaacatacctgccttctgcaagctgtcctgagagtatatccttcttcttccgctcagaatgccttacctgctctatccacaggaagcagacaagacaagtgccccagccacttcgtagaagaccccatggaagaaaagcaggaactcgtacagccttcgctgcatcgcattgacgaggctaagctcgccgtgcacggccttcttcgccacgctcgctgtgtgcttgaagaccccaagcgaggagagccacgcgcgcatatcctgcatggtcgtcgctggcgacccataagctgtcgacgatgcctgaaagggcatctgtcagcttcccgtcctcgggcctgcccctgccgcagaggatggcatattcgtctcctagggaaacgatgattaatacctatgccggccgcgaaaggccacgtggctggtcctttctggcacatcattgggaattaatcattgtttccctaggtcgttcgcgcagcaccccacgcagaccttcttgttcgatatgccacagcaatgcacaacatggccgtgcgtgtgcgcctccccggggcatctggatgttgggccttgccctgttgcctgtaagcgactcgtcgagatagatcccgatcttttggcaggagacggtgggtccatacctaaaggcgccaagcgctgcctgcagcagctcgaagagcctcatgcgcatggaaccacaatgtccttaaggctcacagggcagctttccgtaagctcccttaagggacatgcctgcaagcgtgccctttgcatatgcggcccatgtggcggctgtgggcttggacatagccaggacagatcttgtctttacaaagaaggtcttgcctcacgagcaacacttccatctcttaaggccacacgcgtcgtggcccttgcaatagaagctagccgatttgcacctcgggcacctcttgggtgttcccgcaagtgccgagcctgccatcttcttggctatgagcgccttcagcctctctaagagctcgcgcttctcggcgatccccatctttttgatctgctgcagtatcattggatccatccgggtcctttgatcctcgatgtctttgtttgatgatatgcattgtaggcaaaggcccggacacttttgggcccttcttaggtcaattatggtctaacagcgagatggcaatctagaagctgccaatcaaggcaaaggaatgcgccagatgagggtggtaacggttttctgtaccattccacctacaaacctaagctgccagcgcgaggccgaggctctgcctgaactccatcgggctcactcctttaagcgagcgcttgcgcattgtcgtgttataccagacgatgtagcggttgatgcgctccttcagctccttaagggtcacgccaccccacttgtgcttcctgaacacctccgtctccagaagctccgaagaaagccttctgatgcactggttgtcggaagagcaaccctttgcgcgacatcgacctttcgatgccggcctctttacagatcgatatccacttctggccagcagcagtggcagctacgttcgctgtcctcgacgacgtcctgctcacgatcgcgctgtcgaagcagccgaggatagggctcaggttggtcctatgtcaagttttcggacaggttaaacataactttttcaccctctcctgccggtccctgcttgagctcagacaatcgcttcgaatatgctgcttcatattcatctggagattgatatttacaatggctgtgaatccgaaccgtgttataaaacgtattgatatattcgaatacatagcg

SEQ ID NO: 314 - DNA, 46248 bp, Unknown
  Metagenome-assembled genome
ttcgtactcgataagcatgggatcgccagagattgggggctcgctcaagaccacgatcggctcttcgatacctgctcttcctgagtcgacccctcgtcggcgttgccaccgcaaagagtagccccggctttgacatgacgtccgccacagcgcaccgcgccgtgcccataggcatcggccttcacgacgcacatcatcgtctgaccgcaccgacttcaagcgttttttgaatgcgcgcacattggagcggcaccgcgccgaggatcgatctacaccaggcaagcggtcaggcgaggcaattgttttctctcatgaaaacagttactcctttgtatcattcgaggagagcagctcgtcacgtgtgctccagagagtctgacgccaaccgatgtcgtggattgatatcggttgccatatgctacaggggagcatagctgctttgcgggggcgccgcgaatccggccaacgcaatggatctcgccgcccgcgagcacagaagcggacagttcttccttgtcctcggatcctttgcgagcaaggctgagatgataccgtcaggacacgggacacctgacgtggagagcactgaggtgcccggctcaggaagcaaagcggcttccaagacgacaaaagagccggactgcctttcgacccaacgcagatctacactgcccaccgtcgctcccgacgatgcggacgcgccgcttcgaggcaggcgggtgagtgaatcaggggtgtattctatgacaatccacagacggccccacccctgagttcacgtcggtgcggggcaggactagcggcttatcccgccgggtgacctccgggaactggtcgagcgaattgttggtcagactcctttcagtggagaggcagttcaatccatccgcatcgacaacgagcgcacctctgcgttgaggagtgctgaaacgactgagatggtgcctgcggtgacgcgcatgcccggcccgaccaaggtcgagggagttgcgctccgcaagcttgaggatcgcggatcgcctgcttggcaaaggttccgctggtctgcggaccataaaagaaaaaaacgacgaccggaatctccggtctgctgctgaaggaaaaaaaatgagcggagcgaatcgtgaccggaaccgcaagcgtaacgtagcctgcgccagcgcggggcagcagctttcgctccatgagtgcagcaccggaaagagggaggagcggcccaaactgacaagcacagagccacggaatattatccataggttgatcgtgggctgcaggacattccgcatagtcctgaggactcaacgcgccaggatacggatccgtactccagaaccacacgctcggtctgctccgcaagggcgcaacaacgaggggttgccgacggtccacgtcgagggcccatatctgcgatcagccccggctttgaggacagcatcgcagtgtctcgtccgcgccttaagcactcacgggcgcatggacagtcggatgcagagagtcccgacggcaacacgacggcgatgacggggcctcagaggcgttcacgtattgatccagatatcaaagggtgctttgggtcaaccgtgaaggccggtcccgatgcattcggcatcaaacgatcaggtcggaatctccagcagcgctccagatcctcgcggggcggtccgaccaccgatcggaacctcggcgtaacgggtagggctgggctaccagtcgcgcagagtcgctctttgattcactcgggcctcaatcggtgcaccacagtccgtcgtaccagggcggaagagctgcgtgaggcggacccatcgtccgcccccgttgtttgccaaaggccgactaaaatagcgacttttctggagatcctctaagagcatccactctcgggccaccgcaccgccggcatggcgcatcagttcagacaacggactccctctttggagaggcgttctcaaccgctttgacgtcttcacgtttgaactggttgcacgctgttcatcccttcgccagcagggtttcccgaggcgccctgattctggcaaaatagtttctgttctgatgttagcgcatcgagcctctacaggcctcaggagtcgcaccttcatcttccatgttgtccagattagtccagaaaggagcgggcttccgaaacggccttatcgagggtacggcgcggatcgaggcctcctttttcttgggccgacctcccagagaccacacaccgcatgggcgatcccagatcatgggtatgtgagagcgaaagggctattcggagcctgctctgggctatctcttttgccctcccattaaggagcgcacggggccgtcccactcatcgcgcgtcaacgagacatcatgccagccgaccccggcgagaacccggtactcaacgcctgagcaactgcctcaagtgcgcagaaccggcgcggcatagttcgcggggccaccctgacttatcgccgtattatgctcctctttcttaaagagccgcggcttcatatagaggagtgcgactcagtgcacgctcaatccgtgcgatctctaagatattagactccgaccgcctgcacgcaccatgcttcctcgctattccaacgtgtttgacttttctatggtacgaggtttatccacatcaccctcggggtcaagggtacaagagcataaaaacatcggtcactgcacaactgccacaattgagactcacaccttctttgattcaagcaacaaaaagacccatctgccgaagcacatgggtccaaacaagcagatatgaaaccgtagtctaacgcttggagaactgcggacgcttacgagccttcttgaggccgcacttcttacgctcgacagcacgtgcgtcacgggtgaggtagccagccttcttcaggtcagcacggtactcgcctgcggaaagcagtgcgcgggcaatgcccagacgaagtgcaccagactgaccgttgatgccgccaccgtcgcagttggcatagacatcgaaatgtccctcagtgtcggtcacgtggaacggtgcgagggcattgtcgatcagctgctgacgaccgaagtagctcagtgcgtcacggccattgacgatgaccttgccagtgccggggatcaaacggacacgggcagtagcctccttgcggcggccggttccggtatatacagcgctattgtctgccatgacggctaagccctccaatcaatcttaacggggttctgtgcagtgtgaggatgctcagggccggcatagacgtgaagtttagtagcctgcttgcggccgagcttggtactgggaagcatgcccttgatcgcgtgctctacgacgcgctcagggtgcttctgcatagcctccttgaagctctcggtcttgagaccgcctagccatccagagtaacgccagtaagacttcttcatcgccttgttgccggtaagctggaccttatcagcattgataacgacaacaaagtccccggtgtcagtgttcggggtgtactggggcttgttcttgccacgcagtgccattgccgcggtcgtggctaaacggccgagcgttgcgccctcagcgtcgatgagcacccatttgcgctcaacttcgcctggcttagcatagtgagtcggcttgttcacttgactcctccatatacttaatgagaaacgctttttcctacagagattacggggctgtgtggaaaagctttaaaagtatacaacgcccaggtgggaatcgcaaaatttatttgaggaagttcctacaaatgcacgggagcttcacgcttcggcacctattgccacactcagcgcatcaccctatcggaagtatagagagattcccaccgaagatgccctctctgatgggaatgacgatatacacattagacttgctgttttgggttcccgaagatgaactgcatgtaacgcgcatagacgatgatctcaaagatcactgcgatgatggtctcgaccagcgcgatcggttgcaaccagggcagcgcaatcccaagctttgcagcacaggctacggtctgcttggtcgcgatagcggtaatgacgaacgggaaggtgaaggccgcccagctcggatagaaccgtttggtgacatagtggaagctctggatcagggcaaacacatagataaggtttgctaccaagcacatcccgagcaaaaactccactgatttcagcgccaccgacccaacataacctgctacacagaggctcataggcgccgcataaatgcagatcagcggctttgccggatccgggacgggaatcttaacatagcggaccgtgaccaggatgagtaggacgatcagcgagacaaacccgaaccagaagcagaaggttccaaacacctcctgcccaaacgccggggcactgactgcagcggttgcgatcccaacatagacgatgtaccaaacggtaaagacgttcttgagctcaaaatggcagacgaacttggcggtgaagtacacaatcaaaatgaagtgcaggatcaccgcagcgcaccaaaccccgaaggcgaccggcatcatagacggcttgatataggtggcaagcagcatcaaacccatggtacaggtccctgagacgcccgctgtaatcggattctggaagtccttctttacatcttgcggatacttgcagagtttcatgatgatgagggtaaggaggaagagcgagaaaaccccacagataccccgcagcacctctgagtagctctgcagcagattgcccaaccctgcggcacccaccatcacgccgcagatcggcattggaacacgttttattggatcagacatcttacctaagcgtttaccgtttccttcttctgtgggggggcaggaatggcttgtcgaggcccttgataggctcggagtccagattcttgacttccagctcacggcagaggatctcggcaaccttgccggcgcacagaccagtgaatgcgatgcactgctgcttgtgttcccctgagaccatatcaaacccgcgggtcaggatacggcagcaggtagcatgctttgcgttggcctcacggaaccagtcgtgcaactctttcgtcatggccatgcaccgattaactttcggatccttcgggccgccctgtgtggtgcggccaaagaacataccgattgccatgatgccgccgttgagtgcaccacacatacagccggaacggcctacaccgatagacatgccggaagacattgcaatgaccccctcagggacatcgatctgaaatgcggtacggattgcagacataactgcctcacagcagaagaatccgccctggtagagaccttctgcggctttctgaacctcttgggggctcacttcagttgcaccatatctcacgttggcttgctttggcacagtaattcctctcctctgccaattttttagcgaacgcgataagtataaaagatcaatcctataatgtggcctgcaatatatggacagcgatttgacgttcaaaagagaacccgcacagtgtgcacaagcacacaaagtgaggtttgtgaatgccgaagggaaagccataccccgccgagttcaaggcgagggccacaatcgaggtcatgcacgcaaagaagactgccaacgagctcgcctttgagcacgacctaaaccccaacctggtcaagaactgggtcgcaaaggctacctttgagatagcgcgtgttcacggcgtccgaggacgagcgggggttcagtgagcctcattgcaagatcggcgagcgcgaccatcttcaacactgcctgcttaagcgctacggcatcgacataaaagacattcctggtcgatccaagaaacgctgatatcaacgtggtcaggcagctccagtagctgcagatccccaggttcacctactacaaggtcaagggccgcgcaggcgctcttttgagggatcgaatcgcaagcgctccatgcgcagcgtggataacgtccacctgaagcagcccttacgcaggtgtgggaaggataagccgtacgctcgaggcatcgaggtgctgggcgcgaaggctcatggagaagatgggtgtgcgctcgatctgccccaagccggccaaaagctcggtgaagcacccctgcctgctgaagaacaaggcgatacgcttcccaaccaggtagcgtcgagatcacctacatttcgataggaggcttgcacctgtatctgatctgtgtgatcggctggttctcccgctgtatcgtgggccggaaggactcatccggcatgggcgccgcaggtgtgtgtgagtgcatgtgtcaggtactggaggagcacaaagaccctcctgcgccaacttcgaccagggatcgcttctctccgctgcaacgtataagggtctgctggcttgttgaaacatctgccagagcatggatggcaagaccaagtgggtcgacaacgctatcgtaaaagagatgatctagaagcctcaagagtgagtgcgtgaggatcaacgagtacaaagcgtctaccgagctcaagaaggctcagcgtaggcttacgctaagcagtacaacaacgagcggctccaccagctacttagctacgagacgctcctcaaactggtatcgcttagggctgatggcggcttaagcccccggatcgaaggaggcgggcactctttcggggttgatttcagtgtcgaatcagctgagccactttacttctgttcagctgtctggcgatcttggatatgttcttgccttcagtgtgaagaagcgtgatatcttcaagctgagatgacgatagcggctcatggtgacttctttgattgttttgtcgcaaataccatcatattgcgagaagccataagtcgctatttttctcccttaccgttgcactagcaatgagaacccgccatcatgaaaatgtttctttgtagggtatgaggtgaagagcatctccctctagcgtagctaagtatatatcgtggggagaagaaaagccggcaatttgaagttgctgttcaacccacgatatatctttgccggaaagcataagcccatctgccactatctgcccatcgctaatcaaaggcagagggcacatagctcgtacatcctctttacgctggattgtgagcctcccgtttgtttccataatggcagagcctacttcttcgatagaggagatatttgcctctcgcaaacttctgcttaactgctccgctgtcaacccgactttggcacagcgagcaacatccacttttcctgcacacaccaaaagttctggggccgctgataccgcccttttaaagatcgaactcgattctcgtaaaatctttgtgatgattacaaccaaagaccagatgagtagaatgattaagaactcgagaaccgaaacagtttggttataaattaccccaccaataattccacctaagacatagttctgtatctggtttaagggagtattgagcgagaattcatacttcccaagaatattgatctgcaaaatcataaccaacatacccagggcaaatttaatagcaacaagggtgtaaatatccatcaatgctttccattcacatacacgtgatgatcaatgatgtgagtttcctcgagggtataggagttgttgtcatcaccaagatgcacgagataatcctcatcccgcaagcgaacaataatcccgtctttcagagctgtcgagtttaccaacacttcttcctctggaactccttgatcggttgccactccttcgataaaaccactcatacgttcagtctgagacatccgctgagagagctgtaaatattgttcagtctggatgcctaagagcaccaaggaaaacactaacgaaccaagtgcaacatcacgcatccgagtattgagtttgtttctcaaatacaaaagactaaagataagtcctatgaggagcataacaaatataaagatactgcgtaccagcgagtctgtagcatgaagagaggtaatgtagtcaagtgtaaagaaatccattgaatctttctcatatccatactagataaggttacgttttgaaagacactgggctacacgcagtgctccttctaacaaaaagaataataaaacttgaagctcgataattctacttctatgctcgtttcagataaatatcttgatttgaagacgctgcatctctacagatagtatatagtctgatctcattgtccatacgaattccggtcagaccttaatgtcgagaaaatcccctcttgcagtgcgctgacatctgtcctgcttaagggccaccagctaggctaataactggatgcgagagcttgaccaccatacgaaagcgcgatgacgggcagcggtgctctcgcgatgtggtagtccttggcggtgttgctggtcaagtccgacttcgtgtgtaaaatcgctgccgcgttccctgccttacgccttcgccatgtccctctggttgcgcgctatctttgcgagctcgtcttccacctgcaggagctgcgcgtaagtcctatccgtagtagctcttcctctgcgtcgagctgcactcgttctcctcggtaaggaccgacccgatcagcctgatcgccgacgccttactcgagaagaccccgacaaagcaggcgtgcctctctatctccctgtttagcctctcccggtagttagacgtcctcatgtacaggcgcatctcgccgatcagcaccttcgcggtcatggcgtcctcgaagctgtcctctgagctgtaatcttttggtggacagtgggattcagggactggcaacagatatgctctgtccagatacccacccagcacagtcaacagattgaagagatgagatgtcgctaagcgcaagcgagatagagaaggcaaagtcccgcacgaagccggaaacacccaaacactacactgaagaagtattgccttaaggctgtcgactactacaggaaggcacgtaaggccaacccgaagaagagcatcagaggatgcgccgcgaagcttgaggccaacgacaagaccttaaacgactggatcatcaagcactcaaagaccaaaagggtgacccaggaaaggatcgacgatcacaagcagctcgacgcagtgaacaggcgcatacacgagctcgaaagcgaaaataagttcctaaaaagtggcagccttcttcgccagaagcctctgttgaaggacaggttttagctcatgctggagaagagggcaacctacagcgtctcgatgatggagcgcgtgtcgggggtgagcagggctcacttctacagatggctcaaggccaaaggcggtaaggacctatggggtcccctcaaggaagccatctgcgcgatatgggaggaaagcgacaggcgctttagctcctgctaggtctgatccaagctcacaggagatccaaagttacgcaaaatttacaggcacgacccactaccgcgtgcgcaggtgcatggctgaactgggataggcaacatctgatccaatgcctccaagaggacgatactgcccgcacctgatacccccgagcgccccgccctcacccggcacggcttttcgtgtcccgtcccgacagccaagctcgtgggcgatataacctatcgcaggaccacggcaggctttatatatcttaccgtcgcacacgatctgtgcacacacatggtggtgggctgaagtattcgggacaacatgagggcagggcttgtcgtctttgtcctgaagatggcatattcgcgcggatacgtgaccggaggggccatattctaagcagcccaggcagccagtacataagctcaaagctggccgcctgctcagccgtacccgacgtgaggctcttccgtggggagaaccggaagctgccacgacaatgcgctcgccgaatcgctcttcgccacgctcaagaacgagtggtactaccttgagcgcctctcggacgcatccacgaccaagcacaaggcacacgagtttaatcgagtcgtactacaaccgcttccgcccgcataagtccataggagatcgcgtgcccgcagaggtgatgcaggagttcttcgagcgcctcgagagaggccttgcgtacgatccaaaggcgatgcagaccgcataaaaaatctgagattcctctgtccattatattgacagggctcagatcttccccgccatgtggcggaacctgaggagcgtcgtggcatcgggcacatcgttctctgagcccacggactccctcacggccagcgaatcgcacagcgcgtcctccgtgatctcgtcggagaggtttaaccaggcctggaccaggaacatgcgcagcaggatctccgtcggccagggctggcgctcccctcctgcctgccttcggcctcttggcctcgacgatcgccataaggtccgcccagggcacgacggagtccatctggtccaggaacgccttcctccccgtcgccctgccgcccgatacgaacgaggggtccacgacctgtgcctagcgtgccatagaaagcctccgatagtacatatgcactggcaggcatatctattatcccacagacgggcattccgtggggccggctagcctctctcagcggcgctatttattcagcgtttccctaaaggtcgccgtgatggcatcaaggctgcgctcggccttgcgctgcagctcggagagctctgggatcctgtccctccataccatgccccgccattacgccggcacgcatttgaccggtggacagcttcagcgcgggtctgagcccccttcagcgggcagcccctgacaaccccgggctggacctcaccgctatctccagggcggcggcgtgctgcccggtgagatattgacaaggctcactttgttgagagaaacgggctcgggcgcggcctgaggctctcgcttgcgggctttgacgtgcaggactgggtcgccaacgtgcccctgtatgtgctctcgctgctccccgagtacttttcggagcggatgtaaggtcgccagcgcggctgtcaccgaccggcggcacgcgcaagcgcaactttcagcgctgagatgtactttcggattttcccacctgcgcaaacgcctttcaggcttaactttcagcgctgagtgtcacgtttctcctgagctcatcgacagcctgcccaccctagacgtctgctggcccactgtccttccaccactggtctcttgagatggggccactgccagaatcttccagcagctcacgcagcctcagccagttctcgtcaacatagcccatatggagaacttcctgcacgtcaggaccatcaaaatacttgacgtgcgaagaatcgttccccatccagccctcgggccatagatacccgacataatcgtgttcgggccctgatcctgccctcgccttgtgggagactacgacgaggggcttggtccccaagctactaattgtcacaacagtccctatgggcagcagatgattagtctctttcattgtcgtcctccggtctcttgctatgcctcgcaaagtttctggcagagaagcttctttcctgccttgtctgcatacccaagaagaagacccttttcacctgtgcatcatcaaacaaaatcatggcctcaggcgctgcatatccctctggccaagcacagcccacataatcccagatgtgttctgagcgggggccagcggactccgcatccttgcccttgaggtgcgctcgcctcccaaccaccatcacgcaatgcgtggcgcccttaagcattacgaccgagccaataggcagatattcctcaagttcttgcgtcttgctcatcgagcatcgctcctcgggtagccgctaaagggctcccagcttgtatcgagcgctgagaggccggcatccagcagcttctcgagcgcctcctcatgtgcgtcagtcatgccgagatgcagaaccctctgcacctgatcgcgtcggcaaacatagtagtcgtcctcgcccgtcagcccctcgggatacctcacgatgacatactcatagaggttgcgacgcttatcgcgcacgttcctgccgaccaccatgatcgcctctccatttaccaccgcgatgctccccacgggcagccagccgctcgtgacgtcttcgtaggatcccatcttacctacccttccgttatgcacggcactgctcgccccactgggctgcggcaaatgccagcccctccacctgcgggtgtagtcatggggaacgagccactttcctatctggatcttgcgacagtgccacgagtcccacgggtccgacttgtgaagccaggaagcaggcctcggagcgtgcgaaataccgtagacgcgcgtctgcgcgggcagcaccccaagcacttcatccacaagcgaacgtacttcggcgaggccgagcgctgacacgtcggccacaacgtcgcgtggcccgccatgccaggtggtcctcagcacgagcatgccccactcctgtgacacgaagagcttatagacagaggagagcggaacggagctgtcgccaaagcccaaggtccgaccacgcacgtccaatgtcacttcgtcaaagttgctgcacggcctcttaaaatagaattccgtcgtgggcatcgcgcccctggagctcgtcatattcacaaggcggcgcttgcaacgcttgccatagcctttccccatagggaggccaagtgcagcataaatgtatggtaccgcaagccccatgaggacgaccgcaagcaagagcatggccacagccgcaaagagataccctgcgggagaagtgaccctgtgtgtcgaggagatgccatcctgcctaacatatcccggatggagatagacatagaccatgagcacacatgccgcaatcgcagctgctgcacacagacagagccccagtgtcctgcgccacgcatccctaccgagcgtcgccctaaggtactcctcgagcttgtacggacgagttttggacaggcgaactaccccactatgctccggagcggaaccattgcctgggatgccggacggaccgtctgagactctcatgaccatgccaacccaccaatgaaatcgctcgcagagtctcctatcccagagaagaagccgacggcctcatcggcagtattgctaactgcactgccagcctcatcggcagcattaccaacccaacctttgacttcatctccaacagtcttgtcaccatcggcgggagcattccagatggtatctgtgacaactgacaccccaactccaaccgcaataccagctactactcctaacggcccagccgcagcgccaattgtcgcacccatttccgcatctatgagagcatctgtaacagcaacgcccactgcctctcctgcagcatttgccagcaggtctcgtcccaaagtatatgctccctgtgcaatagtttcgccccatcttgcaggttcagagagatccgcatcagcctgatattcatcgtaggcgccaactgccgtgtccataacgacagccactttccctaagacatccgcagttttactaagacattcggaagcaagagcagcgctcggcctctctaagttttccgcatttgaagccaggcagcgtgtggtcattctcacagtgttgtctgccgtcatcttatagccggaaaagatgaggtaaccgtctgcggttctcgtaatctttcctgctcttgcaatattctgcattgtcaggataaatgcttctgcaagagacagctcattcgaagcgatgtcgctcgcactctgtgtcgcagacccgatctgaaccacaggagatgtgaagtcggaacagatttgataccccaatggcgatgtgtccgcactatctgcctgcacatcaccagtcgcaaaattctctgtttcggaaaccagattgttcacattcgaaacagcggagcaataggagtccagcttgcctgtaaattcattgcattgcacgacaccgtcttcagccaacgagacaatctgacccccaccgtgtgacaaacccgatgctagggacaaaatcgatgagaacgcttgcaccagtccctctaccgtacatgccagctcattcgcttggccgggaagacccgcagagtcatcctgtacagccacagtacccgaatcagaggggcctgaagcgccacctagagtcggaggtacagcctcacacgctgccttaatagaccttgccgtatccgccaatgaggcagcggcggcagatccggccgcaagcccttctgagatagatgcagctaaagagccccaatcgccaacactgcttatagcagcgactccaccattgcctatgaggccacccgcctccaaagactgcctactctgtacagaagatgccgatgcctgagcacaagaatcggaggagctctgtagcgtagtggagagtgagtcaagatcgtctatgctgagacgtaacattgctactctctccttgctgtgaagctgcctgagcttccctctggcgctggtcctcaatggcattctgccggcgataatagtctgcctgttcagaaatctgcgagctgagggtatcgtaagcagagcggatgtccgccactgcctggcacaagttattgcctaggaactgtgccaccgaggagaggcttcccggatcagagagctgcaggtcactggtcgtactgttggcaagcccgttaagcccttcttggaccacttgcacctcgccctccgccgaattacaactcgcctgaatctgctcaagaatctgcaggtcagctatacatctaccgagctcttcataataatatggcatctacatcagtccagctgctgaatagagatctgcctggagattatcttgctggtgaagagccccatttgcgtcggtgactccggccgcaagagcatctgagtcattcgcaagactgctcatggcagcatacgctttatctgcaaagtcaattatcatctgcgctgcggcgccctcgcagctactcttcactgcagaaccagccgatgacaggcttcccaccgcatcagaaatagtcgatgatgtagcgaacagtcctgtagctgcatcttggttttgggcatcatttgtctgtatggtctcccccccataatccatttatcgctcctttcgaaagccattcatatactgctctgcaacctctcacgcaactctagaagccatgaataaccgactcatagccccagcccggatatcgagtctacccgcggaactgcgatgcgatgccttggccggtttcctccagggagctggccgtagtcctcagagcttcggcaatctcgtggatgaggtcacggatcgtgcccgatgcccgggcgcagctcgtagaagcgattggtgtaggcgtgggagacctcgccctcccactccgtctgcagctcgtcgagcagggtgtcatcctcacgatggcgtcatttacgttgctgtactcggtatcatactcgcccgcgcgggcgcgcatctggtccggggtgatcctaatctgtctgccattttgtattcctttctgtaacgcgcctaccggacgcgtccagtaagatccacagcgcggccgttggggagctatgtaggggctcggacaccccagggcaatcgtgcttattatagaccacctcctggacagctaaatcttcagccacttcatatggaggcctttgccacctgactttggtatttgccccgacgaatcagcattccgagtgcaacaggatggcccgctgcatgcaggcgtggcacgctccggagggctacgatgctggctgtctgagccctgtccattatattgacagggctcaaagttctacatatcaggaatgccatcgggcagcgcctccgcataggcgttgcactctgagaggatgattcccagcttggggaacacgatggcgcgacgggcgcggaaggacccgctgccgatctcgtggtagcaccatccatacttgtacgaggtctccgcctgcttgcagtcggtgaaatacgctgggtagcgcgtcgcacccatcccgcagtcacggctggcctcgacgaaggcatccgcgtcgtcgagtcccttgcgcctgacataggctcgcgcataggcctcattgctctcttgaaacgccttgacgacgtcctcctcgggccgctcgacaaacgccgcatggtactcacgaggcgcggggtcaaacggatagccgcgctccggtatgacgctctcgcagaagcaggcggaccaggcggggcggccctcggggaagggccgcaggtaccagccgccgccgaagccggggccttcaccacaccgcaggctccaagacgtcgatgacgacaccggcagtgtgtcacgctccctattgtcgtttgcgatggagagccccatctgagtgagtctgttgagggcgctcttgagctcagggttgggattgcccctggcgtccacgagcccgagaagccccagacgtctgatcatctgtcgcttccagggtcctcgctcggacttctcggcgaggatgcggcgagccgctgatccggtgctcgttcaccgcgacagagcacgtgtcgaagccgcccagcagcacgaacaggtcctcgcttgagcacctcacctacttgagatctgaatctccaaggcccgccctgcccctggcaaacagcatctccttgcctcctgaccaaacggggattggaaccctatgggcgagaggggcgaccgccatcgttcttgtcggtcttccccttctcgcgttgttcatcccgctcgatgctccttgcggcaagccgaccgatgacaaagccgccgacgacgatcacgacaagcgtgagcacgacggtgacaacgacgatcttgacgagcgtaccagcgtccacgacaacctccgatagtgggtgtgacaaaggggcaaacccctcctcatactagcgcaagatggcttccgttcacgagcgccccctgctcgacgagcgcgccaatcgtctcgttggggttgagctggctgcccgcgagctcggtaccatcaagcagcatgaggtcaacgtcttgcgacgcgtcatagcgggccgcctccgtacgggcgaggatcgaggagatgagacgtgcgctctgctccaccgtgaggccatagggcactcggaactcatagctttgccctgtggcggggagcttcacggagagaagaatcttgtcagccacagaaacctcctaccttgcacgcttgccagttgttctcacaccatcaccagaggctcttgcggcggcatcgcgctttgcctcgagatacgacggctcggtctttctgagcaggtcgttcatgtgctcccaggtgaagtcctggtagcccaggtacatgactccatcgatggagtcgcgatcgaacatgatgtcgttgcccggctccgtgaagcccacgggatgaaccaggccaaagtagtcccacacaagcccagtgctaatgtcctgctgcatgtacccaaagatcgtgacgaggtcgtcgctgcctgcaaggtgcacgaccgagcccagagggagccattgttctgtggtaagcatcttggttgtcgtcccttctatgcgtacgcctaattgtcgttgtcgtggtaggtgtcgatctcgtgctgagtggaagagatcttcccggaaaagcaattgacacggctttccgagtacgacttgccgacacgcgactcttcaagactccccctatagctttcgagatcgctctctagctgctcgatgaggtgccgcaacttctcagaggcgctggtgatggagtcgtcattcgagtctgccaggcgtctcatgaccgatgtggcattttccgatccggcgcacctgtcgatctccgccccaacgtctgtgagccttgccctcgcctcagagtttgccggggccagagcggtcaccttcggcttggcagcccgggcgatggcaagctgctgctcgcggtcatcgaccagtgccgagtacttggatatcctctgggagtactcgtcagcgctgccctgccaatagcgtctctgaccacagtagtagtcaagcctgccgtacaacgagctcagactcatggttatctctccttccttcgacgcggtagcccccacctcacttcgggtagtcagggatgtcgaggagcgcctcgaggaggtcacccgaggggtagaagtcgatcgaggtgaaggcggtcttccgtttccactcgccgtccgggtcctgcaggtcgaggctcacaccctcgtgccaggcgttgcagtcgctgaacaacgcaccggcctcgctcacggcgatgaccttacgctggcgcagcttgccgcgcccgccatccggccagcgccagcccatctcgtagctcggctcgacctcggtcgtatcgtcgacgtaggccttgaaccccctgtacccgcccctcatgtaggtggagagcctgatcgcgggctcggggtctgcgcccttccttttcgcgattgcggcgagcatggcctcgtcaccctggttcagggccctaccaagcgcgattccctcctcctcgcccccgtcgacaaacgagacgtgccctcccctcttcgcggccgcgaagggatagcgcctgggcacgaatatctcgcggaacttcgcaggccacaggctgcggtcttccgggaacggtctcagctgccagcccccacccggggcagggacgaccccgcaggcgccctccgcaccgagcgtcacgcccatggtgcgcttctggggtgcgatgctatccgctatacccacccccatctggccgagggccctcagggctcgctcgagctcggggttggggtttccctcctcgtccacccagcccgatggggcgagccggtccaccaccgccctcctccacgggccgcgctcgggctttttctcctcgacgagatcgaggcggagcttataggcattcaccacgacggcgcagccgtcgaacccgttgagcaacacgaagaggtcctttgtcgagaagcgcagctcctcgagcgagaggctcgccaggtctaccttcttcttccttcctaacagcatgtgtgcctccaagcactaaacgattatccgaaagggtgggctatgccgctcactccgggtagtcggggatatcgaggagcgcctcgaggaggtcgcccgaggggtagaagtcgatggaggtaaaggccgtcttccgtttccactcgccgtcggggtcgtccaagctgaggctcatcccctcgtgccaggcgttgcagaagctgagcagcgcgcccgccttactcactgccacgagctgcctcatccgcagcttgccgcgcccgccgtccggccagcgccagcccatctcgtagctcggttcgacctcggtcatgtcctggacgtaggccttgaaccccctgtacccgcccttcatgtaggcggagagcctgaccatgggctcggggtccacgcctttcctcctcgcgagcacggcgagcgtcgcctcatcgccttgtgcgagcgccctgccgaacgcctctccctcgttcccctcctcggcgaacgagacatgccctcccctctccgcgggcgagaaggggtagcgcctgggcacgaatatctcgcggaacttcgcaggccacaggctgcggtcgtccgggaacggcctcagctgccagccgcctcccggggcaggcacgaccccacaggcgccctccgccccgagcgtcacgcccatggtgcgctttctggacgccggcttgtccgctatgcccacccccatctgcccgagggccctcagggcacactcgagctcggggttggggtttccctcctcgtccacccagcccgagggggcgaggcggtccaccaccgccctcctccaggggccccgctcgggctttttctcctcgacgaggtcgaggcggagcttgaacgggtttaccacgacggcgcagccgtcgtagccgttgagcaacacgaagaggtcctctgtcgagaagcgcagctcctcgagcgtgaggtccgctaggtctaccttcttcttccttccaaacagcatgtgtgcctccaatagagtgttttcattgatgtcggcgtgcgaaagggcgcctcgattactggggggcgaacgcaaaggtggcgctcggcgactccctctgggcgctagcgactgtgttaatcatatcctgcttggcctgactgttgtcaaagatcttttggccttggtccaggagaaagtccactccgcagccgatggccatgccagcgacggcgcccaccgggcctccgaagcaggcaccgaccacagctcccactaccttgccaacaccccatttcacgaggccctcgcccccttccaccatggcggcagcggacttctgagcacggtcgccggaggttgtctggtacgcctccctggacttctggaatgtgtcggcgatggtgacaacgtcgccgacgaaccccagcgtcttgccggcaccctttgcgagcttgcctgcagaggaaccgaggctcgcggcgtcatccaatgccggggtggcagaagcaagtccatccatgtcatctgctaccacagaggctttcttgcacagcttgctcgagaggtacgccccgatttctttcccaccatcgcgcaggttctcgtaagcgtcaattgcctcggaactaagacgcgcatcgtccagtttctcgaaaaagcgagacttaaatgtgcccgtaccgaagaagctcgcgttgaaccccgtggcttcggctccgatggcaagggcggcacgatcgaaggagtggtcttcgtcactgcgcagtcccaccacgttgagcagaaacgtcccgggggccccagaagcgaggctcttcgcatagccggcgaagcttaccatcgaaccaaacgcgttcgcgtgcccgagggtgctcccaagcgtactgaggatcctcttcgcccacttgtatgtatcgctcttcgtgaccgacgtcgcggcagagttggccctcgctgccccggacatgccgtactcgtcggccatcgtgtcacgcgtcgcgaagatcattccgctgtctatgaacttgcccttgtccaaggacgtggagtccgtgctgctcgagtaggccgactcgaactcggacgcggacgactggagcctcgcccacgccttcgagatgcgctggaccttgtcctgctgttgggagaggtcttcttgaagtgaggagaggctcctggtgattcccccagcccctcttagaccagagagggcagcgatggcatcccccaccttggagctgaggtccaccatctcctcccgagcctcgtcgcagaagagcccgactctgccgtcggtgtcgcactccaccatgtccccgaaggccacagacgcccccgcctcggacatcagcgcatccctgtttccctggatggtcttcgcttcgcagacgagaccgacgaacaccttgtcgagttgcgccatcgcctggctgaagatgcgtgcgttggtctcgatgttgaccgaggcctttgcctgtgcttcggcccaatctcctgactggacactcgagaagctcaagttctccttcgacgtcgtggcaatggtgtcgagcagcctgccttcaatgtcgttgatgcgcttctgtcccgactcaagctcgcttaccttaaatctcagtacggacaaggctctcacctccaatactattcgttaccatgcagcatcagatgcctgctagcgctcgggagggcgatacctgacctgcgtgaagtccttctcccagacgtaggtcgaggcaaggtaggtgtctttgtctatgaatctgccttccgcgttgcggatgagccccgcgtggatcagcacgtcctgctccagcgccagggtgcagttgtcgatgcaggtaagcgtccccttaaatgcggaggcagcctcgccttcccaagcgccaaagagctcgcttcccaggtctgccgcactcgtctcgattgccgcgtagtcttgagcgatgccatcataggcaactgccgaattcagcgccgcctgttcgtctacaaagatgtgtccagccataaccaacccccaaactcagtccgagattgttgcagctacttgccctgccttgtcttagcctcttgatacagcccggacgcagctgtaagagccctttggtgcttgattgccgcgcggtccaaaaaccctatctgaaggacctcggcaaccatgtcgctgtcgaagaagtagtccttggtggcatcttggcggccttccggccatgggtagcccatgtagtcccacagccggcaggttacgccatcgaacgccatgcaccccgcgaccaccacggggcgctcaccgtccttgagcttcacgaccgagccaatggggaggtatgagacgacgatccccggctcctggccctgttccatgcccgatccctctgttgtgtcagtcatctcttggctcccttgtctctttcaggagatagaacgcttcgtctgccagacggaagcgctcttctggctccacgcgggcacttccctccttgggcaggcgcgtccctcttacgaatatcccgttgagcgacccaaggtcctgtacggtgatccctccaccatccgtcgagagacgggcatggcggcggctgaggtttccgtttccttcgatctggacgtcggcatgcacagagcgccccaccgtcaccggtgctgagaggtcaacgctatgcctgctgccatcgcgttcgcgcacgaggacgtaggtcggccggcggccaccgtctgccgctgcctgcgatgtcgtgcctgcccccgaccccagaagcaccgtcctgctctcgtgcaggctcgcgggtgcggaaggcgtggactcagcgacctcgtctgcaggtccaacgtgggtgccgacagagaagggtgcggtgggcgagatgtccgccacaccgtttacggcccgctttgccacgccctgacgggccgtgacctcgaaggccgaggcgcggtgagagagcatgccgaccatgtcgaaggctgccgcacaagatggggtgccaccccctctgccgagtggggaaggtgtatggagcgggacggaagccgcctgagcagacggtgcccctccctcgccacgatccatgcccagctccacggtcaaaaacgtctgcagcgcggatatggagagcacgggagtgcggcggacgaagtcgtcgagctgctcccgcaggcggttgtcgtcatcgaccacaaacttcacatggctgcgcgccgagaggtacgcgaacatcgcgaggggtgccatccctggaggctcgggaccgcctgagagcggaacgaacgcaagccgcagggcaccgccatccgctatgtaggcgtggtctgggtcaaagcacatgccgctcgtgggatagccacgcttcgtgcagagagccatcgcctcgtacaccgtggcaagcatgccgagatactgggcgctcgtcacctttgccttcaggtagtccctgagcctggcgagacccgtcacgtcgtagtagaggcgcggcggcacggcgtcctgctcgtaggcgaaggggagcaggaaggatttgccggagtgtacgagccactcggcctgcgcgtactccagcttctcgcgcttctcgcccacgacctgcagcgtgcgcgagccgctgtgccagtccttgcgctccgagaacctcatcgcacgtcgcccccgtccgcattggaggcagagagcaggcggaccgcgacggcgtccccgcgcagggcgaggtagccgtcgtcgaccgccgcgggcctgcggtattcgggcagcgagcgcgcatagcggaacatggtctggtcaccgaagccgccaccaacccacacgccgttgccgtaggcggaaagcgttttgtaccagtcctcgtacagcgacttgcagcgccacgcctcgcaggccgcaaccaggcccgtgatgcccttgccctgctccttggcgatgtagtccttgagctgcttggacgccgtggcgggcagcgcggcgacgtcctcgacgacgctcgtaagcacgaggacgtccaccgggtcgcgcgccaggatcgcaggcagcagcagctcgggagccttctccgggtcctgcaccacgcgctcgccggcgtcctcgcccagcaggcgtgcggtgtcaaccaccaggtaggagacgctggacgcgacgaggacctccctgaggccggcaaggtagcgtgcgttggcctccgcatcgttgcccaccacgagcatcgggaaacgcgagagggggaagcacgcgggctccacggagagcttcccaaggcccacgggaagcattccctccgccacctgggagacgtccacgtcacccacgtgcacgcggtgcggcagtaccgggatagcacgcgcacgtccggagcactccatgcatcgacgacgcgccagcttcgccacggccttcgcgtccgagatcccctcagcggccatggcggcgccctggaactcgaacgtctccttgccgatcgtgacgtagccacgccggtcctgccgcggtacgacggtgggtggcttgtgcccgaggagcgtgatcatgtcggactcgtcgttgagcatgaggaccacgctcgaggcgaagttcgagcgcaggcgcatgcgggcggcgctcgccgagctcgcgctcacgaggaagtggatgccgtagcgcgctgcgtcacgcgtgagcgtgacgagcgtgtcctcgtagccgggatagaggtcatagaaggccgcgatgttcgcaatggccacgacgaccctgccgataggcgcgtcggggtggctcgcgtcgtactcctcgagggtgcagccggcctcggccagaacggcgcggcgctcgtcgcactcgcgctggaccatacggaagaggttgcccgtgcgctcggcatcgcccgctatcaccaccccaccgcactggggcagctgggcgagcgttgtcatcgtgccggagcccatgtccaggacgtagaaagagacctgctcgggcacataatcctcggcgagcgagtagagcgccgtggccacgagcgagtccgcacctgagccctgggcgccgtagaccatgaggttgcccgccttggcaaggtccaccgtgtaggggagctggcgctggcggccggggtcgtccgcctcgcccagcacggcctcgcaggccccgcctggggcaaggccaaacttctcacgcagcgcatcgacggggatgcgcgcgggaagcgggtcgagccagaggcgcttagcctccttgccctgcgccttggcgacggcgcagatctggtcgagcacggcgttgagctcggactcgtctgtcttcgcggtcgtcgagggcggcttcgcgctgtcgatcgcgtcacaggtgttatccacgagctcgagcgtgtcgtccaccttgggctcgaactcggcgctcggggcatacacggcgcccgcataggcagcctgtccgccgcagaagagctcgttgtagcccacgagcatgtagtagcgcccgggcagcgtgatctcggccgcgtccgggcggcggatcatctccttggagtcgctggcgtcggaaaccttgaggcacaccttgaagtgcgagttggaccagatctggtcgttcaccacgcccgtgggcttctgggtggcgaggatcaggtgcacgcccagggagcggccgatgcgtgcggcggagatgagctcgtccatgaactcgggctcctgctgcttgagctcggcgaactcatcagccacgatgaagaggtgtggcagtggctccatgagtacgcctcgacggcagtagcgcaggtacttgtatatgtccatcgtcgcctcccccgtcacgttacgtgcgtggttgaaggcgtcctggcgtcgcttgagctcgctcttgatggagacaagcgagcgtgagatggcggcgccgtccaggttggtgatagtgccagcgagatgcggcaggcggattcgctcgttgtcgaaggcgccggcaaggccaccgcccttgtagtcgatgagcacgaaggccacttggtcgggggcgtagttcacgcacatcgagaggatgtaggtgatgatgaactccgacttgccggagcccgtggtaccggcgatgaggccgtgggggccgtgtgccttctcgtgcagattgagcgtggcgcactcgcctgcggcatccctgcccacgggggttacgagcgttcgggacgcgtcgtcgtccgcccagcgctggccgatgttgagctgtgccacgttacccacctcgaacatctcgaggaagccaagagagttggggagggctgagcgctgggagggcatgtccaggcgcacccgcacgaggtcgagtgagaaccggcgcgcgtcggcctggcccacgaggacgtccggctcgaagcgcaccatggtgccggcgacgtcgtcccggtcgaacatacaggcggagccttcggagctcacgaccttagagagctgggccgtggaccccatgccctggagcgccccctcattggtgaggtcgatgacgtaggagcactcacgcggcaggtctgaaagcccctcgcccaggaagacgagcgaaaatcccaggttgccgtgcatgcgctccagctcgctgattgcgtccgagcgctcgcagagcgccttgttcgcgcagatcacgaggtagtaggtaccgcagtcggccaccttctcgaagcgctcctcgcggcgctggtcgagcacgtgcgagaggtgggcgccaacgagcgtgaggtcatcgtagtcgcaggcgaggtagcgcacggtcccggagtcgtcgaacaggtgcggtagcgagcgtgcgaagccccactccgcctcctcagcgagatcggccaccagcaccatcttcacgtcctggtagctatagtaggccgcagcctgcatcatgaggccgcgcacaaatgcccagacgcgggcgcgcgggccgacgatgccggcaagcgggtgcttggcggggtcgaaggcgagaggaacccccttcaccaccggtgggttctcggcaagctttgagaccttgtccagcagcgggtcctcctccatagagaagcgccgttgcgggaagcggaggtcggcgtcgagctcggtgttgccgctccccacgcgcagctccatgaagtcgtcgtggtccaggccgcggttcatgagatgcggcgagagcgaggccacgtgctgctcgatggcaggcatatcctggcggcgcaggcgcaggacctccgcctgcctctcgcactcctcggcgaaggcggcctccatcctgttgaggtagtcggtgtagcggctctggcggcgccgctcctcctccgcgtcgcgacgacgcgtgtaggagcgcgagatcacgggccagatcaccatgcccgcaagcatcgatacgcacatcgcaatcgagggcaggccgctcatcacgctaccaccggccatgatgccctgcacggcattggcagcgcagaacaccgacgccatccccatgagaaacgagggacccatctgcatgatagccggcttatcgtcgggcttgctgggctggggtggctcgtccacctggaaggcgcgcctgtggatcgtgtaggagagcctcggcgcggggaagaacaggcacttctcccccgtgagctcgctcgcaggcgggcacgccgcccggaaagcgtcgtggccgatcaggcccataccctcgagatgaccaaacgtgacgccacgagggctgtttgagacaagcaggcgcctgcccgccatgatgctcagccccaggatactcacaacgtctcccggggcgagcgcgacgcgctggttggcggggatgagccgcccgttcacgaaggtgccgttcgcgctgccgaggtccgtcacgcagacgccctcgcccacgaggtcgatgcgcgcgtggcgctcggagacgtagggagagtcgtagcggagcgtcgcggcaggactgcggccgatgaggacgctggcgtcgcaggagaacccgcgcttctcgaaacggcgcaggccacctgtcgagggataggagaacagaaccgcctccgtgccgtcctgggcggagcggatggagaagacggcctcttcgtcgaggggaagggtcgccttttccatcggctcgcccgagggaccgaggacctcgtgcgcatgggcaggccgcaccgtgcaggcgccgtcctccatctggatcacggctgcgccagggtgggcgcccacgaacagcactgactgggtgtccgggtcgaaagcgctcacgcgcatcgaaccgtcggctatgagcgtgaggagcaggcttgccatgcgcatccttcctgtgtggcgtgggtcggtggggccggggcaacagcagagccgaggccacggcggagccgcccgcagacggccccaccgcagggggtctagccgcggaacgaggcggcgatgctagagtcggtctcctccaggttctgggccgtggagtcgagggcctgggcgatctcgttgatgaggtcctgggccttcacgaagcccgggcgaagctctgcgaagcgctcggcgtacgagtcgctcgcggcaccctcccactcgctgcgcagggcgttgagcagggagtccatgttggagatgacactgccgacgttctcagcctcgttgcggtactgaccggcgcggctacgcatctgatccggggtgatcctaatctgaccagccattctttgtcctttcctcgagtttcggccgacgcagcgcgcgaaggccgccgttccctatcgacactcgcgacgcgtgcgccgcgaggaatcgtccgctagtgtccgaaggggttcctcctcgactccatggccgcatgacgcctgcgcgccagcagcaccacggcaaccacgatgcccgccgccacgatggcccctcccacgacgcgagcgagcaggtccggtgtggcaagcacgtactccacgacgttgcccgtcacgcgcacgcccttgcaggcggccgtcgactcgttgcccgccaggtcgtgcgcgaccacgcggtagctgtgtacggtatcgtcggacggcagtcgcacggagataggcatgccgtcctgcctggtatcccaggaggcgacctccttgccgtccatgtacaccgtcaggtcgcgaagtccgaggttatcggagccgtctgcaagcacggtcttgctcgggtcgaggtaggtcgtgtcgctcgagagccccacgagccctgcctcaggcgccgtggagtcgacggcgaacgagacggggaagtcgccttcgccgtctatgcccttgccctccatcgtgttctgtgagaggttgcccgctgcgtccgtggaagtgagggtcacgcgatagaagccgtcctgcgcgaacaggctggctggcagcgtgtaggtcgtcgaactccagccctggtcatcctcgttcgggtcgagcgagaagtcctgcccggcaacgaggtcgcgcgagcgatcgtccgtggcaaggctcacgcgcgatgcagaggtgtccaggccgctcacgttcacctcaaccacctggacgtcgcgcggctgcctgagataggcgcccacgatgtcgtccgagtcgcctgtgaggtagtacgtggagccgaagcggttcactgagaagcgcaccgtctcggtcgtcgtgttgccggcgaggtccatgccggtggcggtgtaggtgtagacgtcgtcgtacctcggctccgcaggcacgtccgcaaagcccgtacgcatgtcggtcgccgtggactgctcgtactcgccgtcgaagtacgcatcacccgtgcgggcaccaacgagctcggtgcccgagcccaacgggtcgaggttcgtgtcggagaagctcgcggagggcgcgaggtcgccagcgtatgcggtgctgttcgccacgccgtcgatgttcacctgcggggccgtcatgtcgatgacaaactcgccagagtcgtagggctcggccacgttgcctgcgaggtcggtggcggcgaccttcagctggtagtgcgtctcgcccgcgaaggaggccgtcgcctgccacacggagcgctccttcgtctcgctccacccgctcacggagggcgccacgccaccggagagcgcctcggcgtcgattgacccgccctcgggcgagaagttcctgtcgtccaccacgatcgtggcggtgcgtgacgccttgtagtacatgccattggccacgtcgtcgttgtcataggagaccctgagtgagggcgccgtcgtgtccaccacgaagtcgtcggagacaacgttggaggcatggcccgcggggtccgtgaaggaagcctccaggtgccagtccgcatcctcgtcgcactcgatagaggcgacgtagacggccgtaccgtcaggctgctccacgggcgagaagtccttcgcgctcagcgtcgtgaagggatggtctgcgccgtcgcgatacgcggccgcgatctgcgtgtctggcgcataggcggcgagcaggtcaaagttggactcgctcacggagaacgtggcagtgcgtccggcgttgtagtacttgccgttgcggacatcgttgttgtcgtaggtgacgctgatctgcggtgcctcaatgtctatcgcgatacccgtcgcgccggccgggaggttcgtcacccccacagcgacgaagctgtctatgctcgcaacgttgccggcaacgtccgcgacgctcgcccaggagccgtcgagcgccatacgcgcgccgtcgccgtcgaaggcgagccacgccgtgcccgacaggccatccgcggcgaggttgcaaccggtcgagagcgtcgccgtgccggcggcgtgtgcctggaacgtgcttgcgtcaacgccggagaggttgtcgctcagagagagcgtccccgtctccctcccggtggcgaagacccacccccagggctttccgcggttctcgccagaggagtaaacgggaaagggcgaggtctctgagaagttggcgatgcccagctcgggggcagtgtagtccacgccaaaggagagctcctgcgtgagggggccctgcccgtcgagcgtgcgcgcgacgccccggtaggagacctccacctggtactcgccctcgcgcggcagtgtgctcccctcggcgcagggaagcgtgaccgtcgccgtccaggtggtctgggagtcgtcggtcgcctggaagctatcgggcgtcagcgagaacgcaagatcctccgagcccgagtctggaatcgcgacggtgcccgacgccagcgaggccccactcgcaagcacccggtacacggggagccatgggtccacgacgctcacctggatggaggcgtcgccgcggtggtagtgcgagttcgcggaggcgggagtgtcctcgccatccacaatctgcgcggagagcgcgaggttcgtccctttgtccacgaggacggacgagaagtcccagccctccttcgtgcgttcctcgtccgagagggaggagatgtagtcggcaagcgtcgcggagagcatgttgccgcactcgtccgatgcctcgatgcgaatgtcttcgagcgagtagagcccctcgccctccaagggaatctcggcccagccgtcggagccgacggagggtgaaagctccgtctgcgccttctctgccgaggcgccgaggccgtttgcgtaggagagggtcgcgcggaccgagctcgcgtcgagcccggaggtgcccttctcgctggcgcccgccgcatcggcactcgtgccgtcctcgtgggggaagaggtcctgcaggcgcacgcggatggtgcggctggagcccgcgagcacgcgcgagccgtccggtaacgaggcgatggtcttctcgccctcgtacgctgcgcccgtcacctgcggcgccgtcgtatccacgccaaactccaccgaggagcctcgccagaagaggaggtggctgaagctggctgagtaccagccgtccggcaagtcacccgaggagaggggcacgtcgagctggtaccagcccctcctgccggggaccgccacgaggcggcttgcgccggaggcgtcgacggcgacgttggggatgtcctgcctcgcgcctttcgcatccgtcctcgtgacaccgaagtgcccctcgaatcccggcagggcggcgatgagaggcgcgagacggtccctcaccgcgtacgtcaaggtcgagtcggtcgggtaaaacacgcgcccgtccgagatctcgcgcaccttgtcgggactcgacgtctgtatcgagaagccatacgagaggctcccctcccgctgcatgggctcggccgtctccaccgcgataccggagatgccccagccggcggcggcagccgattctgagagcgcgtaggtcgcgctgttgccggccttgtcggtcacggtgatgcggacgtcggccaggtcatagtagccatcctcgcccaacgtgaactcgtaggagccatctgcgcctcgcgagggctcgcccaggtcgaccttctcgccgtctgcgtctcccgcagcctcgctgcgcgacgccatcaccgagcacgaggcgacatcggaggcgtccgtggcggagccgccggcgaggtcggcaagcttgagggagacggtcgtgcccgacgagacgagcaccttgctgccatccgaaagcgcgctcacgctgcccttgtcgattccacccaaaacgctggcagaggagaccttcggcgccgtacggtctatcacgaaacttgcggagacggtggcagcacctccggggatgagcgacgagaggcttctgaacctggcgccggcacccatgtaggagacctcgaccgtgtgcctgccctcgtcggtgacggtagggagcacgcatgagaaggcgtcgtccgggtcactgccctgcgcgaacgcgctcggctggactgagacctccttgccgtccaccttcacggtgaggggattccaggtcgcgtccaccatgagctcggagaagagcggatcggctacagtgacggtgggcacgacctgggcggcgttgctcagcgtgacggaaccgcccgcgtccgtggggtcatcctcgtcgcccgtggcaaccaccttgacggatgtcgtatacgagccggaaagcaccctcagcttggagagcgaggccaccgtggcgtccttcgcacccgacaggaggtcggagagcctggccgtcgtctcgttgcccgcgacgtcggagacgctcaccgtcgcggaggagaggtcataggtgccttctccccccaatgtcgacgcagagagctcgaacgtcgcgacgctatccttcacgcttccccgcacggtggcgccgtccagcttgagctcggcgctcgtggcgtcgacgcccgagacctcctcgccgtccgggctgggatctggggcggcagcgtcctccacgcccacactgagcttgatgccgctggcatccgtggtgagcgtgccgtcagagatccagcacgtatccgccgagattgcgtctcccgaggagagcgtggcggcgagactgcctgggcccacctttggcgccagggtgtcacgggccaccgcgacgtacagcacctggccggcgctgtacgtcgttgagattccagagacggcgttcgcgcaggtcatgtccctggcaagcttgaggtagacgctcgagcccgaaaggcccgagagctcgaggacatcccctgccctgtcgctcgcgaaagtgccgtctgcctcgagctggtaggtatcggagagagtcgcgccatcgtctgccgcagaggccttcagggaaagcgtcgtgtcggaggcgttgcgccacacgaaggcagagccgtcgtcgcgtgtacccacggtagctgcgtgcacgtcgtcgccatcgcccatctcgatgtcagcgagggcgtcgacgggagccactgccacgtccgccgccctcgtgggggttgcggcgagaaggaccttcgagtccagctccgagagctcgggcgtcgtaaccccgcgacacgtggagccccacgccacgaagtcggagagcttgccgccgtccgtcgaggtgggataggccacgttgggcagcagggcgaaggcctcgcccctcacgaagcaatctgccacagatgggtagcgccaggtggacatcgagaagagggcgcgctcgcgctgctcgtctccgagccacgtcggcacgtccacgccataggggaccgccagcgtctggacatcatccctcacgcggaaggtgccctgcgagaaaggcgaacgggcatcgacgaggctcggggaggctggctggccctggatcgcggcctggcctctcggggcgtcagcaggcgcaccctcggcatgtgccgggcacccaaggccaagcgtgaggccgagcgtgaggctgagccccagcgtcactatcacgtttccgcgcaggcacaccctggaggacctgccttccggggcgtccgtcgcattcttgtcagcgctgctcagaatcattggtcccctcgcctcccagcagggtcgtcatcgattccgatccggatgcgccggcagcctgcgagagaagcgtcgtatccgactcggagggagcctttgacgcctgggcgggcacggtctccgtggctcgggtgcgcgcctgtcccttggacatctcgggcacgtcctccagaagcgtcgtatccgactcggaggacggctcctctgcctgggcatcagtcattccggtggtgcgccggccaaagaagcgtacgtggagagaaccgctcggtgcctccgcggagcccagtgcccctcctctccagctcggcgtggcaagcgcaccggcggcgaaacggctcacgccctcctcgcgcatctcctggattgccgcgcgcgccgtggcgcccgtcagctcgccgcgcacctcacggatgtgatgggtcacgaagtaggcgacggctgcgatggcaagaaccacggcaactgcatacccaaccatctcaaccatgccgaaagcctgcacgctcattgttgcaccgtccttgcgtccacgaacgcatcatcgattgcctggctcacgccatccgacgtcgagagcgcgcttgccttctctgcgtcaaggagaggcgtggtcggcgaggtctcgtccgccagcctgcgggcgtcggaggcgagggcctccatgtccttctcggacacgtcgtccgcacggaacttgcgggggtaggtcgtgagagagtcgagcgccaggttcgcggtctcgaggcgcatgacgtcgttgtcggagtctgccatcgtcgcgacaagcttctggaggttcgcaaagtagggcccgtagacgccctcgtcggacccctcgttaatgagcgggactatgtcctggttgaactcggcgataccggcgtagacctctgctaggtcgtggtttttaaagtccgggtcgctcgccgcggcacccatccactcgacggcggcgcggatgcgcgcggagcgcccttccacctgcgtcgtgcggtcgagcgacgacgtctcggcagggtccacgccgaagtcgtaccagtacagctttccgatgtcaaaggcgagcccggcgtagccctcagaggagcgcagctggtccaggttggggagcagagcagacctcagctccgcctcctcgtcggttgtgaacgtaccgtcctcgcgaaagcgctctacaagcccctcgtagggatccgtctcctgcggctttatctgcgcggctcgctcgtaggccgccacggcctcgctggcgtctgaggtctgcctgccgatctccatccagtggtcatagtcgctgttcgtcgtgacgacgcggccgacggttcccacgatgccgacggcaagggccacgcacgccgctgcggcaagctcgacaaacgtcctccacgtgcatctcagcaacgcatggcgacgctcatcctcatcggagcggtgcatgagcgcgtgggccatctcggcgcagtccgcgtagcgagcatcggggtcgggctgcgtcgcatgcgcaacgacgcgctcgatgccctcggagagttcggggcgaatctggcgcacagcaggcagctcgccggctgaattcgctggatccttgcctgtgagcagacagtacatggtcgcgccgagcgagtacacgtcggaacggacgtccgtgccgcggttggggtcggcctgctcgggaggcgcgtagccacgcgtgccgagaaggtcctcgtctacgaggccgttgtcctcgacgtccttgtggagctcgcgggcaatgccaaagtcgatcacggcgacgctgccgtttggcttgagcatcacgttcgagggcttcatgtcgcgatagatgaccgggggattcagctggtgcaagtactcgaggacgtcgcagagttggatggcccagctcgctaccgcgtcctcgggctgcggtcccatagagaagaccacgtcggcgagcgtgcggccctctacgtaatccatgatcacgtagagcgtgcccgactcgtcgacgatgtccacgatgcgaggaatcgcggggtgatcgaagcgcttgatcatgttcgcttcggtgacgatgcctttaacgatcaggtcgcgcatggccgggtcttcgacgcacttgatctccttggcggcccactgcttgttgagcaccttgtcgagcgcaaggtagacggtagacatgccaccgctgccgataaccgtaagcagctggtagcggccgcctatgaggtgtgctccgcagaccgccggtacagcctcgacgcgctgcttgccctcgccaccagacggagcgtcgtcgtggtctcccactgcatcaccgtggtctcccactgcatcctgaacgtccgtgatcgcatcctctcgtctagctcattcttctggatagaaagtatagtgcaatcgttctgagactatcaaggagttttcaggagactgtgaggatgagggcagcacttgcaccctcgcttgtacccgcgcgctactcagactttggtcccaggatccactcgggactttgacacttagccgacaatcatcgaactaattcaagccacaaatttctgggtctacctgggatttgtggcttttcttatacgtcggtttatggtagacgtatctgtggtatttggtgtcagttgcatgtggattgggtaaagatatgaaggttcagctaacaaggaccaagaccagcgagaccttctatatagccaagacctatcgggacaggaagaccggcagatccacctcaaagatcgtaaggagactcgggaccagatccgagctcaaggggatgctcccctcgggcacggacgtgatgggctgggccagggaagaggcaaggcggatgacagagcaggagcgcgggctcacccgcaaggtcacggtgtcctatgaccctgcgaggcagatagctgagccctgtcaatataatggacagggctcagtctcctttacctccgtgaccgaggagggcgaggtcgccgagaggtgcattctctccgtcgacgataggaaggtcgagaaggaggcctcctgggacggcttctacggcctggctacctcgctcgacgacgaggatgtcctgggcatcgtgaagctcgccgccggacgctggcaggtcgaggagtgctttcgcatcatgaagggcgagtttgaggcccgtcccgtcttcctctcgcgcagggaccgcatcgaggcccacttcctcacctgctttttggcacttctcatctaccggatcctcgagaagaggctgggcggcaggttcagctgccctgtgatcgtcgacaccctaagaggtatgcagatggaggaggttacaggcgagggttggcgccccctctacatgaggaccgaggtaaccgatgcgctccatgatgccttcggcttcaggaccgactttaagatcgttcctgtgcggcagatgaacaagatcgtcaggaagacccaccggaagggcccgattaccacaaagaaggaggctggcaaggatatcaaataactatcttcaccagcccttatgtgcaagctatgtagggttaagtgtcaaagaccgaagtatagtgcgatcgttctgagactatcatggagttttcaggagactgtgaggatgagggcagtgcttgcgccctcgcttgtacccgcgcgctactcagactttgggcccaggatccactcggcaagcccctcgtcatgcttcgcgcgctctcgcccagcacggccggtatacgttgacctcgactcctttatgcgagaggtaatggtctgcagcagctcgggggtagcagcgtcattgggtacaaacagcaggccattcatgtcctcgttcctgaacgcccagttgatgccaatggcgttgtagatgacggagccatccttgccctggtccttgaggaagcagacgccgccaggaaccttcgctgtcttgccggagagggcaaaccacgggatgcggttcgtaggggacgccgagctctcaacgtagccatagtcctcgatgctcacacggtagtcgcactcgagggacgagaggggcatggccgatgcattggtgcatccatgcttggagaaccagttgtacacgacgcccttcctgccagcgagcgccatctgcggacgcaccgcaaagactatcccgaacaccatgagagccaggaacagcagcgtcaaacccaggtctttgaaaagatagcctagagaggcaagggggagcagcacgagcgcaccgacgacggcgaggaacacacctgcgacgcgctggagcttcccattctgagcgacaaacagactcttgaacccattgcagttcatatgaacggcgtacgtacaattcgaattcattgtgtattccctcttatctcttatccctggtcagtatctgtaattctgcattatataaaattgccttcttaatcataacatccgcagctcgccattctcaatgccaaacgtaatgatgttgtaagttttcgaggcttctgcagtttgtgtggtcagaacgcgcccatcctaagccgccagcttcgtccagggcagctctatcgggaaccccgagcacctgagcatcaccatggccctcaggctgtcgaagctgcggaagccgtaggccatcttggccgtgagctcgatattgctgtccacggcctcggccctagggaaacgatgattaattcacctcgatgaggccagtggggccacacgctgtatgacatcggctcaaaatgtctcgaaccacgcagtgcccatacccacatagatgcctatctgtcttctggatatggtatagctacatccacacattccagcatatccaaaaggaagatatgggcagccagatgagcttttaggaccttaaatcctaaggtctgaggagaaagatcaggcgagaggcactcttagagcggatggatgcaatcgttgtgtgggatagctggattgttctggtagataccagctaccactgacaggctcctgtcaggcatgtgcgcactgcaaagacaaagctttaggatgtatcctgctttaggttatgtttgggctctcagacgagggaacttaaagatgctatcctggattgtcggtcctggtagcgcttctgtgcacgtagacctcatgcaagcgcaggtaccagatgcgacgacacttgcgaagatgcgccatagccttaaagcgagaggagttcggcaaagcttgtgcttcacgacctggacttagagctcgaaaaggcagggatcacggcgcggggcggctctatcgtggacgcgaccttcatctgggcccttaagcttaacgaagaacaaggaccacgcacgcgacccttaaagcgcaccagtccaagaaagactaactattaaaagtcaatcatgaaaaatggctgagtacctccagcatagttaggctccctgaactgtaagcggcttaggcaagatcgaaggcatctttggctggaccgtcgcggtggctgcgatgccgaagagcaagacatggatgaggcacatctcgtgcagcagctccatgcaggcatccctttacatccctgtggctgtatctttagctgagtgagtccgcaaggagtgcatgtgggccttgggaaggccatggaaggcgccctcaacgtaggccttgaaggtggatatcacccttgtggaccatgggaagggatacatccccgtccgctctgtcgtactccctttagacgagcccgcaaaacgaagagaggccggctgctatgccgctccagccatccgcccttatcttcgatgtatggcagagccgctcatgccccacctggcgccagcaatctttcgagcacccctttgcgcagcgcaggaggcagcagccctgcctgccgctgttaagcatcggctgctgctttgtgccgcggcccgcccttgcctggtgccttggcgccgatatagaagtcgtccacctcgtgtgtgtcagctgcaaggacactgaacgcactgcgatctggcccaggcgagcgtatccttaaaaggacccgccctgccgtctttaagctgcagcctatctgccttctgcagggcgcaggcgctgatccttgccttctgggcggacatgagccatatcgcccacgaaccacttcctgagctcgagatgcgtgccctccatcaatagtccctgcgctcacgctcacctggtgcgagcacttcgtgcactgccacttgtgcgcgcggcctcagaccttcgagcaggacgtattggcgcacaccgggcagacaaagccgccggagaccttctcctcgagcagcctcccctcgcacgactcctcgtctgagaacctctccaaaaggcccatcaatgtctctttgctctcgcattcgcgcctgctcagagcgcctgcatgcccctttaccatctctttctttgccctctcggatgcatcaaccttgcatcctcattgtacggtttggaggcgacaggaactcctgcggttatgctggaggtcctcagtcatttcatgaaattacgatttttcgaatgaaacacggagacgtgttttagatagatcagtaccttgaaaactgcatgacgaacagagtctcgggaatagggctctaagaaaaggctatgggttgtaagatttacgctgcctggtattcgctatgggtcagctccatccggtagatggttctgactagcttctttgccacgtgcgacagggcgacatagtagtgcttgccttcagcacgctttctggccagatacaggccaaaccgctcgtcccacttggagacgtatatagcggcgttgaagagggcgaagcggaggtatttggagcctcgtttctccatatgggcataggtggatgtcaactgcccggactggtaggtagatggcgacatgcctgcataggcaaggatctggtccgcattgtcaaagcggttgaaatcgccaatctcggccaggatcatggctcccatccggtagttgatgccaggaatcgtcatgatcggagagctgctcttgtccataatctttcgaatggaagcttctactttttcgatgtcggcagtcagggcatcgatctggcggatcgtctgcttgagttctatggattttacagacatctctgatccgacagaggatctggccgcattccggatctcgatcgccttctctcggccataccggccacgggaggcatcacagagcagggacttcagatgtgtgaggttggcatcggcaacacatgacgcaccgggcatttcttcaagcaggcgctagacggtgttcatgtgaagcgttgggacgaggccttccagtttggggaatacgatgttcaccagcctggtgatggatgtcttcagcttcgctctcctctggatgagatcaaagcggtatctggtcaatgacttcagctcttcgctggggtacgatgtatccgtgtagggcctgagggtcttatcagtcacaagcatttcggcaatggagcgggcatcgactttatccgttttcgtctttctaaggcgctgaccttttctgtaaagatttgtgtgaagcgggttgattacaaaggtgcggtagcctcgatcaagaagcgagcccaagatgttgtaggaatagtggccggtagcctcgagccctacttttatctgggacaggtcttttgaggccgtctcgattcttctgaacagctcatcatagccttcgcgattgttccggatggtaaagaccgggaacagttcttcagcgtccggaccaagaatgcagcagtcgtgcttgtccttggcgacatcgattccaacgtagatcatctttaagatcaaagaagcggttgattgttctgatgctgtcgtcagaccacagggctctctgccaatcgtatcctcgttctacataaaccgtcatgcggtatctaactgatcaacaatgcagcaaagaggctgtggctggagcctttctaaaaccgtcgagcggtaggggagcaagaccactccacagcatctgatgacaatgtagccgtctgccaggaacaggtaaaggaaagctatcacttaataatacgaggggagcctggcgtatcagatacaaggcgcatatcggcgtggatgccgcaggcggccttgtgcatggtgtggagacgagcgctgcgaatgtgtctgacatatcctgtggcacatgcactcgtaagggaagatgacaggttctgctgcgcagactttaggctatagaggtatagcgaagcgcccttaaggacgcataaagacccacacctctcatctatgcgctaaagcgttgcaaggaagccttcgactagagagggccttgcctgtgcactcttctccgaaaaggacatcgagtccaggaaagtatccggtcgctcaaaggcagaagcacccttccttatcgtgaagcggcgcttcgaccccttaaggaagcgctacagaaggatagagaagatctcctgcacactcgacgtctctctcgcccttgcaaaccttacccatgtgcatcttttgccggcaggctgcacctcccggctcccagcgtcgcttgatccgtcttggagccttcttgcggtgcatggggcaggacagatgcctggatggcggctcctgcacatgctggatgagcatccttccctgcctttcccgcataccggcctagaaagaccgtgtggtcggtcctctctgacacgttatggggcattaatcatcgtttccctagggactgtctctcactgtaatggaaagcaagggcctaggccaatcgtggtctaacatagagtttagtaattgcaaatgatacttggagttcgagcccccggctcatttctctatttcgctgttagaccataattggcctgacgcccctgtccttccaatagctccagaagggctgctctatgtctatgagcgcacgcctggtatggacatacctgcctcctgcaagcttgcctgagagtatatccttcttctcccgctcagaatgccttacctgctctatccacagaaagcaggcaagacaagtgccccagccacttcgtagaagaccccatggaagaaaagcaggaactcgcacagcctttagtgcatcgcattgacgaggtcgagctcgctgtgtgcttgaagaccccaagcgaggagagccacgcgcacatatcctgcatggtcgtcagtggcgacccataagctgcccacgatacttgaaagggcatctgtcagcttttcgtcctcgggcctgcccctgccgcagaggatggcatattcgtctcctaggtcatacgctcagcactccacgcagaccttcttgttcgatatgccacaggaatgcactacatggccgtgcatgtgcgcctccccgaggcatctggatgttcgaccttgccctgttgcctgcaagcgtgccctttgcatatgcggcccatgtggtggccgtgagctttgacatagccaggacagatcttgtctttacaaagaaggtcttgcctcacgagcaacacttccatctcttaaggccacacgcgtcgtggcccttgcaatagaaactgagcgatttgcacctcgggcacctcttgggtgttcccgcaagggcagagcctgccatcttcttggctatgagcgccttcagcctctctaagagctcgcgcttctcggcgatccccatctttttgatctgctgcagtatcattggatccatccgggtcctttgatcctcgatgtttttgtttgacgacatgcattgtaggcaaaggcccggacacttttgggcccttcttaggtcaattctggtctaacagcgagttcggacaacctttctacctgagcttttgcaagaagcacaaaacgggcttctgcaagctcccgcgctgtggatacccgtacctccaacttctgtaggaatcactgtcaaggctctgccatgtggatagatgggcggatggatgggtggaggggacagacaaatgggtgtcgatgggtgcgctcgcacgctacatgctgcacctgaaggttctctctgggtggcgattcttacctacgggtataactgtcgcaagaagtgttcttggtcgcgtgcgaatcatacctggagtcgcagaggacaatcgcgaaggtacgagtggcctatcaaccgaaaccccattgcaccaccaacgtccctcggcgacgaccaagccatcacggccatctcggtaccagcaatcgcaccgccgcgcacacgtcaccaccacacatcgaagggagccattatgcaaaaggagcttttggactacaccgcatcgaaggtcgaggagatgctggccgcccagtcggcatccgccgatactaagaaggcggcacaggcctggaaggacgccatcgccgtgggcaaggacgccgacgaggccacgaatcaactgatggacgccatcagcgcacaccaaaccaccatcgacgacctcatcgggttcatcagctcgcccgcgggccagcaggtctttggcaaggacggcagtaaacaggctctggcccatgcccgggagcgcaagaaggctggcgccaagttctgcgactgcgcagcctgcaggccctgccacgagctgctgcacaagtttggccgcgaggaggcagacgtctacctgtagtcatctcaacacgctagccacagggcggggtgccggcataagccgacgcccctttttgcctccattagagaagaacgcacgcttttataggatgaacatttatatagaaggatcgcgcgcaaagtgggcgtacgcacagagtggtcgcacgcgaagtgggcgctttcgagaagcgcagccgtcccaccaaagcagtgtccagcagaaactatccccgccagcagccctctacagcgtccgcatcagtccgctaccaggtcgagccagcactgcatcagtggctggacctgcccttctttgcccctgcggcccacctcgggtgtggcaagtgacagcccgtgcccaccgtagggaaagacgcggagcgtaaaggacacgctcgccttcctcatggcctcggccagaagcaggctattctccaccgggaccgagctgtcctccagcgtgtgaaagacgaacgtgggaggcatgtcttctgtgacgcacttctcaagcgacagccactccatcagctgggcgtcatcaccgcacagattctggaacgaccccttgtgcacgaactcgctcaagctaatcacgggatagcctaggacgaggccggtggggcgcaggtcctcgcttggagctcccacgcgctttgccagccagggctcctgccattcacagcccaggtcgcaggccagatgtcctcccgccgagaagcccatcaggaagatgcgactcgggtcgatgtgaaactgcgccgcataccgcctgagatagtccacagcacccgccgcctgcaccaacgccgcaaggtacctggcaagggcgcagctgtaggtgaccacgcaggcggcaaagccccacgctaccatctgcagggccaccggctcggcctcacgcaccgaggcaaacgcgtaggcgcccccaggtaggatcgcgacgcatggacatgtgacgtcgcggtctacgttatcgagcacgccgggaaagtacgtctggatgagcgctggctcgtccttgttcggaagcctcagatggttctgatgacccacctcgtgcgcgccgtcctccgacgcctgaagtatctcgtgaaacatgcaagccccccacagcctaggccctacagctccgccccgtctggctagatcgcatgcttgaaccactagaaactgtccttgcgcgagcgcttcaggatgccatcgcccttattgtccatgtccgcacagacaaagccgtacctctttaccatctcacccgtggagcgggacaccaggtcgacgttgccccacatggtgtagccgatacacggcacgtggtccaggcagatggcgtcacggatgacgtgcaggtgcttggccgggtagtcgcaacggtagtcgtcgtgtaccacgccgtcatcagacacctggtcgatagcgtcaatgccattctcagccacaaagagcggtttctggtagcg

SEQ ID NO: 315 - DNA, 14492 bp, Unknown
  Metagenome-assembled genome
tttcagagcgcctactgcggctacgatgtcacgatctggttacgttccgaagcttccatcgggcggtgccagccgaagctggaccgactctgtgaaatctatctgcagacgctggaagcgatgaagaaggatccgaaagcctatgcctacggcctgtgcgcaaaggatgaggtagaggctggccacctggacgaactcaagcagcaggtccgccacgcttattcttcaatcaaccttacgacctcctatgaggaagcctttggggatgccgactttgtgattgaggccatcgcagagaatgcggagcagaaaactgctttctatacaacagtggtaccgtacctgtcccagaaagtgatcgttgtaacaaactcgagcacgctgttgccgggtcagttcgcggacctgctgccgcagccaaagcagtatctggccctccactttgccaacgagatctggaaaaatccgaccgccgaggtgatgcgtcaggcgaagacctccgataaggcctttgaggctacggttgcctttgcaaagtcgatccgcatggtgccgctgaaagtcatgaaggagcagccgggatatctactgaactctatgctcgtcccgctcctcaatgcggcgctgagcctgtgggccggcgacgtgggaagcgtcgaggatattgatgccgcctggactatgtcgaccggagcaccggcaggtcccttccgtatgctcgatatcatcggtctcaccaccgcctataatattatggtgatgaaccccaaagctaaggatcctgcttcacttgaggcactgattgtgaagaagctcaaagcgaagatcgatgcgggagaaaccggcgtgagcgccggtaagggcttctatacctatagcgagtaagattcagctctaatatctgcagacctcctgacacgctgttttatatgtgtcgggaggtcttatgctacacaaaagacaacatatcttgatctgatgtcgagtttgcgcggggtgtcgagttactgtggaggtacctgtgcatcaaagcggtaaaaaagtgcataaatacgcaggatacctgtagatttatgaattgtgttagctgtcgagtttatgtcaaattaaagaacttttttccacgaagtagcctaatataaaatcagcatgcgtccagaaaaagcgttgtttcaaagcgggccgtgcctgatcaatatttcaactacatggcacaccatgtgtttgtttatatatggagcgaaaacatatgcctagtcgtaaagacagcggtaaacatttcagggataccaaagcgcacaaacaagcgaggcactcctcaaggcaagagcagagacagagacggaatagtagaagacagcaacagcagtatgcagacgatagggaagacttcgacgacagtggcaaaaccaaggatgagaatttagatggcctcgatgtgatggcctcctatgtggattccgaatccacgcatgaaggggatgacccctacgatctgatgccggatctttcgatggatgcctacgagcagaccgaaaaggacgaagagcgggtttgggaacatgagcggcagaaccatccgcaccatcgcgtccgtaatacctttctggttatccttattgtcttcattgtcgtactcggcggttttacagccgtgttttatgtcagtgcgcgcaatgtctataactcgagcctgaacgcagtgtcgctttcaaaagacattgcaacgagcttcggggaaggcaacaccaagaacatcgtctcagatgcgcagtccttctcccggtgcctacaatccatgaaggatgagacggacaaaccgatctggaaaattgcccagcacgtgccctttatctcaggggatgtgcagaaggcgatcgatctggtcgatatcgggcagcaggtctcggtcaatgtggtgacgccggtggcgcaggatatggacggcgtgtccgtgcagtcgatcctatccaaccagaagattgacctggactccctcaatcagctgtgcaaggtcttcagcgatgtgcagcctgcgatcgccgatgcagatcaacagatcaacgccttaggcgatgcgcagttcgaatatctcaacgatcctctgcaggcctcgaaggcgcgcctcaatgagctcaataccgccgcagtgaatctgggcaacattgctccgcagctgccggcgatgcttggaagcgaggggacaaggacctacctggtcgtcgcccaaaacaacgcacagctgcgctcaacgggcggatctcccgcggcgcagatgttgataagcatcaaccagggaaagtttaccctgagcaccttcaagattgcggatgaggactatcaggaaggccagatcccactgaccgatgaggagcggcagattgtcgtcgatctgatgggtaccgatgcggataccgagcaacaggatgtcaatgtcgtaccgagctttccgagagcagcccagctcctcgagtggtgctcagagaagaacaccggagagagtgtcgatggtgtgatcgcgatcgacccgatcttcctgcaggacctactcgatctgatcggcggtgtcagggcctcaaatggcacgcagatcgacggtgagaatgcggcgcagctcatgatgaacggcgtatacctcaaccaaagtagcgaaagcaagcatggcaacagcgacttcgcacagctcgcagggctgtccttgagctctgtcgtgaataacatggggcgcgtcagtatcacggacttcgtgcgctgcgtctgggatgcgacgcagacaaatcacttcaccatctatatggataaggaagatgaggaagccgcaatcgagaggatcaatgcggcgggcgaagtcaatcaggacggcacccagccggtggcagcgctgtacttgaacgatgcctgcgactccaaactcgattggtacctgaaggcacagcagcggatcaccggcgtgcagtacaacgacgacagcagcgtgacttatacggtcgatgcgacgctggagaataccgctgcggccaccgcgatgcagaacaatgcgccggaagagttagtgggtgacaatccggagggccgtaactatgggatcgtgctcagttgcctgatcatggctccgaccggcggatccatcagcgatgtggatgcccgcctgacgacggacaaggatcagagcaatgtaagcctctacggcaacaacgtcgtcacgggttccctggagatcgatccgggggagacggtcgatgtgtcgtataagataacgacacaaaggggggcaacggcgccgctgcagctgtacatgacgccggtcgcacagagctgagcgttctgcctctcatatatacaggagggccatcgtgcggtaacaagagcggtggccttttctttgccgataggctgcaccacagggtttgtatgggagcatgctgaggggagtgttggtattccactatggaagtttggactcaccgagggggacctgtctcggaaaagtctgtgcggaatgctgtgagataccgtaagctttactaccgtaaaacgatagtactgattgttaagctcgaagcctcttgaggggtatgagcatgaaacgtcgcgcgtgcttcgttgagcgatatccaatatcgggggctttgagtgcaacagactacggtcggtcacagaagggaacacacatggcagggtctgacttaaagaaccgtgtattagatgcctggacgatggttgagcatctgtccgaaggagattttaatccgagggataccgcaaatcacaaactgacgctcaacgctcaggacttctatggccttttcggtgaggcaatgaggaagaagggatcaggcaagaaaggcggtatcgttttattcctcaacacctttccctttgagcgcgtcatcagaatgctgcatgaaaagttccagcttgaggataccgatgaggatatctcgtacgggactaagttctcgctgtcactgagttttgatcgggaattgaatctgctgcctgacaataccttcctgaccgagagtgcctatttcctagaggtcaatagcattctggatgaggataagttccagcaatacgaggaagagcaaaaagaaacgattgaaaagctgttctatgctgaagaagaggatggacacagggacacccatacttcgaaagcaaccccacggaaattcttcaacagggctatgcgtaagttcatcacgcactataacctgcaggacggccaatgctattaccgggccgtgaagaaccttgattcggatgtcacgaatctgcattcattcttcgtggacgaccttcagagggccaaagagaccagcaccaaaaacctcgatgcgtacctctaccaacaggtacacaatgaccgtgtggaccttgatgcaaaccaaaagtctccgaattttaaccccttaccgttttacgatatcctccagccgaaatactatcagttgggacgcttcccgagccatccagagtatgcgctctccctgatgcagcaggttgcggtaaacctttcgacgcattgcggtgacgaacagatccgcagtgtcaatggacctccgggaaccggtaaaacaacgttgctgaaggatatattcgctgagctgatcgtgcagcagtcctatgagatggcattactgcagggtaagaatttcgatgttccggggagcaatggccctgacggcattggcgaacttcctgattccattgcggacaagggcattgtggtagctagctccaacaatggcgcggtacagaatatcgtcaatgaattaccgctcaccaaggaggtcgatcattcttttcaagaggccctaatcaaagccgattactttactgagattgccaactccgatgccaaagaggagtgggtacaaggcgaggacagcaaaaagcataagagcttcgttgtgaagcccactgacagcgaggacccgaataaattctggggcttattctcacttgaaggcggcagaaaagccaacgtcgaaaagattacgaccgatatcgaccggatcgtcaagtactttgacgagcacgtgccgaatgacggagtgtatgccgagttcttagatgcgtataagaagcaggaacaagaacgggacaaacgccagagcgcggtcgataccctgaaccaggtgtccgttctggaatcccaactaaacagccacaagacagactttacccgtgagtaccaggagcgggaagctaatcttaaacagctgccggcacaggttgagaggaccattcggcagattcagagcaggatcggtctactccaggcacagaagcaacagatccatcagtcccgggtggagaatgccgatcgggaagcgacactcaaccaacagattgatgccctaaagctgcaaaaaccgggagtgctccagctctctaagaaacgggagtatgaccaaaaaatggctggctattcaactgcgctgcaagacgtgatcgggaaaaagcaggaactcaaggaagctgaggtaaagcaagatcggctcattgcgcagaagcaggcagccggacaacaggcacaaactcagctgaaacaggaacaggctgactttgaggcttggaaatacgagcagctctacaacatgcagcaagaggaacagcagcttgcccagctgaagcaggagaacgccgaattctcctatccgcgcctcaatctcaatgaggactacgacaagcttgagatctcaaatccttggtttgataaggagtaccggatacagcagtcaaagctcttcatcttggcccttcgagtccgaaagcagttcctgtatgacaacagaaagagtttgtccaaagccacctggatctggggtgatcaacagaaattcatgaatgaaaatcctgaccttatcgtgaaagcatggcattggatcaacctgacgatcccggtcatcagcaccacctttgctagttccagcaggatgttcaagaatctgccgccggagacgattgggaggctctttgtcgatgaggcagggcaggcactgcctcaggcgagtgtcggtgcgatcatgcggagccgtaacgtaatggtggtcggtgacccggcacagattaaaccggtcctgacgcttgattcaaaggtgttgggattgcttggacggcactactttgaaggcctgagaaatccggatgatcttgcagagacctatatctcggagaattcctcaacgcagaccttgattgatgcaattggaaaatacgggttctataaggataaggaaaagacagactggatcggtatcccgctttgggtgcacagacggtgccagtaccctatgttcgatatctccaacgacgtttcctacaatggcaacatggttcaaggtaacaagggggatggtgcggcaaagtggtttgatatcggaggctctgccaacaataaatatgtgtcagagcaagggcagcttctgcactatctgatcaagaagatggcccagaagaatcacgatattctcgacccgaacaagaaggatgtcacatacgttatctcacccttcaagaatgtcgcagatcggctgaagaaggaactcaacagtcctgacctgaagttcacgcgaagagatcatggcaaagtgaccaacattggcacagtccatacattccaggggaaggaagcgccgattgtcttcttggtgcttggcgctgatgaaaaaagcaagggtgccgctaattgggccatgggttcgagcaatccgaacatcatgaacgttgcggcaacccgtgccaaaaagcagttctatgtgattggcgacctgaagctttaccgtggcttaggcagtgatgttattaagaagacacttgaagcgatcgatcaattcaatcaacggatacagaaatccaataccaatgcggatcagaaagaagacttcacagcgcagtacgaagaaggggagccgggcatcgtcgatggaaaggctttgcttgatgctctggagaaggaattctcgtctgcattaccgaatgcactgcagaacgctgaggctgggacatcgaataaaccacaagaacagcggcaacaacaaaggaatgtgctccctgttacacagaaccaacagcgtcaaccgcagcaggatttgcgacctgtacggaattatcaacggcagccgcaacagaatacacgccctgcgcagaattactggggaaaccatcggggacagtcgcggcagaatgcatatccggcacagaatcgacagcagcgacctcaatatcagcagtcgcagcgaaactcacgtccgatgccgcagataatcaagaggcgggtggatctgaatgtcccctatgaggaaaaagacgaagctaagaagttaggcgccaggtgggactataaacgcaaaacatggtatgtgcggccaggctctgacctgaacgagtttagaagatggctgaagtaaggcgcgtcgatcggaggagtggctgtatatctaaggtgcattcacttcaccttcattcgttttggaactaactctaggagtgacggatatcaatatatttcattcgctgttagaccaggattgacctaagaagggcccaaaagtgtccggacctttgcctacaatgcatgtcgttttcaaacaaagacatcgaggatcaaagggcccggatggatcccatgatactgcacgcagatcaaaaagatggggatcgccgagaagcgcgagctcttagagaggctaaaggcgctcataccaagaagatgggcaggctctgcccttgcggaacacccagaggtgcccgaggtgcaaatcgcttattttctactgcaaaggccacgacgcacatggctcccagagatggaagtgttgctcgtgaggcaagaccttctttgtaaagacaagatctgtcctggccatttcccaagcccaacggccgccacatgggccgcatatgcaaagggcaacgcttggcaggcatgacgcttaaaggagcttgcgaagagctgccatgtggcagccttaaaggacattgtggtttttgcgcatgaggctcttcgagctgctgcaggcagcgcttggcgccttcaggtatggacccaccgtcccctgccacaagaatcggatctatctcgacgagtcgcttgcaggcaacaggataaggtcggccacccagatgctgagggagacgtacacgcacggccatgttgtgcattgctgtggcattcgaacaagaaggtctgcgtggagtgctgcgcgaatgacctaggagacgaatatgccatcctctgcggcaggacaggacccgaggatgggaagctgacagatgccctttcaggtatcgtcgtcgacagcttagggtcgccacccgacgaccatgcaggatatgccgcgtggctctcctcgcttggggtcttcaagcacacggcgagcccggctcgtcatgcgatgcagcaagactgcgcgagttcctgcttttcttccatggggttcttacgaagtggctggggcacttgtcttgcctgcttcctgtggatagagcaggtaaggcattctaggcgggagaagaaggaacgcctctcaggcaagcttgcaggaggcaggtatgtccaaccagcgtgcgctcatagaccatggagcagcccttctggagctattggaaggacaggggcgtcaggttaattatggtctacagcgagatagtaaaatggctgaggactttaatcataagcccaacacttcttgtcggttttcgagctacataccgatgaaggggttgatcatccaaaagatcggaaaagacatggccaagggcatgccaggcgcacttaagcatgaaggaatgtgaagagcaggggaaccttgatggagcttctggagaggttcttagacgagcaaagtcctgcgagcaaaggctttcgaggagaagttcccgtagagttcgtatgccctatctgcggccccacgagctgctcaacaccagctcagcgtgagcgcatgaacgatatggagggcacccacccatcttgccctaggaagtagtttgtcgcgatgtggttctaaccagtcagaaaggcaggggtccatgccccaggcaggatgcagctacaagatagccggacacgtgcttgtaaggatccgctgtgccatagcaagatcgaagtgcttgcagcgtcctttctgctgattgcgtagaagtcgacaacttctacatagaagtaagatcaaaaggcacgaggggtgtagcacaagcatcgcctatgcctcgctgcgatggacagggctgctgccgtctgcgctgcgtggatgaccgctcgggcaattcctgtaacagttcgaacacgaccacctctgtatatgtccaagatctgtgccgatgcctggagtaggaatatcggcaggctggattgcttctgcggcttgtctagaaaagtagacagctctacgatgacccctcgcttccccagggcccacaggctcatatatcaaggcatatgtcgagggagcgttccacagcctttcgaaggcccatacaagtcgtatgccgactcgttcagctaaagatacagccacagggaattcttttgatgcttggtccgatctcctccacaggaatgcacatcccgctcgcaggcatcgcggccacactgcagcccaagttgtctaagcagcttacagttcatggagcctaaccatgtcgcaagtccctagccttatctatgattcagtccgagcagggcggcgcctgatcgctccgcacagctgcgaatccttatgggtggtgactcgtgatttcagagcgtcggagaggcgcgtggacgcaccgatatttggtgccactcctccggtcctcacatagggtggctctgcatggacgcggcggctgcatcaacggtttttcttccgggcgactgaattattgagcccgtggataatgtcagggatcggattgtcccttggccacaagagagacaacttcagactctgcaaagaccgtacacatggagctgatacggacggggtttttttccactcaagcccagccttgccagaagtcagacaagggcaatctcaaggtgcgccgccggaaccggcagattcctggagatgatggcgcgcaccttggagatgcccttgtctgacttctgcaaggctgggcttgagtggaaacaccccgtccgtatcagctccatgtgtacggtctttgcagagtctgaagttgtctctcttgtgccaaggacactccgatccctgacattatccacgggcttcaataattcagtcgcccggaaaccgtgatgctcgcccgccgcgtccatgcagagccaccctatgtgatgactacgaagagagtgtcacagcacaacatcttaaccggtccacgcgctctccgacgctctgaaatccgaggtcaccaccataagattcgcactgtgcgggagcgatcgcgcgccgccctgctcggacttgaatcatagatatggctagggacttgcgacatggttaggcctccatgaactgtaagctgcttagacaactttggctgcagtgtggccgcgatgcttgcgagcgggatgtgcatttcctgtggaggagatcggcaccaagcatcaaaagaatccctgtggctgtatctttagctgaacgagtcggcatacgacttgtatatgggccttcgaaggctgtggaacgctccctcgacatatgccttgatatatgagcctgtgggccctggggaagcaggtgtcatcgtattagcttccgtactttttctagacaagcccgcagaagcaatccccctgccgatatcctactccaggcatcggcacagatcttggacatataacagagtggtcgtgttcgaactgttacccagaattgcccgagcggtcatccacgcagcgcagaacgcagcagccctgtccatcgcagcgagcatagctgctggcttgtgctacacccctctgccttttgatcttacttctatgtagaagttgtcgacttctacgcaatcagcagaaaggacgctgcaagcacttcgattcttgctatggcacacggatccttaccagccttgtccggctatcttgtagctgcatcctgcctggcactgacccctgcctttctgactggttatgaccacatcgcgacaaactacttcctcagggaagatgggtgtgcccctccatcatcgttcctgcgctcacctgagctggtgtgagcagctcgtggggccgcgataggcatacgaaactcttacgggaacttctcctcgataagcctttgctcgcaggacttgccgtctaagaacctctccagaagctccatcaaggttccccctctcacattccttcatgcttaagtgcgcctgcatgccccttggccatgtcttttcccgatcttttggatgcatcaacccttcatccatggtatgtactcgaaaccgacaagaagtgttgggcttatgcttcaagtcctcagccttttactatctcgctgttagaccataattaacctgaccccctgtccttccaatagctccagaagggctgctccatgtctatgagcgcacgcctggtatggacatacctgcctcctgcaagcttgcctgagagcgtatccttcttctcccgctcagaatgccttactgctctatccacaggaagcaggcaagacaagtgccccagccacttcgtagaagaccccatggagaaaaagcaggaactcgcgcagtcttcgctgcatcgcattgacgagcccgggctcgccgtgtgcttgaagaccccaagcgaggagagccacgcgcgctatcctgcatgtcgtcggtggcgacccataagctgtcgacgatacctgaaagggcctcgtcagcttcccatcctcgtcctgtccctgccgcagaggatggcatattcgtctcctaggtcattcgcgcagcactccacgcagaccttcttgttagatattgccacacaatgcacaacatggccgtgcgtgtggcgtctccctcagcatctgggtggccgaccttatccctgttgcctgcaagcgactcgtcgagatagatcccgatcttttggcaggagacggtgggtccatacctgaaggcgccaagcgctgcctgcagcagctcgaagagcctcatgcgcataaaaccacaatgtcttaaggctcacatggcagctcttcgcaagctcctttaagcgtcatgcctgccaagcgtgccctttgcatatgcggcccatgtggcggccgtggcttggacatagccaggacagatcttgtctttacaaagaaggtctgtgcctcacgagcaacacttccatctctgggagccatttgcttcgtggcccttgcgtagaaactaagcgatttgcacctcgggcacctctgggtgttcccgcaagggcaagagcctgccatctcttggctatgagcgcctttagcctctctaagagctcgcgcttctcggcgatccccatctttttgatctgctgcagtatcatgtgatccatccgggccctttgatcctcgatgtctttgttgacgacatgcattgtaggcaaaggtccggacacttttgggcccttcttaggtcatcctggtctaacagcgaaaatatattgatatccgtcactccttaagttagttccataacgaatgaaaggtgaagtgaatgcaccttagattacagccactcctccgatcgccgcgccttacttcacccatcttctaaactcgttcagtcagagcctggccgcacataccatgttttgcgtttatagtcccacctggcgcctaacttcttagcttcgtctttttcctcataggggacattcagatccacccgcctcttgattatctgcggcatcggacgtgagtttcgctgcgactgctgatttgaggtcgctgctgtcgattctgtgccggatatgcattctgcccgcgactgtccccgatggtttcccccagtaattctgcgcagggcgtgtattctgttgcggctgccgttttataattccgtacaggtcgcaaatcctgctgcggttgacgctgttggtttctgtgtacagggagcacattcctttgttgttgccgctgttcttgtggtttaattcgatgtcccagcctcagcgttctgcattgcattcggtaatgcagacgagaattccttctccagagcatccgtaaagcctttccatcgacgacgcccggctccccttcttcgtactgcgctgtgaagtctttttttctgatccgcattggtattggatttctgtatccgttgattgaattgatcgatcgcttcaatggtcttcttaataacgtcactgcctaagccacggtaaagcttcaggtcgccaatcacatagaactgctttttggcacgggttgccgcaacgttcatgatgttcggattgctcgaacccatggcccaattagcggcgcccttgcttttttcatcagtgccaagcaccaatgaagacaatcgacgcttccttcccctggaacgtatggactgtgccaatgttgtcacttgccatgatctcttcgcgtgaacttcaggtcaggactgttgagtcccttcttcagccgatctgcgacatcttgaagggtgagatacgtatgtgacatccttcttgttcgggtcgagaatatcgtgatttttctgggccatcttcttgatcaatagtgcagaagctgcccttgctctgacacatatttattgttggcagagcctccgatatcaaaccactttgccgcaccatcccccttgttaccctgaaccatgttgccattgtaggaaacgtcgttggagatatcgaacatagggtactgcaccgcctgtgcacccaaagcgggatgccgatccagtctgtcttttccttatccttatagaacccgtattttccaattgcatcaatcaaggtctgcgttgaggaattctccgagatataggtctctgcaagatcatccggatttctcaggccttcaaagtagtgccgtccaagcaatcccaacacctttgaatcaagcgtcaggaccggtttaatctgtgccgggtcaccgcaccaccatacgttacggctccgcatgatcgcaccgacactcgcctgaggcagtgcctgccctgcctcatcgacaaagagcctcccgatcgtctccggcggcagattcttgaacatcctgctggaactagcaaaggtggtgctgatgaccggggatcgtcagttgatccaatgccatgctttcacgataaggtcaggattttcattcatgaatttctgttgatcaccccagatccaggtggctttggacaaactctttctgttgtcatacaagaactgctttcggactcgaagggccaagataagagctttgactgctgtatccggtactccttatcaaccaaggatttgagatctcaagcttgtcgtagtcctcattgagattgagggcggataggaaaattcggcgttctcctgcttcagctgggcaagctgctgttcctcttgctgcatgttgtagagctgc

SEQ ID NO: 316 - DNA, 65125 bp, Unknown
  Metagenome-assembled genome
gcacgtaccgatgcgaggaatgcggactgaccatcgacagggatttgaacgcggcaatcaacatactcgtcgccgggagtgccccggagacgctaaacgcgcgcggagggtcctccgccggggcgcctgcccgcgcgggcgctaggcgcgatccgatgaaacgcgaaccaggcgttcgggagaccgatgcgagacctggagctgtccctggcaacggggacatgcaagctagaacaaactagcttgctacggtggtttgggacctgcggttgcaccgagctatgccggagaggctctcgaaggatatgagggtaagcaggaactctccccatccctggacagaaagcttttctgtcctcgaagatcatcctgctggtcggtatgaaggtgcatccgcacacattgcagcgccagcggcgcaccctttggagctcatggccgagcatcgctattcgcctcgaaccacacctcaggcaggaactgtgctcaaaggcatcaaagagcgccgcctcggcctctccaccctgccgatgcagcctttcgtagtgctccttttgccatcccatcgcgagccttcaagcaggcgtgagtgaagactcaccagtgccgtctttggacgtggtggacactgcgggcatcctccatcttccatagatgggtgataagtccttggcagcgctagtcagcagtgccgccaaggactaccacatcgcaagagcgccgctgcccgccatcacgctctcgtatggtggccaagctctcgcatccagttattagcctagttggcccttaggcaggacagatgtcagcacactgcaagaagggatttcgaccgtaataatctgaccggtatgccatcgctctgccgatggttcgctttcctttaagtgagtgcgtaacctcaatgtgcgtacttgattttgcactcgtacagccctgaacatagaggtaaggacctgtctggcctccattgaaagggacgagcgatggcaaaagactttaaaccacagccctacctgttcccgatgccgacctacatggtcgggacctacaacagggatgacaccgtcgatgtgatgatgatggcatgggcggcgttgccgcgcaaaatatggttgccctgagcttggaaatagagcgcaaaacgctcacaaatatcaaggcacagaaggccttcacgctagcggtccccgataccgacacccccaagcagtccgattacttcggcactgtctcttcgagcaacactccggacaagtttgagcgttcagagctccacgcacacaagagcgagcgtgtagacgcaccgatcatcgaggagtctccgattacactcgagtacaagctcgtcgaggtacagacacagccttacagcacttatgtgctagatgagaccgtcagtacgcgtgcagccgatgcgatactcgatgagagagggagatcgacgccagcaaggtacgcgccttcgatcagatacgcaatggctactatgcgatcagagaggagatcggcaaagcctggaatgccgggctaggcttcacaaaataaacgtgggacccaccgcattcgcagcaagtcccacacaccaagaactggatcagtgattagtggttgttcctcttctcttccttatcgtgttcagcctcgttcttcacaacttcgctcagcagatcatccagggaagacaggtcctcgttgataacatcagagttcttgtcgtcctccttcttggtctgagtcgggccgccgatcagctcatcgtcgtactggtgagtcgacggtgccgcctggccgagcatcacgtcgttgtccgcatccggtgagaacacgatgttcagcagctgggtcagatcctcagagtccgcctcattgtcgtccggctccaggatatagagcaggccacgcttctgcaggccgtcgcggagctcctcgatagcctttgcgccgataccgtcaatcctcaggagatcatcctcagtcttgccgatcaggtcaccgaccgtctcgatgccctcctcggagaacttattggtccagcgctgtgacacgccgaggtcatcgtacagatagagctttgcgtcctcagagctgagcgtacgcccgttctttgaatagactccgccgtatccgttgtagtcgtcgccgacccaggagagctcatgtttcggcagcttatcctcaatggccttcaggtcatccggagcccactcaggcagcgtcttggcattcgggctcgtcggctcaacgcgcttgcccttgtaggtaagctcgacgtcctcgtaagccggaaggccggtgccagccgggatcttcttaccgacaatgatgttggacttcagatcctggaggtgatcaacctcgcctttgatagcagcctcggtaagtacacccgcagtacggatgaaggaggcactggagagccaggagtcaatggagctcgcgaccttgagcgtacccagaataaccggctctgcctcaggaggcgtaccgcccgcaagcgtgatctcgcggaccttgtctgcgaagacatagcggtcaacgtactggccgagcaggtagtcggagtcaccggagttggtaacttggacgcggcgcaacatctgacgagcgataacctcaatgtgcttgtcgttcagatcgacgccctgggagctgtagacctccttgacggagttgacgaaggtgtgcatcgtcgactcgatgtcagtcagcttacgaagctttctgaagttgacgaagccacgggtcagctgctcgccagcgcgcacctgtacgccgtcctcgatttcaggcatgaagcgtacggatgccgggatccgcttctcagtcaaaactcggctgttatcgtcggaatctacgatctgcatcaggtactgcgtgccctcggtcgtgatgcgcagcgtgccagaggcgggagccaggtcagcctcgcggcccaggatcttctcgttgatgttgccgacaacgtcgaacatacgggcaacggttggcaggccctgggtgatatcctcggcgcctgcgacgccaccggagtgaatcgtacgcatggtcagctgagtacccggctcaccgatagactgcgcggcgataacgccgacagcggtgccgatgttgactggccgacgggtagaaagatcccagccgtagcatttctggcagacgccgttcttggctttgcaggtgagcaacgctctgagctcaaccttcttcaggccgtggtctgccaagttctgcagatcgtctgcgctcgtgacgtagtcgccggccttgataaggacctcaccggtcttcgggtcaaccacatcgtgcagggtgcagcgaccgatcaggtcggtgttcaggttcttcgtgccgggcaggaagatgttgtaggtgcaggcctcatcggtgccgcagtcctcttcgcgaacgataacgtcctgggcgacatcgacgagtcgacgggtcagataaccggaatcagaagtgtgtgacgcggtatcgaccaggcccttacgggcgccgtaggtggagatgaagtactccagcggctgcaggccctcacggaagttggacttaatcggcaggtcgatggtgtcaccggacatatcagccatcaggccacgcatgccggcgagctggcgcaactgggtcttggaaccacgagcgccggagtccgccatcatgtagatcgggttgtcctcgctgaagccgtcgagcatcttggtgccgagcgcctcagtgcagacagtccacgcattgacgacctcgatgtggcgctcctgctcggtcagaaagccatcctcgtagttctcgttgatctcgtcgaccttcgcctgtgcggcatcgagcatctcctgcttctcaggcgggatgacagcatcccacacggagacggtaagtcctgagatcgtcgcatagtggaagccgatggacttgattgcgtcgaggatcggctcgacctgtgcgttggtatagcggtcgcagcactcgttgacgagctgtgagatgtcgttcttgaccatcttgtagttgatgaaggggaaatccgcaggcaggcaggaacggttgaagacaatgcggccagcggtggtctcgaagtggatcgggccatcggtcacgtcgtaatcctgcacatcgtgcgcagaggtcttgacgcggaagatctttctgccgccctcttcggtgttagcgtcagccggatacacacgcacggtaactttcgcctgcatatccaggtcaacatcgttggagattgtattgacagcatcctcgaagttggcatacacattgccttccccggcgacgcctttcttctcagtcgtcagatagtagacaccgaagaccatgtcctgtgaaggaacggtcagcaccttgcccgatgccggtgagcgcaggttgttcgtcgaaagcatcagtacacgggcctcagtctgcgcctgggtagacagtggcacgtggacggacatctggtcaccgtcgaagtctgcattgaacggtgcacagatcagcgggtgcagatggattgcctcaccttcgaccagaaccggctcaaaggcctggatagacaggcggtgcagggtaggtgcacggttcaagaggaccagacggtccttgatcacctcatcgagcacatcccagacagccggctgctgacggtcgattgcgcgcttggcacccttgatgttctcgaccttgccaagctccaccagacggcgcatcacgaacgggcggaaaagctcgagcgccatggtcttcggcagaccacactggtgcatcttgagctgcggatccgtgacgatgacggaacggccggagtagtcaacacgcttgcccagcaggttctgacggaagcggccttgcttgcctttgagggactcagcgagggacttgagcgctctgccaccacggccggtgactgggcggccacgacgaccgttatcgaacagggcgtcgacggcctcctgcagcattctcttctcgttgttgacgatgatgtcaggagcgtcaagagagagcagacgcttcagacggttgttgcggttgatgacacggcgatagaggtcgttcaggtcagaggctgcgaagcggccaccgtcgagctgcaccataggacgcagatcaggcgggataaccgggataacatccagaatcatgttcgcaggatcgttgccgcccttgatgaaggcatcgacgatctcgaggcgcttgatagccttctcacgcttctgcttctgggagttctcgttgttgacaatctcacggagcttcttggcctcctcctgaaggtcaatccccttgagcagatcacggatagcctcagcgcccatgccacccttgaagtagatggagtaatagcgcttcatctcggtgaagagtgactcatcggagatgagctggcgcttctcgagctgcatgaactgattgtaggcatcctggcggagcttcttctcctcctcatactcagcttcgaggtcagccacctcagccttgatctcatcctcagagagcggctcaacgccgtcaaactcggagcccccctgatcggcgccctgcgccttgacgcggtcgatctgatcgtcgcgctcagcgtcgagctcttcgaggtcagcagcgagctcctctttcaggtcagcggcgtcagtgtcgcgggcctgggtgtcgacatcggtgatgatgtaggaagcgaagtagagaaccttctccaggtccttgctcttgatgtcaagaagacgggacagggggaatgaagtcgggctcttgaagtaccagatgtggctgaccggcgcggcaagttcgatgtggcccatccgctcacggcggaccttcgcgctcgttacctcaacgccgcagcgctcgcacacaatacctttgaagcggatacctttgtattttccgcaagcgcattcccagtccttggtcggaccgaaaatcttctcgcagaacagtccgtctttctcaggcttgagggtacggtagttaatcgtctcaggtttcttaacctcaccgtgagaccaactgcgaatagtatcagcagaagcgagagagatcttaaccgcatcaaaatctgtggtatcgaaatctgccaccgttactccttcttgtccgtagagttaccaattaaaatttcgtcacttttgtgacctgtattctccggtttgccgccgatcagctcgtcagcatcgttgttcgcgaagacctctgccggattcttctcggtcgaggtgtgatcgtgggaccctgagcccttgtccccccgctttgaataggagatcggctccatatcgagcgccagggaacggacctctttgacgagtacctcgaaggactcagggatacccggcctcggggcattctcacctttgacgatcgcctcataggtcttcacacgaccgttggtatcgtcggacttgaccgtcatgagctcctgcaggacgttggctgcaccatatgcatacagtgcccaaacctccatctcaccgaagcgctggccgccgaactgcgccttgccgccgagcggctgctgggtaaccaggctatacgggccggttgcacgggcgtgaatcttatcgtcgaccatgtggccgagcttcaggatgtagctcacgccggccgtgatcttgttcttgaaaggctcaccagttctgccgtcatacagggtcgtcttgccctggatattcagttgcgggacgaactcgcgcatcatgtggtcaccgtagtccagcttggccttattcatcaggttgatgttggtgcgctggataacgtcggcgacctctttgtcggttgcgccatccaggaccggcgtagacacgtaggtcgggccggggacgtagcgctcagagtgatcggactcctggtcccagccatgtgcggcagcccagcccaagtgacactcgagcagctggccgacattcatacgggacgggacacccagcgggtcgagcagcacgtcgatcggcgtaccgtctgccatgtagggcatgtcctccatcgggagtacccggcacacaacacctttgttgccgtggcggccagagatcttatcgccctgctggatctttctgcgctgtgccacgaagacacgaacgagctcgtttacgcctggcgacagctcgtcgcccgcctcacggctgaagcggacaacgtcgacgacacggccataggcaccgtgcggcatcttcagtgaggtgtcgcggacatcgtgggccttggcgccgaagattgccctcaggaggcgctcctcagcggtgagcgcggtctcgcccttcggggtgaccttgccgaccaggatgtcgcccgggccaacctcagcgccgatgcggatgatgccatcctcgtcgaggtttgcaagcatgtcctcagataggttcggaatctcgcgggtgatctcctcaggtccgagcttcgtgtcacgagcatcgatctcgtggcgggagatattgatggaggttagaagatcgtcgcgatcaagacggtcggagacgatgatgccgtcttcgtagttgtagccttcccacggcatgtacgccacggtgaggttcgtacccagtgccagctctgactggtcgacagaagggccgtcagccagtggctcgcctttaatgacgtggtcgcccacgtgcacgattgggcggtggttgatgcaggttgactggttggaacgctgatacttcggcagattgtaggtgtcgacctgaccgtcagcagtcgtgacctcgacatgcgctgcatcgacggccgtgacgtcgccttcatgctcagcgctgatcagctcgccagagtcaagggctgctctgaactcaaggccggtgcccacaaatggagcatgggaacggatcaggggcactgcctgacgctgcatgtttgcgcccatgagggaacgcttagcgtcgtcgtgctctaggaacggaatcaggttagctgcgaccgagagcaactgtctcggggagacatccatgtagtcaacggtatcgacgtcgacttctgccagcgcaccgaaggaaccgtcgaagtcgcgggtacgcgcaacgacgcgctgtgccaaagcaagcttgccggtcttggggtcacgttcgacgaactgaccggtcttcgggtcgatcggggtgtttgccggggcgatgttgtggtcctcttcctcgtctgcggtcatccagtcaatcttgtcggttgccttaccgtcgatcacctgacgatacggtgcctcgatgaagccgtactcattgacgtgcgcgtagagtgcgagtgagccgatcaggccgatgttcgggccctcaggggtctcaatcgggcacatacgggaatagtgcgagttgtggacgtcgcggaccgcagtaggaacattggtacgacggctggacccggacttatgtcctgccaggccgccaggtcccagagcggacagacggcgcttatgcgtcaaaccggacagtgggttgttctggtccatgaactgtgaaagctgagaggaaccgaagaattctttgatagctgctacaatcgggcggatgttgatcaggctctgcggggtgatatcgtccgcatcctgtgaagccatacgctcccggacgacacgctccatacgggagaggccgatgcggaactggttctgtaccaactccccgaccgtacggacacgacggttaccgaaatggtcgatatcgtcggtcttcttggtggtatcgccagcgtgcaacgcaagcagatacttgagcgcggtgacgatgtcctcattggtgagcgtacgctccgtatgggtttcggagtcaaagccgagtttcttgttgatcttatagcggccgacacgggctaagtcatagcgctgcgggttgaagtacagaccattcagcagtgcctttgcggagtcaactgtaggcggctcaccagggcgctgacggcggtagatctcaagcagtgcgtcttcacgcgtcgttgcagaatcgcgctcgatcgtggagtgaatgacatccgtatcaccgaggaggttgatgatctcatcgtcgctctcagcgatgccgagagcgcggagcagaagcgttgcactctggcggcgcttgcggtcaatagagacgacaagctgtccacgcttatcgacctcaaactccaaccaggcaccacgagcagggatgaactgcgcatgatgggtgagtaccccattatcggtctcctgggagaaatagacgcccggggaacggacaagctgagaaacaacaatgcgctcggtgccattgacgataaaggtaccgcgctcagtcatgagcgggaaatcgcccatgaagacaagctgctctttgatctcgccggtcaccttattgacgaatttgacatcgaccagcagaggtgcttgataggtgatgtccttcgcacgacattcatccatcgtgtgagcaggatctccaaattggaaatcaccgaaggtgacttccatagtatttgcgttgttctcaataggcgaaaactctgcgaatgattcggcgagcccctcagtcatgaagcgatggtaagactctttttgtacagagatgaggttcggcaactccattactggcggaatcttgctaaagcttacacgctgacgtttttggaattgggctttggaagactttgcggtatgcaccaggcacttcctccttcatacagtcacattcacggcattatgccgcaagctagtaatatagagaaagataccgatacagtcaagctcagcgcttgacataaaaattaaaatagtatatttagctgaacaccctatttaatctgtatagatagtcagtgtccatatatggagaagctgtgagaggctccttgatacatacgtaagcataccaaagagggaaccaggtgtaaaccctaaccctctcattttttgggctcttcgctgtttctagggaaacgatgattaattcggctcgatgaggtagctggggccacatgctgtatgacatcggctcaaaatgtctcgaaccacgcagtgcccatatccacatagatacctatctgcctgcggatatgttataattacagcaacgtattccagcatatccaaaaggcagatatggacagacagatgagcttttaggaccttaaatcctaaggtctaaggaagaagaccagacgagaggcattcctggagcggatggatgtaatcgttgtgtgggatagctggattgcactggtagataccagctaccattgacaggctcctgtcaggtatgtgcgcgctgcaaagacgaagctttaggatgtatcctgctttaggttatgtttgctctcttaagacgagggaacttaaagatgctatcctggattgccactcctggcagcgcttctgtgcaagtagacctcatgcaagcgcaggtgccagatgcgacgacacttgcgaagatgcgccatagccttaaagcggcagggactcggcaaagctatgcttcacgacctgaattcagagcttaagaaggcaggaatcacggcgcggggtggctccattgtggacgcgaccttcacctgggccttaaagcttcacgaagaacaaggaccatacgcgcgacccttagggcgcaccagtccaagaaagggggagcctggcgtatcggatacaaggcgcatatcggcgtggatgccgcaggtggccttgtgcatggtgtggagacgaccgcttagaatgtatctgacatatcctgtagcacatgcactcgtaagggaagatgacaggttctgctgcacagactttaggctatataggtatagcgaagcgcccttaaggacgcataaagacccacacctctcatctatgcgctaaagtgttgctaaggaagccttcgactagagagggccttgcctgtgcactcttgtccgagaagggtatcgagtccaggaaggcctccggccactcaaaggcagaagcatcccttccttatcgtgaagcggcgcttctgccccttaaagaagcgctactaggggatagagaagacctcctgtatgctcaagtctttctcgcccttgcaaaccttacccatgtatcttttgccggcaggctgcacctcccggctcccagcgtcgcttgatctgccttggagtctctgccgaatgcggtcatgcggcaggacagatgtaaggatagtggctcctgcacgtgctggatgagcatccttccctgcctttcctgcatgccggcctagaaaagtcgtgtggtcggtcctctctaacacgttatggggcattaatcatcgtttccctaggcgcagatccgcggattgcgtagttaacgcagcggtcgagtcaagaaaaaagactgggtgatgggtcgatggagtgtactaccccatcgaccctttccctggatgttgacgaactaccgctcagagggggttcgtttttgattttctgcgttgggtctttctacgacccccacgcagggggcatccgaaccctgtttacctgcggtaacgtaaagttttcccagttaaattggggtacatgtttcgcaggtcttctatgttattgcggttattgtgaccatgcacaagaccgctacagactatttaggtactacgacctaaatagtctgtgacaagtgacaaacgcaggtcagagtggccgtatttttaggccagtttgagagccggtggcgccggctgcgcgccgcctggcgcggctgaccctcgatgacgcgccgccgcgtcatccctagaccccaccgccggggcaagatggaagcgtagtacaaattccactttagtggaatttgtggccacgcttcctacatcttgcacaccgttgggggtggtgtgacgccgcactaccccattgaggtcttttcggtacgctttagtgtgctaggattgtggtgctaaaagggtatactataggtatgacgaaaggggtgcgatggaaccggagattcatccgaacgccctaaagcacctgagccgtggggaggtgcttcaggcatgggggtcggtgacgaagagcatcatgcgccagagccctcaggagcctcctagatggctcatggtcggctggctggccgatgggagggacgttgagctgatagcggtcgagacggtctctggttggctcgtgatacacgccatggcgccagtgcagaggaagtttgcaagagagatagaggccactgaaaggaggtcgcgatgagcgagaagacgtgggtcgccgccaacggccaggagataaccgaagagatgatagatcgctggtgcgacgcctacgagcgcggtgagttcccggagggcgagcgcaccgtgggtggtgtcgtgcacggtcgcccgccgctctcgaccgaggggacggcggtcatctcgatcaaggtaccgatcggcatgaagagggccgtcgagcgcaaggctaagagtgcaggcatgagcacgagcgcgtacgcccgcgcggcgctggccgataagctgcttggggtcggatagggaagaggtgcgggtgcatggtgcgtgatgacggggccgtgacggtctctgtggagctgtctggggagacggctcgggtggcgtccgagcaggcaacgagggcgggggtgagcctcggcgagtacgtgagcggcctcgtggccggggaggtcgagcgcaggaggccgtggcgcttcgagatagagttcgacgagcagagggccgccgcacatgggaccacagcgaacgagctgtacgaccgcgtgggggccttcgtggagccctacagcaacgtccgcgtggctcgcggaacgtggcaggtgtgcgagggcgcagacgagttcagggcacagccagtggcgctggcgcgcctggtgcaggagcgctgggtcatgcagagcgtcagggccataacgtattgcgaggatggtgtcgagggggactacctcgacgtggtacgtagggtctcgccgcgactcatctgcgattagaaagaaaaaagcccgccctaccggaataaggcgggcgggtttatactggtggccgaaggttcttggtgctgctaacaccaagaacgccgaagacgaggttgcagctcgtatcagcaccaccattgagtataaccggtgcggtcacgtccgtaaagtggtgtaaatagaggaacgagccagaggctcaggttccaagtatcatttgcaatcgccagagagcaagaagacttgaaggcccgaacatggctcagatcaatattacacttaaccaggacgagataatgcgactgctcgaagattccagcggggaggcgttcaagctcgtgctgcaaaagtcgctcaacgcccatctgctcgcggagtcggccgagcagatcccgtctttagcgtttagcaccacgattcttcaggacccggaacatggcccggaacccgaaaagccagccttgagctggcttttttcatgcccaaagcttgatctgcggggaatttcctggcgtcatctatatacggtgctatggtgctttcgtctgacagggagtggcagatggcctacttcctcaagcagacgcgcaacaggaaagggctctatctccagatatacgagagccactgggaccccaagcgaaggcataccgcgcacaggtccgtgaaggcgctgggctatgccgacgcgctgatggagaagggcatcgccgatcccgtctcccattacaagcgcgaggtggcctgcatgaatgccgagcggaaggccggcatggagagggagagggtgcgggagatctgacgtgcctgccacgagacacctcggccacttcgccctgaaggcggtggacacggcgcttgtagctgcaggcgacatggcgctgctccagaccccctcgggcttccgcttctcgctgcacgatctcctctcctcgctcgtctatgcgagggccgtcgccccctgctcgaagctcaggacattcgaggacgtgctgccccagatggagggcatcgatgcgcagttcacgctggaccagctctgagacgggctcgcctatctgggcgatgagtacgacaaggtcgtcgagatctacaatgcgcacgtggaggaggccttcggccacgacatgtccttggcctacttcgattgcacgaacttctacttcgagatcgaccgcaaggacgatttcaggaggaagggcccctccaaggagcacaggccggagccgacagtcgcgatgggccttctcctcgacgccaactgcatcccggtggcgatgagcctgtttcccggcaacgagagcgacaggccgcagctggggagatgcatcgcccagatgaaggagagaagctccatatccggcaggaccgtgagggtcgccgacaaggggctgaactgcgcagccaacatcgcggaggcggtgcttgcaggggacggctacatattctcgaagtcggtgaaggcgctccctgccaaggagcgcacgtgggcgctctcgggagatggctggacggacgtcgccgacgggaagggcgagacatcgtttcgctacaagatggcggacggcgacttcgagtacacggtagagggagaggacggaaggaagaggaaggtcgagctcctagagaggcgcgtcgtcacgtacagcccctcgcttgccaggaagcagaaatacgagatagaccggcaggtggagaaggcgaggtcgcttaaggcggcagccgcgaaaaggtccgagtacggcgacagcgcgaagtatgtcacgttctcccccgtcaacggcgagggcgagctcagggaggacatgaaggccgtggccaccttaaaccacgaggccatcaggaaggcgaaggccctggcgggctacaacatgatcgtgacctcgaagaccaggatggacccccgtgcgatatatggcacctaccacaggctctggaggatcgaggagagcttcagggtgatgaagtccgagctcgatgcgaggcctgtctaccttcagaggcagagcacgatcacgggccacttcctcgtgtgctacatcgccgtgctgctcatgaggctcctgcaggtgaaggtgctgggagatagcttctcctccaaggacatcatggggctctgtcgcggcctcgatgtgtgccgcacctcggagaggaggtatgccaacatatccaggagaagccccatcatcgaggagctggcgtcaaggacagggcctccgctgcttcacttcaacctcaccgagggcgacgtgaaggcgatctcctcatgcacgctcgcccaagctgcgcggtgaagggaaggggcccttctgccggcaggaagcgcggctgaagggccccatagcaccatatcggggatcgaaaaaccaaagtccggtactacaagcatctcaagcccacaggaggaagactgcatagccgagctgcgtggcacaaggaaagtccatcaggtgtatcgcacgcaagatcggcagggacagatccaccatctgccacaagatcgagaaaaatgagcgcgcaaacgctttagggcctgtgcggcccaaaggagagcagctgcccgccccatggcagggagagggcggaaaggcggctcttggccccttgcgcttacagagaagatgcgctcgcttatcataagccaagcgctggtcccccaagcagatagacgacatctcagacccgagtatggtgtcagctgcgtcgttgagcctctcgactattctgcagacaggcccaggccgctacgctcgagaccatcactgcgaattacgataaggggttcgcaagacatggctaaggtcacaaaggctcttgcaggcgtgcagctctacttctgcaagctgcaccacccctggcagaaaccgacggctaagaacactgacggggctgctgcgcgcgttcttctcgaaggggacggactttagcagggtagcagacgaggaggcccagcacacagtggagctaatctgcgacaggccgaggaaggtattaggctacaagacggccaacgaggccttcaaggagatggtgcactcagtttgacaatctgccgtgcaaaaaggagaccaggcacgaagcctgatctccctcttgttcaacgctctgtgtttggaaacacaagcttatttcagggttacagaagcacctgcgtcctcgagctccttcttggcggcctcagcgtcctccttcttggcaccctcaaggattgccttaggagcagcctcaacgaggtccttagcgtccttcagaccaaggttggtaagcttacggacaaccttgatgaccgggatcttactgtcgccgtagctctcgagaactacgtcaaactcggtcttctcctcctcaggagcagcagctgcagcaggagcagcagcgaccgctacaggagcagcagcagagacaccaaaggtgtcctcaaggtcgtgaacgagctcagagagctcaagtgccggcatctctttaattgcctcaatgatctcatcttttgtgacagccattgtttttcctcttcttgtctaggcactcttatacgagtgcaccaattgattcgttactgatttcaggcagcagcacgtaggttatgctgcgtccttctccttctgcttggcaacagcatccagtgcagttgcgagaccgcgggccggacccgcgcagacagaagcgatcccacgcagcggacttgcgagcacgtgcgtgaattgagcgataagctcatcgtggcccggcagatctgcataagccttagcatcctccggtgagagtgctttaccgtacgcgatgccaccgacgaaggaaagcttcttcgtcttctgagcgcaatccttgatgacctttgcggactcaacaggatctttctggaagaagacataagcgcaggttccactcagatccaaatcgggcatatcggcctctttgagggcgatcctcacgatgttgttcttgtacaccttcatggatgcgtcagtatcacgaagattgcggcggagctcctggctctccttcacgctcaggccacggtaatcgacgacaaaaagtccatcggaagaatccagggactccttgaccttgctgagcatttcgacattgttcttgttcggcatgtatgacacctccctgcatacctctcggcacgaactacaagagcggcaggtcacatagaaaatcccgcctggtccataccagacggggtctcaatcaaatacctaagaccacctcggcaggcagggcatctatcccttttaaaccttctcggtaccggctgtctctggcagtagacgtgcttttgtttacaacaatagatatttatacaacacgggacacaaaagtcaagctcaaagcgcttaagtgtggcctcacgtacagcatatacacacaaaaatgggagaaggctccaagccctcccccacagcatcactcatatgcatatggtgtgtaccagctactcctgcggaagcaggttgcgggttgcggtcggatcgactttgacgcccgggcccatcgtgctcgaaagcgtgacggacttgatgtacttacccttggcggttgccggcttgatacggacgatctcagcgatcagcgctgcgtagttctcaagcaacttctgctcgtcgaaggaagccttccccagaggtacgtggcagataccgtagcggtctgcacgatactccacccggccagccttgagctctttgaccatctttgcgacatccatagttacggtgcccagacgcgggttcggcatcaagccacggggtccgaggatacggcccagacggccaaccttgctcatcatgttcggagttgcgatcgcagcgtcaaagttaagctcgccgccctggacctgcttgacgaggtcgtcggagcccacgatatcggcgcctgcctcttcagcctcgcgggccttctcgccctcagcgaagacggcgacgcggacatttttaccggtgccgttcggcagtgagacggagccacggatgttctgatccgcttttctggtatcgacgcccaagcggattgcgacatcgatagtctcgtcgaatttagcactagcgagctgctttacgagggtaactgcctcgctcggctgatagagtttgttctctaccctcttggagttctcgcggtaagtcttaccatgctttgccattgttttttctaccttctgtggtcaacgggcaccgatccgtgccctcccacattggatgagcgattgttcgctcacttcagacagcagccttaactgttgtccctcagtcccttacaaccttagttctcggcgactgtgacgcccatggagcgcgccgtgccagcgacgaccttcttggcggcgtcaatgtcgtttgcgttcaggtccggcatcttgatctttgcgatctcttcaagctgctcctgagagagctcaccgaccttatcacgctgaggaacgccggagccgctcgtgatcttgagggccttcttgatcagctcagctgcaggcggggtcttggtgacgaagtcgaagctatggtcctcgtagacggagatctcaaccgggataatgtcgccggccttgtccttggtctggttgttgaatgcagtgcagaactgcatgatgttgacctgtgcggcactcagtgccggtcctactggaggagcgggggttgccttgccggccggaatctgcagcttaataaaattgataaccttcttaggcatgataaactcccaataatctatacgccctatattgtaagcattgacgcagagaagcttcctcaccgaacagcgccgtgcttaagaagccttagtcgatgctgcggatctggtcgagggtcagctcgaccggggtctcgcgaccgaagatcgtcagcatcacgcgaaccttattggcctccgtgtcgacctctgatatcgtaccatcaaaatcagccaacggaccggagacgaccttgatcgtctggcccttctcaaaggacgaggcaactcgtttgggtgctggccccttcttcgaagcgtcgtccttgtgcatcatcttgttgtactcactgcggcgcagcggagcgggcttagagccgtcaagaccgacaaagccggtgacacctggggtgttgcggacaacagtccaggtgttgtcatccatctccatacggaccagcacgtagcccgggaagactttctgttccttggtttcgcgcttgccgccttccttcacctcggtgacctcttcggtcgggatctggatgtcgacgatcctgttctgcatcccgaaggtctcaatgcggtgctcgagatccgtcttaaccttgttctcatagcctgagtacgtgtgcaccacgtaccaatgcttagcaaccatgatctagcccctcagtcctgtaaatccgacgagtaacgcaacgacaccggtatcaacaagccaggtgcagacaccaaagataatgagcaggacgataaccgcgcccgtatagtttctgagctctttcttggagggccacaccacgcggtgcatctcggtcctcacatcgtcccaatagctgcggatacggcccttcttctttggtttgaccgcgacggtggtcgtcttcgtgttcttactatcgggagccttcttcacatacttcggagccttcttctgcttctcagcatcctgggtagctgcaaaggaaccatttgcggccttacgggccgcttcacgttgagcacgttccgcagcgcgcgctttgcgagcagaccgcttattacgctccttattagccattccccactcctcaagtaaggcttgtacatagaaaccggctaacccatacgggaaagccggtgaaatttctggcaggccaggaaggactcgaaccctcaacaaacggttttggagaccgccgctctaccattggagctactggcctgtatgcttatcccgcttagcgggtctccttgtgcagcgtgtgcttcttgcaccacgggcaatacttcttcatctggagacgctccggattgttagtcttgttcttcgtcgtggtgtagttgtgacgcttacattcggtgcatgcaagggtaactaaagtacgcatgtatcgtatcctcctgatctaaggtcatcgtcgggacaacctcgaccatgacgcaagagtgtacgctaccatcgagttagtaatgctgtcaactatcttcgcaagtatttatcgtaatgcacaaaacgtgcagatacaagcacgcatacccaagatagaaaaagacccgatgcaagcatagcaccaggtctttgtgaatcaaagattaaagctactcaataatcttggagacacggccatcagcaacggtgtggccaccttcacggactgcgaagcggtcgccctgctccattgcgatgtggtggatcagctcaacgctgatcgtcacatggtcgcccggcattgccatctcgacgccctcaggcagggtgatggtgccagtgatatcggtcgttctgaagtagaactgcggacgatagttggagaagaacggtgtgtgacggccaccctcctccttggtcagaacgtagacttcaccctcaaacttctggtgcggggtgatggagcccggcgcgcagatgacctggccacgctcgatgtcctcacgacggataccacgaagcagaataccgacgttgtcgccagcctcgcagaagtccagggtcttacggaacatctcgataccggttgcggttgacttctgggtcggacggataccgacgatttcaaccgggtcgttcatcttcagcgtaccgcgctcaacacggccggttgcaacggtgccacggccggaaatggtcataacgtcctcgatagccatcaggaacggcttctcgttatcacgcttcggggtcgggatgtaggtatcgacagcctccatcagcttcttgacggagtcaacccacttcggatcaccctggagtgcgccgagcgcggagccacggatgataggaatcttgtctccggggtaaccgtactcagagagcaggtcacgggtctcttcctcaacgaggtcgatgagctcttcgtcgtcgaccatatcgcacttgttcaggaatacgacgatatacttaacgccgacctggcgggcgagcaggatgtgctcacgagtctgtgccatagggccatcggtagcagcaatgaccaggattgcgccatccatctgtgctgcgccggaaatcatgttcttgatgtagtcagcatggcccgggcagtcaacgtgtgcatagtgacgcttctgggtctcatactcaacgtgagaaacagtaatcgtgataccgcgctgacgctcttcaggagccttatcaatgtcctcaaacggctcataggtcgctttgcaacccggagtttcagataggaccttggtgatagctgccgtcagggtggtcttaccatggtcaacgtggccgatggtaccaatgtttacatgtggcttagtgcgctcaaatttttgcttggccatttgccatcctccttcaaaaatcaaccctttggttggtttctcctaactatacactatcctaaacggcaccgaggcaccgtggtagatctggtagcggtgattggactcgaaccgatgacatcgcgggtatgagccgcgtgctctaaccaactgagctacaccgccataggtgcttgagtatggagcctgcgaccggatttgaaccggtgacctcttcgttaccaacgaagtgctctaccgactgagctacacaggcaatggtggggatgcatggactcgaaccatggaacccagagggagcggatttacagtccgccgcagttgccgctgtgccacatccccatatgtaatcaagcaaatgctgtagggctaatccccagcagcggagaagatagtacgtccttagaatggcactgtcaacacatgacacccacccgggcgtcacccacacacgattcccacacatctgcagccagggtattcagagtagtaaaaccgcccaacgcaggcccctatacggtctcccgctatcaaagaggaccgggcggtcacccggtcctttcagcagcttctggagccagcagagggagtcgaacccacaacccacggtttacaaaaccgttgctctgccattgagccatgctggcatatacctggtaatgatacctctaactacgtaaaatatgccagagttttttgcgcatgtccggtgagattctgtcctcaatcgtcgccttgtggtgggaacggtcctgctcctcaaccgcgacctccgtgtcgatgtgctcgagttcgcggacaaagatttttgaggagattgcagtcacatccccagggccagcgccgatcgtcgcacggatcgtattgtccgaggtggcgacgctcaccatcctcccctcttgccgggcttgggtcgcaaggcgctcgatcacggaatccgcactttcccctgttcgggagaatacgacggtgagtcctgcctcgtgggtcgcattgcggtcagggtcagcgttgctggctccgtcaaagactaccaccgcatcaaagcggccctgagcataggtcgccacatcgctgatcagggcttcgcgtgcgcggataaaggggtcggtgtcaaagctcttcgggtcggtgtgttcatcgatcagcccctcatagcgcggggttgcacccattacattgtacccgtccacgagcagcagctcgcgtttgctcttgtccatgtccatgctctctcagatccgacccatacctgctgcaccgcagcacaccgcatgagcgcgtatcagcacatctgagactgatacgcgctcatagatggtggctatgctttcttgcgcaggcgagcgccggcttgcgtgtcttcgataacaaggcctaagcctgcgattccgtcgcggattgcgtctgcggtatcccactgtttggccttacgggcattctgtctcgtctcaatgagcgcctgcgccgcttcaacgggatcgtcgccgtcgaagtcggtatagcgctttgcgaggtcaatgagctctgagggcaacccctcaggatccttcgaggagaggtcgataccgaggacgcaggaaagctctaccagagcatccgcagctctcagtgccgcggcggtcgaggtgtcgctgcctgcctcagacaggtaggtattgcctgccgtgaccagcccaaagatcgcggcaaggccgcctgcggtattgaaatcatcgtccatctgagcggtgaaggaggcctgcgcctctttgaccgccttcgttaaggcccggtcatgatcgctgagccccccgtcctggggggcattctttgccgcccacttaaggttcttgacacagctcttgagacgctccagggttccgatggcgccgctcaggcgctcaaagctgaagtccagaggtgagcggtagtgggtctgcagcatcagcaggcgcagcgcgtccgccggatacttgtcgaggacctctttgagcgtgtagaagttgcccagggacttggacatcttctcaccgtcgatcgtgagcatgccggtatgcatccacacattggccagcggcgtatgccagttgcacatgcactgcgccgtctcgttctcgtggtgcgggaagatcaggtcctggccgccaccgtggatatcgatcgggacacccagataacggtggatcatcgcgacgcactcggtgtgccagccaggacggccgtcaccccaggggctcggccagctcggttcacccggctttgtggctttccacagcgcaaagtcaagcggatccttcttctgctcgtttttctcgatgcgggcgccgctcatcagctcgtcgacgttgcggccggagaggatgccgtagtgcggatcgcttctcactgagaagtacacatccccaaaaggcaccgcataggcgtgcttctgatcgatcaacccttggatcatctcctgcatcgcggcgatctcgcgcgttgcgcgcggacggatatcagggtcgaggatcccgaagcggtgcatctgtttgatgaaggcatctgcgtattgttcggagacctctctggcagctctcccctgctcattggcccgattgatgatcttgtcatccacatcggtcagattctgggcgaaggtcaccgagtagcctctgtaggtgaggtagcggcggatcacgtcgaaacacaggaaggtacgggcattgccgatatggatctcgtcgtatactgtcggcccacagacgtacatgcggaccttgcctttctcaatcggcctgaactcttcttttctcctggtttgggtgttatagataagcatgctttgcttctcctttatctgcgacaccagtccctcgcctcaaaggtcgatgcctctgtctgccccgctattgtacgtacggctgtatctcagaacaagacacattcaggctttctgtacatcaagcgctgcggccaagcagcgctacggcccacgccgcaatgccttcgctgcgccctacgaagcccaatccctcagtcgtggtagccttgacgccgcactgctcaggggcaacgcccatggcttcagccaggtgttttctcatctcatcccgatagggtgcaagcttgggcgcctgggcggcgatcgtgatatcgcaatcgatcagctcaaaaccgtggctgcgcactttctccatcacttggctcagcaatttgagcgagtcagccccctcataggcaggatcagtgtcgggaaagagctgtccgatatccccttcgcgcaaagctccgagaatcgcatccatcagcgcatgggtcgctacatccgcatcggagtgacccaaaagccccttttcagaggggatgtccaccccacagaggatcagctttctgccttccaccaaacggtgtacgtcatatccatgcccgatgcgctctatcacgatattattctccgctcttccggcttctctcctgccactgactcagccgctggtcaagtactgcctcagctagggagagatcctctggcactgtcaccttgatattgttgcgcggtgagaccacgcagcggatcttgccgccgtagtgctccgccagacttgcgtcatcggttcccacgtagcgctcagctgccgccgcctgatggtaggccaggatccgcttggtacggaagacctgcggggtctgggcgacccaatacagcgagcggtccggcgtcgaaagcacagtctgcttttcaacgagtttgagggtatcagtagcgcggtgcgcggcaatggtaccggcgagatcgggatccacccgcaggtaggcgatcgcgttttcgatcgtcgccgaggtcacgagtgggcgtgccccatcgtggatcgcgcagtacggtaaggttttatcctgtgcctggatgccgaggtagcttgactcctggcgggtggcaccgccctcaacgacggcaatcggggtgttcaggctcagcggcgcgatcgcctcgtcgatcatcttgtcgcgcttacccggtgggcacactgccacgatctgtgcgaccgagcgcgcctcatcgaaggctaaaatggaccaagagaccagcggtaacccacagagcttgacaaactgcttctctcgaccgaaccggatgccggaacctgcggcgacgatcacgcccgcgcagtctttggtggtgcggctgaagttgattgttgcgcgctgcgtctcagtcttcgtacacatctcggagcaaacaccatacatcagtgcttaccccacatacgatacaggctggccgccagaagagaggggttcttgacgccgagggaatcgaggcgggacgggttatcttggatatcgtcaaggagctcctgcagcgatccgtactcatcgacgatcttctctgccatgccctcacggaccactgacacccgcgagagtgttcttaagcccaacggcgtcatgatcgaatcctcagtcttgtcgtggtagcccagaagctccgcgatccgcttggtggagcggagatccttgttgttcatcgcatggaacttgacgcggatctccttggcatgctcctctgaggagtccgtcgcatagtcgcggatcatcaggtcgtactcttcgtccatatcgcccacgaactcgtcgcgctgcatatcgacggtcttgccttcgctgcccagctcatcgatgcacttctggagctgctcggccgaggtcatcagcacctcaaactggtagaagacctcggagatatcccccaaggtcacgtagttatccaactccagagtggtcaggcgcagaaggcttctgtcaagcgtctggcggctattctggagggtcaccaagagctgattgacactgctcatgatctccggcacacttctcagctggaagcggtgcccgtcaacaaagacgctcacgacgtggcggcgctcggacaccgagatcaccatcgccttagtcaaaagactcatacgtgccgcggtgcggtggcgcataccggtctcggaggtcggtagcgaggggtccggatcgaggcaaaagttagcgcggtagatctgggtcatacccttgtcgattacgattgcgccgtccatctttgagagctcaaagaggcgattggcagtgaaggagatgttgagcgggaagccgtcattgccggctgccagcactgcatcggtgtcgccgacgcagatgagggcacccatgttgccggctatgatcatatcaagcgcgcggcgcaaggaagtacccggcgccgtcgcgacgaccgcgtcgtgaatccgttcctcttttgttttctctttcacctgggaggccgcatcgctgtgtttgatctcatgttctgtggcgcccatatctacccctttaagtgttgctagaagacacagaaagtttactagttgttccttctctagtgtaataaaaaggctgacgcaaagcaccaaatcgcggtcctttcgtcagccttcggttctttagaagcaggtacctatcactgctctgaggtttgaagttctccgtcattgccgccggataccgctctggttgaatcgggcagtgaccaactgtcgtgcgccttcggggcatccatgtggatgtgcttcgacggctcggggatcttgccggtcgttttcgtaaaggtcagtttctcgtcctttgcgtcgaccaggacaatgtcgcctgccttccacttgccctgcagcagctcctctgctagcggatcctcgatcatcgtctggatcgcgcggcgcagcggacgcgcgccgtagatcctgtcggtgccacgctcagccaccaagtcacgcgctgcatcggtgagctcgatggacataccgttagcgatgaggcgatcacgcaggccgttgatcataaggtcaacgatgccgcgcagctgcttctggttcagagacttgaacacgacgatctcgtcgacacgattcaggaactccgggcggaagaggcgcttgagctcgctcatgacatgggagttgatctccttgtcggagagcccgtcagagccaccggtgaagcccattgtcgtggtctgtgcgatatcgcgcgcgccgatgttggaggtcatgatgatgacggcgttggagaagtcgacggtacggccctgcccatccgtcagacgtccttcatccagaatctggagcaggatattgaagatgtcagggtgtgccttctcgatctcatcgaacagcacgaccgagtacggacgacgtctcactgccttggtgagctcgccaccctcgtcgtagcccacatatccggggggagcgcccacgagtttcgagacctcgtgcttctccataaactcagacatgtcaaagctgatcagggcatcctcagagccgaacaggaactccgcgagtgccttcgcaagctcggtcttgccgacaccggagggtcccagaaagatgaaggaaccacccggacggcgcgggtccttgagcggagaacggcttcttctgatggcgcgggccaccgcggagaccgcctcgtcctggccgatgacacgctgatgcaatgcttcctcgcagcgcagcagcttggaggcttccgcctcggtcaagttggacaccgggacagcggtgatcgaagacacgacatctgcgatagcagcgggcgtgatggtcgtcacgtgctcgttgatcttcttgtgccaggtcccctcgagcttcttgcgcttgtcagtgagctctttctcctggtcacggtagcgcgcggcctcctcgtactcctgcgcagcagcagccttgtccttctcctgcttcacgtgggcgagctcttcgtccacctttgcgatgtcaggcggcgtcgtcatctttctcacgcgggtacgggcgcctgcttcgtcgataatatcgatggccttatccggcaggaagcgatcctggatgtagcggactgagagcgacacagcgctgcgcagcgcatcgtcggtgtacttcacatggtggtgcttctcatagcggctctgcaggcccttgaggattttgaaggtatcctcctcggtcggctcgcccacatacaccggctggaacctgcgctcaaacgcggagtccttctcgatgtgcttgcggtactcgtcagcggtcgtcgcaccgatcacctgaatctcgccccgggacagaggcggcttcaggatggaagcagcgtcgattgagccctcagcggagccggcgccgatgatcgtgtggatctcatcgataaagaggatgtccttcttggagtcacgaacttcgttgataaccttcttgaggcggtcctcaaactcgccacggtacttagagcctgcgacgagggctgcgacatcaagcgtccagatctgtttgttgcgcaggatatccggcacgttgccggcgacgatcagctgcgccaagccctcgacaattgcggtcttgccgacgcccggatcacccaggatcatcgggttgttcttctgacggcgggcaagtacctgcatgatgcgctcgatctcacggtcacggcctatcaccggatcaagcttgccttcgctcgcaagctcagtcaggttgcggccatactccttgagcatggagccttcctgctgttgctgctgaggctgtcccatcccgctgaacatctcagcacccatgttggggataccctgcgatcccggctgctggggctgtacctcgtcctgcgtcagctcgtccaccgcgttgcgcaccgcgtcaccggagacacccatgcgggagagggcctccatagcgacaccgttgccctcatcgacgatgcccaaaagcagatgctgggtgtcgatgtaggaggcgctatgcgtcatcatctcccgatacgcaccctcgagcacgcgcttggcgcgtggggtgaacggaatatggccaccggggatcggctcggtgccatcccgggtgatctctttgatcgcctcaagggtctggtcataggtcacatcgagattcttcaaggcctcggcggcgataccgtcgccttccttgatgagggccagcaaaaggtgctccgtgcccacatacatctggtcgaggtttcgcgcctcatcctgggctaaggatatgaccttgcgggccttgccagtaaacttttcaaacattgggttgagtcccccttaaaattggtctccatcttctactgcatgagagagaagatgtggggcatcaggtgattgttctctctataccccgggcagttcctgtttatcccaccgcatcgcttctgtccacttcatgactcacgcagctgtacctgggttgaaaaaagcctccgaaagtcttgcgacctctcagaagctttttcaccactatccttgttcttatgatagatatacccagatttactgcttgccattcgacttcgcgtagatatctcccacgggggcgatcgccttcatcgcggtcaggaccgcgtcgaggcactcgttcatctcctgccccatgtactgggcaccttcacgcatcacctcgcggttgcagcccgcggcgaagcgcttgtccttgaacttcttcttcagtgacttgagcggcatgtcggtgacggagccggaggggcgcatctttgcggccgcttggatcaggcctgacacctcatcgcaggcaaagaggactttctccatctgcagcttcggcttcggaagcgcctcgttgttgtcggagttgtgcgtcatgatcgcatgcgcgagctgcgccgtagcacccacctcagccaggagctctgcagtcttgacggtgtggttcttctcgtcctggaacttctcccagtcgagatcgtggagcaggcccacgatgccccagaagtcaacgttgtccgggtcatactgctttgagaaatagcgcatcagtccctcaagggtctcaccgtgctcgacgtggaagggctccttgttgtacttcttcagaagctccatcgcctgatcgcgggaaatccccgcctcaagcttgcctgacatatcggcatcgatcgccgcctgggcagcctcagagaggccgttgtcctcgacagcaggctcactcaggtttgcctctgcctcttctttcttttctgatgccatatcctcactggctcctttctctgcattgtcaaagagggcgtcggcagaggctgcagagttgtccgtggcatccggcagctgtgaggcgatgtcctccttcgcgatcttctccggcttcatctgcgggaagagcaggacatctctgatagagggttggtcacagaagagcatgatcatgcggtcgataccgtagccgacaccgccggcagggggcataccgtactcgagggcgcggacatagtcgtagtcgtagcccatagcctcgtcgtcgccgaagtcctttgcagcgacctgctccgcaaagcggccagcctggtcgatggggtcgttgagctcagagaaggcgttggcatactcgcggccggcgatcagcaactcaaagcggtcggtgaggcgcggatcgtcctctctgcgcttggagagcgggctcacctcttccgggaagtcgcagacaaaggttggattgacgatcgtatcctcgcccagctgatcatagatcgcgaagaggagcttgccgacgccccagttcttctccgtctggacgccatttttctcgcacagttcacgcaggtggtcaatcggggtgtccatatcgacgtgctcgccgacaacctgcgagtcaacctcagctaccgacatgctcttccaggtgccggacatatcgatagtctgtccctggtaggtgatcacctcatggccttccttgcagccgcagacctcacgggcgatcgccttgaagaggccttcgctcaagcgcttcataccctcgaggtcggagtaggcgcagtaggcctccatcgaggtgaactccgggttgtgcgtcaagtccatgccctcgtttctgaactggcggccgatctcaaagacgcgctccataccgccgacgatcagacgcttcaggggaagctcggtggcgatacgcagatagaagtcgcggttcaaggcattgaagtgcgtgacgaacggcttcgcattggcgccgcccacgatcgcatgcatgatcggagtctccacctcgaggtagccgtcggcctccatatagcggcggatcagcgagatgatcgcggagcgcttgcggaagacctcacggatctccgggttcatgatcaggtcaacgtagcgctggcggtagcgaacctctttgtcctgcaggccatggaacttctccggcagcggacgcaggctctttgagagcaggacgagcttggtcggcgagatggagagctgcccgcggcgagtacgcacgacgtagccgctcgcctgcaggatatcgcccatatcgagcatagagaggagatcccagtcctctttggccatggtgttgatccggcagaagagctggatcgagcccgtgcagtcctccagaatcaagaaggcgatcttgccctgcttgcgcagcgcgcggatgcgacccgcaacggtcacggaatcggtcgtgtcctccccacaagccaggtcagtgtacttcttctcgaggtcagtggcatgggcggtgacggtacttttgatcggatacgggttgatgccctcctgcatcagctcggtacggcgccgcctgcgctgtgcgcgctcgtcgttttgggatggctttccctgtcccgtacttgttgtctcagccatgtatcgtgttctcctagcagaaataaacgccccgtcctatggtttgcaccacaggcgcggggcgtggctctctcacagattgttggtcagcgcgtcaccttggtgatcgtgtagatgcgcaccttacccgccggggacttgaaggagatggtgtcccccaccccatggccgatcaccgctctgcctgcgggggactcattagagatcttgtgcgcgagcgaatccgtctcggtcgtaccaacgatcgtgaaggtcgtcttcctgcctctgccgttcttgagctccacagtggaacccagggagacttccatcgcgtcctcattctcgacgacgcgggccgtcgcaaggatggtgcggatctcattgatgcgggaggcgttctttgcttcctcgtcctttgcgtcatcgaactcagagttctctgagaggtcaccgaagccgcgggcaatcttgatgtgctctacgatctcatcgtgtttctggccctcacggtagttgagctcctcaacgagtttatcccggccttccggagtcagtacgatctcatccgtcataatctaaaagcccttccataaagaaggtgttcagcttttaagctcaacaccttcactgtaccgttattattcttcagtgtccgcagtttctgcggcttccggttttgtcagcttcgcgccgcacttggagcaaaacgcggcgtcagctggattcttcgctccgcattttggacaaaagacaactcctgcctcagaagctgtgcttgcttcctctgaggaggcctcttcgaggtgagcctcagtctcggttgccttctcttcatccttcttcttatcgtcgtcaccgctcatgccttcgcggacgttcttaacagtcttaccgagggctttccccagtttcgggaggttcttcggcccgaagataagaagagccacaataagaattacaataacttccattggtccgaggttcatggaatccctctctcttgcgtctctgtgatatgtgttctacagagactctattcagcatcgaataccatagtataaccagagttagtatattacagcacagatagtgctctctcacgaatgaaacaattgtaggatattgctggcgtttcctcaatgcggcatacaatcctcacgggtactgcgcatacttcaatacaaggataaaaaactgtatcgtttcggctcgaggagcgtcctgattgtgactacgaaagcttcatatcactttgatgcggtcttctttgacctcgatgataccctctacgatcagtctgagccctttgcctatgcggtgaagcacgtgctcggcgatctgaaggggatctcgggggcccagctctttgaaacgagccgcctgcactcccaagaggtctttgcggcctttgcacgcggctatcgcccgaccgacacggtgtacatccaccggatgcaggatacctttgcggactacgggatccatctggatgatcagaccgcgctcaagctgcagcgcgtctatgccggcaacaccgccgacgcaatgcacctcgatccctcaatcgcacgggccttagactggtgttcccaccacaccaaccgcggattgggaatcatctcaaacggcaaactgcgcggacagattgccaaagtagaggccttaggggtggacagatggatcagcgcagatcgaatctttgtctccgatgccgtgggcgtcgccaaaccgaagcctgagatcttcagcctcgcctgcagacaggtgcgagcggatcccgaaaagagcatctacgtgggggatgcctttgccctcgacgttatcggcgccacccgggcccgcttaaaatcgctctggtacaaccaccggctgcgccacgcccccacctcgcacccaaaggcgacctgggaagtgcacaccgcaccggaactctatgcgaccctcaaatctaacgttatctagcctcgctgacctgcctagttatcgtcaggctccgcaaaccacaggttgtcaaaatcagtcgatacctgcggataatcggcatccgggatctccgttacatagaaatccccgtcaggcgtctcattgtagccatagagatatacatcgtctgaatgggcttccggagagagcgcaacgtactcggaatccccactctcaaagacaccgaggacttcgcattcctctgaggtgccatcttcgtaatctaaggtaatgtagtcaatttcgtcttcgttgcttgccatgaagattcctttctgatgcacctcttgtcttggtttgttctatccagtgtagcggtgggcggactcagagcgtggcactattctattaacggataaaatggcgagtacaggggcggttccccgcagttttgttgtacccctcggtataggcgtgggtcgtctcgatcgcatcgcgctcaaagtcatcaaggctgtgatacccgctcccccttaaggcgagcagctgtattgtaaacgtatcccccgccacatagtcggcgtagacatcgccgtttcccctgccggtaaagtgctggttgacacggctcagcacctgatgggcctgccccacatagtacctgcggcggtcagcattgtagatcagatagatgcccgggaaatccggggcaagggtgccgtgagggcgccgtacctggaagaattgctggggagtgagcttcctggagcccgtcgcaagccggcggatccgtcgacggggccgcgagacagccagataggcgatgcaggcccacacgatcaggatcgctgcgagataccccaggtagcgcggcagcagcgctacaagagtctgccgccccaccatgaggaataggtcagggtcgataatccctgtcggcagtgcgtcacgcagcgacatgaggcattcaacaaccaggcagaggctccacaggatcagagcagctttcccaaatcgcgcaacaccgggatgtttctttcccctcatgccttattcgcgaaacttaagaaggcttgggtgcgcgggtctgtggcgctctttacaatggattgcgggctaccctcttcgatgatctctccgccgatcagaagacagatgcggtcactgaccgtctcggcaaagtccatctcgtgcgtgacgatccccacggccatcccctgctgcgccagctggcggatcagatcgcgcatatcccaggtcagtttcggatcgagggcacttgtcgcctcatcgaaatacatcacatcggggttcatgcagagggcccgcgcgatcgccacacgctgctgctggccatcggagagctcacaggggaccatgttctcctgctctttcagatcgagtcgctcaagcagctctttcccttgtttttgcacctcttcctcatcccgcttctgcaccacaaccggcgcatcacagacattttgaaggaccgtgcgatgcgggaagaggttgtagccctgaaagacaaggccgaagtgcatacgcgccgcctgctcagccgtcctgtcatagactgcaccttttgaaccctcgttgtcgcacacgaccgtatccccgtaggcgatgcgcccgcggtccagacgctcgagaagtgtgaggcagcgcagggtcgtcgacttgccggcgcctgaagggccgatcagcgagacgacctcacctctctcgatatggaaattcagtccatgcaaaacctctttggagccgaaggacttataggccccggtaaagctcaccgcgcgcgtagtatcctcagtcatggtagtaatccaagttgttttcaatccgacgcagaataaattcgatcaagaggcaggtgacccagtagaagatcgccgcgatcacaaaagggaccatggtacgctggcttgccaccagggcacgacccacggtgaacatctctgcaacaccaatcgagaaggccagtgaggtgtcctttaccagggtcacaatctcgttgcccatcgccggcaggatgttcttgaacatctggggcaggataatatggaagaaggtctgtgaggggcggtaacccaagacctcagcggcctcatactggccgcgggggatcgactggataccggcgcgatagatctcggcaaagtaagcggcatagttcacgataaaggcgatgatgcaggccacaaacatgtagttcgggccggtcacaatcccaaagccgtaatatggcaggaagaagaccgcgaacatctgcagcatcagcggcgttccgcgcatcagcgagatgtagatacccaggaccaccgaaagcagcttgcacttggagagcctgcccattgcgaccagaatgccgagcggaatcgaacctaagagcgtcagcccaaagatctcgagggtcacaagaaaaccttgcgccagcatcggaaccatggtggatatactcacgcttacaccctctccttatcgttcacacatactaattggagacctttggcaggcaccaggcggtgtatgagacgccctggtccgcgtacttgttgcagatctcctcaaccttaccttcggaatcgagctgctgcaggtcagcctcaacggtgtgtgccaaggagtcgttgcccttctggaagcccaccgcaaagtgctcagagttgaggggctcgtacaagatcttgaagtcctttgagtcgccgatattgaagaccgcgaccgggtagtcaaccgccagggcgtcgtaggtcccctgccgcagcatcatgaacgcggtattgtagtcgcccatcgtatcgagcttggcgaagctggcgcccagatccgcctggtctcccccttcagtcaggaggtagtaggccgccgagtcggtctgagtacagacgttcttgccggccagatccgcgagtgaattgatatcggagtcagcgctcgtgacgatcacctggcggttctccatgtagggatccgtgaaggtgtagtcatcctcacgcccctcgatcgtaaagccgttccagatgcaggtgatctggccggagttgagcattgcgtctttagcgtcccagttgattggggtcggctggaactcccagccttccttgtcacagaccgcctgagccaggtcgatatcgaagccagtaatctgcccgccgtccccgatgtagccatagggcgggaactcctggtcaaacccgagcacgaaggggccggtgaatgcaacagagctgcctgagcctgcatccgccgtggggctcgaggagccgccacagcctgcgagcgaaaaaagcgccacgcagcctaccgcactgccggaaagtgaaagaaattgacgacggctcattgaagacatggctcgtacccccttcgaagatcgcctctgcgattgctgtctgtagtactttagtctagtaaagtagctgcgcagtagagcatacacgaacttcacaggcggcgcaagcgtgcacgcctgtcctgaaatagagctgtaaaggaactaatcacgttggttgccggtagcgatagagatcgcctgttcgatatcgtctgccacgatcagctggtcaagctcctctttagagatatcgcccgcctgggcaactgtattgcgcagccactcaaccagccggtccaacagtcacgcccgatcagcacaagcggggcatagccggtctcatgcgcctgaatcagcgtcacgaactcaaccatctcaccgaaggtcccaaagcctcccgggaagatcagggcgcctgagaagtatttgacgaatgtggtcttccgcacgaagaagtaccagaacaccatacccacattggcccgctagttgagcgcttccttgtggggcagctcgatccccaagccgactgagacacctcctgcatcgtaggccccatggtttgcggcctccataatgccggggctaccgccggtgatcgccgcagtgctgtccaagtttgacgcctgccccctgcgcctgcctgtagtagagcgagctctgcggagtccgggcaaagccaaagcaggcgatcgcaggcccaaggttcgcgagtgcatcgaagtcatccacagactctgtctgcccggccctccgcgggtcctcatgctgccagtctgtgttcttgtgcgctacggtgaggaagtctgctcaggcgccgtctcgccccgcaagaggatggggcctctgatgtagagctgcttacccccggcacctgcactttttcagtttggtaggcgtttggttgctttttcggtctctctgaagctttatcatcacgagctgtagtatttgtttgaaaattcatatcaaacctctcttcagtatttactatgagcctaatacagtttttgagaaattattgagaatttgtcttagataggctattcttttactgctgtgataggtaccgttgctccgcttgaacgcgaagacgaaaggggccgtatggctgctgaaacaaccaagacactggatatcacgaagccaatctctgagcttttggcttccaaccctgaactgaaggacaccctctcagagctcgatatcacgatccccgacacctccaagacgctgccggagctcgcccacgaactcggtatcggtatcccgatcatcgctatggcgctggaagctgccggctacaccgttgagggctattcaggcgatatggaccaggatgcgcccgccttcaatccgctgccagatctggtcgcgagagtgttcggcgtggaccatgagggaaacccactccccgagccggatttttcaaaaccggatatgtgctcccaggacgccctcgcccacaatacatccccggatacgctgtacctccacatggaggatgcgatccgtattgcccggaatgagggcaggctccccaagaatcccaaacaggcagacagctgattggttccaaaccacgtacattccaggccgcatcgacaagagtgccgatgcggctttttcgttgccgtacacgtgcctcgaggcaggattgctacgcggtgaggtagaccataatgataatgagagcaaagccgaggatgtccgccggtgagaagtgatagcccagaagaagcacggtgccgatcgtagagactaccggctcaatcgtgccgagcaggcttgccttgagtgacccggcgtcctttatgccttgcaggtagagtgcataagccccaaaggatccgaggacaatgattgcgatcagaagcaggattgcgtggaggtcaagcgccgctacattggtccaaggatggatgaagaggcccaaaaggatcgccgagaagaggaacccgaagccattcacgacgaaggagccccacttgttgagggcttttgtcggcacgatcgctaagcatgcgctggcggcggcacagagcaggccccagatgaagccgccgaccggcaggttcaactctccgggattgcctcccgtcgccaccagataggtaccgatcaaggcgagaaggattccgaggacctcacggcgacgaggagcacgtttcgacactgagcaggtgtagaccagaacgccgaccatccccaaactctgcatcacggtcgcggtagcaggattggtccaactcaccgcctcgatgtaggacacattggagaagagcagcgcgacgacgccgaccagcataatcgtgagcagtgctcgtgcactgtgaacagcgcttgaaaggcgctttcgatcggtcagcgccgctgccgcgataaagaaccagcaggaaccgagttcacgcataaaggtgagccacaacggatcgaccgcataggtatccatcaggatcttcgatatgaccccattgagaccccaaagggtcccgcccagaagtgtacagatgatccctcggctgacacgccgctcgcgttggagtcgtttatcgattcccgtcgtttcggtgctcacaggctcttccctatgctcgcgcgtttgagtgcgtccgtatcatagcacgcaggcacagacccgctgtgtcccgggttcaaaaagcacccgatcagaggccaggtgcctgcagcgcgtagtggttgtttgcttgctgtatgtaaactggctgcggtaaagctccacgccgtccttagcgggaagctccctgtgggttccctgctcgatgatggtgctgtggcccatagcgaggatgagatccacatcgatgatcgttgagaggcggtgcgcgattgcgaagctcgtccgattctccatgatcgccccaaaaaatgagctgacgaacagggagaagacgctgctgagcgatagcctgtgcccgaagtggaggctctcttgagctgctgtgtgccctttcgcttcccacttcgagctaccactaccagctaggcgccactccagccggtagccgagatggtaaggcctgcgagctcgtctgtgccggcttcgctgcgagccgacgacatgtagggcaggcgcgtaagcgacgagctgaaggcacaaggccacgccataggtgagtggagggtagcgcgcaccatgggtaaggaagacctggtgccccgcaggatgcccaagaagaagtgcggctacagctcgtaggaaggcgagatatcggcacatcccaacaacagggtgaggcaagactttgaggcaggccttcccaacttccttgtggctctcgggcgtcacgcagtttgagatacctgccggcaaggcctgcctgagccctatcctcgactgcggtaactgtaagctggacgccctctaccttacccgatgcggatatggccaactccatggtcggctcggcacttaccaccaccaagcaagagcgcagacatctggtgatccactcgaactgtagctgccactggcgctgtacagaaagtggatagccatctgtaaggaggccagaatcactcgctcccaatcgtacaagcgttgctcttctgataatgcctgttgggagggtttcttcgagacgatgaaaaacgagatgctctacggcagggactggtctgtcgcgacgctggatgagctgggggtgaagatagacgactacagtcagtggtacaacgagaaaaggaggaagaggtcactggggagcatgagcccgctgcaatacaggcgcagcctggggcttgcggcttagggaagacaggcacggattcccgttgccaccccaaaatgcatgggatacctgcgggtaagaagcctgtgcaagagtttagtttcctgcttcgtgccacgcgatcagatcatcgacgacaagcccataggagcggataccgccccgctcgccaaaacttgagagataggaatcgttgacagtcgtccctacgttttcaaagggcccttgaaactgttggtagtgcttctgggtctcctgccggtcgtgcacgacaagcatgaccccgtcttcgttctgttccaacgctgtctgcataacctgctgtgcgagattaggatcctccctacacagcgcattgaagcagtagttgaatgcgctgaagtagccggagtagacaaagtggtcgtcttcactggttgtgcaagctacaaacgaagcgaagttggcctcttcctcgcgggcgatcccgaggcgatgcgccacctcatggcacatatcgaactcaatctctgcgttcgcatcatcgatcggcacgctcgcctctccggagtcagcccagtagataccggtgtgaccggaatacagcaggggtttcccaaacagtattagcgccttcaccggcgttgtcggcccctggaagatcggatactgttttgagagcttctggtaggagcttcccgcaaccttcgccagttggaagaagtcctgctgctgcagggttccatccttatcgcgccgcaccgagtccgcccgctgcgcggcctgatcgagatagtaactggttgtctctgcaagttggttggttgagtattcctggactgaaaagcccatctcagaggcgagcgtgggggcataatggttgagcgcccaaccgtcaacggcacaggcaatgagcatgctcgtgacgagcaccacccagcttgcccatccacagaccagttccttgttccacaggtgacggatcagcgtaactaacgccatcaccaccgcataggcgatgagccagtcccaaaccgcgatcgggcaccaggcattgatcgcgccgaggatggtcgccagctgcttggttccctcccggtagacgggaaagaaggactccggcgactgccgaaacagtgccatcaggatcgggcaggaggctaacagcaccgcggcacagatgaatcgtatccgcgaatacagcctcagctgtcttttggtctgccgtttcttacggccttttctttttcgtatgcgcttttgtgccatagcccttcacgtcgtatcgttgtgttcatatcagacacaccgcattataaccatcgacgtatacaggatacttaaaccctgcagtcactccaccatactgaacctctggccaactcgtcttactgtggtcacaaagcagatcagagctgcctgagcagcgtcgccgtgcggtcccccccctgctcccttgcgccgctttgcctgatcctttttctcttccgcatcaaagccgtacagacacttcaccgccaatagtaaggtggcgagtgtggtgatgatgtcggagactggctgggcggtctgtacacccaaaaggtcgaagacgctggagaggatcaccgccacaagtcctaagacaagaccgaaccgacaggtaccgataaaggtcgcaatccacatgtatcctgagatctgcagcatatagttcgctgtcattgaagccccactgagcgctatcgtgaacgaagttaagcacagcgtgagcgtcccagcttccacgacctcttcttcattcctgaagaaatagatcagctgtgggacaaagatcgcagtagcaacaccggctgcaagcacgacacagaacgccagatgcaccgagaagaaaatcctgctcggtccacttgaaatttctggctcccaggttgtagcccaaaactgaccggaagccctggccgattcccctctgcagatagttggcaaagctcgtgatccgattcacgctcgccatcaccaccacatccccaaaggctgtcgcagcattgttgagcaacgcacctgcagccgccgacatacgctgacaggcaaaagaggggggcgccgccccggttgatcccgtggaagaaggctttcgagagacgcacatacttcaagtgaaaaggcgtaagcccgttgcgctgcataatcgtgaccagggccacaaagctgataccttggcacgctatgtttgagagcgcgctgccggcaatccttaagttggcaccaaacaccgacgacggattcaagaatacagtgatgagggcacctgacatgatagcgagtatggcggagagactctcaccctcaaagcggatctgcatgttgagcatcagcgcgaagcacatccagggccatccccaaaagatggtcccgacgaggaccttggcacagggcaggatcgagggagttgctccggcaagcgaacagatcgcctccatgaagatattgccggacagcgccacgatcgtcccaaccgtaagcgagcaccctaatccggttgaggctagcatacccgcctgttcattctcctcggtactgaggtggcgagacatcgcgttgccggtcagatgcgcaaaaaaaatcgatggtctggatcgtgcccatcactataggggagataccgatcgcgcctgaggcggaggtacccaactgccctacctagtaggcatcgacgaagttatagagcaccactgcgagactcgagaggatggcaggccaacgctggttgttttcaggatggtgggcctaagcggccctttcgtcattgcctgatacacctgctctgagctctctgccacgatttccccgcctgtgcagctcgacacgctcttgatgcagagtaggaaattaaagcttcgctgtgcaggggctgtgcagtgaggcctctcatcgaagacaaggtgtgcatcgtcaatcgctcagacagggaatcacagcagcgagcgatcaagagtattcagagctatctgcaggtgtagatgaacatctccctattttgcctgcaaaagaatcgaggttcccacaccaccggcgcagctgacctcagcgcttatccgtcaccggctgtgccttcgcctgttcctgtttgtccgcctcatcaaagttatgcaggcaccacagtgcaaacgggatcgtgatgatagcggtgatcacatcggagaccggctgagcgatctgcacaccgagcatacccatcgtgtgtgaaaggatcacaatgacagaacccagaacaagcccgagtcggcaggcgccgatgaaggttgcactccacatgtggccggaagtttggagcaggaagttggtgatcatggaggcgccggtcagcacgatggagaaggaagtcatgcgcagcgtcagagtacctgcctgcacaacctcagggtcatctctgaagaagttgataagctgcggtgcaaagattgaggtcacgacgccgatcgcaaagaccgagatcgaagcgacgcgcagggagaagaagtatcccttacggacgcgcttatagtttttggctcccaagttgtaacccagaaccggctgatagccttggccgataccaatctgcacataattgccgaggctcgtgatgcggttcacgattgccatcgccgccaccatcgcatcaccgtacggatccgcagcgttgttgagcaaggtagccgctacccccgacatgcactggcggacgaaagatggcacgccgccttgggtgatctcacggaagagtcgcttggaagggcgcacgtacttccaccggaagggggtgatcccactgttctgcatcatgtagagcagaaggacgaagctgatgaactggcagataatattggccaatgcgctgccggcaataccaaaccccgcaccgaagatcaacgccgggctcaggaagatattgataatagcgcctgcgaccattgcgatcatcgcagagaggctttcgccctcgaaacggatctgcatgttgagcatcagcgccgagcacatccaaggagcacctaagaagataatgctgatgaaggtcctggcatagggcaaaatcgtaggtgttgctccggcaatcaggcagatctgttcatcaaagatattgccgaggattgcgatcgctaggccaatcgtaatcgtgcacaccaagccggtggaggccaacacattggctttttcgtcttccttagcgccaaggtagcgggacatcgccgtaccggtgccttgcgcgaaatagaagccgacagcttgaatcacgaccattgcgacaaaagagaccccgatcgcgccggaggcagcggtacctagctgccctacaaagtaggtatcgacgaggttgtaggcctcagtgaccatgtttgacaagatagctggccaggcttggttgataataacaggaccgactgggccctccgtcatctctctatagatctgctctgagcttttggcagttgctactttaatgatattcttcatgctttttatcctaccgcgaaggatgcacgtacccactgaatatccgctatgcactgcaggtatattggtgtttcctgggcttatatccctcaagagaaactctcaccataaaaacgccaccccggcgcggtgtgaggtggcgaaaaagaaccattgatcgtagtggcgactactgcagtagatctgccatggtcttccctggagccagggaatcaaagtccttcctgaactggtccaccgctgcgtcgatggcggcattcttaacgaagctgtcaatcacggacggcgcggcagttgcggcgccgacgccgtactgggcaagctcaagcacctgctggctgttcttgaaggaagccgcgagtacctcgcagtccagcgcattgacctcgaggatgtcctggatctgctctgcggtagccacaccgtcatagcccatattgtcgatacggttgatgtagggcgcgacgtagtctgcgccggactttgccgcgagaaaggcctgcaatggagtgtagacgacagtgccgcaggtgtggatgccttctgcggtcagctgcttgatcgccttgaagccctgcggggttgaagcgatcttcacaacggtgttctcaccgaaggccttgacgatcgcacgggcatcgcggaccatgccctccgcatcgttgggaacagcctgtacgaagaggataccgtccttaccgatctgctctctgatctcagtgagcgtcttgaccggatcctggtggactctggagaggatcgtcgggttggtcgtcaccccgtcaatcggatagaggtcctctatgcgtttgatctcatcgatgtgtgcatcatcaatcaaaagtttcatttcaaaagacctttctcctctatagattctttcgttagtaataaaatatcattctgtacgtaatgtatcacatccagcgatgaatttacatccttttttgaaaaataatatttcatatgcaatgttcataatttttctttgaaagaagagcagaccgattcgtctatactgagcacagaaaatatagaaaacgtgacactgcgatcggaagtagagagatgtctgcaaaagcaaaacggttgaatcagatccttgagattcttgcacaggagggcgaggcggaggtcaaagacctctcagagcagctcggggtctcccccgtcacgatccggaaagacctaaacgagcttgaggagaagaccttgatacagcgcgagcacggaattgcccgcctgaggtccagggacaacgtcgcaggccgcatcgcttaccactacgatacgaagcgcaagctcgcgaaacgggccgctacgctcgtccacgacggagaaaccgtgatgatcgaatccggctcctgctgtgcgctgctcgccgaagagctcgcccagacaaagcacgacgtcacgatcgtcaccaacagtgcctttatcgccgacttcatccgccactacaacaatatcaatattgtctgcctgggcggcatctatgagaaggacgctcaggtgatgaccggaccgcttgtcagccagtgcgcacagaactacttcgtgcactccttcttcatcgggaccgacggatacagcgagcgcaccggcttcaccaacaacaatcagctgcgggctcaggcggtgcgtgacatggcaaagcagtgcgaccggctcatcatactcacggagagcgagaagttccaccaacacggttcggtaccgctcaacgtgtcttcccggcccacgacggttatcaccgacagccgcatcgagtcggatactgcgcacaccctcaaagcccatggatgtgacctcatcacggtagagtgattgtgtcagagcctctaaacaacagccgcaccctctcaaatcggagatgcggctgtctgtttcgcccgatactgttctgtgtcttacaaggtctgctcagtacgggcgataatgtcgtcctgcgtggctttggacaagacgttgaagaacgcagagtagccggcgacacgcacgatcagatctttgtgcttctcaggatgcttctgtgcatcgagcagtgttgcgcgatccacgatgttgtactgtacgtgatagccgttgaggcggctgaagaaggtcgagatcagcatctcaagcttctgccggttctcttccgtcgcaagcatcgcgggtgccatcttctggttcagcagcactcctccggtgatcttctcagttgggagctttgagaccgacttgaaaactgcggtcggcccatgcgtatcgcagccgtgcgccggtgagcagccttccgccagaggctcatgtgcacgcctgccgtccggtgtcgccatggtccccataccctgccccacgtttgcggagatcgaggaggtgccaccgtagcggatgccgccgaccgggcctctgccgtagcgggtgttcgggtatttcttgatctcgtcgaggtaggagtcataggcgtcaacgacaagctgatcgacacggtcgtcgtcgttgccgtacttgggggcgtcgtggatcagcatgtcctggatcttctggttcttcggagacgtgaagttgtcgaggatcgcatcccagagctcggccggggtgatcttcttctgctcgaagaccagatacctgatcgcagccaggctgtccgccatgtttgcgataccgacctgcaggccggagataaagtcgtagactgcgccgccttccttgatggtcttgccacgggcgaggcactcatccgtaagggtcgagcacagaacatccgggacgtcgcgttcagaggctttgtcgatcgcattctctgtgatcacggagtagcgagcgatctcacggacggtcttgtcccaggcctgcatcagctcatcgtaggacttcatatccttaaagtagccgtaccccttcgcaaagcgtttaccactcgtgaggtcgacaccgttgttcatcgcgacgagcaggatccgcgggaagttcatatagctcatgccggtacagcggtagccccacttgcccggcacagcagtctcgacgcagccgattgcggagtagttgtaggcatcctgctctttgacgccgtgagcgatgaaggaggggatgatgatctcatcgctgttgaaggcaggcataccgaagcccagacgcatcacttcgatgcactcatcgaagaagtgcttgtcgatgctcttgtggtagcgcaccgtgaggttcggctgcgtcaggcgggtctgtgcgactgactgcaggaccagaaaggacattgcattgactgcatccttcttgtccggcgtctggcccccgatcgtgacgttttgatacatcggggaacctgcggagctataggtatgctcctggctgcgcaccttgttgatcgtgagggtcttgatccacaggttgtcgagcagctcgagcgcctgatctttggtgagggtccccgactccagatcgtgctcatagtacgggaacatgtactggtcaaagcgcccatagctgagagagtgtccgttcgactcgatctgcaggatgagctggataaaccacaccgactggatcgcctcgcggaaggagtgcgccggctcgtaaggcaccgtgtcacagctgtggctgatctcctcgagctcccgcttgcgctgtccggtggcgctctgagccttgtcagctgccagtacggcatagcggtgcgcgaagtccttgaccgcctggatcacgacaagcaccgccttgtagaagacgttcttgtcgatactttctggctgggtcaggtcaaggtcagcctggtagcgctttgcgcgctcctcgtagccgcgcagcccctctttgagcaggcgcggataattgacggagagatgcgcatccccggcattgagcttgccttccataccgaagaaaccggtctccataaagaccttgacttcatccggaagcagcacttccccgcggtcacgcaaggtattgttcctccagaaaggggcaatccctctcagggcctgcttcgtcttgtccgtgatgtagaagacatccccatcgcgcttctcgaaagtatcgagctcatcgagcacaaactccattgtgtactccggaaagatcggggcattgcggttcttggtcgcctgattgccgacgatcaaggtatcgtcctcaatgtagatggtcatgtggtccaggatgttcttcagcatgtacgcacgcaggagcactctcggcagatcgcggtgctcctcgtaggtctgtgtggccagcagtgcccgttcctcatcgatatacggtctctcatcgagaaccgcctcccggaagtgctgcatccggggcgtcaaccttccaaaatgctccgcattctccatggctgtcactcacctttcatacaaaagccttttctctttctttcttgactacactgtatcacattcttcaatacgatgtgcatatattttctaataaagtttacttttgtttcgttcgtaatactctatactggatacagcaaccactcacaaaccgatcaggagaacgtatatgactgagggcatcatctttaacatccagaagttttcgatccacgatggaccaggaatccgcactacggtctttctgaaaggctgcccgctgcgctgtaagtggtgcgcaaaccctgaatcacagctctccaaagtagaggtgctctacgacgaatcgaagtgtctgcactgccgaacctgtgtccacacctgtcccgtacaggcagtacgctttgaggacaaccacgtgtatatcgatgagaaaaagtgcgacggatgcctcaagtgcatcaaaggctgccccggccgtgccctgaccagcgagggggaaaagaaaagcgtacaggaggtggtcgacgtctgcctacaggataaggacttctacgacgagagccacggcggcgtcacgatctccggcggcgaggggatggcgcaacccgattttttgcgggaactgcttgcggcgctcaaggcacacggaatcaacctcgcaatcgagacaactggctatgcacctgaggaggtcttccacgagctggctccacagtttgacctgttgctctttgatgtcaaacaatacgaccccgccaaacacagagtcggaaccggtgtcacgaatgaactgatcctcaagaacctgcgctgggcacatgatcatcagatcccaattctgccccgtatcccggtcattcccggcttcaacgccaccctcgaggatgcccagggtctctctgatctcctggtgaagcttgactttacacgggtacaactcctccccttccaccagcttggggagaagaaataccatttcctcaaccgcaactatgccttagagggacagcagcctctcagagctgagaatctcaaagactatcagcgcatctttacagcaaaagggctcgactgcttcttctaatgtcacagccgagctctccacaattcacgctttgcccgatatgcctctcgagcagagaggcatatcgctcagcccttatagcctctccaggccagtgagatggaacccacgccgaggtgcagcgacaccaccggattgccgtcgcgcacggcgacgttggcatccggatacaggtggtgaaggatgctcaccaatgtgtcgctgacctcagtcgcctcgccgtacccggttacaatcaatccgttgtttgcaagctcatggggcacctgcttggccagcgcccgggcggtgctgcgcataccgtgcgccacatcgatgtcctcgatgccgccctctttgagtgccatgatcagatagcggtcgagcttgccaaccacagccccgcgggtcgcgcctaagcgtccgctgcgacgcagcacgtctatgtccggtacagtaaagacgatgccttggtctttccggtcctctttcagccctgcggcgatctctgagaggctctcaccccgctcaacccgctcatgggcgcggcgaaccaggaactccaagccgcctgaagtggtccaagaatccacgattgccatgcgggaagcctcggctccctcgtgcaccagctgctcctccgcagcccgggcgctccgataggttccggagagccgtgagctgatcgtaaggcacaggatgttagatccggcctccaaaagcttcgagaagcgctccgcaaagacgttttggtagaccgcttcggtcccgaggatacgggcattgcggaacagggtatcgtagtccccgttctccccctcatagttctcggcgagccgaaccccatcgaccaggtagtgcatcggtatcaacgtaacgccgagctcatctgccacttttctgctcagtggagctgtagtgtcacagagaatcgcaatgggacgtctatctgatgtcccctgcgtgacttgtgcgtcagcattcacctcagcaggcgtgttttcccgtctcgtagttgcatcgggcgatgcattcttctctcccattattgtctgttcctcccgatagcgcgaaacttatcgtgacgctgctctatcaattgatcagaatccattgattccagatcgctcagttctctttcaatgcgcgctctgaaggtatcggcgaacttcggagtgcctaaccccgtcgcgtcgatcaccccatccacgatgcctatgtgctgcaggaagtctgccgtaatgcccaaggcttccgccgcctcatccgcacgcttcggggtcttccacaggatcgaggagcaaccctcagggctgaccaccgaatacaccgcgtcggaaagcatcaaaaccttgttcgtcacggcgaggcccaaagcaccgccggaaccgccttcgcccataatgacggagagctcaggggtcttaaggccgcccattgcgaccaggttatccgcgattgcggcaccttggccgcgctcctctgcctccataccggggtaggcgcccgaagtatcgatcaggtagacgaccggacggtgaaacttctccgcctgcttcataagccgcagcgctttacggtagccctcaggctcaggggatccatagttgcgctcgaggcgctcacggataccgcgcccacggtcagtgcagatgacctccaccggtttgccctccagaaggccgatgccgccgacgattgccggatcatcaccgaactcacggtcaccgtgcagctcaaagaagccttggaaaacctgctccacgatcgtggggatcgaaggtcggtcattggcgcggactcgcttcaccttatcgtaggcagaggcgccctctttgagcggtgcctgcaggtggcgcggagccggccaacgtggctcatccgggaaggccgccgagcacttcggtgcctccttgtcggagtccagggcctctccatcatgcaggtacaggagataaccgagggtcaggggaaggtctttgcgttcgatgatcgcatcgacaaagccgtgcttcaactgaaactcagagcgctggaacccctgcggcaggcgcttgtgcgtggtctgctcgacgatgcgcggtcctgcaaaggccaccagggcattgggctctgccaatgtgatgtctgcttccatcgcgaaacttgcagtgacgccgccggaggtaggatcggtcaagaccgcgatgtagagcaggccggcttcgctgtgctcacgcactgcgtcggagacctttgccatctgcatgagggaggtcaggccttcctgcatgcgggcaccgccggagacggtgaagccgacaaccggaagcttctccttcgtcgcgcgctcaaagcagcgggtgatcttctcaccgacaaccgctcccatcgaccccatcataaagtcgccgttcataacaaagagggcacaacgctccccgacgatcgtcgcctcaccagtgacgacgccttcgcgctcccctccggaacgctcccgggcagctttaagcttctcgggataatcggggaagtggaggatatcctccgtggtgaaatccgcatcccactctttgagacttccctggtcgattgtgatcccgatgcgccgacgcgctccgatacgcatatgctgtccgcagcggggacacacatccaggttctcagagagcttctgggcgtcgatcgcatgccggcaatgggggcagcgcaccagcatggtgcgctgaggcatatcgaccggaacctcagttatcggaccttccagttcgttggtactatttggccgctcacgcatagagatgctccatcagattcgtatggtagttcccagacaaaaactcttcattcgagaggatatcgagctgcagatccgcgttgcagtcgacgccgtcaatcacgagctcacccaatgcagagcgcatctttctgatggcttcggcacgggtgggactgtagacaacgagcttccccaacagggaatcgtagtagggtggcacgatagagccgacatacagagcggaatcgaagcggacccaagggccattcgggacgtgcagcatcgtgatttcgccgcacgaaggcataaagtctgcagtctccgcattgatacggcactcaatcgcatggccgctgatgtggatatcttcctgcgtccatgtgtccagcttgacgccggaggcgactctcatctgccacttcaccagatcgatacccgtcacaaactccgtgatcgggtgctcaacctgcagccgcgtgttcatctccatgaaccagaactctccgctgtcagagaagaggaactcgatggtgccgagtccggagtagccagtctccttagccagattgcgcgcacactcatacatgtgctcacggatctctggagtcagcaccgggcaagggctcgggctctcttccaggagcttctggtttctgcgctgcaccgagcactcgcgctcgcccagcgaaaagacgttgccatagttgtcggctaagatctgtacctcaatgtggtgcgctggagagatgaacttctccatgtagcattcaccgtcaccgaaggcagactgggcttccgccctcgcctgctcaaaggcatccggggcatcttcgggcttcataaccttacggataccgcgaccaccgccgccggcgcgggctttaatcagaaccggacagctgatgcgcttcgcctcctgttcggcttcctcaggcgacttcagcagctcacaccctggaacaatcggcacgccaaccttctttgcggtcttgcgggcctcatccttgtcgcccatgagttccatcacctcagggctcgggccaatgaagaccagcccgtgctcttggcattcgcgggcaaactctgcgttctctgagaggaatccgtagcccggatggatcgcagaggcacccgcctcaagggcaacagtgatcagggcattcatattgaggtagctgtcctgaggtctcgggcctccgatgcagtacgcctcatccgcaagggccacatggagcgcctcggcgtccgctgttgagtagacggcgactgtcttgacccccatctccttgcaggctctgatgatacggaccgcgacttcaccacgattagcaatcaatatcttctggaacatgagcgttagacctgtttcttcggtaccaaagcaaaagacatatcagcggtgcagcacacgttgtcacccacgcgcgcttccccatgggcaaaatggaagatcccgtgggaacgggtcagggtgcagtcgagcgtcaccgtgtcaccgggacggatcgggtgcttaaatctcaccgtatctagcccggcatacatcgggatcgaatcgtgtgcgtgggggtcatccgcgagtaggacgcagcagttctgcgcgagcatctcgcactggatgacgccggggacaatcgggttgcccggaaaatgtccctggacaaagaactcttcaccggtgatcgtgacatgaccgattgcgtgatccccttcgaccgtcgcatcatcgagcaaaagcatcggcggacggtgggggaggattgtctcaagctcctttttgttcatcgcaaccattccccctagtacagcttcatcagaacggcgccgtactcaacgagctcgccgtctgagacgcagatatcgacaacttcgccgtctgcttgagcggtgacttccttcatctctttcatcgcttcgataacgcagaggacgtcgccctttttgaccttgtcgcctacctgtacaaagggcttagctcccggagagggtgcagcatagaaaatgccgaccatcggggctttcaccgagatgaccttggtcatatcaagcggcgcttcgccgtctcccgtgtccggagacgcatcagaggccgcaggggcagccggagctgcagttgcagcctgcggagcagcgcttgccggcgctgcagcagcaacaggctgtgtcgatacaggtacagcaggcgctacgggagcgggaaatgctccgggtccctccaactcgatggaggcatccccttcttcgatgcggacacgcgcaacgccacgctgttgcatcatagccgcaatcttatcgagtctatcgattgaggtatccatctattaatcctcctcgtagcgtttcagcgctatgactgcattgtggccgccgaatccaagggtattggagagcgcccagcgtccgtcgaagctcactgactgtcctggcgtatagtcaagatcgcatgctggatcagaatctttgaggcccatggtcggcgggatcacactgtccctcagcgcgtaggcgcaagccatagcctccagcgcaccggtggcgccgagcatgtggccggtcatcgacttagtcgaggaaacgtgtgccgcatgcgctgcctcatccccaagtgcctgtttgatgcccttggtctcagaggaatcgttgagcttcgtcgaagtgccgtgggcattgatgtagaggccctctttcggatccaagccagcttcttcaaccgcgagtttgatcgcgcgggtgataccggcggcatccggatcggggcttgtgatgtgatacgcatctgcggtatttccgtagccggcgatctccgccacgatgtgcgcgccgcgcttgcgagcgtgctcgagttcctcaaggaccagaatgcaggcgccttcgcccataacaaacccgttgcggttcttatcgaatggacggcaggccgtagtcggatcggggttggtcgtgagcgcacggcaattcgtgaagcccgcgattgacaccggaacaacagcggcttccgtgccacccgcgaggattgcgtcagcatagccgcccccgattgcgcggaaagcttcaccgatcgcattggtgctcgttgcacaggccgtgacgaccggaagcgtcgggccctttgccttgtggcggatggaaacctggccggctgccatgttcgcgatcatcatcgacacaaagaacggggaaatcttgcgggggccatcctcaatcaagcgcttcatctgctgttcggtcgtgccgatgccgccgacaccggagcctacatagacgcccaagcgttcaggctcgatcgcacccgacgctgagagtccagaatccttcattgcctcatcagaggcgaccatcgcgaactgtacattgcgatcgttgtggtttgcttccacacggcccagtgcggcaaccggatcaaatcctttgacctctgccgcgaccttcacgcggaaatcagtcgtgtcaaacgatttgatctcgccgataccgacctttcctgccaccagcgacttccatgtttcgggagccgtaagacctacaggggtgattgcccccataccggtgatgactaccctgcgcttcatcctgtatatcccctccaaaacctgaatagtttggctgtttgcacgagtgctgctacatgctcagtccaccgtctacgcggatgacttcgccggtgatatagctggcggcatccgatacgaggaacgccacaacgtctcccacctcgtcgacgcttcccagtctgttcatgggaatctgagcctggtacgctttgacggtcttctcaggcagcttgtccgtcatatccgtcttaatgaagcccggagcgaccgtattgaccgtcacgccgcggcggcccaactctttagccaccgctttggtcaagccgatcaagccggcttttgaagcagcataattagcctgtccggcattgccggagagtccgactacggagctgatcgagatgatgcggccaccgcgcaggcggacaaagttcctactcagcgctcggatcatattgaaggcacctttgaggttcacgtcgataaccgcgtcaaagtcctcgtccttcatgcgtgccaagaggccatcacggttgatacctgcatcgttaacgagggcccagaccggaccgaaatctgcgatgattgctttgacggtgtcgttgacctgagcggaattcgcgacatcacactgataggccttcgcggtagcgccgagcttactgagttcctgcacacagtctgccgcagcttctctattgccggcatagatgattgcgatatcaaaaccctcacgggcaagtgagcgcgcacaggctctgccgataccgcgggagccaccggtcacgagcgcgacacgtcttgaggcgtcccgctcaagggtccctgttgcctgatctgccactattcgtcccccctcagcgctgccacaacctgatccagttgctccacagtctccacgttgtaagtcgcgacatccttgagtgtccgctttacgagccccgttaaggtgtgccccggaccgacctcgataaaggtatcgatgccggcgtcacggatcgcatggagctcaccggtccactttacagggtgggagacctggttggccacggtgtgagcgataacctcaggatcggtgtcatagctctcgccggtgtagttggcgtaggtctcgatcttggggctgtgcggggtatggtctttcaggtatgccttgagcccggccgttgcctcactcatataggggctgtggaaagcaccggagaccttcagcggaaggcttctgcccccagcttccttcacgagctgatcgagcttcttgcaggccttagctgaccccgccacaacagtctgctgggggctgttgtagttgaccggccacgcctcatcgcctgcctcacgggcaagctcctcgacctgctgagcattgagcttaagcaccgcgcgcatcgcaccgggatgctcctctgagcactgctgcatcaggcgggcgcgctccataacaaaggagacgccctcctcaagcgtgaagatgccggagaaagtatccgcagcgatctcacctagggagtgccctgcgacagtctcggggacaatccctctctcctgcaccgcataggcgcaggcaagatcggtcgtgaagacgcagggctgcgtgttgatcgtctgcttgagctcttcggccgtcccctcgaaacactggtggatcgtaccggggcgcactgcctctaccttgtcaaacaagtcatgcgccgccgtgctcgagtcatagagcgctttgcccatgcccggcttctgggatccctgccccgcaaacagaaatgctacgcgagccatctggaagcccccttcaggcaggcttcagcgccgttcatcagatcatcgacgatctcctgtgcggtctgctccttcttcaccatgcccgcaacctcacctgccatgaagctgccgtcctggtagttgccgtccaccgcggctttgcgcagagatcctgcgcccatccgggctagctcttccggcttcgcgccctctctctccgccttcaggaagcgctgggagaacggggtcttgagacagcggactgcgccgttcattgagcggcccgtaacgatcgtcgagaggtcgttggccttgaggatacgtttcttgtactccttagagacgctgcactctttggcgacgaggaagcgcgtgccgacctggacgcctacggcgccgagcatcaaggcggcggcaacctgtctgccatccgcgataccgccagcggcgatgaccggaatcttcagggcgtcaacgacctgcggcaccagcactatcgtcgagacatcaccgatgtggccgccggactcgccaccttccgccacaaccgcgcaggcccctacccgctgcaggagccgcgcaagtgcgacggaggagacaaccgggatcaccttgatatccgcggcttcccagtccttcatgtactttgccggattgccggctccggtgacgaccaccggaaccttctcctcgacgacgacctttgccacctcatcggcaaacgggctctgaagcataatgttgacgccgaacggcttgtcggtctgccgcttgcactcacggatttgtccccgcagccagtccgcattcgcgttcattgcggagataatgccgaggccacccgcattcgataccgcgctggcaagccccgcgtcagcgatccatgccattccgccttgaaaaatgggtttttctatccctagaaggtcacacagaggagttttgatcatagtcgcgcaatccttaagcttttcccgtcctaaaactactgaggcttagtccttgttcttcagctgctcgtctacgaggtcgacgaactcctgaacggtctgaggattagcctcagggtcgatctcgatgccgaactcgtcctcgcacgccataaccgcctcaacggttgacatggagtccaggccaacctcagagagcttggtgtccggcttaaggtcgacgttgtcgaggccctcctgatccttcaggatgctgacgatgcgatcgaatgttgattcttctgccatggtttgttctcctttagacggcgccctacccttcctgggcgcgatttacctactatcacttgacaccggaggcctctagcttgtcttccagcggataagtgtcgaaccgatatcgagcccggccccgaaaccgacgagcacgataagctcccctgccttgagctttccggcccgattgagttgatcaagtgcatacgggatacaggcgcttgagatgtttccagtttcagcaatcgtatgggcaatcttctcattggggatagagagcttctttgcgattgcgtcgagaatccgctcattggcctgatggaaaataaagtggtcgatctgatctaaagggatgccagtttcctgttccatgcactgaagctcacgcgccacgtggctgaccgcaaaatggaagacggagggccccttcatagagagcacgctgggtcgggcatccacacggccctgatcaaaagggcagttgcctgccacacccggaacctccagggcggcgacattgggatcacacgtgagacgtgtccacagggggctttccccctgtgcctgcgcgacaacggcgcccgcaccgtctccgaaaagtacgcaggtggagcggtcggtccagtccatgatccgcgtcatcttctccgcagagacgatcaacgcacgcttggcacgtccccgcgcaaagtaaccgtcggcgacatcgagcgcatatacaaagcctgagcaggctgcactgacatcgaaggcggggccgtgggcgcctaagcgctcggcgatcgcgcaagcctccgccggcatcagatggtcggcagaggtagttgagcacacgatcaggtcgattgtgtcgatcgtgaccccggcagattccaaagcgcgcttgcacgccgcctccgcgagctcatcgagggtctcggtggccgctacgtgtcgcgtgacaataccggtgcgcgtgcggatccattcatcggaggtatccaagaaggtggaaagctcatcgtttgatacgacgcgttggggaagtgcggagcctgttcctataatcgtataactcacgctaccgcttcccctcgtatttggaggtcttcaggcgctcttcctctgcctgctgaaccgtggtgtagaagtgctcgaggcgtgctatacccttgagcagcattgtacgctcgtcaggcattaatccccgcgagacttcctcttccatccgccgattgaatattgcatgcagacgaaagacgcgctcacctgcccgcgtcagaacgatattgatgcgccgggcatcctctctgtttctctgttttgccagatagcccttacgcacgagacggttgactgccgcagtagcgctcggcgcagtcacgtgcaagcaatcagcgagctgtgagacactcatctcccctctgtcgtggagtacagtgtggcccacgatttcgatcgtgttcagctcacttaccgtgaggtcgatgccatgcgacttacgcacaatgtcttcgaggctgtcgattacgtcataggtacgggagagcaggcgagatatctcggcgataaaagccgcctcgtcgcttacgtcgacatgtttttcctcagtcgagtcagcactctcaggaatgcttgccggcataaccacctgtgcatgtctcccgatgctcttgctcatttaagcctcacctgacacgcgtgagtcatccaaagaagtgctcactcatctttcttgaattttcgtttatttagtctaactaaataatctctgggggcaatacttgcaccgcacacgatatattgcttcctcggtatttacacagacgctccacattcaaacgtatggtaaatattttatacgctactccgcagcgatccttgctcgggcagcagcgccagataggtaccgtcgcctcgctgtatccgcgcttttccccatccatcgacccctaaaaactgaccggtttcagctaccttattgtcgggagtgtacaccctcactttccggtgtatcagatagagatgctcctcatatatatttttgaggggctcgaggggatccacgcctgcatctacagtaagcgcatgcacccaccggtcacagccggtcacaattgcgctgcgtacccgctctgctagctgatcaaatacctcgagatcagatacatctgctgagtgggccagacaatcttcgagatagccggtggataagggatgcgcctgcccgtcgtgcaccagctcaggccgaatgatctcatggtcaggatgggtgaggttgatgccgataccgacgacggcaaaatcctggccatgcgcatcctgcttacgttccacgaggatgccagccagtttctgcggatcggcaccttcaggcacgatcaccagatcgttgggccacttaagcgctaagttctgtgctgaaagacgcccaagctcctgcagcacgaacgccccggccactaaaggcagcacactccagtaggttggggaaacctgcgggcgcagcaggaccgagaggtagaggccgcctgcgggagagacccaggtgtggccacgccgtcctctgccccgccgctgtcggtgtgcggcgacagcggcgccgtgggaagcaccacggcggccaagctctgccacatcgtcgtttgtggaatctgttacctcgacaactttgagcagttctgacatagctcacctctatgctggcatgcggacattgcgcgtgacagagcgcttctaaagctgaagtaacaactctgggaactctctgcgcttctaccgatgagtagcctagtgtgtaagtttatagcaacgaagaggcgagcgttgcgctcgatactgttgcccaaccaatacaggaaggaactatgagtacgtttcttaatgacagccctgtcttcggcccggtccacagccgccgtttaggcatctcactcggattgaacctgatgccctcaacagggaaaatctgcacctttgactgcatctactgcgaaaacgggtttaacgagtcgcgcaaaacggacgacacctatgttgacctcgatgaatttagacaggccttggagcagaaactcaaagacctcaaaggtcagaacatcaccccggatgtcctgacctttgccggcaacggagaaccgactgaaagccccatctttccggaggcggtcgatgccgcaatcaagctcagagatgcgtatgccccctcagctaagatagcggtgctctccaacggtacctgcgccggaaggcctgaggtgcacagagcattgctgaaggtggacgacaatatcctgaagctcgacaccgtcgatccccaatacatcaggatgctcgaccgcccacaggtggcctatgatatccatcatcagatccagacctttgcttcctttgatggacatgcaatcattcagacgatcttcctgcggggtacctacaacgggcggaacttcgataacacctcccaaagattcgttcagccctggcttgaggccctcaaagagatcaaaccttccagagtcacggtctacaccattgcgcgtgacacgccggcacccagtttggaaaaggcacctaaagatgtactcgataagattgcgaaacaggttaaagactcaggtatcgcctgcagcgtttcatactagtgagaatagcgaggacgtgttccccgctatttttatgtcctgcctggcggtggagtcacagcgccaaggctcaccctgcagtaaggctggcctgaaaatccataccgtgatagaggtcttaccgtttgctatagcctcaagctatatctagacatagcctatagatagtatctttaaacttaggttcgtgtcacactttggagtcgaacaaacccacagcgaaagggcacgacctcatgaaactccaagagccacctcatacttttgatactgtcggcggctttctgcgtccccagcgcctgaaacaggcacggatagattttgcagcagaaaagctcagctgtaaagaactcatcaaggtggaggatgagtgaattactgaacttgtcagcaaggaaaagaaagcgggccttcacaccgtcactgacggagaattccgccacgcgatgtggcacctgaacttccttgaggcactcgagggcgtcgaacgtatcgacacgaagaactgatctgtcgagttcaagggagctgaagcctaagggacccagctcaccttcactggcaaggccgacttcggaccatcccttccccggtgccttcccgcacttgcagacaattgcggatggctaccccacaaaacgaacggtccccctcacctacaatgctgcacctgatcccccgcacacgcagcaaggcaacttacgagccgattgagcgctaccaatccgaagcggatctcctgcacgatatcgcccccgctcatcgacacgcgaaagccttctatgacttaggatgctgctatctgcaatctgatggcaccgcctgagagagctctgcgacaagcagaaacgcacagcctgctgacactccggcatcgatttcgacgctctgaaagcaagctgtgtcaatctgatcgacgctgcgcttgaagcaaaaccaaaggacatgacaatcgcgacatacgtatgtcgcagcaacttccgcggcacctggttcagctccagcggctacgacccggtcgcaccctatctcttccagctgaactatgacggattcttcttagaatacgacaccgaccgtgccgggagattcaccctggcagaggctgccgggcaccactacaccgtcgtcctcggcctcatcacctctaaagacgggaagttggagggcgaaaatgcagtgatcgagtggatccatgaggtggagtagcatctgcctttagagcagctgcaccttcccacccaatgtggtttctcctctactgagggggccatgtcctcaccgaagaagatcagtggaacaaactcacattgatccgctgtatcgcagagaaggtttgaggtacccaacgtccgcactatcatttaggagacagacagcaaagaccgagcacgcatgcacgtacccagccctttctaatataggtatatta

SEQ ID NO: 317 - DNA, 21236 bp, Unknown
  Metagenome-assembled genome
gcccgcgcgggcgctaggcgcgatccgatgaaacgcgaaccaggcgttcgggagaccgatgcgagacctggagctgtccctggcaacggggacatgcaagctagaacaaactagcttgctacggtatccctactatggtctaagagggtgattggtatggttggatttcattttccgtggagccgcaaacgccgcgcacaggcttcagatacgtcctcaacaacagagccccaacacaaaccgatccactacacagggccactgcggcgggtgtcactcaggtaccgcggcagggtacaagccgttgggttccgctatcaagcggagatattggcccaatctgtcggggtgaccggttgggtcagaaacgaggacaacggcgacgtactgctccacgtccaaggaacccctcagcagattgagcggtataaggagggcatccaggagctctctgccagccgcaacacctggattgaggcggcgctcgtcgaagagaaaccgctcgaggttgtggatggggaacggaagttttcggtcgcctatacctgagtgtttttgcccctctacctgctttctttgaagatgtgcgctttgcgtgtcatactaggagggctaacacaacaaggaggggaatctggagatggtatgcgacttagtgaaagaccgggcagagctgacgaaagcggcgcagcctgctacagctgaagacagcgcagtagcccaggatgttgaggataccctggcctcactggatgacgcttcatgcctcgcggcgaaccagatcgggtacccgaaggcgatcggcgcataccgggacaaccggggacgcatccacgtactgttcaatccgacgattaccttcaaaatgcagcccttcaagacccaggaggggtgtctcacgaaggatgaaccctcacgggtgactcgctatcgcaggatccgcgtgagctatgacgctctagaggcggggaagctcgttcaccatgaaaaagcattcggtgactggtatgccgaaatggtgcagcacattgtagaccatatcgcaggtgcctacgtctagggaaacaatgattaattcccaataatgtgccaaagtggaccagccacgtggcctttcgcggccggcataggcattaatcatcgtttccctagcgcagatgcagggctttggctccagagcggctcagatttgaatcagaagaaagacctactatttaaagtcaagggataaacccaagattttcgataggaaccttgagaagtgaatatgggataaagagcagacatgctgacgcgcgccccgctgggagcgcaagcacgattcagatgtagaaaaggctacttgccgccctcctgaagatgttcgggttgatggtgccgtgggctcccaggggcgctgttccttcatgagggctagacacacgcccatgagcttgcgagcaacacctgcgagggctaggcagtggtgctttttgtcttcgccttccctgttggcgtagtagtcgccgaagttatgggtcgtatctgtgcacacagtctgtagcctgcatgagagcccatctgagatctgccgcagcgcgcttggacatgcttttacccgatgccacactctcaccggacttacttttggtagggtccatgccaacataggccatgagctgatgggcaccatcgaagcgctgagcgcgccgatctcgcctgcgataattaaggccagcgcgattcagatgccagggacgctgagcagccacctactgcttgccttgtcaagcaagcaggtaagttcaaattccacctcgtcgatctgactgcggacgagctcagactccttatggaagagtctgagctcgaaggtgagcgtctttgaaccgaagccgactgcaactgacgctttcgtggcggccttcagctcctcggccttcttttggccgcagttggagcagaaagcttccttcagtgtgcactcgagcgtgcacatgtcgcttgagtgtgtctgctgcggcgtggcacaatgttcgagtagcgtctgctgggtgggcctaaacgagccgctgaacaggccgtcgaggatggctgtggcgcggtttttgagcatggtcgagctcttcggcaagcgacgcgcagtagcgcgcccaagcttcgcagctccccgctcgcccagcgcgcagggctcatagcgcttgtagcgcataaggtctgcgatcatggctgcgccgatcgcatcggtcttgagcgtgcgcagcgtcatagccataagcggccatgaagttaaacagggcaacccagtagtgccccgtggcctcaatactagacaggctgccctctggaccgataccgcccttcttcagccgatcgagcagctttttgaagcctgccggcggtattgacaaatctgagtgactcgatgagggtccctccatcctcacccacggctgacagcacgtggaagtacttagcgatgtctatgccgatgtagaccatgcagctacctcctacctcttacttgactgaggggctaaggttttcctctgctctttgcaggcacaacctcatggggacatccatcgcctaacgacatcttgcctaattcgcgtccagctgtgagccaaaggcgccagccgtctgcaagagccaaactccagcagaacacgccgagtgccctgcgatccatgcacgccctttatcccatattcgcgtctacaggaaaagagcgcggccactgcgcgagaagtggcagaaagaatatatgaggaggatacatgcctcatcgtgaaatagtgacatacttttccatcaccggaaccaccggaaggatcgcgcagagcattgcgaaactgcgcaatgcggatatcgcggcgatcttcccgcaggtgccgtatagcgtagaggacctcagatggcctgattcagcgaactgccgcagtgcccgggaaatgaaggacctgaacgcccggccggcaatggagccgcttgccactgatcttgcttcctacgacgtggtgtttttgggctaccccatctggtggggtatggagccccgcatcatcgacgctttcctggaaacctatgactttaaagggaagatcatcgtcccctttgcgaccagcaatggttcaggcatgggcgacggcccggcccgcattcaggctctgacacctggatcgaccgtgcgcagcgcccgcctgattccgggggatgcgactgacgacgcactgcaggcgtggatgcacagcatgcgcctataagtacatagtaaagcatgaaaggatggggcctgcaccgctcagcggtgcaggccccactgcaaactctgtagtgtaagctatttaagctgcggatcgtaggcgcgggcgtactgcgtaaagaaccggtcgaagaagtaggtcacaccgaaggtcgcaaagatccggtggagcgcggagccttcccgcgcgctgtcgccgagctgtaggacctggttgaagtgtgagtggagttcagggtctgagttggcagtgacgatcgccttgtaggccatgctcgcctcgatgcgcttttgctggcggcgggcaaacccgtttgaggtcgtcacgacgatcaaaaggtcgctcggcatcatcgctctcacgctgttgatctcggaggaagactcggagacgaggcggatcgtcttgccctcggcgagcatcgcctgctggaactcacgcagggcgagcgttgaggcgtccgtcgcaaagaccacagtgtgagcggattggttcatcgtcgagactaggcgcaggatgtccccattttccgaaagcgtatcgatctggctgtagatcgtgtccagatccttgtgcagggaacggtgctcgtcgcgctctgcctttgcgtagacgaggtagtgctgacgtaaggcttccctctcttcgtcagacagcggttgcgggaggacttcgatcttaaagccaatctcactcatgtgtgtctccttgggtagggccgacagatctatttgatgctgatcaggatgcttccgaaagctggaagcgtgcatgctatttcctgggtcttttcattataggtgatatcggttttgccctgcggcgtcgctccgttgaaacgctgccaatcggtatccaagaggacggagatgctcttcgcattcttcagcgggacacggtagtccttttgggcggcaccggagaagttcatcaacgccgcgacgcgctcaccccgcttgctggtgcgctcaatcgcgtagcacacgcgggtcttagaatcgacgtcgagccacttgaacccggcctgctcgtagtcctgatcccagaaggcggcaagcgtcagatagagatggttgagctcacagcagtagtgatagaaggcgtcgtggatcgggtacttgcgcaggaaccaatcctgctcgcggtcctcatcccactcgcgcagctgcgcgatctcagagcccatgaagttcagcttcttacctgggtgaatcatcatatagaggtagagcgtgcgcgcttgggggaacttcctgtcgtagtcgccccacatcttctgcgcggtggtcgccttaccatgcacattctcatcgtgcgagagcggcagcaggtagcgctcgttccaaaagtacatcatcgagaaactcagcttgttgtagttgcccgcgcggaagtaagggtcggtctgcatgaaggagagggtgtcgtgcatccagcctaagtcccacttgtagtcgaagcccaagccaccctcgtcggtcggtttggtgatgccctcgtagttcgtggaatcctctgcgacaaggaagctgcctgggttgagctgcttgagtgcggcattcatcgtacagatgaacttgacgttgtcgttgttcaccccacggttctcgtcaccctgccagtagatgatgcggctgattgcgtccatgcgcaggccgtcgaagtggtaggtcttgagccagaagttggcggaggactgcatgaagctcctcgactcaccgcgtgagtacatgaagttgtggctgccccactcggagatgcccaccgcgtcgttggggtattcaaagagggcggtgccgtcgtagtcggccaggccgtaggagtcctttgcgaagtggactgggacgatatcgaggatgcagccgatgttggcctgatgcagcgtatcgataagcttcatcagctgcttcggggtgccgaagcgggaggtcggggcaaaaaagccggttggctgatagccccaggagccgtcaaagggatactcgttgagcggcatgaactcaacaaagttgtagccggcctcggtaagatacttcgtgagcggctcagcgagctcctcgtaggtgtaccaatccctcggatcctgggactctttgtcgccggacttctttctccaggagcccagctggatctcgtagatattcatcggcttgtccgcagcgttgctgcgctgcttcatccaggtagcgtcgtgccaggtgtagtcgtcgaggcttacgatgcgggagcggtgcgcagggcgcagctccattgcaaacccgtaggggtcggcgtggtcgacagtgttgccggcgtggtcgatcgcataggtgtaggcatcgccgggcttgactttcgcctgtgcctcccagaagttgccgtcctcgatcttgtgcatcgggactgaggcgtcctcgagcttgagcacgatggactgcgccgccggcgcgaaggtcctgaagacgtaggtgccatcttggatcttgtgggtaccgaggaagtcctcagcattgaattcggttccggcatagaaattagagagtctcatgggatgtgcctcgcttgttgtctgtgggcgtgctacttgatctccttgaggatacgacattgtatttgtaacagtactgcttcatggttgtttagagcgtataagtttgcctacggtagcagctgatacaagcgtatcctctaaagagaacgataccaaaagaacgccaaactgctctgggcgtttcgggaaggaaacagagcatgagtgaagtgttcgattacaccacggatccagagcgtgtcggccacgacgcaatggcagtcgacattctggggaaacggggagcgccgggagcttcaaagaggggtttgacccgatccccatgtgggtggcggatatgaacttcaaagctccctcctgcattacggacgcgatggtggacaggatcaagtatctgttcttcggctacgttgccccacgcgatgaacactctgacacaatcatcaactggcagcaaaatggggttgagggcctcacctgtgaggcgatcggctacgagggcggtgtcttgggtggtgtgatgtctgcaagcgccgccttcaccgctgcgggtgacgccgtcttggtgcacagtttggcctacatcggttttgccggctgcctcaagcgtgtgggatgcaggatcacccacttaccgctggtgcgggacagcgagggcgtctggtggatggactgtgaggatatggaccgcaagctcgaggagtacaagatccaccttatgatcttctgcagcccgcagaatccggccgaacgcgtgtggaccacagaagagctcgagaaagcaggcgaggtcttcgcaaagcatcactgcatcgtgctctccgatgagatctggtcagatctcatcatgccgggctaccgtcacatttcctatcagtcaatcaacgaggatgccaagatgcgctgcatcgccctctattcctcctccaagccctttagccttgtgggattggtgggctcccgccacattatctacaacccctatccgcgtgaccggatcgagtccgtggcggaggatacccgctataacgagatggatatcctttcgagatatgccctgatgggggcctacagtggcaaaggggcggagtggatcaaagggctggtatcggtcttgagcgagaatgtggacatggctgggcagtacctgcgtccctactatatccacgttgcccgtccggagagtatctgcctgctcttccttgactgttcaggctacctgaaagagcatggcatcacgatcaacaaactgattcgcgcaggttgggacgtgagcgtgatctggcaggacggacgtctgctccacccgggtaacacgatccgcatgaacctggcctcaccgaccgcacgcgttgaagaggcattctcatggctcgataagtacgtgtttacagattaactgtcactacgaaataagaggagcttaagatggcaaaactcggctttatcggaatgggcaacatggcgctcgcgctcaccgcgggttttatcgagacagaggcactcaagccacaggagattgcagcctttgccccgcaccaggacaaactgaagaagaatgcggggcgtctcgggtttgtcccctgcacctccttgcaggagcttacgcagtcaagcgaggtgctggtgatggcctgcaagccggtgcaggtggaaggggtgctcaaggagctgggggaatccctctctgggaaggcgctgctctccattgcctcaggatgggactttgaggcctatgcgaagcatctgcctcaaggcgcgcgcctccagttcattatgcccaacaccccggtcaaggtgcacgagggggcgctgctcttcgaggacaagaacagcctcacggaagaggagcatgcttgggcagtcaagctcttctcctcaatcggtaagatcgtcgagatcccgagtgaccagatggatatcgcaggcgccatcaccggttgcgccccggcctttgttgatcttttcattgaagcctacgcggacgtcgcggtaaagtatggggtgaacaggagccaagcgtataccttggtctcccagatgatcgaagggagcgccacactccagcttgccacgggcgagcatcccgccgcactcaaagatgaggtctgctcaccgggcggcaccacgatccgcggagtctgtgcgcttgaggagcacgggttccgtgcggcttgcgaagcttccattgacgcgatcatgaactcctgagaaggcgaggagatacacttcttatgagacgtctccgctacggttaggactgatacgtgttttggtcattactttcccttgtcgtgctcttactgctcatcaggttcggcttttgggtcgtcaaatccttcatggcctggctgggccgcggtgagccggtcaagcgcgcagtcagaaagcgcactgtctccccagaagtgatcgaggcggtcaacaacctcgccaaatatcgggcagccaagcatctcggccagcagacaaagaagcccgtgcacctggcctggaagcagatcgtggggattcaacgctccgagcgtctggtgcgcgatgattacgtcgaccacatgcacatgagctggtaccagtgtgtgatcatctttttgctctgcgcctttggtggcctcgtgcttgaagaggtgtggatgttcatctctgcagggctcactcaaggccgctacggcctcgtgtggggccccttctcaccggtctacggcatcggtgcgttgttcctgacggctgcgggcacgtttgtgagaagaaagcacatcaaaccgtgggttttgtttatctcctgcatgctgatcggcggggcgctcgagcagctgaccggctggctgatggagacctacatgggcgcggtctcgtgggactacatcgccgggcacgtccctggtgcgatcaccaagtgggttgcggtcccgtacctctttgtatggggcatcctggggtgcctctggacctatatcattatgccctggttcctcttcacgatcggagagccgacaacgaagcgtcaggtggtctttgtcgctctccttatgatctacgttattgccgactttgcaatgacgctcgtgtgcttcaaccgccgcacggcacgcgacgaaagcatcccgccgcagaacagccttgaggagtgggtggacggacactactccaatgagtttatgtcgcagcggttcgagaacatggtgatcgagcagcgcgatcctgatgagtagtggcgtctgatagctgcggttaccagaagaagccggggcgcctcatgagagatgctccggcttcctcatgtgtacaaacttctaagcgttcagcctagcgcaggttgtagaaagcctccctgccgcggtaggtagcagcgctgctcagcctgtcctcgatgcggagcagctggttgtatttcgcgacgcggtcggttctggcaggagcaccggacttgatctggccggtgttcatagccacggagaggtcggcgatcgtcgtgtcttcggtctcgccggagcggtgcgacacgatcgcggtgtagccggcttcctttgccatctcgattgcgtctaaggtctcagtcagggaaccgatctggttcaccttgatcaggatcgagttggcagcgccgagcttgatgcccttcgcgaggcgcttagtgttcgtcacgaacaggtcgtcaccgacgagttggatcttcttaccgaggcgctgtgtgagcttcacccagccatcccagtcttcttcgtccagaccatcctcaatggagatgatcgggtaagtggcgatcagatcctcccagtagtcgatcatctgatcggaggtgagggagcggccttcacccttgagctcatagagcttcttgctcttgtcgtagaactcagagcttgcgggatccattgcgaagacaaaatcctcgcctggggtgaagccggcaagcttgacggccttcatcaggtactcgaagggctctgcgttggtcttgaagtccggggcaaagccaccttcatcgccgacgcccgtcgagaggccggcatccttgaggacctgcttcaaggtgtgatagacctggctggcccactgaaggccagtgtggaagttcggagcgccgaccggcatgatcatgaactcctggaagtccacgttgttgtcggcgtgtacaccgccgttcaatatgttcatcatcggcaccggcagggtgtgggcaccgaccccgcccagatactcatagagtggcatacgcaatgaagttgcggcggcacgggcgaccgcgagcgaggcgccgaggattgcgttggcaccgaagttacccttgttcggggtgccgtcggcggcgatcattgtctcatcgattccacgctggtcgagggcatcgcgaccgatcaggagcttcctgatctcatggttcacgtgtccgactgccttggtgactcctttgccgagataagccttcgggtcgttgtctctgagctcgacggcctcaaactcaccggtggaggcgccggatgggacgagggcacacgcacgggtgccgtcgtcgagtgtgacttccacttcaaccgtggggttgccgcgggaatccagaacttggcgtccgtatacatctgcgatggtcttcatgggtgcaatcctttcactcgttactacggttacctgacaacagaatgctttaacagttaaccgtaactaactaccttatcagtcatcatacccaccgagcggcgcgctatacagaagaatcaactagtatgggaaagaataaaaaaattctgagacgatcacacctgatacggctgcagagaaggggtaagcatgccgaacaagcgcaaagattatatatcgtgggacgagttctttatgaagatggcaatggcagcacagcaacgctctaaggaccccaacacacaggtcggagcctgtatcgcggatacgaaccaccggatcttgagcgtcggatacaacgggaccccttctgccttaaacgacgatgacttcccctgggggccttcggacgatcctctaaaggacaagcactcctacgtgatccatgcggaagccaatgcgatcctgaacttcagaggctccctcaaggatatgcagggggcaacggtctatgtgacactgttcccgtgccacgagtgtgcgaagcttctggtgcaggcgggcatcggggaagtggtctaccgggacaataagtatgccggctcgatcgacaaccagattgcctgccgtatctttgacacttgcggtgtgaagtaccgccagatgatcatcgacgagtagcgacgcaccccgacgcacccaaaacaaatctgatattccaactgcggcggtccaaaggccgccgcagtgctgtagagatcctagatgcagtagggggagaggaaacggtgttctagaacggatattgacaaaacgatggagtttctaccgtacaccgaaaaataggagacttgacaggtggcacaatctcgcttcagcttcctcgatttatgggaaagcgtaatatcagaactacgtctgttattgacttaaaggtttttgatccgctgtgtgacgaaacgaggtaacgcacatggttggctatgttgtaacgggacacgcagagtttgcgccgggactcgcaagctcactgaaccttttagtatcgtcgcttccagactttgacgcggtgccgtaccgcctcggtgaagaatcaagctacctccagcgtctgactgaagccgtgtcccgtgtcggacaggatgaggaaggcgtcattatcttctgtgacctgatggggggaagccccttcaatcaggcgatggcgctggcaaaacagactgacggcgtcgaggttatcaccggagcaaatctctcgatgctgcttgccgcctacaatgcgcgcgccgaaggtgtaacgattgaggagcaggtcgcgacggcgctcaaggccggtaaagacgggatcaataaccccactgcaaaggatgacgcatagccagatacaatcaagcgtgccatataaggtcttggaagtacaagaggttgcagcggatgccccaaggacggatactgcagctgatagtttttgacgctgaccgagaggggaccggtatggcaggctacgcgcttcacgctcaacacgttgttcttccttcgcatctgagtggtgcagggtatctgaggattgagaatggtaagttccgggagttctcagaagagaaaccggactgcgatattgtcgagttgggcaatgcgattgtggggcccggcctcgtggatacccacattcacggtttcttcgatcacgccacgaccgatgcggatgcggcgggcctgaacgaagcgagccagaggctcgcagagcgcggcactaccagctggttgccgacgaccttcaccgattcggtcgaacacatcaccgatcagtgcgcggcgatctatcaggctacacaagaccgcgatggttcgttcctaggtgcccgtattgcaggtatctatctcgaaggccccttctttacctcaaagcatgtgggagcacagaatcccgaatacctgattgccccgaactatcaggatttggagcagtggcagctggcttcccacaacatggtggtgaagagcgcactggctccagaatacccggaggcaagtgactatatcgagcaggcgactgcttcaggcgtggtctgttcattgggccacagcgatgccacctatgatcaggcgatgcgcgcgatccgagcaggtgctacctgctttgtgcatacctacaatgggatgcgtggcctccaccaccgtgagccgggtatcttaggcgcggcgatgatcagcaaagaagcctacgcggagctcatctgcgacgggcatcacgtagtgcccgcagcctgcgaagtcttggtgcgcgcgaaaggttgggagcacgtggtgctgatcaccgattgcctgggctgcggtggacttcccgagggcgactacatgagcggcggcctaccggtcgtcctgaaggacaatctctgctatctaaagaatgaggatggaaccctcggcagcattgcgggttcggtcctgaccttggcagagggcgtcaagaacatggcagattggggcatcgtcactccggagcaggcgatccgcatgggctctgagatccccgcacgctctgcgcatctggatcgcaccgcaggctttatcctgccgggacgcaatgccgacttcaatgtctgggtaccggatctgtcacttgaggccacctacatcggcggcgtcaaggttgcttgattgatctagctacctctgctgtataaaaacagaccgcttttggcggtctgtaagtctgtaatagggttgtgatgttcctttgttacactaggcgcaactcttgtaatagctgaaaggatgcatcccgtggaaatcgtaaagactgttcacgcaatgcgtggtgtcgcgcccgcgcttgcggcctcctcactcgaagctagaaaccaagcgctcgacaatatcgccgaaggactcaagaaccatgcacaggcgatcttttcggctaaccgggcagactgcagcaacgcccaagctgtgggtatcgctccaactatcttgcatcggctgaaatacgatgagaagagactgcaggagagcttagatcagcttgaggagctcaaagggcttgaagaccctatcggccgcctcgagatggagcgtaagttggatgacgacctggtgctgcgccgggttagctgcccgatcggcgtcttaggcgttatctttgaggcacgtccggatgcgctgatccagatcggttcgctgtgcctcaagagcggcaatgtagctatcctcaaaggtggcagcgaggcgaagcgcaccaacgaagtgctgttcgagatcgtccacgacgcctgtgtgtcagcaggattgcctgaactctccttgtccctggcgcagacacatgcggagatcgatgagctgttagcgtgcgacaaggatgttgacctgctgatcccgcgtggttccaacgcctttgtccgctacattatggaccacaccaagatcccggtaatgggacacgcagagggcgtctgccacatctatgtacataaggatgcggatcctaagagagccatctccatcgtggttgattcaaagacccagtatccggcggtctgcaatgcggcagagaccctactgatcgatcgagcggttgcccctgaactgctgccgaagattgcgcaggcgctcgcacagcggggagcgcgtctgagggggacccaggaagtcgtccacctgctcaagagaacaccggacatcccggcggtggagctgatgggggacaacgagttccacaccgagtacggcgatcttgttatgagctgcaagatcgtggagaatatcgaggaagctgtccaacacatcaaccgctggagctcccaccacaccgatgcgattgtcacggaagacgagtgtgccgcccagttctttatgcgctttgtcgactctgccgatgtataccacaactgctcaacccggtttgcggacggtttccgctatggcttcggcgctgaggtaggcatcgcgaccggtaagctgcaggcccgcgggccggtcggcctggaggggcttgagagctataaatatctgttggaaggcaacggcaacattgtggcttcctacgcttcggggaagcgccacttccacttcaaggacatcaagccgctctactaatcggtgaggtcgatgcgctggtagagtccattgtctttaaagcccagatggcggtagtactcgcgggttccgacagcgctcacgacatttaacttagaatatccggcgcctcgcgcaatctccttcgcgtgatcgatcagctgtctgccgagcccgcggtgttgagccgaagcatccgccttacctaagtgggcttcctgtccgtagacgtggacctcgcggatcatcgcttcgccgggctcggtcggcacttcctcggctgtgacattgagcgtgtgcgtggcaagctcatcccagtgggggagggagaggcgcaaaaagcccacaatatggttgtctggtgtgacccactgcaggaaatgctcgcttgaggtcagtgtcttatagggcacatcgtcgagcgtaagctgtgagagatcgaccgccttgcgggcgatttcacggtagcggatatcgtggatgaggccggattctccagctttctcaatcttctgctccaccatttgacgcaggttggctttcttgttgccgaccataatgtcctgtgcactgatgtcgcggatcatgcgggagattctgacataggaaggtgtcacgagggtgtcgtgcacaaggacatcgaggagctcgtcttcgctgtacggcttccagtgcccctcttcatattccttcaccagtgcggtcccctgaaccaaagtgcaggggtagagcttgatctcgtcgggcaggaagtgcttgtcctcaacgaaggtctcgaagtcctttttatctgcctcggggtcagatcccagtaagttcaccatcagatgcgtatggatcttgaagccgtagagccggatcaagttgagtgtccgggagatctgctcgatcgtcgtagcgcggtggttgatatcgaggatctgctgacgggtggattggatacccacctgcactttggtgcagccgagggtgcggaagaagcgcaggctctcgggagtgatcgcatcgggacgggtttcgattacgaggccgaccatacgctgggcggcagtctcgttcttcttctgctctgttttgagctcctcaaggcttgctgccatgcgtctccacacggtctggtaggggaccgcatggtcgtagagcttgtgccaggcctgattgaaggtctccttaccctgataaactttctcttgttcggtggagacgaagtcctgcagcatagcatcctgattggagagcccggagccacggtagacctgatagcgggaacggatcgtgccaatatcgttgggccactcgttgagggctcggaagagttcctttatgaaccagatctgatagctttggggatagtcgctccaggtgccgccgaggacgatcagctcgatcttgtcggttgcgtggcccatctggcgcagggcacgcagacgcgtagtgacctgtaggtaaggatcgaagtagttctgctcagcccgctgacaggccggctcgtggtagaggtagcttttcggcatccgtaaatcgcacgggcagtacaggcagttgctcgagcaggtgtaagggcgggtgattacggtgatggtggagacgcctgaggcggtgcgccgtggtttcatgcgcacactcagcaggaagcggtgctccaactccggatcgatatgccagctttcccacagctttttgctgtgttctttgatatggaggtaggcgggcaggatattgcgcttcttgtagcggtgatttccgttgagctcacggctgtgtttgcggatcaggtgatccaactcatcaggagtgaggggacgggaggtattgctcgttgctcgcagtgtggcaaatatgtcttctatcagtgattccatagcaactcattataaagccctgactgtacgctcaggaaggccagccgggaaaagtcaggccctttacaagtccctggaatggacgtccgtcttgaggatcgtgataagggatgcgaatcctcattgctagtgcaacagcaaggattaaagaacagcaacccggggtctctcacaatgcgatggtatccgcgaaaaacaatcaaaggaggctgccctgggctgctactatcatcttagctgagaagagcgaaaagatgtctcgctttcccacactgaaggcaaagacacatcccaagattgtcagaaagctacattgcaacaagtcgaccatagcttgtaagcctgtagcaaactcatgcaaccgggaagtatccgatatgtgatagggggcatctgttgcacaggggcactgcaacaggcacaggcagtgaagtctcaaagagcctctgtgcctgtgtgcaggacaagactgtcaactgtcaggtatcaccacaacagatcacaggaaggcccacactaaagaaggggtcatctcctgtagcctgtgccacgctctgcagagctatcagtgatcgcacacttaaagatagcttggccttgtacgtatcgagttccccgcgatgtcgctgacagacccgataaggcagaggagcgctttaaggatcaaggactgagaaggcagatagcacactgtgggaaagataaggggccttacacttgtcggcaggaagcacaagatacctaagcgctacctcttgcacagacacatacagcacaagctgtagctaagacaggaaagcttgctgtatctggttgtcctgtcaagaccagcacaccaaagagagacaaaagggtctgcacagcacagagatgtcacacagacactgaaagctgagcttctcttctgtctgccttatcacctgtagcaaaaagtgagtattgaaagacagctatggccctatctaagagtacctcccaacgcgtacaagctttcctgatgccaccttatctgaagtcagacagctctatacgaatgctatcaacctaagaccacaccagatgtctcgctaacaagacaccctgggaagtctttcactttcagacgttgcagttgataggggaattaaaggggctcttcgacacgatgtgtgaatgaagaatatgcgaatgcgcaggtggcacgacacgttctcctgtaggtttttagttgtgaagtaaagacccggcagaaggagcgcaccgtacgcatctcaaacttagccaagatcatgatcggcgtcgaggatgtcgtcgtgcaggatatgtccttcgacgaggacgcacaggcgatcgtgatcgacgccaaggccctacaggccccactcctgcagatgtggtaagtgcgggcagaaggccccctgctacgatgcagacaggggaaccaggtgctggagatgccccgatgtcgtcgggacgaaggcgtatgtgcaggcggatgcattcaaggtgagatgcccaaaatgcgataccgcggtgcggaagctgccctgggcagaccatggtagctggcgacccgtgtctttgaggacagctgctgctggcttgtgctgtcgatgagcaagcttgcctgccaaaggcttctgcgcatcttgtggaggtgggtgggcgcgatatgctcgcgggtgctggaaaggctcaatctggcgcagccgccaaggacagcaggcctcaggcgcataggtgtggacgagacaagctacaagaagggccacagttacatgagcgtggttgtgaaccttatgacataggatccgtcgtgtgggtgcatgacgccatggacgcaaggtcttcgacgccttcttcgagcagatcggcgataagggaagggagcccatcgaccttgtgagtgcggacggggcgtgctgggtggacgatgcgatgaaggagtgggtggcacatgcgctgcgctgcacagacaccttccacatcgtccagcgggcaacggagctgctcgacgagctgtgccgccagtcatggagaaaggctgtgcaaaaggccaaggcagcaccgaagggcaggcgcgcccgccccaggaggggagaggaggcgagccccgaaaggaaggccgctgcatccgtgaagggcccaagggaccccctccttcaagaacccagagagcctgaccgaaaggcagaaggcggcacttcagctcaccgcgatcttgcagccgcgcctccacagggcatatctgctgaaggaagggataaggcttgccctgaagctgcctgctaacgagatcagggagggcatcgggaagtggaggggcagggcctggcgctcgaggatcccccaagttcgtcgagctctaaaggaagatcagaaggcatctggatgccatcgtcgccaccttggagagcggcctgtccaacgcacgcgttgaggtcatcaacaacaagatcaagctgaccgtgaggatggcctatagctttcgcagcctcgacaacctcttcgcgatggtgatgctcatatgctcggggctccagatgccgctgccggggagagcctagcgctcacatatcggttcacacattgtgcagataactccaataaaatggcctattatgaatcaggagtttcgagaagaatccgttgacggggaaaggcaccacgacagtatgaacaaccaggtagcccgacgcttggatgctctgactgaggagttttatcagcgtaatgcagtgagctttgatgcgacgcggcaaagctcctggccaggatggtcaaagtgccttgaggcagcgggactgcaagaacagaatcctgagcgtctgaaggtcctggatgtagctgcgggtaatctgcgcttcgcccgttttctgaatgatgcctttccagacacagagctgatctatacggcggttgattcctgtgaaccattgctggcgaattcaaagccgatttcgcatggacgggtaaacgtccaggttatcgatctgatcgaggagctcctgaaggggaatgaagatttgtttagtgcctgtgggcagcaggatttagccgtttgcttcggctttctgcaccatacccccactgaagaggcgcgtatacatctattgcagtcaattgtggaagcactgaagcccggcggcatcgctgcgatctccttttggcggtttatggaagtgccttcacttgcaaagaagactcaatggacaacacagaaagcgctgcagaagctctgtctctccgaaagtgatctagatcagggagactatttgctcgggtggggagagacctctgattcctggcggtattgccacaattttaacgatgcagaactcaagcgctactgtgaggcactgacggggagcgcagagcttgtacagcatttccgctccgatggtagacctggagatctcaattcatatctggtgttgagggcgtaatatcaggtcaatcgaagcataggagaagtatcctgcacaataagccataaatgggaaacgatgtatgactcctaaggcagagaagttcagtgtgtacatacctcctcaagagaagaaagaattggaagcgctgtttggtagccgggggatgacactgccggaagcagtcaatatcctctcttatggtcgatgacatgcctttgatgcgcaggggaccccggacattttttcggacctaggctgcatatgcgcagctaaggcctctcctgtgctccctgagcgtcctccacccacaaggtacgcttgagcttggccaaacaataccactcaatgtagctgtcaagacagctcttgaactcctcgaatgtgctgtcagcccaatccatgccggaaaagaggtcagacttgagcgtgccgaaaaagcctttggcacgggcattgtcagggggcttttgtccttgggcgacatcgagtgggcggcgttgcccccctgctgcaggcatctgcccgttcgtctgtcatatagagcgcaccggtgtccgtatgcacgacgaggagccttccctcgaagagctttaatcttgcccaccagatcctcgagcatgccgaccggaagctcacagtcgggatgcatcgataccttccagcatacaagccagccgttgaagcagttggtggcggaagagagataggctttgtagccatccagggcgaactccgcctcagcgctgaccacgaacagccctagctcccctgcgtggaagccgtggatgccatcctgtttgagtggtacgttctcgggcctcaccgccgcactcacctgccttgctgcctgggccttgccctggacttctccgggctcgtcaaaaagccagggcctgctgcttttaggatatccagtaccgccaatgcctctacgagcttgacttcgctcatctaggctctctcggtcaaaccgtcggacagcttacggcgaaggcgcgccatgtggtgtgcacgggatacctatcggtatctgatgcggtctgcctgccgtcttggacatgcgctgtcacggcgagcatatcatgtcagccgtacccatagttgggactgccctgtccgtaggtacagtacatgctgctgtgtacaggcccgcctcctccatgggcagccaaccgcacagaacgctcgtgctgggcaagcaggcgcagtgtgcgacagacctccccagtcaacaggccgctctcgtaaaactcccggagcaatcccttcgcgttcttctttggtatacatcccggactccgattccaaaccagttggtccgactttttgtccggggtccccataagcccaaatttaatgaagagaatgaggaggctttgcaggaagtcagagatattaaattccggtctctctgttagaccacgattgacctgagaagggtccagtgttgtccgggcctttgcctacaatgcatgtcaccaaacaaagacatcgagaaatgggagggccggactcaatgatactgcagcggatc

SEQ ID NO: 318 - DNA, 8153 bp, Unknown
  Metagenome-assembled genome
tctcacccacagggatgcctgacgagcaaagaagcatgtaagggagcaacgcctaaggccgcatacgtacgggcagctaaatctggtgcacttcgccattctcgacgaccacgatctcgtcggcacacgcctcaatgagctccctgtcatgggttatgagcactacgacgcgcccggcgtcagcgtagcggcgcattgccgcggccacgcgcctcatgttcaggtagtccatgccgctcgtgggctcgtcagccaccagcacgtccctcttggctgccaaggctgcagcaattgcaaggcgctggcgctcccctcccgaaagcgacaacggatgctcctcgtgcttattctccaaccccaccacagccaggtactcttgagggtcgcatgcaccatttgagaggaggatctccttctcgacactcgaagtgaacaactgtgcgttcacgtcttgcaggatcatgtagcaagaattgcgctgccaacgtcgccgaacgggcgagccgcccatggtgaccttgagccgtataggcttcactaggccgcacagcgccttccccagcgtggtcttcccctggccgttgccacccaccacagccgtcaccttgcctcgtggaaacatcaggtcgcgaatatgcagcaagggcttcttgccgtatccacaatccagctcttcgatgaccaggccgccgcgttcgtcttcactccgcgctgggatacggggcacagacgggtctgctcccctcagtcccatatcatgcagctggaccgaactcaggctcttaaactcatccccaacaaacgcccgctcaacttggccatctcgcatgacgatcacacgatctgccaaactactcagccaatccaagcggtgctcgctcaccacgatggtcttgccgacttgcttgagctcggcaagaatggcaccgatcctctcgatggtgtcgatatcgagattgctggtgggctcgtccaggaccacgcacggcacatcggttatgcagcacgccgctaagcagatcagctgcttctgaccgccggacagcgcaaagatactccggtccatgaggtgcccaatgccgaaccgattgaccaccgcgtcgaggcgcgctttcatctcgttgatgcccataccaagattctcggccggaaagaggatctctgccgtggtattggtcgtgaagaactgggtcttggggttctggaacaccgatgccaccgtagacgtgatgtcgtacgtcttcatcgaaatcgtatcagctccattgagctgcacttcaccctccaggcggccttcaagaaggtgtgggatgatgccgtttatcatccgggtgacggtcgtcttgccgcatccactgggtccggtgagcacaacgaactcgccatcctctacggtcagatcaatcggcccaaccgaggtcttgtcgggatattcccagatagcatcatggatcgctatgcccatacaaacctccacacaataagggcagcaagcaacgagaacacgagggcatccgcccatcccagacggcatgcgaagtaacggctcttgcgtcctgggatgtcgacaccgcgtgtgtatgccgccatcgaaaggtcgtcggccataacagaagcgcctgagagcagcggcacgaaaacatattccaggctcttcatcggcgtaagcagggcccccaggcctgtcctgatgccgcgcatgtgcatggccgccccgatgttttcgacgcccttgcgcaagcacggcatgtagcgcagcatcacgcacagcgagataatgagcccccgtggtaagtgcaactgttccatcgaggccataagctcgctcacctgagtggagcgcatcagatagccggcagccgagagcggcaggcagaacaccaatgccagatggacgatagtccccaagatggccacgataaacagatcggcattcagcaccgcagacagcccgttcagagcagcatagagcacgacaagcttaagtgcatccttcgcaaaccccgaagcgacattgagcaacagaatggccaccaggcacgccagctcgacgggcagagtcattgcccaggtgatggacgcgctcaagacaaggaccagcacaatcttcgttcgaggatcgagtttgagccacccgtcgcagatcatgtctcgatgccagacttttcgagattcttctcgaggatgcgcttggccagcagtacaccgaacactgcacccacaataaccgagacgtatagcacaggcagcacccatgtgggaaggttcagatagcccattgcgaacgtctcgcccatggtctccaacgtcttcgcataatacgcttcgcggttcacgaaaatctgccaatagctcgccaccatgttgaggctgagagcgacgtgggcgagcgtgatgcccttgtacgtatgcagtccagcccattgacgcagcagctcggcgatcagagcgaacgccacaatatgaacaagtagcaggtaatgaaggccggtcatcaggtgcaataccagaaacggcagcagcgcgaacaggaacgtagcccactttttctgacacctcgtcatgaagaacaccgtaatgatggtcccgatgatggcataggcgaagggatagagcatgtaggcgaccaccgacatcccaaacggggtgcccactacgaatgatcccacaagatagatggcggcaaagatgccgatattcacaaaatccttcgtttgcagtctctcgttcacagacgtgctcctttcgctgatgcttccatgcttgttcatgaatttctacaacccaacctgatagctgtactgttccacggcgaccgaccgttcgacgaggctgcgatacaagggacactcctccataagttggtcgtgagtgcctgccgcctgcacctggccattgtcgagcaccacgatgttgttggtgttctcaatggacttcatgcgatgtgagataacgatgaccgtcttgcccgccacgagcttattcagtccttcttgcaccctggcctcgctctcgacgtcgagcgccgcagcaatttcgtcgaggatgatgatgggagcatccttgagcaacgcccgcgcgatggatatgcgagcgcgctccccaccggagagccttgccccgttctccccgatggtcgtgccatagccgtcgggcagatgggagacgaagtcgtcgcatcctgccagctcggcggcatgcttcacctcatcatcggtggcatccagccttccgatgcggatgttctcgagcaccgatgtgttgaagagcaccacatcctggaacacaatggacatgcagctgaacagggcttctgtatccatctccttaatgtcgcacccaccgatggagatcgacccgctatcgtagtccaccagacggctgatgacgcgcagcagcgtcgtcttgccgcacccagaggggccgaccagcgccgtcacctcgccctgcctggccttaaacgttacaccgtcaagcacctggcgcatcccgtcataagagtaccgcacgccgctcaaggcgacgtcgaactgcgtcggcgcatcgcctaccccttcttgagtcggcgtatccctgatgtcctcgatcttctttacacgtgcatcgagataaaagatctccgcaaggtactggaacacgttgttcacgcctcgggagaacatcgccgctgcaaccacgtagcccaccacgaacagcaaggtggcctgcccttgggcaagcaggttcacgcccacggcaagtgtgataccgataggcagcaccgtgatggcctgggctgcgctcaacgggatgacctgcgcaagctcgcttccccactgcagcttctccgcgttaacgaggttgcttgagatgcgggccctgaacgcctccttaagctgatagcttttgatctcctggctcaggtcgatggtggtttggtactcttcggatatctcacgcagcacggcatactgttccgtgcgtatctgcacttgcaggcgctttgtcaagcagactagggcaatcgagaaggcaatgggtacgagaatacacagggcaaggcgtacatcgccgagcaacatcaaaactgcaccgaggatgaagtaggccacgaaccctatcaggttggcaaccccgtgagccagggcgtgctcaagggcggccacgtcggctgtgagcacctgcgcaaggtcggacacgtcgtgtcgcgtgaagaacgagagcggaagttccttcatccgacttgccaaatcgattctgatgttggccgtctcgcggtaggtttcgttgtaagagacgcgataattcatatcgacagccacatatatgacggccgccgatgcagctagcaaaccaacgtagaaccaaatgttcggctcttgcccctccgtgagctgccaagccaggaaaaacaccagcatcatcggaagcaagagcgagaggtagtagaagaaatagctgacgctcgaccgtatgaggccgcgtgccccatcgtcggtcagcgcgaacaaccttcgaagcaattctttcatgacaccctccagtcgtttgcttgctggtaaagatcagccagctgtctatagcgcccacttgtccgcatgagctcctgctccgagccccgttcgaccacctgtccatcctctatgaacagaatctcgtccacgtttcgtatggccgagagcctatgtgcgatcatgatgacggtcttaccttccatcagcctggtgaaggcgcgctgcagctcgtactcgttctgcgggtctgcggcagcactggcctcgtcaagaataaggatattcgcatttttgagcatagcccgcgcaacggcgatgcgctgtacctcgcccccagaaaggtgcacgccctccgacccgaccaccgtagcctcgcgatcagagaacttgtcaaggatggaaaggcactctgcgtcctccagagcgcgcatcacctcgtcgcgcgaagcggcaggccgaccgcaatgcacgttctcgtagatgctcatgtgtgggaagagctttgcattctggaatacgtatgcaatgttgcacagcagcgcatcctcggtgtatgcgtggatgctgttaccgccaatcagcagctccccggtcgacacgggatagaaccccgagatgagcttggctatcgtcgacttccctccgccgcttgggcccaccagagcatagatcttccccgcctcgagcgtgcaggagaaaccatccagcacaacgcggtcgccataggcatacgtgacgtcgcgaaactccacgtcgaagcgttgcatctcgtcaaggtctccagaggttatacgagatgccgccatttcgctacgcaggttttccagatgatcgagcgcctgcttggcctgatagttgtccatacccgtgaacatcacggccatgaaagccgagtagcacacgccggaaaacattgagaagaacagcaccttcaccaggatgacgccggcgggttccccctgcacgataaacaagatcgcaaatggtatggccagcgcatagaagacgttgaacagaacctggaatcccacgtagggccgccggcagctgagggtatattcgtagatattgtcccggtactcgcggatggcatcgatgagtgccttgtagtagtgcacggtgacgccgaagatcttgatgacctgtatgccgcgcacatactccaccgaggcagagctcatctcctccatggcacggccgaacttctccatcagctcggggcgcccatacatggccttgtattggagaacgccgatggcaatggtgacaagcagcaggatgcacagcctccagtcaatgatgccgagcagaacgaacatgagtacaggcgtaacgatggcgcttacgttgttgggaatgagatgggcaaccgtacgatgcgtattacccgcattgtcgtcgatgatgcgcctgacctcaccgctctggtgcgtatcgaaaaacgagaacgaggcgtcgagcacatcgttcagacccgacgtgcgcaacttcgtttcgaggccgaaccccagatagtgggagtgcagcagggctgcaatgttcagcaggccgtaggctaccatcgccaagacgatccacatggcgtaactggccgcttggcccggatcgttaccaaccaggagcaggaccaacgtttggtacaaaagccagtaagctaccatgttcattacgcacgatattgcggcaagggcgatagacacccgagcgtggatactgcgctctgggatataacccaataaccgtcgatagagctcgaacatgtttgcctccttattgaacagacaagttaactaaggtaaagtctacgagtgaccattagagcacaacgagctcaatcaaatggtctcaacggaattcatccgtctatttgaggtagcatatttgcctaatcgaggtagcaatgacatctaaggggcatcgacgtctcttgtccatcgcaaggccagcagaatggtcgtatcgacctgcaggcctgacatacgagatcgaccttgaggatgttcagggatttcgttggtattaccgcatggagggccgctactccatcgccatcgaccagctctcttttgcccgcgacttcatgctccaaagcaaagttgagtccttgtacacgatcgtcttgtacgtcacagtctcaggggacgaattccttccctatcgcagcctggcatccgactccatcacgctgtacgcgcccgatacccctttcaaagtgatctaccaccacaacatggagctctatgcgctgacaatcaacatatgcgcttcgttcgtagagaacttcctgcaggagcgttaccccgcactggctgaagctatccagacagcgtttgcacgaggcccgcggcataggttcgacttgatccgtccgctgatgtacgatatcttgcagtgcgataagagtgcagaagtttcagcactgctcttcgaggcgagaatcctggagatattgtcacgaatcacaagtgcccaggaaacgttggccatctcagacacggcggcggagcgggtaacgatcaagcccgaggacgtcacggcgctcacggagattgctgagtatatctccgaccattacaaccggcagattttgctcaagacactctcgagcatctcgctgatgagcgagagcaagctcaagaccctgttcaaggcacaatatggaatgaccatcacggagtatatccagaagaagcgcatgagcagcgccgagctgcttctcatcagcaccgacctgccattggcacaaatctcgaaaatcgtgggctatgcgaaccccagcaggttttccgagttgtttcggaaatattacggtatcgcaccatccatctaccgcgcggggaaataacggacacttcacttctggtcttcggctcgccgaacgacttagattcggtgggcaatccgtaggatgataatcgactcgcgagcaaaatgtcacctggttgcacccttatgcccttacaagaccaatttacatagctgggctggctggcggagatatcagctccctgagcttacctccttatgatagtagtcccgctatctaagcgtcgcccggcacccatgccaccctctcggctatactgctaccaacgttgcacgacacccaccagaggtcgagccatcctctggatgtcggatgccctgaagctgccatatacgctgaagaacttcttgaacagcccgtactcctcgtcgatcctgcaaagcggagttccgatcgtcgaaaagtctaaggaataccttcgcgttgtatgcctcacccttcggatgtaggcttcccgacaagtgcgaggacgaggtggcatgtgtgcgcgacgccacaggttgtgcatacatgctccattactggaaggccaaagctcttgctggtctttgccggctgctaggacgaagccatactgctagacgcatctgaatcgagatgaaacctaatggtcgctcgacaggcgcagccgcgcacttcggacggacgggataaagctaaaaggactcacccaaaacaagatctgaatagggaacgacacaaacatccgccccaccactgcatatcttggaggggatgcaaaagatcgagcggcgcaaggagctggactgtattcgggacgcatatagcgcagaccccttgctcgtctcgaccggagacatcctagtgcatcc

SEQ ID NO: 319 - DNA, 25155 bp, Unknown
  Metagenome-assembled genome
atgacccctgtcatgggtttttcatgatcactacgacgcgcccggcgtccagcgtagcggcgcaattgtgctcccgcgccactcgcctcatgttcagctagtccatgcccgcctcgtgggctcgtcagccaccagcacgtccctcttgtctccaagctgcagcattgcaaggcgctggcgctcccctcccgaaagcgacaacgggtctcctctgctattctcccaaccccaagaccaacccacagccagggtactcttgaggggtcgcatgcaccattttagaggatgtctccttctcgacaactcgaagtgaaacaacttgcgttcacgtcttgcaggatatgtagcaagaatgcgctgccaacgttcgccgaacgggcggagccgcccatgtgaccttaccgatgagctcactatgccgcacagcgcctccccagcgtgggtctttcccctggcccgtgccacccaccacattcagccggccctttgccttcgtggaaactcaggtcgctaagatgcagcaagtcttctgccgtatcccatccacgtctcgatgaccaggccgccgcgttcgcttcactccgcgcttggatacgggtcacagacgggtcgggctcccctcattcccatatcattcatggctggaccgcactcatgctcttagaaaaactcatccaacaaaaccccccaaacgccccgctcacttggcatcctcggctgactatcacccgatctgccaacgactcacccactcccagcggtgctcgctcaccacgatggtcttgccgacttgcttgagctcgcaaaaatggcaaccatcctctccgatgtgtcgatatcgagattgctggtgggctcgtccaggaccaacgcacgggccctcgttatgcagcacgccgctaagcagatcagcgcttctgccgccgcgacagcagcaagatactccggtccatgagtgtcccatgcctgaaccgattgaccacctcgtcgagggcgcgctttcatcgcgttgatgcccattctagattctcggctgaaagaggatctctctcctctgccgtggtattggtcgtgaagaatgggggtcttgggttcgggaacaccgaatgccacctaacgtgatgtcgtacgatcttcatcgaaatcttatcatctccattgagctgcacttcaacaatttcacaccctccaggccctcagaaggtgtgggaatgatccgtttagcatccggcttacgtcgtcttgccgcatcccactggtccgtgtgagcacaacgactcgccatctctcggtcagataatcggccccaaccgagggtctgtcgggatattcccgatagctcatggatcgctaatgcccatacaacctccccacaaataagggcagcaacaacgagaacacgagggcatccgccccatccagacgcatgctaagtaacggctcttgcgtcctggaatgtcgacactcccgcgtgtgtattcgccattctaaagtctcgccataacagaagcgcctagagcacggcacgaaaacgtattccaaattccaggctcttcctcggcgtaagcgggccccagccctgtccctgatgcccgcgcatcgtgcctaggcctccccgattttgggcgacgcccttgcggcaagacggcaggtagcgcacaatcccgcacatcgagataatgtatccccctggtaagtgcagaaatcacctgttccatcgagccaatatctcgctcccttagtggagcgcatttcatatagccgcgccggaaggaagcacaggaaaacaccaatccgatggacgatagtccccgaatattgccacgataaacagatcggcttcaagcaccgcaacacccgtttcagagcatcatatagcacgacaagcttaagtgcatcttcgcaaaaccccgacgacattgagtcaacaggatgccaccaggcccgccagctcgacgggcagagtcatgcccaggtgatggcgctctcaagacaggaccagccaatcttcgtttcggatcgagtttgagcccccgcgcagatcatttcctcgatgccagacttttcgagattcttccgaggatgcgctggcagcaagcaccgacactgcagcccacaataaccgagacgttatagcaccggcagaccccatgtgtggatgtgcaatacccatgtcgaactcctcgcccatgtgtctcccaacttctttcgcatagatacgcttcgcggttcaacgaaaatctgccaatagctcgccaccatttgagggctgagagtcgacgttgcgtatcgtgacatccttacgtaatgcagtcccagcccattacgcagcatctcggcgatcacgcgaagccacatatgaacaagtaagcaaggtaatgaaggccggtcatcagtggcataccaaacggcagcagctcgaacagaacgtagcccacttttttctgacactcgtcatgaagacaccgtaatgtgggccccgatgatcaaaatagccccgaagggatagatcatgtatgcaccaccgacatcccaaacgggtgccactaagaatgtcccacaagatagatggcgtcaaagatggccgatattcacaaaatccttcgtttgcagtctctctttcacgacgttctcctttcgtctgatgcttcatgcttgttcatgaatttctacaacccaacctgatgctgtactgtccacggcgaccgaccgttcgacgagcctgcggagacacgggacactagactcctccctaagttggtcgtgagtgcttgctcgcctgcacctggccattgtcgatcaccacgatgtgttggtggtctcaatggacttcatgcgatgtggataagatgaaccgtccttgccgccacgagcttttcatccttcttgcaccctggcctcgcttctcgacgtcgagcgcccagccaatttccgtcgaggatgatgatgggagcatccttgagcaagcccgcgcatggagatgcggcgcgctccccaccggagagctttccccgttctccccatggtcgggcatagcccgtcggtcagatggagacgaagtctcgcatcctgccctcggcgcgcatgcttcacctcagcatcgtgtgggcatccagcttccgattcggatgttctctgagcaccgatgtgttgaagagcaaacacatcctggaacacatggacaggcagctgaacagggcttcttctgtatccatctccttaatgtcgcacaccacgatggaatcgacccgctatcgtagtccaccaacgctgatacgcgcagcacgtcgtccttgccgaccccaaggggccgacaggccgtcactcgccctgcctggccttaaacgttaccaaaaaccgtcaagccaccatggcgcatcccgtcataagaggtaccgcacgccgctcaatgcgcttcgaactgcgtcggctagcatcggctacccttcttgagtcggcgtattcccggatgtcctcgatctctttacacgtgcatctagtaaagatctccgcaaggtactggaaacccgttgttcacgcctcggagaacaagtcgccgctgcaatccacgtacccacgcacgaacatcaaaggtggcctgcccttggcaagcagttcaccggcccacggcaagtggtaccgataggcagcaccgtgatggcctgctgcgctcacggatgaacctgcgcaagctcgcttacctcccactgcagcttctttccgcgttaacgagttgcttgaaggcggccctgaagcggctccttactgatagcttttgtctcctggctcagtcgatggtggtttggtaactcttggatatctcccgcacacggcactgttccgtgcgtatctgcacgtgcagcgcttttgtcagcagactagggcaatcgagaaggcaatggtactagaatacactggcaaggcgtacatcgccgagcaacatcaaaactgcaccgaggatgaagtaggccactaacccctatcaggttggcaacccctgccagggcgtctcaaggcggtgtgccgacgagatcgtggtcgtcgagaatggcgaagtgcaccagatttagctgcccgtacgtatgcggccttaggcgttgctcccttacatgcttctttgctcgtcaggcatccctgtgggtgagagacgccatttccccagtaactaagccacatcagcgggtataggtttttggctaggaagtggaacacagatatcagaatatacgagatataccatatccatcatgtttctgtatattccgaaatccatatgccttgtgaacaatcagcttgatcttgttgttggttgcctcaatcctggcattgctcagtttcagtcggatcgtattcaggatatgatccttgtggtgcctgatcttctcatacaggtcgtagagtgccgctatcctgctgtagctctcctacctgagccagtgttttcagactcggcttcaacctgtgtgacatcggttgatttcaaaagtagatgcaaagattccttcagacactatgcccgctacagcttcaaatcatttgcctaaatcactgataatgacaccacagttaattcgacaggggatttcctgcagagttagctgtaaggcatacgccctggacacattggcttgcgacagggcgctggcccatacatacaccaaccgccatcgtgcaggccggcctgcagctgccctgttgcgtcctgccacaggtatcccgaaagcctgccatgacttcacaggagcatgggcactgccagcagaccggactctcctgcttctagcgcttctgtcagtgttgtgtctggtttgccagcgggatgcccatgacggatggaggtcttgcatgtctggttctgggacgctctgcgctggcgtcgacacatacacaaggacaagcatgtgctctgtatgctggatgccatgggcagaagtggccttcagcggggagtttcgggcagacagggtctgatacgaatcgctcgtagaggcgatgcagaatcgcacggtgtcgctgtcatggaggtcctgcggcccaagcgagacaagaggcgccgcagccgacaaaggcacaccggtgccaaagtcgagggatggccgggccgaggcggcaagggcccccgtgcgtgcaaaagagatatgcgtgcggacgtcgacgggtgcatccagcgccgtcaagtccctgctcggagcggctccggaggagatccgctcgaagtttgccagggggggggaactttcgaaatgatgaggtcgcttgccaggaagaggccaaaaggcgctgagctggtcgccgactcgctgcttgtgctccaggcgcttgcgaagaacagggtagccgagctggaggagcttgtgcaggacaatgcgccttccctgctaaagatatagggctgcggcccgctgctctcggcatcgcagcgctgtgcgcagcggcacccatcgagcggcaagcctgtcagataccggctcaaccgacaggcttcccgggcgctgtataccatcgcactcagttgcatgcgctacgacgagcggaggctggcctacgtcttcagaaggacagctaaaggcacatcgaagcgcgagatcacaagatgtttgaagagatacatagccagacaggtcttccgtgctcttttgaatccaggtaccaaaaagcacgagcgcgaagagagccttaaagtcgaagcggctatcggcacacctcacccacagggagaccgctgtaaggctttaacaccgagcccgtcaggatcagcgagatcgagcgcgaagcgaggaagcactgcgagctttaggacagatactcgatgctcctatccgaaatatgcaagagccgtgagatgactcttgacacaccataggggcgtccttggggacgcaatcaatgatggcggcagcgcctgctgcaagggccgaccttcgcagcagaggcaacgatgtaggcacctgctaaaatatacatctcatgctaaagtatgagaccgggtctatatttcagtctgatttcgtgaatgagaggctgaggggagacatgcgacagagctgctacgcttgctgtatatattccttgtcggatcgtctcgaaaggaaatgaaatgagaaagaaaatgaatgacgtggttctcgaaagtgcaccagctgcacctggtcttgctggccttgtgcgcagcagcagtacaaaggcgagtgttctgcgcatcgcggtcggggctgtggcgcttgcgctctgtgcgaatctcgagattccgcttcagcccgtgccctttacgctccagatcctggcgcttggctttattgccgcaacgctgaagccgaaagaggccgcgtcggctgctgccgcctatgctgcagccggtgcgtgcggtctgccggtctttgcaggtggcatgggcggcgtgtggcgcctggcaggccctaccggtggcttcatcctcggcttcattgctggtgcctgggtaggatcgttccttctctccaagctctcgaagacgcaccttccttgggccgtgtccgccttcatctctctcgtcgcaatgataggagctgtctatctttgtggatgggcgcagctcgtgctcgtcgtgcatctttctgtttccgctgcctttgcagcaggcgtcgctcccttcgtcgtttttgacctcataaaggcaggccttgtggcatctgtcttgggggtagggcatatcgtcgcagacagtatgcatcgctgaggcgcagcccgcactctctatgaagttcatctcaaggcagtctgggaaggtatcccgggctgcctttttctgtcagaggccagtgcatgcatctgcagcctttctgctcttttgcggctagccttcaggtgggcatagaatcgctgtggatacagtctgggtaggaaggtatgaggctatgggcgacatcgtggtaggctgtcatctctcgacgtcgaagggctatgaggcgatggggaagtgcgcgctcgagatcggcgcgaacacgtttgctttctttacaaggaatccccggggtggcaagggcaaggtgccagattctgccgatgtgcaggcgctccttgatcttatggagcgccaccagttcggcaagctcgtggcacatgctccctatacgatgaatctgtgctctgcgaagccagatgtcgtggagtatacgcggcaagccttcgcatccgatatcgagcgcatggaagagctgcccggcaactacctcaattttcatcctggcaaccatctgaagcaggggacagacgaaggaatccgcctcattgtcgaaggactcaatcaggtgctcgtgcctggccagaagaccatagtgctgctcgaaactatggcgggaaaggggactgaagtgggccgcacattcgaggagatcgagcgtatcctcgagggcgttgagcacgacgagctcatgggtgtctgcctcgacacctgccacgtgaacgatgcaggctatccgatagcagaggaccttgacggcgtgctcgacgagttcgatcacgtgatcggcctcgagcgcttgaaggcactgcatctgaacgattcgaagaatccccttgcttcccacaaggatcgccatgaaaggctcggccagggcacactcggccttgctgtcttccagaagatcgtgacgaacccgcgtacgagcggccttccgatgatactggagacaccgaacgagctttccggttaccggcgcgagatctcggcgctgcgggcacttgcacggggagcttcgctcgaggaagccgaagcgctactcaaagctgctgatgacaaggctcagaagaaggcatagtcttcaaggtagagacaggtttgccggccgtaccggatggcctgtcccgacgagaagccacaagctttgatgttcttgggggaacatgatgtgcagtgcaaagacagcgatgacctgtgccaacatcgatgtgggctcaaggaacatgcagaaagcatcctgcatgaagtgggcatcgcgcccttcaggtgctgtagagccagattgtgctggcgaaaagtctctcctcgatctgcgtctccctgccaaggagcctgtgacccttgaacgcataagcggagaagagccgaacgcagaaccggccagaggatgcgagtccgccttgtctggagatgcacttagttctgccggcatgggcaagatgccgaagaatgagtacgacgcatagcggtgtctccatgtcgacgggcatccacgtcaggtgcagagccctgcgcccgctctctctgactgcatagcagcgggcggtcatgctgtcttctgtaacaccgtgatagggtggacaggacgttgtggatagcgaaacgccgaggaggacggatggatctcagggacagactagcctggcggctgcatacgatctttgtgcggaagattatggtgccctactgcgatatctttaaaggcgagcttgccttgttggttgcagacgatagtgcttgaggagctctctatgggaacgaggggctgtgccagcaggggctggccaggcaactcctcctgtcgaagcagcacatttcgaagatcgtttcctgccacggaaagcttggcttcgtggaacttgcgcgcgatccggaagatggcagaagccacattgtgagccttacggatgagggacacccctacctcgggatccatattgaagggacagagagaaaggtagaagagtccttcgctcagctggctcccgaagaacactcagagcacgacgaagcaatgaatatagtcattcgtctgttcgagaagatgtgagtgcgcctctcatgggcatcgatacatcctgcgccctgatgtttggcaacagcatcacgcgtaccaatggcctgccggatcttctgagcaaggagctttctcgtgaggtcgagatccatgtgggggggagcacgcctcgccgagcagctctaaacatgtgatggcaggcatccaagcgtggagagcacggagcttgctgtgcagatccttgcttctgctatcaaaggtgcttgagccctatgcgacctgacagaccatctttccgatcatgatattcaggatctcaacgtccgtggggtgcatgccggcgccggcacgccgatgtatcccatggaccgaccgtctcttcagtcatctcgtccgatgaggccctcttctagaaaacgatgattaatgcccatgcgtgccagagggaccgaccacacgactttcccgctaccggcatgcgaaaggcgaaggatgtccaccagtacgtgcagaagccgccgtccgtcccatgcaccgtgccagcccgtttagactggccctgattctaaaccactctttccacttctcccattccgtgacaaaaaatctgtcatagttatcgatctgtatgctatgctgttgcaagctcgtctattcactttctgcttctatgaaagggcatgacctgactgtgctatctctcctcaagcagactgcagctctttctcggagatgtcagtgcagatctggtgttctcctctaagcgacaagcaaaccgctttcataagcggatgaagggatctgccgaggggaaaccatacagcctttggtctgcgttgcagcgctcctgagattcattggtgtcaatcccaagccgcgatccagtcggtaatcattcggaagccatcgtctatccagctacggtaggtctccgtgcaaagaacagaactagtggcgttccgacttcgtagtcgttagagagtggctgggcatcacacagagggaccttggaagccggccttctgcgtcgcgtctgcttttccaagaccctctcctgtcattgactgtttccttagatctcgacgagtgcagggggtcttatgtgatgcccttctaattgtcaaagtcgttgagaatgcggttatggcatatgtcgtcggagtacagcccgcatcgcgcgctatgatcgcttgacgcctcgtcgtatcgccgagcttggatgcccctcggacatcttgcggccgcctgcttgagcgccttgtctgtgcctcatgcccttggcgtgccaagcatcgtagtacccgcgccaacattgcaagagggcggggagaaaagacggggagagatggaaaaagccgggagaaggaagagcggagaagaagagagagaggaaagggaggggaatgaaaagaaaggaagaaagagaaagggggagaggaatcccgaagcgcttctttcgtcccctcgagtcgagttgcctctgaattgaggaggttctttcagcctccttgttgcctttatggggcgctctctgcgaccatgatggatgatctgcagtcttggtctgcgggccgcagtaggcggcgagcttgctgtcctcttagggaagagcgaggttgggcgagcgccgagtgctttgaggccctatgccccagatgttagcaggcagagcgtaggtcttatcggccctggagcggcggcccagcttggagaaggctttgccctccgaatcggccgcaggatccccctgcaaggctgcttgccctgtcctttgcaatcgggatggaagggcgaggaggggacgagcgttggacagcttccagaaggcatcccttgccatgtacaggtaacgacgccaatgcctcgcgcaccggcagttagccgcctcctgcctgctgcggccatccctgtttcccctggtcgtattcggccatcgccggctagctgccatgcgctcgagagctcaacctgcgggctcgaatgccggtcggactttaagaaggcaaccgcattggcctgttgcgggccgggtacgcctcgtggcatatgatagctgaggaccagcggagacgcaggtgctgaggtcgtcgggtctcgggcctatggccctggatggccgtcctgctgcctatccctgcctgcgctatggtctcggcgtctgttctggcactcacttggcagtccccggagaacatccccggcgtacttcaatcgccttccccggaaggtatccgacatcgatccttttcgcgcacccctgtacacataacgcgagccgatgtttggttcttcctggtccaacaattgaccagggcgcccgattccgctcgtcgagcagagccctgtcgaatgtttctcctggacctgtcctcgccgagcggatcgcgatgtcgccacccggtttcatcagcccactgcctgaaatggccgtcccccacatctatgcagagatagaagcgctgctgcccgaaaccattctttgctggcttgcctccacatgaggtggtacttatccttactgtccccgtttctaggggcaacatccacatacctgctatcgttgccggaatacctatcagccgttcacggacagaccaccatcccttagcaagcacccccccgcggcttcgcaagaggcagtgggtacacggctgtcgggaaaaaaaggttagccagccaagtcatcccctttctcggccatcacaaggttagggaatcccgcaggcactggatgcatccattgtcgaaaaaaccccaaagctcgagaagtccccaagggcgctctccactgtaatgggatagagaagaccgtcctgcacactcgagtctttcctccgccctttgcaaacctcttcatgtgcatcttctgcaggcaggcgcttagccggctcccagagtcgcttggtctgtcttggggcctcttgcagtgtatggggcaggacaaatgtaaggatagcggctcctgcacgtgctggatgagcatccttccctgcctttcccgcatgccggccgcaaaaagccgtgtggtcggtcctctccaacacgttatggacattgatcatcgtttccctagggcttgtacaggtgccatggatcagaacttctgctccaggtgctgattgaggaacttgatcatgcgagggatcccgtcgaggtcgtaggaggtcatctggtagacccagtttagccagttgcggtagagcaggttggcatgggcgcgccaggtgaatctgggctcgtagtgtgggtcgtccccggggaagtagttgaccggaagcttgatcggcttgcctgccgtcttgtcgcgccagtactcctcagcgagtgtcgtgcgcccatactcaaagtgtccggtgaggtagatctcgtggaagtcccgggtagcgatgatagccgggccgctcgtgatgccctctgaaagcacctgcagttccgggtgttccctgagttttgactcatcgagcatcgcatggcgggagtgcggcatgtagtgcacgtcgtcaaacccgttcgtgaggaagtcgtactcatcgcagagccgctgcgggaagatcccgaagagcttctcaggcagttcgatcttggggatcccatagctcgcatagagctttgccatcgcgccccagcacagatacatcgtggagagcacgtgttcatctgcccatgccatgatctctttgagctcgttccagtagtctacctgttcaaactcgagctgttccaccggggcacccgtgatgatcagcccatcatagtcattgttctgataggtgtcgagggtctcatagaacttgacgaggtggtctttcgagacgtggcgcgcctcatgggtggaaacgcgcatgaagtcacagtccacctgcagcggggacttcgagatcaggcgcagaatctgggtctcggtctcgatcttgttgggcatcagattgagcaggacaatatgcaacgggcggatctgctgttcgtttgccgcctcctcctcaagcgcgaagatatgttccctgtgtaggatctttttggcggggaggtcgtcggggatattgataggcatgtggtggaaacctctttcgaaacgtaggaataccagatgaggacagtgttcgctacatccggaaggtgaatgtctccaacaggttgctcatgatcgctccgtcaaacatagtgtgataaaccacctcagaataccatgcttctggtgaagctatggtctgtcgtagtcctttagaaatagggaaacggcagcctgtatagcatcgtgccaatcctattgcagttcccgaaaggagaagatcccgttctcatagatcccgaagctgtgggtcccgtctttggggataccgatggagccgggattgaagcagcggatcatggggtaacggtcggccatcatgttgaccttcttgtgggtgtgaccgtagaccaatgcggcccccttcgggagggttggcatgtgatcgatcgagttgtggatgccggcgccccagacatgcccgtgggtcaggaagagctctatacccttggtgtgggtcgcttcgttgtccgcatcggggtcccacagtacgttgtagtcatccatacaggggaagttcagaaccatctggtcgacctctgcctcgcagttgcccctgaccgcgatgacctgatcggcgatggagttgagctgtgcgatcacctgtttgggggcatagtcctgcggtacttcgttcctcggtccgtggtagagcagatcgcccaaaagaatcacgcggtccggctgtacctcatcgagggcatccatgaacttctcacaccaggaagcggcgccgtgaatgtccgatccaatcaccaatttcatgagaaaccttctctctttttgacttcatagcataacaatagtgcaattcaaaaaaatatatctataaaaccgcagttaaaaagcatgatatacggaatatgaaaaaatctattgttttgagacttagataatgtatagagatgagcacaatcggttatcatatctaatgtaaagcaaggcggaagctcgtatagaagatacgagcccgcgtcaaaagaaaggaacttcaccatgggaaagattctaggaatcgaccttggcactacgaactcggccatggccgtccttgagggcggagaacccacgattattgttaatgctgagggagatcgtacgactccttctgttgtaggtttccgttctggtggagaccgtattgtcggtaaggcagcaaagaaccaggctgtcaccaacccgaagagcacggtgttctctattaagcggttcatgggtcgtaagtatgatgaggtcggctctgagctgaagactgtcccgtacaccgtcaaaagcggtaccggtggccgtgcagttgtagagatcaacggggaggattacacccctgagcagatctccgcgatgattctgtcaaagatgaaaaacgacgcagagaaatatctgggcgagccggttaccgatgctgtcatcaccgtcccggcatacttcaacgactctcagcgtcaggcaacgaaggatgcaggcaagatcgcaggcttgaacgtcaagcgtatcgtcaacgagccgacggcagcagctttggcttacggcctggacaagaagaacatcgaccagaaagtcttggtcttcgacctgggcggtggcaccttcgatgtgtctctgcttgatcttgcagacggcgttgtcgaggtgttggctaccaacggcgataaccatctgggtggcgacgattgggaccagcgcattatcgattggcttgcggacaaattccagaaggacaacggtatcgacctgcgcaaggatccgatggccctgcagcgtctgaaggaggctgctgagaacgcgaagaaggagctctcctccgcgcagcaggctcagatcaacttgccgttcatcaccgctgacgcctccggcccgaagcacttggactacacgttgacccgtgcagagtttgagcgcatcacccgtgatctgcttgaccgctgcagaggtcctgtgaccaaggcgctgcacgatgcaaaccttcagatctctcaggtcaatgaggttatcctggtcggcggctcttcacgcatgccagcagtccagcagctcgtgaaggaaatgaccggcaagcagccgaacatgtccgtgaacccggatgaggttgtcgcagacggtgcagctgtgcagggcggcgttttgaccggcgatgtatctggcatcctgctgctcgatgtcactccgctttccttgggtgtcgagaccatgggcggcgtgatgaccaagatgatcgatcgtaataccaccattcctacctctaagactgaggtgtactccaccgctgcggacaaccagacttccgttgagatcaacgtcctgcagggtgagcgtgagatggcaagggataacaagagccttggcaagttccagctcaccggtattcctctggcaccgcgtggtgtccctcagattgaagtgacgttcgatatcgatgcaaacggtatcgtcaaagtcaccgcaaaggataagggtaccggtaagtcccagcagatcacgatctccggctccaccgcgctgtctgatgacgaggtcgaccgcatggtcaaggatgctgagacccacgaagaggaagacaagaagcacaaggacgagatcgagatccgcaaccagactgactctttggcctacagcaccgagcagaccctgaaggatctgggcgacaaggttcctgccgatatgaagaagcaggctgaggacaccgtcgctgaggctaagaagtccttgggcggcaacgatatcaacgcaatcaaggcagctggcgacaaactgcaggaggttggccacaagctcgcagagatcgtctactcgcagaccaatgctcaggccacaccgggccagaacgctaacaccaaccaaggtgctcagtcaggccaggcgaactcggatgacaacgtggtcgatgccgactatgaggtcgtcgacgacgacaagaaggacaacaagaagtccgagtaagctgtgtgagcgaatatgaaggggcggcggctctgtagccgccgcaccttttagtctgaaggagggagacgtgaaggtgccaatcgataaggacgaggaaaaacctcaagatcaaagctctgatgccacccctgaagatacgcaggaacataaggatcagagtactgaaagcaacaacgatacggcagataccaaggcagccgacaacagagaggacatatccgaagaggatatgatccaggcagccatcaaggctggcgaacaggccgctgccgatgatctgaagaaagatgccgacaaagcggcttctgagcgtgatggtctggcgaagaagctgagcgatgccgaggatgagctcaagaaggcccaggaggcccagaaagcggcggaggacaagttcatccgcctgcaggctgagtggcagaacttccgcaagcgcgctaatcaggagcgcgcggatgaacgttcgcgcgccaatgagcgcctgatcgggaaactgttgccggtcctcgacgatatggagcgtgcaattcagcacgcgaagaactcagctgataaggatcagaatttgactcagtttgccgaaggcattgaagcggttcatacgaagttgctcgggattttaggcggcgaaggcgtcgaggtcattgaccccgctggcgagcctttcgatccccttttgcatcaagcagtgggccgcgaggagaacacggatgtctatgaggacactgtggctcaggtgtatcagaagggctaccggatgggcgacaagatcattcgctcggcgatggtgacggtcacctatggtggtaagaaacggtcccaagagaagaaagacaacgacaaggtcgacaaagatacggctgaggacacaaaagactgatacagcaaactgctttttgcccgagccgtgctgaggttcgggcaaaatttataaaaagggggcgaaagctttatggctaacaaacgtaatttctatgatgtgctgggcgtaaagcagaacgctacccaggacgaaatccagaaggccttcagaaagctcgcagtcaaataccatcccgacaacggtggggatgagcagaagttcaaggaactctctgaggcctacgaaacactccacgatcctgacaagcgccgtgagtacgaccagatgctgatgttcggcggcattccgggctctgacttcggtggctccggcggccgcaaccgtacctatacctacaccaccaacggcgtaggcgtggactggaacgatatcttcaacaacatccgctccggcgacggcgcattcaacgggtttgacttctcctccatctttggaggccccggtggcgcaacgcgcacccgtcagccccgcccacagaaaggtggcgatctcacagcttcgattgaggtgcctttcatggatgcgctcaacggcgcgacgcgaaaggtcacctatacaatcccctcgacgggggagcgtcagacgatcaccgtcaagatcccggccggcgcggtggatggtggaaagctccgctaccgcggacgcggggattacggctatgccggcggtgagcgcggcgacttcgtgatcaccacccgggtcgcggaccatccgctctttaagcgtgatggtgcggatatccgcatgaagttgccggtgagcttttatgaagcagcgctcggcgctacggtaggtgtaccgacaccacagggcgagacggtacggctgaagatccctgccggctcacaggatggtaaaacctttagattccgtaatttaggagcgcccgatgtgcggcacaaaggcgccaaaggagccctgtatgtgacgatccatatcgcggtgccgtcgcatctgacgatgaaagagcgtgaagtgctcgaggcactcaaaaaagcggatacccgtgattatagaaaggatgtagagcggtatggcacagagtgacacagataagaacaaaccgctctatatgatcagtgtggcggcggaattgacgggcatgcacccgcagacgctgcgggtctacgaacagaaagggcttgtgagccccggacgttcgcgtggcaacacacggctgtattcacgcgccgatatcgaacgactcaacctgattgccaagctgaccgatgaaggcatcaatttggcaggtgtgatccgcatccttgatatgcgcgagacggcggagaagcgcaataaggagatcgacgagcttcggcagcgggttcgtgagctcgaggaggaagtacatgagctcaagacccgcgagaagatcaccgcgctcacgccctataagggcgctacggccgagcaggtcatgcgcgggttgctctcctccggggatatcggcgaggacggcgataaaaaatagtgtaggctccattctatacggaacggtttgttgaaaggcagccactgtgaggctgcctttcgtgtaggggcgatccctgcgtatctgtaggctgagtgcctatataataaaaaatctactgcaaatacacttagatatatgtatgagaagaccccatatcgggaacatcctctagtgataagcgaaagaagcgttgggtttgtgcacatagcaaggcccaatgcagagaggtgatggccatgaacataaacaaatgggcggtaacggcccaggaggcgctgcagaatgcactcggtgtcgcaactgatgcgaacgccggggcagtcgagccgatccatctgctcaaggcattgctcgattcaggtgaacataatatctccgcgatcattgagcgggtcggtgtagagccacagacgatccaggggcaagtcgatcaggcgattcagaatgctcccaaggtctccggggatatctcacagatgggtatgagcaacgattttgtgagaatggcaaacgatgcagagcgcatcgcgtccaagatggacgaccagtatgtgacttctgagcacttgttgatcgcactggctgatgacaagtctgaggccggttcgattctgaaggcaagcggactcacgtcgaggcgtatccgcgaagcctatgaggagctgagaggtgacgacagagttacgtctcaggaccagaagcctgaatttgaggcgcttgagcgctacggccgcaatgtgacggatcttgcccgtcagggcaagctcgatcctgtgatcggccgtgtggaggagattcgtcgtacgatccaggtgctttcacgccgtaccaagaacaacccggtgctgatcggtgagcctggcgtcggcaagaccgcaatcgtcgaaggcttagctgagcgtattgtgaacggcgatgtgccgacaaccctgagggacaaagagctgatcgagcttgatatgtcctcactggtcgcaggcgcaaagtaccggggcgaatttgaggatcgtctgaagtctgtcctgaaggagattgagaagtcaaacggcaaagtcatcctctttatcgatgagctgcacacgattgtgggcgcaggcgcggttgaaggctctatggatgcgggcaacatcctgaagccggcgctggcacgcggtacgttgcacgcgatcggcgcgacgacgctcaacgagtaccacaagtacatcgagaaggaccaggcactggcccgtcgtttccagcccgtgatggttggcgagccttccgtcgaggagaccatttcaatcctgcgtggcatcaaggataagtacgagcagcaccaccgtgtccgtatcacggacagtgcgctggtgagtgctgcggatctgtccaatcgctacatctccgaccggttcctgccagataaggcgatcgacctggtggatgaggcagcgtcacggcttcgtatggagcttgattccatgccggcggatatcgatgcggtcgaccgtcagctgacgcagatgcagatcgaggagcaggcgctgatgaaggaggacgacgaggcctccaaggagcgtctggagaaactgcgcaagaacatcgcgacgactcaggagaagctggatggtatgaaagccaactggcagaatgagaagtccgcaattgaccacgcgcaggatgtcaagagcaagatcgaagatgcgaagaccgagatggagaaagtgacccgtgagggcgacctaacccgcgcctctgagctcagatactccacgattccgcagctgcagaaagagtatcagaaagctgaggatgccttgtcagcgaagcacgctgaggatggtgggctcctgaaggaggaagtcacctctgaggagatcgctgaggtcgtctctgcatggactggcattccgatctccaagatgatgcagggcgaaatggacaagctgcgcaaccttgaggcgaacctgcacaagcgggttgtcggccaggacgaggcagtccatgcagtcgcaaatgcggtcagaagaagccgtgcagggctctccgatgagaaccgtcccatcggcagtttcttcttcctcggtccgaccggcgtcggcaagaccgagcttgcaaaggccttggcggagtgcctgttcgacgatgagaaagcgctgatccgcatcgatatgtctgaatacatggagaagttttcagtccagcgtctgatcggcgcaccgcctggatatgtgggctacgatgagggcggccaactgaccgaagcggtacgccgtcgtccgtactccgtgatcctgctcgatgagatggagaaggcacatcctgatgtcttcaacatcctgctgcaggtgcttgacgatgggcgcctgaccgatggccagggccgtgtcgtgagctttaagaacacgatcatcattatgacctccaacgtcggcagccagtacatcgcaggtgccaacacgaagagctgctcgatagcagcggttcagatgacaccggccatgagcagtgcctgagtagcgaaccagaagactgttctcggtggaaggggaaatcgaacctgttgaagaggtcaggtcgaattaaagtgaccttgcgacgtaggtatagtcctgcgaggcactgaacaaggctcgccatggtctgaacacgcgtgaagacaatgtcggcgaaagcgtttcgagatcgaagtcaccacactttggaagtcatggcaaagatgtagttagatgacagcaccgcaacaccactgctccagattatcagggagcgcgcgtgaagaagagcgaaaatggtgcgcttgatcttattgcccttggagccgcttgtttatgggtttccatggatatctcctagctctgagacaaagttccctctcatatggggcggtgtaattttcgcggagcgaaggcaggcagtgcccatctcctaccgcggagggattgcagccgggagcggcaatgcagggacgaagaagagacgctgttgtgtcaggtggaggaaatctccgagaacgcgactcgcctacgctgaacgcagggcaggcacgaaaaaacaaggggccaagagtgcattgctatcaggggggaagcgacattttgactcagctgatatcacgccgccgcgaagcttcagggtccatctcgctggcgatccgcccatccgaaattagcagcgacggaggggagcctgcaacttcgcagacgccccttcttctctatttctgaatggcagagctacgtccaggatcggctcgaagagacggcttgccttggccttctgtcagaccacgggtcgtatccgtcgtcgtcctcgttctcgggagggcgaaggcggatcgaaaccagcttcttctgcctgttccttcttcagatcctcttcttgctatcgtctggcttcttcatggctactttgccccagatacgtatctgtgcatactgtgcgatcgcttcaggtctccgactgtgccgaatcggcatccttcggagcgcaggtcaggactgcctggatggtcgaagagcccgactcctgaagagcagcacggtccagatgagagtctccctggctgccagcactgcagatataggaagtgcggatgtggtcttcgtgctcgagctgtccttcgagcatccgtagagccatcgagttcgtattcgtgcttgtggacgtgctcgaagaggagctcgagggttcgccgtttggctctgcgacgacgtgctggaagatgtgctgctgcacattcgcgaatgtcgaggaaagagctgctgcgatacggggcgccttcgtgaaaaggccgcgaacgacatggccgcgaccactccgtcaccgtcaatgccgtgcacgatcggaggcggaaccgtgagctctgcacgcccgaaattggcgccagaggcaagcacatcgtccgtcgccatgacgtcgtgcctttgcatgaggcgtcggcgtgaacaggcaatggtaggtgcatatccttcgtataggtgcaggttggctacattgtagaagacgcgcatagacgagcgcatagagctgcgattgaacttggcaaatgtcttgcggggtggcagagaagtagtctgcgatatggtctgcatcggtgagagacgagcttttctcttccttcttctcgttcgcgacacgcacggtcacgacgtgcccgaagagaccgggttccggcggcaggatcggtcgaatccacggtgccgccgtacggtctgcatccacctagacgaccttgccacaaggccgctctgggagagcgtgtacacagcgcgtctttgtcatgctatgacgtcaggcacttcatagccctgggcaaccgtgagcgtcacggtatcgcctgaagagattgtggtacccacatcaggatcaacagctaggaccgtgccagcatcggagtctgagcttggtacacacagtgaatcgtggctgaccgatctcggagagtgcggcagatgcatcctccttcgtcttgccgatgatgtcggggatggtgcgggccttgcccactcaagagagtcgtggcccttgcttgccgctctcctgctttggttccctgcgagagcaccttgccggcatctgtatccacatactgtgagccgacgtctgccacaaagcggcctcccgattttggaccgctacatcttctgtaagtccctggacatcagggacgctcacgcctccccaccacggaacatgtagcgatgaggccaatggcaagaacggcagccacggcgcagattgcgatagcggtcgtgcggcggcgcttgggtgtggagccgtgctctgtgccatctcctcttctggcttctcctgatctgcaggagcctccgcgccctcttctcctgcaggccctcctcggagggcagctcttctggtgccggctcaggcgctgccgccatatcgagtggcaccgcgaccggcgcgaccgtgtgagcgggatcggaatcgatgctctcgtctatgcgctaaggcccaaggaaggactgtgtcctcttcctcattctcgaaagacagcctcggtagccttctccttgatataggtttcgaagtccaccgcattgtgggcccctcttcgaccttggctgtttctgccatgcgttcagggacacgcgggccgtcgcttcaggtgcatgggtgtcgtagggaccgtggcatcccaccgcccccaaggctgggtctgtcctgggaacgtgcttcggcggccttcctcactgcctcatcgatctggctgcagcaacgtcgctgcagcatcctttgcttccacgcatgcaccttcggcgccttggcaccaggcttcaaggatagccgcactgcgtgcagaagcgggctgtatccaagacttgctccgcaattcgggcacttcataatcggcaagtccttatcttatgggcagcatgcgttgcccgaaacattccgaatgaaatgatacgccagcgccagtccggcatatatccgcatacgcaaagaggcctcctgcaccattgctggcacgagaggccttcatatcaggcagctggcttatcagctgctatgcgcaattactcgacgtcgtcaggctcgagcggtcgtttggagctttccaggaggaacctgcctccgctccttcttccgggcctcggaagcggcatcgtcgcgctctgcatagagctgtcgttctgcccccacatcgaccttcacgacatcgccctcgtggagcttgccgtcgatgatgaggttggcgacattgtccacgacctggcgctggatcagacgcttcagaggacgtgcaccgaagaccggatccagtccatcgagagccaaggactgctttgcggggtccgtgagctcgagcacgatgcggtcacgctcgagacgcttgcggacgtccttgagcggatatcgacaatcttctcgatgtcttcgagtccagcggatggaagacacgacgtcgtcgaacggttcaggaactcgggcttgaacgtctggcgcagggattgttgactggcgctggacctctgccgggtcgctcgatgcattggcaccggcgattgtatggctgcccacgttcgatgtcatgatgatgatcgtttcttgaagctcacgaccctgccctggccatcgtgaggcggcatcgtccagcacctggagcaggatgttgaagacatggatgtgccttctccatctctcgagaaggatcacgcagtaggatgcggccgacgcttctgtagctggccccttcgtcgtagcccacatatccaggaggagcaccgataagacgctggaccgagaacttctccatgtatcggacatatcgatacgagccagtgcttctcatcggcgaagaggccatcagccagagcctttgcaagctccgtcttgccgacaccggtaggggccgaggaagaagaagctgccgataggacggtcaggatccgagagtcccgcacggctgcgcctgacagcggtgcgacggcacgcacggcctctcctgccccacgacacgcttgtggagtcggtctcgaggctcctgagcttgtccatctcgccctgcatcatcttggacacaggaatgcggtccagctcgaaacgacctctgcgatctcttccgaggtacctcctcttgaggagccctccctcttcctgcttggcattgagcgccttctctgcagcgtcatactgctgaggggccgggatcgtggcatgcggagctggaggccgggccaggttgcccttcgcgggtgacgcgccatctcggtcttcgcgtcctcgatctggctcttcaggtcctgcaccttgtcgatggcagacttctcgttctgccagttcgccttcatgccatcaagcttctcctgggtctggggaatctccttgcggagcgtcttcaggcgttccttcgaagcatcgtctcctccttcatgagagctgctcttcgatctgcatctgtgagctggcgatctatgcatcgatatcggcaggcatggaatcgagtccatgcggacgctcgatgctgcctcatcgacgaggtcgatggccttgtccggcaggaacctgtcggagatgtagcggttcgaaagatcggcggccgcaacaagcgccg

SEQ ID NO: 320 - DNA, 22619 bp, Unknown
  Metagenome-assembled genome
ccagaacgcacgagaacggcgggccctcgactgcttctgtcacgtcgggccgttcggcctcaatgccgccggtgacgccacctacgtccgcggtgtcgatatctccgatatcacccttgagctggcacagaacaaggtgcggctcaacaaagagaatggtcccgtcgatccgaaaacacccatcgactttacctgcgctgatacggtagatcatctccccaagcatgcgcacgaccgcgatttcccccgtgctgagagtggcccgtttgatctgatctcccttgatcctccggcgttcaccaagagcaaagggtccctcaaccatgccaagaagggctatgaggagatcgatgaggcggcagtgcacctgcttccctgcggcgggtatctcgccacctgcagttgctcccactttacgacccaggagctgctctcagaggctatccagaccgctgcgcaccatatgaatgtgcggctgcgccagattgagctgcgccagcaggcccccaaccaccctattggttgggggattcctgagatccgctatctggactttctcctgttgcaggtggtgtggcctgtttggtctgtgctttccgctgcgctcggcgctcacggaagaagtctttcaggacctgtgcgcagggcccttccagaacgccgcttgtaacttcaaactcatggttcagctgggggtcgtgagacacatcgtagcgcgatcctaaggcaccacctttcgggtctttggccccataaacacagcggtcgatcctggaattgatcatcaagcctgcgcacatgaggcagggctcaagtgtgacatagacggtgcagccagtgaggcgccagcggttcaacacatgcgatgcctcaatcatcgctttgaattccgcatgggcggacggatcgcgctcgtattcgcggcggttgtagccccgggcgataatgatcctattgtagactaccaccgcaccgatcggcacttccccctcaaaggaagcgatctcagcctcgatgagggcttcctgcatataccgctcatctaaaagatcttgatcctccatgcaaacctttctgagacaaacatctaacacagctgcacaggcctgcctgcgttgagcgaataatcctagggtaaaaatacttgactccaccaaagatgatacgctggaatctatgaaacgtatcacatatcgtgccccgcgtcggcacagctgaaagggtaggcctataccatgatcagaaccatctgcctcaatccggcgcttgataagacagccctggttgcagggtttcacgtcaatcaggtaaaccgtattgtaagctcacgtaaggacgccggcggcaaaggtatcaatgtttcaaaggcggtcgccaaattaggcggaaatacgtgcgcctacgccctgctgggcggcaatgttggcacctatattcaggacgcagttatcaatctcggtatcagctgcatctcagtccccatcgaagaggagacccgcaccgacctcaagcttatcgatacccaaacaggaacccataccgatatcaatgagcggggaccgctcgtaagctcacaggaactcctgaatctgctgcagcgactgatcaacgatatcaggcagggagacatcgtggtactctccggcagcctgccgcgaggtatttcctcagacacctatgcctcgtggatcagggcgagtaaaaaggccggagcaagcgtcttcctcgataccaatggacgggctttggtagcaggcatcgatgcctctcccacactgatcaagccaaatctgcatgagctgtctgaactggtcgggcaggagatcacctctcaggaaggcgccatacaagctgcccaggatctcctccgttccggtatcaaagaagtcgtgatctcgaggggcgccgatggggctatctttgttacgcaggacaaagtgctggtggcccgtgcgcctcgggtgccggtcggctccaccgcgggcgcaggagacgcactcctcggggccatcgcctatgcctgggagcacttctacagctttgaggacaccgcggttctcgctatcgcctccggctctgccaacgttatgcaatcaggctcacagagcgcagagcgctcggtcatcgaatcgctgctccccaaggtcaaacttgaacgcccatagcagaaccgatcagtgaagcttctgtacatgtacgatccttgcccgtaccgcattggctgcgtataccttctgcttttttacacaggaatcagaaaccttttggtgttgtactgagtttgagtgtgctgttgacaagcccaatcggaggtacttcgtctttgggaaacccgtgagatataggttggcaatagtctaaaagataaatttgaggtatagttatattctgctagtcggaggggtgacagagtggctgaatgtaacggtcttgaaaaccgtcagacggctgagccgtctcgagggttcaaatccctccccctccgccacattccttctttatttcaaatccgcatcaaagcttttatgcaacggaggggaaatatatggccactgttatgatcatcattgttatcatcgctgcgctcattatttggttcatcgcactgagaaatggcataatcgagaaaaacaatcagtgtgacaatgctctgcagaccatcgatgcgcagcttcagcgccggtttgacctcattcctaaccttgtggagaccgtcaaaggctacgccaaacacgagagccaaacgctcgaagcagtcaccgcagctcgcgcagaggcaacgtcggcaaccgacacgtcaggacggctggcagcagactcccatctgacccatgcgctgcgtcagctctttgcggtgtcagagcgttaccccaacctcaaggcggacaagaacttccaacagcttcagacagagctgcgcaatactgaggaccgcatctcctatgcccgccagagcttcaatgactgcgtcctcaactacaacaacgcgatccaaacgttcccgggcaatattgttgcaggcgccacctttaagaagcgtgagggcttcgccgtagaggacggtgaggcgcgccaggcaccaaaagtgcagttctaatactccgcgcgttctcagacagagatagtaagagcgagtctcccgctcccctcatggggaacgggagactctttttgtaccgtaatcggcggtgagccggtactgtccagtcagccgaggagggcgaagccgatgcggttttctatcgtccgcacagctcggccaagtcctttacgatgcgctagcgcgcgtgcttcgcctgtttggcattgctgtgcgcaggatgtgtcttgcgataatgctgccagatctttaccgtcccaatcgtgaggatgaatgcatcgagggtgccgataacgataccaaagatcggcaatcctgtgtgtttgatcggacgcaccaactgctgctcaggatttgcctggttgtacagcaggttctccgatctagcattgagccaggtatagaggatatctttggtggcgccccgcagatcgttctggaaggtgttggatgtcgtgccatagaaaaaggcaccgttgcgcatgataccgtccatatagagatccccgccggcgcgcagcatttgatcaggattcatataggtatgatggtccgcgtaatcggtgatcaccgagccgcggaacccccactcatcgcgcaacacatcacgcaagagtgctggggaaccgccagcccagaccgcgccgatacggttatatgagctcatcatgcccgtagcaccgccctcttctaccagaagctggaagggcttgaggtagatctcacgcagcgcctgctccgtcagccacgtgtacataccgtcacggttcgtatcctgatcgttcaggatcatatgcttcacgaagcagtaggtaccggtctctttgatgccctggacttcctgcacgcagagatcgccggtcagcagcgggtcctcagaaaagtactcgtagttcctaccgccgaagggagagcggtggatattggccgagggggcatagataccgtcaacaccgagatcggctgcctcctgacccagcgcctgcccgatctggtgggcaagatcggtattccaggtctgcgcgaggagggcatcgtcggcgaaaccgacgccgtggcggggttggttgaaggaccccacctgagaggggccgtcgacttccttgctctgcggcttgccgatgcttctgatatcggtagtgttggagtaaccgtgcaggaccaggtcctcctgctcctgtgtcgtcatctggttaagcagtccatcccactggggatcgttgtagttcataccaagggcatagccgagattggtgatcgatccgtcgtctccgagcatctgattgccggactgtccagtcttcacactgggtccagtagggtcaatggtagcttcagcctgctgtctgctgtagagattgagcgcctggatgttctctgtcatcgcccggttatccgcccgctcatgcgggaaggtgcccgcaaaatccgcgcggtcaagccaggtgatattcccatcggaattgctgccgtcgatcgatactccatccacagcacccgagccggtgaagcggttggtaaccgtggcaccggttgccggatccgtatccagctcgatggtgcgcgggatattcagtgtcagcgatccatcctcgatatccgctggagtgtgcgcgtcatggcgaagctgcaccgtataggctccgccgtccagctcgtagccggagaacccgtcatggttcgcgtcatagcaatcataggaggccatgtccctgcctgtgacggtcagggtcacgtcctggctctgcccaggggcaagcatatcggtcttggcaaacgcccctaacacccaagcgggtttttggatctcccccggtttgtacggaggtgagaaatagagttctacgacctctttcccggacaccgatccagtattggttacccgcacggtatagctgatctgcgtattctcgtcgatccaattgccggtttggggatagcggtcgatgacctgccaatcaaaggtggtataggagagcccatagccaaaagggtactgcacgaccccctgatagccggttccgtactcgttggagacatcgtcccaatagccttctgcatccgcagtctcataccagcggtatccgacgtagataccctcctggtaatcgtagtagctcaccccatcgtagtgggcgatggtgccgacgttaccgttgagcgtaccgtctgcgggatagtagccctgtccattggtataggtcccgtgtccccagctgccactgttgacatagctgggatcagttttgaagtcataggggtaggtatccgcagtcctacctgaagggctcgcatcgccccacagcaactgggggatcgcattggcgccggtggtacccgttgtccctacgagcagacaggcgtcgatgccgggaattgtattgaggggaccgagctccatcgggttggtggagtttaccagcacaaccactttgtcgaagtgcgtccccacatacgtgagcaggtcaagttcctgcgtcgagagctcaagatagtttctgttagggtctcgcgtcacggtaccggtattggagagtttgctctgcgtaccgggggcatcgatactctcaccgccgacgcggctgataacaacgagggcggcatcggaatagttctgggcgtcatccagaatcttctgggtataccaagcccggttttggattgaaggttccaccagccggcagtagtcatccgcaaatgagttgagcgagccctgcgaggagcgggggcggctttcgctgtaacgctggtacatatcgctcagttcggtgttgtaggagaccccataattgaccagcgcatcgaggatgccgaccgagtttcccgccacgccgcctgagcctgagccacttgcaacccattgcgttgagctccacccgaagacgttcaccttatcagtgtttttggaaaacggaagtgtctgattgtcgtttttaaccaggacggtgccttcagcctgctcctgtgtagccaagcgcctgtcgcttgcgatccgtgcatcatagtcggcctggcctacatccacatgatccatcgaaacccatgaattgagcgtcttcccgaattgggccactgcgatgttggcggcgacagtgaggccgataaagacgataccgagaacacggcgacgtacggttttggcaggtgtcagcgattttttcggcacaagaatccctttttcagtgcatcattccaaaaaggccatcataggctatctgctggccttcttgtactccttcttaaacgactcgaacattgagcccattttaccaatttgcttcccgacagcgcgcgcagcctgtgcactcacatcttgctgttccgtagccttctttctggccggttttccgctcacctcgtcaaactccttcttggattcctccatcgcctgcttggtttctaagatacggtgccccagcttataggcgcctttatccatggctttctgcgtctttttcccggcttcctttcctttgattttggccttggcatagttctcgccggccttggcggcaaggccgccgtccaattcgaggtgtgcagcctccggagcaacaaccatgtagcccttgtgataccccttgagcattgagactgggatctcaatggcaccgacaagcttgcgggagaggctgtcatcaccgacgaagaactttgagaccttaccggtttccgggtcgtattccgcatcgtcaatgtagccgagctccttgccatcagtggtcttcgcatccataccggtacagatcagacagtggtcccagtcgatatggaggcgttcacgggctttgttatcaaagctctcgtccccccgggtagggacaatccccttctcatccactactgtaaaggagtcgtaggcgataaagacatcagggcgtttcaccatgcctgcaatatcggggcgtgagatcgtaaagcccaccacacgcttgccggacggggagaacacagtcatatggatacggccgagacgggtctcctttgttttcccatggcgatctttcttttcggtatagaccggcatcctatacatctttcctatacgcagcacggcgcccccatcctttccgtataaacaacaaggcgcaactgatacgctgcgccttgttgtttcaactcactgttgtagacaaaatctactcggcctctgaggtatccccagcgtctttgttgtcctcaacgtcgacgtgcacggagccgctgctgggctcagctgccgacttatcagtgcctgcgacggcgtttacagtgtcggcgacgtctgaagccgcatttgcaacggtatcggaagtcgccgccacggcatcattcagggagtcacggagctggtccatgcgctcacgggcaaggtcaatctttgcgcggagctcatcggtgcgtgcatccacctgaggacggaaatcattgatctttgtgttaacgacacgggaaccgcgctcataggagtcaaccgcattatcccaggcatcattcatggcatctgctgccatcgcacgactctcggcgccagaacgtggagcaagcaacatccccgcaatggcacctaccgcagcgccaaacatgccgcccaaaacaaatccaagacctgtgcttcccttgctcatatagcgtccttcctttttgtttgcgccgtgcaatgcggctccacttttttgtctgtgaattatacccagtttaccgtatagggtgttcacaaccaagtgcgtaaatcaatccttagcctgatcaaaagatatagtatcagaatcctcagggttcggcgccggttcttctgattcctgcagctgtccgttttcagggtgttccggggtattcccatggtcatcctggtcaacccgctggaccagcgcaagaagtcctgagacgattgcctcgatatccggctcgggctctcctccaccgtcaaacgcccactgcagggtccaggcggcgcttgagagtgctcccacacagagcacgtcgtcggggcagtcaagctgcacgatataggtccgctgcgcgctgtcgtccgcccgggtcctgccataggagatgtcaggccccaggtttgtgcgggccatcagctcaaccgtcacatgctcaagcaggtgcgccacatcagtggcgcccatcacatcgcgaaaggtcttgccgccgtcaccgacacagacgtggttggcgatctggggcatcaggcgccagatccgcgtagtcgcctcaagatcctcgtccgtcatcactggatacccatcgccgatgtggatgcgggcagtcagatactggggtcccacactgatttttttaaattcgatcatctgtgccatagccgttaacgctcatttctatcgatcgtccgctttggagttgttgctgttctccgacgactcgtctttggtattcttcttgtcctcttctatatcagaggctttctcctcatccttcttctgaccaaaatcctcgtccgcctcctcaggctcaggaggttcgggtgcggtcacacgcaaaagcgcgatacgtcttccgcgcattgactgcactttgaagatatagccatccttagtatacacatcacccggagacggcagttggtctgccagatccaggataaagcctgctacggtctcatattcctcgttgtctggaatcggccagccaaggtctaccgcgtcgtcaaccgagaagcgaccgtccacgagccattcacggtcattgagctgggtgaggtacttgttgtccgggtcaaactcatcctcgatctcgcccacaacctcctcgacgatatcctcgatcgtaattacgccggcagtgccgccgtactcatcgacgacgatcaccatctggtcgtggctcgactgcatctcctggagcagggggataatatccttggtatccgggacaaagtctgcatcacgcatgtagcgggagatcggtgcgccatccctattctcgtcaagtaacggagtgatgatatccttgatgtgagcgataccgacgatgcggtccacatcctcgtggtagatcgggatacgagagtatccggttttccgcataacggtcagcacttcgtcgagcgtggaggtatcctccattgcggtcatatcgacacgcggcaccatcacctcacgcgcgattgcgtcacccagatcgaagatctcgtggatcatcgacttctcttcgtctgaaaggtcatccgcgtcgtgcaccatgtacttgatctcgtcttcggagacgttgttgcgctcctcggggctcttcaccccaaagatgtatcccaacccccgcgcagaagcagaggtcagccagaccaacggtttgacggcgaccgtgaagtgcgccagcggtccggcgacgcttttcgccatgcgctcaggatccgagagcgcgatgctcttcggcaagagctcaccgacaacgatagagaaataggagacgatcagggtgatgatgatcggcgctaagaccgcagccacgccctctgccatcccgagggactccatccagccggcaaacggctcggaaagattggttgccgcgaaggcggagcttgcaaacccaaccagagtgattgcgacctggatcgccgccaacgcctccgtcggatcatcgctgatcttggccgccaaggcagctcgggtgtcaccctcttcggcatcgtgatccaacattacttttttggccgttgagatagccatctcagacatggagaaatacccgtttgcgagcgtgaggacaaacgtaacgattatgctaattgctatgtccatgcgtactagacgcaacctcctgtaggtgaaaaaataaacacagcttattttatcagatgcagatgaaacacgggcggaagcgctggtcttccgcccgtctgtgcgcagtttctatatacccgaaatgcctacttggtttggtctacaaggtcctctatctgagatttaacctgattgagtgcatccttgctcggaatgtagttgtaagacacaggcttcagcggtgtctggaagccaacatcgctcagggcagcctggatctgcttctggccgagcgggacccacccataagaaccgaaggcgaccccgatgcgctgatcattcttgggcgagagcccctgcatgtagttcagcatgccggccacggtcgggagcatgtggctgttgaaggtcggagatcccacgcagatgtacttgaaatccaggaagacatccataatgtcggattcatcgttggccttgaggtccatgagctgaaccgggatacccctctcagagaaggcatccgtgatcgagcgggcaatcttctccgtggagccccacatcgtatcatagagcacgagggccttgtcctgtaccttgcctgaggtgaacacgtcttcataggccttcaggatatcctcaacatgggagcgccagatcacgccgtgtgacggggcgatcatatcgagggcatctgggccaagaccgcggacggccttcacagcgctggccgcctgcatgcggtagggctgcacaatgttggcgtagtacttgcgcgcctgggccatcgcctcgtgggagtccacttcatcgtcgaaacggccggaggtcgcaaagtgctgtccgaaggcatcgttggagaacaggatcttgtcataggcatcataggtgaccatgttgtcaggccaatggaccatcggagtctgcacgaaggtgagggtgcgcttaccgatgttgagcgtgtcgccggtcttgacgccgtggtagcccaggcccccgtagtgagcggtgagcccctttacaccctgcggcgctgaagtgtagatctccacattgggcgccagtgccttgatcgcagggatattgccggagtgatccatctcgacgtgattgctgatcagcacgtcgatcttagaaggatcgattacagacgagatgcgctgcaggaactcatccttgaacgtgatcttcgtggtatcgatcagtgtgaccttctcatccaggatcaggtacgcattgtacgtgatgcccttctcagtcttgaaaccgtggaagctccgagcattccaatcaagggcccctaccccacactgctggtttaatttgttacttcgccacgtcagcatctacattccaagcatccgtgctcttccgttggggtgcgcttacgggttcacatcccgcagggcgtgtcgcgcatgtgccttgagggatatcacattctacattggtagcccaaggagccctttaggagggatttgttctttttttttttttaatttttaatttttgcttataatagtacaatcatcaaggagctccacaactttgcgtgttgtgggctcggcatttgcttttcagtttgccctatcgacttccaggcggctctgcgctcttcgtactgcctcgttgcagcttctctgcctgtaacttcgtgaggtacgtctgctcatatgccttcgatcttcacgtgaactcgccggtaccacgggagagagaacgcaggcgcgtcgcgtaatccacaacttccgcatacggcacggtcgccgcgatggtcgtcatcccctgctgcttgctgtcggcggcttccatgccttcaacttggccacgggacgcggagatgtcacccatgatggagcccgcgtagctttccggcaccgtgatgctcatctttgccatcggctccaggatgaccggctctgcctgctccgctgccttctggaaggcgatgcgcgcagcggtcttgaaggccatctcattggagtccaccgggtgataggagccatcgtagacggcgactttcacgtcgattaccggataaccagccaggacaccttcctgcatggtctcctgaacacctttatcaacggctggaataaagttcttggggatatggccgccagtgacctcgtcgacgaactcatagccctgacctggattcggctcaagcctgagccagcagtccgcgaactgtccggcgccgcccgtctgcttcttgtgtctgccttcggcagaagcgacacggcggatcgtctcacggtacgggatacgcagtttgacggtgtgcgccgtgatgtggacacgatcctcgagacgggcaagcaggaccgagacctgggcttcaccgatcgcggagataaccgtctggttggtctcctcatcgcgctccaccttgagggtcggatctgcggaggcagccttctctaggaaggtgtagagcttgtcctcagtgccacgcttatccggctcaatcgcgatgcgatataacgagttggggaaccggaaggccgcggcctcgactttgcctgtcaccgacagggtgtcacctgccattacgtcgagcttcgggatcacacagatatcgcctgcggagacggatttgatctctctcatctcgtgccccatcatccgatagaggtgtgtcaggcgctcgctcttacgagtgcgtgcgcagaccaacgatgaccccgaggtcagagtaccagctaacactttcacaaagctcagtttgccattctggggatcctgcagcgtcttgaagacaaaggccaccggccgctcgtcatccggggagatgtcaagctgctcgccgttgatcagcgggatacggccgaagtcgctcatcgtcgggaagtagtccgcgatgttgtccatcagcgagataacgccctcctcgcggatgcaagagccggcgaagaccgggacaaagatacgctgaactaacgctttgtgcagcaggctctcaagctcctcctgggtgatcccctcaccgtcgaggtacttcatcatcagatcatcgtccgcttcgacgacaagttcgcagagcgcgtcgcgtgccttagctgcctgctccttgtagtcgtccggaatgggctcctcaaccggctttccgttatcgttgtgccgcgctataccgtggacaatatcgatgatgcccttgaagtcatcgccgacgcccatcgggatcgtgacggcggccaaacggttaccaaagcggaccctcagcagatccatcgtagcatcgaagttcgcctctgcgcggtcaatacggttgacgaagatggcacgggagagggaaaggtcctctgcggcgtaccatagccgtgtggtcacggtctccggaccgcctgctgcgtcaacaacgaagagcgcggcctcacaggcgctcatggatgtataggcgtcaccgataaagtcaggatagcagggagcatcgaggacattgatgcgggcattttcccactcaatgggtgcgatcgcggtcgaaatcgagaatccgcggttttcctcttcgctgtcgtagtcaagcgtgggtttggttccggcgtggccaccgagccgtgtcgttttccctgtcacgtggagcatagcctcagccagcatggtcttacccacgccgccttggcccaccaataccacattcttgaccgttttgctttctgtatctgccatagttggtcctcccgtagtcccaaagaaggacaaggcttccccgcccctcgaacgtatgagatcttttctaccatagccgtaggggctggaaagacgcctcggatatcgggaggcgtagggggccttggggatggacggtcagtcatgggccttcggatagtacgttttccgttcttcactcagtacggaatcatgttcttcatcaatactgtggcagactttgcgggggccccgaaagcgaggctgtgagcgaggatatcgtggttgaccaagcttttggtgccagttgcagatctttcgccaattgtgactcccggaaggatcgtgacgtctcccccaatccagcagttgtccctatcgtaatcggaaacgcacgctcaaagccagagtcccgttctttcggaagcaggggatgccgcgcggtgtaggtacccagatctggcccgataaagcagcgtttgctgatatggatcggcgcgccatccatcaggtaggccccacggttgatgaagctatcgtcgccgatcgtgcagttggacccatagtcgcactcgaagggcgagagtatctcacagcgctcgccgaagctgtctatcagttttttgaaacagggtcagacgacagtcctgattgcgaggttcaatctgattgaactgcgtctgcatggctttttcgcgcagacacaggggttcagggtcgaagagtatgcattgtaccattcaccgatcggaatacgtaccatacctaccccacgatcctttgtccgagcgtcaccgcggcgaggccgacaatgcgatatagatacaggcctcaccccatgatccccgccatagcaggcccgcggcctccaacgcaaaggtggagaaggtagtagatccgccgcagagacccgtctctaagaagagctccatgcgcggacccacggcaccttttaagacccaagcggtggtacagccgaacagagaggagccgatcaggttgatacgcagtgttttgtacggagatcccgattcaagagtgtgcagaatcagcgtaataagatagtggagcatcgcggtcgatgagaaccgcccgctccgacaataagatgcctgaccaccgacaaactttctatgctcacagatagattcagtatgaggtttgaggcccaaatctgcaaagtttctcatctgcagggcaaaactctctccccagtacgattcggtttctccacacgatactgcctgtagacatgaaaaagggccggtacccgaaagcatcggcccttcgattctttgcacttccaatcactcaattgtgatcttggtcgcgttgttctgcttctcagcaatcttcggaacgttgacactcaacacaccatctgcaagtctcgcgctcaaaccctcatttgcagcatccttcagatagacgccacggcttgcatgaagctctgaggtctccttctgcagatagttcttgttcttctcttcgtcggactctttcttgtctaccgtgatggagaggcggccctcattgagctcgacgtcgatatcttccttcttcacacccggaagatgagcggtcacaacgtacttgtcagcggcatcctcaacatccatcttaaaagcgtcactgttatcgatcgtcaggaatggctccatgaagtcatcaaatgcgttgaacggccaaactctacgaagtgccttctcataatcgctgtacggaaccatgctcgccatagttaccaactcctctacgtttacgagattggacgcccttctttcttttggcatcctctggtttcacatatatatgtatcccggcttagtctttatatacatatttttataaaattttctgagtgcttgtaactaaatatatctaagcgtatctatataagatcttctatttctttgccttgttattgcttgagggcggcatgatccagaacttcaggagcgggaagctgacgatcaccgcaagcagagtattgacgaccgaggcaatcgtaccagagagcccggcacccaagccccaggtgacttcgcagaagttagtgatgtagcccggcaggatcagatttacgacgacgatgatgacagctaagaccgcatacttcggtgccgcctccccaaaggtcgcatcagacttaaagacccacttcatctggacaaagaagttcacgacctgcgccagtacctcggcgatcaaaaacgtgataaagccacccaacccgtgggagccgggagatgtgtagttgaagatcaggaaggaaaagggtgccgtgagccctaaggtatcgataaagaaataggtaccgacccacgtgcagacaaagcgggtgatcgtagagatattgctcagcacattgaacttgataaactcccacagtccctcatgctcttgtgtccaatcagcaaaactcacaagattctccttcatgaattacgagcgtttatcctgaacagcaagcgtgcgctcaccctgagcattgagcaccgcattcttgatgagctcaatgaggagtggcgccacaaaccacaggaaccagacgagtgtaaagaaattccccgtaagcacctgtacgatcaccgccgggaccacgcctgccaggccccagcctttagcttcccggacaagggcatccacaaaccccatcgagatcagattccctgcattctttgccatcgaccgcaacggcatgttgtagacaaagaaggtattggtgttggggttcgtcttaactgcatgctgagcgatcgctctgaaaagccacaggatcgggctcttcccgcggttcaggtccctgacgcacaggtttctgtccagcacagggctctctttggggatcggatgccccaacagcacctcaaacgtagctcgagagacctgctgcacgcgtccgaaatggtacggaagcagtttctcatccccctgtatgtgcggcgcggccgtgcccttaatcttcacattcttatagagatagaggtccgcgcttgaggtgcccacatagatccggtagacgcccgattccgactcccaagcattcgtttcagcatcgaagtagcggaaagctgtttcattgagcttaacggttacccgcttggtctcctgaggattaagcgcgaccttgacaaaccctttgagttcccgctccggcctgaagatcccggcatcctcacgcgcgacgtagatctgcgcgatctccgctccccggtacgtcccggtgttagtgaggtcaaagctgacgttcgctttgggcagccgttgcgcctcgtccacctgcaccctgaggcgggaataggcaaacgtcgtgtaggagagtccaaaaccaaagggataggccaccgctacatgggcggtctcgtagtagcgatatccaacgtaggggccctcccgatactgcgcctgcaccgtatcggaggggaaccgatcggcgagcggggtctcggagagctggtttggccaggactccgccaatttgccggacggattgacctcaccggtgatcacctgcaccacggcagaggcccctgcctgtccgccaagcccttcatagagcagcgattggcagaaggctgaccacggagtcgtcaggactccgcccgaagaaaggacaatgatcatcggcttgcgcgttttcgccaaggcctcgatgagctgcgcctggttgtccgcaagatcaagcgccgttcggtcgagcccctctgcttctgcggcttcggaaaggccaatgttgaggaggattgcgtcagcttttgtggcgagttgcagcgccttttgcgctttctcgtcgtttcttgtatcggtacggtcaaagcccggctcgtagccgacaaaatcgagagcggagcctttgacggcgccgatcaaattgtccacctgtgtcgcattgacccgggaggagccggagccttgatagcggggggtgccagcaaaatcaccgatcacggctaccttggtacctgcgaccagcggcaagagcggatgcgccgcgcctttcccagtgagcggcgccaccttttcattcttgagcaacacgatgcctgcggcagctgcccgctgtgcaagggcgtggtgcgccttcttgtcaaaggtatgggggtgctgtttcagcactgcatcagttgggagaatgaggttgagggcgtcttccacacactggtcgacatcgctctcatcgacctccccttgcttcaccgcatagatcagggagcgagtggaatccagcccaccgcccggcatctcaaaggtagagcggcacttcacagccttaacatgatcatttgagccaccccagtcgctgacaactacgccggtgtaaccccactcatctctcagaatatctttgagtaggtgcttattttcgttcgcgtactccccgttgatccgattgtagctcgtcatcacgcatgccggatgggcctctttgacgatgatctcaaaggcagtgagatagagctctcgcagcgtccgctcatcgaggatggagtcagaagcttggcggcgggtttcctggctgtttgccgcaaagtgtttgacgcaggcgccgatgccggcggactgcacaccttgcacgtaggcgctccccagttttcctgcaagatagggatcctcggagaagtattcgaagttccgcccacacagcggactgcgcttgatgttcacaccgggtcccaagatcacattgacgccctggctggcagcttcctctcccaaggctttcccgatttctttaagaaggtcgctatcccaggtatccgcaagggtcaccgcgcaggggaaacaggttgccgggagactttcgccgatccccagatggttcgcatgatccgcctggtgacgcaggccgtggggaccatcggaaaactccagctcggggatcccaagggatgcatacggcctggtaccgaaggcggtatacccgcacagcagggcacacttctgctctaaggtcatcttttgaatgatatctgcgtgtgacacatcaaccacttcatcgcaatcgcgtatcgatctgctctctcagtttttagtgtgccacaagtatcgcactctgccgcattacagcacgcgaacacatgagctctgaagaatacctagacttccatctgctggagccgcctgtagacgtcgatgaatttgtcagccagcgtgcgaacggtctcagtgtcgcttaactggtcctccgcgtggataaggagcaggttgatcggaatattctgtcccttggcattgtgggcaagcagctgcaagtgtgcgtttctccccttgataaaggcttcatcgccctctttaaccagttgctgtgcctcatcgaaatggtaatcctgagctttggagatcgaatcgatgtagagtgacttcgccgtacccacgctcgagatgatctgatagcacagctctgtaacttcctgttcagtcagcggtttgtcacctaattggcctgccatatttcgctcctttatgcattgctattcctcagagggttctctctttttgaatttggctctgagagcccccaccactgcggggatcacgctgactaagatgataccgactataacaagctcaaagtgctcctgcacggccgggattccgccaaagaaatacccaaggagtgtgaagagcgtcgaccaacagataccacccaggacattgaagggcacaaagtgcttccagtgcatgccgcccatacccgcgaggaacgggacgaaggtacggatgaaagggaagaaccgaccaagaaagatcgcgagacggccccacttatccaggaaggcttcagttttctccacccgctccggcgtcatcgccttcactttccctgactggacaatgcaccttccgaagaagtgaccgatcataaagttacattgatcgccgaggattgcggcggcccaggcggtcgtcaaaagcaggtagaggttgaatcctccgctgtgggcaaaaaatcctgccgcaaagagcagcgagtcgcccggcaaaaagggaaagaagacgacgccggtctcgatgaagacgatcaggaagatgaaaccataggcgtacaggggaccggcgacgatccaccccgcaatggcagcacgtgggtcgtgcaatagattggtgatagcatcaaaaaaggacacaggccgactcctcacggtcgtctttggtaggctctctacatcaagagtgcctccaagacctgaaagatcctgaaggcactcaaaagtatgctcgatgggaacggacgcccgcccgaggctccttatggctgctgcctcccggccctgaccaggttcggaacagtacgtcgtccgaacccatcgaacatactgctattccagtataggtgaaataatattttttcgacagcctcaatgatgttctttcagcacactcacacgaaacccttaatttcccaatcgttcgggcctatctctagcaaaaaggggatctaaagccctcagtctttggatcccctttagaacaactagtggcgatgcgcacgatagaacctgatgagcgcctgcgttgaagcatcctgctcagcgagtgccttgtcatcgtggaaggcaggcgtgatctgcttggcaagctgtttgccaagctcaacgccccactggtcgaaggagtcgatgccccagatgctgccctcgacgaagacgatgtgctcatagagtgcaatgagctcgcctaaggtcttcggtgtcaggtccgtaccgaagatggaggtcgtcggacggttgccagcgaagcagcgggccgggaccatccactcggcggttccctctctgcggacctcgtcagcggtcttcccgaaggccaacgcctttgtctgcgccaggaagttgcctaggaagagctcgtgaatatcctgatctccatccttcgtcgggttcttcgtattcacgaaggcgatgaagtcagccggaatcaggtgcgtaccctgatggatcagctgatagaaggcatgctgtccgttggtgcctgcctcgccccagaagatctcgccggtcttggtggtaaccggggtaccatcccaacgcgtgctcttgccgttggactccatggtcagctgctgcaggtaggctgggaagcggtggaggtactggttgtacggcaagatcgcgtggctctcagcgccgaagaagttgttgtaccagacattgatgaggcccatcaacatgaccgcgttctcttcaatcggcgtattcacaaagtaggtatccattgtgtggaagccgtcgaggaagtcctcaaatatcttggggccaaaggcgatgatcagcgagagaccgaccgcggagtcaacggagtaacggccgccgacccaactccagaagccgaaggcattattcgggtcgataccaaagtctgccactgccttgaggttcgtggagactgccacaaagtgatgcttggtggcatccgcatcggagccggtgtatccctgagccttcaagcccttaagcagccaggtcctgacctcacgtgcattggtcatggtctccagcgtcgtaaaggtcttggagacgatgataacgagggtcgtctcgggatcaaggcctttgagcttctctgcagcgtcattcggatcgatgttagagatatagtgcaccgcaatgccggcattcgcatagggctttagcgcttcgtagaccatgaccgggcccaagtcggagccgccgataccaatgctcacaacatcggtaatcttcttgccggtgacgccctgccacttgcctaagcgtacatcattggcaaaggcgtacatcctgtcgagtacctcgtggacatccttcacgacatcctggccgtcaacaataagttcgccctcatcagagaccggacggcgcagtgcagtgtgcaggacggcacgatcctcagtagtattcagatgtacaccggagaacatctgtgccctgcggccctcgacgtgcattgccttcgcaagcgcaaccagatcttggatgatttggtcagttaccaggttctttgaaagatcgatatgaaaatccgccacatcaaagctcagcttgttgacgcggtccggatcctccttgaaccattccttcagagagataccctgcttctgcaggtcctcatagtcttgcttgagctttttccattcgcgtgtttgcgtcacatcgatcggttctgcaatcatagttacaatgccctccttagatcgttctactcaagaacttcttacttccaagattaatgctagtcaggccctcaatcaggggaaacttacaaatattgtgctaacgacagcatcaatagggcgctacctcaggcggtaactcctttaagcgcgcccacataatctgtttttcgtgtgcatcgttgagcgaagcttcaaatcctccaagattcatcacccgcataccacagatgtaggcgatcgcccccggttggagcatcgcgcaggagaaatcatcaagggcggaaagttcctctgcataggcctccctcatcactgcggcggcggtgtcatccacgataatgaccgtctgagggtcaagcgccccgatcgtctgacgcaacagtgtcgggtcaagactttcgccctgcgtattccaacttgcgacaccacaccaacccgccggatcatatcccaacgcacgcagtgaagcctgcagtgcttttccatctggcccggtaaatagggtctttccgttcccgtcctgcggtccgggatcacctttgagaaagagcactgtggaaaaggcattgccacagagtatgacgccctgattgactaaagcatccacttcagcctgttgtttttcagcatatattcgcttacggtctacccgtgtctgcaccatgattaccaccacaacacgttgtctttatctatataagtaaagcttaccccaaataggtatccctcaaagcgatgaggccaggacaacatcgtggatcatcagtctattgaagaagagattactcgactggatgagccttggaataccgccagtcactgggttggagtggtcaccatatctggacaccagggataagggtgaaaggtgtagatatgccccaaagaagagagcgctacgacagaagtttaagatctctgcttagaggtagtactcagtgatagagcacatgaagaagctctcaggagaattgggtgtccc

SEQ ID NO: 321 - DNA, 29664 bp, Unknown
  Metagenome-assembled genome
atgaccgacaccatgggccgtcttgcactccgaccgcacagtttgcgggctcctcttcggtgccggcacacgcgatatggatgggccttatcggcagggcaacccgatggtcggctgtaccgttgcctgcgctgtcgctgttgagcaggcactgaacaagtaaggcttccgcaggctacaccttcgaatcatacgccggctttcaccttctggtgggagccggctttttacattggcagattgtcaagctgagtgcaccatctcccgatatgttaaagtcaaccccagacttaccgatttgggcaatatatctgcaccagccggggcaataggatcagccagaatcggtgcctgcgccctcctttgggaggggctggctgcaggcaggtccttgatcctgtaggagcttcccgtgatgtgtatgagatggcagcggtagcatagtctgtcgactatggctataagcgcattgccgaagacgtcggcccacatgctatccccacgcttaccgacgcactgtcgagcccctcttatagcttatcgagacaatctggaagatgaggccggcacccgccagcagctcgtcttttcagctggtcgccagcgacgggctctacgtcgtgctttgtcgctaccggggagagcgtctcctgctccttttagacctcaacaccaccttcatcttggactgtgggctgtaggtcttccttgtcgtctttgacattgccatccttaacaatctgtgtctttcagacacatcttcgcgggatttagatggacggtcaaatctgtgtttcaaaaccggcagctacatcaccccaccgatttacagcagggggaggaaactccaagtaaagattcaaattgcttttgagtcatatggagtgactggcgaatcctcctcatttcctgtggggatagcagcccgttctttcttacacatgaggctgcaagagtatgggcgagtttgcctgcttcggtgacattcatgacatgacattattgccatattggtcgcattgccagcgcccaataccgtctacggtgaatgtttgaccgcgatactttctgtcatcgacttcgatgtcttacacacccccactccacacgctgcgcagatcacggctgttctcctttcggcagatcacggctgttctcctttcggcagatcactctgttctcagtcacgctctgggccctgtagaggacttgcattcttcatcaatggagagctcccaaactgaatgatcatcctgctcaacatcacgaacgctggaaaataacgaagggtagaggtgcactgtgaacgaaaaccgaatggctcaccactatgcaggtaagagcagttttagataacgagcacgaggttattacagtgatgggatgccaaactgtgagaggtcgaggacttcaaagagccacaggtcaaaggtgagaagcaccgccccgattaagaaggcagtgataccgaggccgacggattttacccggtcagttctaataatcgcaggggctttcttgcggtagtagatgttgattgggcgctctccaccgaaacggcgtgcttctctgtcatcgtaggtatcgcgcgtagttgcctgtacgaagttcccctccacctgaaaggtgaaggtcaggtggtagatatgcggcgcggcagggagagactgtcgcgcaatgtagcgagcagtggtctttttatataatacgaagggggacacgatctcccagattcccaggattactaagataagggaaaaagggagcaaagcccagcttaacgcttctatatcctgtttgggtaaataggacaaaaagttcaagtatcagatcactttcttttacgagtgcaaaactcttattagttgaacgtagcagcacggatgctattttacaacgatgaaaaacaaaaatatcccagtcctaaaagaacgattctttttaggctgcctggtatatgtgttgtcctgcttcgattgccacatgagcaatctttttgaggtaccagggtgctatggtttaggctgttgacggtgacgtctttcgacttgatttagagagagtgtatgcatatatgggcgcacagtatccccgtacggtaaaggagtgagaccatgccaacctggtcattgagccaccctatcaaggccgccttttttgatgctgatggcacgctgctgtcatttaaaacccatacgatctcagagtccacgaagcgtgccctccacgcattgaagaagtccgggacaaagtgtttcttggcaacggggcgtgctccctatatgtgcgactcgatcgatacctcagatatggaaggcttcatcctctttaatggccaattcatcctggatcgctacggcgtgatctttaaggcaacgatcgacaaggacgatgtagcgaccgtggtcggccaggtacaccaggggctctatgagtgcgccttcctagcagagcagaaagcctatgccagcggccgcaatgagctggtagatagagtagatgagatggcacacatcagttttccggtagaggacatcgatcaagcccttagccaggatatctatcagttcaatattttcctgctgccgggaaagaccgatattgtgcgtaacaacaccaagcacctcaagatcacccggtggacccctgagttcgtcgatgcttttccgatcgacggtggaaaatctcgcggtgtagataagatgctcgagcactatcagattcctcaggaggagtccattgccttcggtgacggcggcaacgacttacagatgttcggagcagctggtaccagcgttgcaatgggcaacggtaaccccgaagtgaaggaggaagctgactttgtgacagacgatgtggaccataacggaatctggaacgcgtgtgttaagttgggcctcatcgacggcgagctgctgtagagaagtgactaacgcaatgattcaggaactcgggaaccatgtcttcgacaaccacttccacaacgtggggccggaaccggatgactatatgttgcactacgccccctatgccagtcacgtcggggccgattctgctgtcgtaatgatggatggaatgctcgcccgtgaagaggagggacagcttgtcctccccaagctgcgtgactaccagaccaaacccgagtatgtttacctctttgcaatcgacgatatgcgcttcttcttagcgctcgacgtggtggtgaatgttggggatgagtttacctatctcgggctgaatggctgccggttctatacgccccgctacctcgcctttgccgcaataacaggctatcagctgtgggattggcacaagcacaaccgcttctgcggcgcctgcggtgccaaactccttcatgcccccaaatctcgggagcttgtctgccctaactgtggcatgatcgtctacccacgcatcaatatcggcgtgatcatcggtatcactgatggggataaactattgctcacgaagtacaccggccgctcttatacgcactatgcgttggtggcgggctacaccgaggtaggggagacgctcgagcagacctgtgagcgtgagattatggaagaggtgggcctccatgtgaaagacctcacctactttactgatcagccgtggtccttctcagggaccttgctcatcggttactttgcccgcttggatggtggcagccaaatcaagctcgaccaccatgagcttgcggtggcggagtggaagacgcgctctgagctcccaaagacgcatgaggatacttcgagcatgacgaactatatgatcgaggccttcgcgaaaggcgaagatccgttctcacagggacgttaagctgcaagtcccgcaatcagtgagacaaaggcgataataacaacgacgatggactctccgttcaggatgcctgaggacactacgaggccacgctgggtgtccggctggctctgctgttcctgctttgcaggagtgagctgtgcacgatagttctcgcagattttgtcgtagacgagtttgatgcgggcgccaatgaaggcggtagtgctcatatagaagggcagataggtgcccaatcccaagagcattgcgggtaagtttacccagtagaggatgacaccggcgataaggccgatgataaaggcggtgaggttggggataccggtgatcgcggtggcagtcacggaaacctgggctgccacaaaagttttacccgagccgaggcgtccggcccacagatattaagaagggcaaagaggacggcgcttgcgaccactgcgccgagaaggccactgatcgctcggccgatccactggacgcgcggtgaggtgccgaggatcttacctgccttgaggttgttcattacatcaccggcgaggccgcaggcgactgcgatgatgcccaccatgtagaagagctgtacttgggtgttctgtcccagggcggtaacagccagaagcacgagcaggccgaagatctccatcgggtcaatgttcgtctgcccccagggctgcgcagacatcgtggtgcagataaagcacaggactacgacgatgaggctcggcagtggtcctaaagaaagtccaaagcagataaggaaggcgactgcagcgacagccagccctaagatcccggcatcgtaattgaggttaccggtgaccaggagcggggatcatcgtccggattcttctgctgtttggtgtctggagcttttgttgtggtatgtgcgattgaaggaataatgtcctttgtgacggggtaaagcctgagtctatcatgagacccataccgaggcttgagacggttgcctgagcagttgcgatatctcataggttgaggatactgccacctacgatatcccgaagtttgcaaagggtgcgctaccgaaccaaaaaagcagaggaaccaagccgaccatgaatcctacgctcatcatcggcaaattatagataatcgctgggctcatgctgtaagtcctcaaccatttttaagattattgatttagttacagtgaatggttctcgaagagcggatcgtcatgccagataacaaccctgcctgtcttgagggtcttgggcatatcgatcaggcgttggtttgcagagcccctaaaacgcagtgagatgtccttctctgcttggataaaggggccatcgactaagacatccaatgtgttgaggatacggtccgtaacgtcggtgcgagggcttgtggtgtagggagccttgacggggactttgccctgcaactcttcaagcgtgaatccggagtagagccagatgtccttttgggggtaggtcttcttgaccttctcgaggaagtcgaccagaccttcctggttctcaggctccatcggctctccgcccaagacggacagcccatcgatatagaaaggctccatgctcttgataatgtcatcctctacgtttgcatcaaacggcttgcccgcatcaaagctccatgcagagtcattgaagcagaatgggcaatgcctgcggcatccggagacaaacagtgtggtcctgacaccctcaccgtcagcgatgtcacagtatttgatgtttgcgtacctcatcgatcacaagccttcttcgtgttggaatacgtactgctgtatgacacacactatttggtatgccctcaaacagtgtagttagacaatatacaacatattgatgaagtacagagcggcaatataagagggatctacaccatcttgatatcagcagtattaacttgtcctgtacgaattgcttcaggcctgcttgtatcccactaaacgctaccgtacgattatcccaacagtaccctccatccctatgattgctttggttcagtcctaattcctgtgagtacccccatcacgacacagctccggcagtcttcgagtagcgcctgctcgcatcgaatatcttgaggaagaagtactcgtcgttagggtatccctagcctgccctcctgagcgtcttgatcatctggttcgtgccttccaccttgcctgaggtgatccggtgcctggcgtgcgcgacgattccgtccatgtgcgactccacgagcctggcgagcctggcgaagtgcctgtctcccgttccccggcagacctccactatctgctccaccgcatcgcgcatgcgcttctcctgcctgtagccgtaggccctgctgagcatctcatctacgatgtcacaggcagccagcagctcgttttgggctatgaggtccttgtacctctggcggcttccgcccttctgggtggcctcctgctttccgaagagggcgcttccccttaagacgaccttgccggcacgtgcatcctggtccttcctcttgctggtgtccgcacaggacatgaggatgtatgtggaatgcttgagggcacgcgccgcatcggcatcgccttcgtccttaagccttgcctgcttatccttccggaccttacagatgaccttctcgttgaagttcttcacgaggtggaacttgtcgtagacgacatccaggcgcgggtgcctttccaagaatgcccgctcgaagtcggcgttcatgtcgcaggcgatggcctccaccttcgacatccattcctccccgacgtggtcgcacaagttgtatacgacttgcttcttcttggagtatgcaagccacaggacatgccccatcttaaggtctatgatcacggtggcccagcggcggcaattatgtagcttgaacttatctgcgcccaggtagcgcgcctggcgctccggcttgtggagcttcctctctttgtccccatcctcctccgtgtagagcccagagagcctcgcccggtcgatctttttcacgacattcctgttaaggcctgccgtgagcgataccgccttgagagtctggcccaaggcgagcaggtcatacacgaatgtcaggagcggcagcgtgatgcgctggcctggcgccctgaacggcacctcttcggtggacgtctgcccgcactccctgcatgcccatcttgggcgggatacctctatccttgccctctccatcccgaggggcaggtgccgaagcgcaatggggacctgcccgttgccctccatcgcccttccgcagcaggggcagcatggagcttccttggcaaccatcctgcctgggacagtgaggatctgcactgccctctggcacctcctggtggatgtcccgaactcctctgtgcgtgtgctctcttgcggcgtgcctgtctgcacgaagccgtccagatgcgaggggatctggatgaagccaggagcggcagcctcgtcggcatgggaaacggcgggcagctgggctgccgcggatgctacacttgtcatcgcgctccattcctcttagagtctgtatgtcgcaatgcaagattctagaggatggccgcttctctgtctttctgggcatctgcccacagcttttaggattgaaccaaaaataaaaaagttctttgacttgggggagcagtctgttactatagacaagcacgcaagagagcgcacttcggctgggtagctcagttggtagagcaggggactgaaaatccccgtgtcaggggttcgattcccttccccgccaccatgaaagatacaggtcagggtatttggtgctctgacctgtttttcttgttaggcctatccagtgctgtaatatttgactcggcagattgtcaagctgagtgcaacatctccctaaagacctcgttgactgtcctgtatttcaggaccttcctcgccctgtcgcagatcagctccaccacatgccggacctcctcgtttgtgaccttgccgaagtcgctgcccttaggggaagaactctagcaggagcccgttggtgttcttaactgtcggcttctgccatagatggtgggatggtggggtcgcagaagtagaactgcacgcctcaaagggcatctgtgacatctgtatgccctgcggactgcttgcccctatccggaagtgagcgtcttaaggggacgtccctgcagcagcccgacctcggccttgaagacgctgccgctgtcgtggtggctctttccgcggcaagcagccccaatgccctgtcggcaagcacgagcaggcacacgggcccggctgccacgagcgtgtcgtctacccactctccgaggcaagatctcgcatcggcctgctttggcctctcctttacgctgtgtaagatctcgatcttgcctttggtctttggcctcttgctgcgcaggtggcgtcgcatcttgccttcggggccggatcccggcaggtcgagggcagcctggacctcccgatagaatagtcgagaggctcaacgacacacctgccgccaccctcgagcctgagatatcgtctatctgctccagggaccagtgtctgtccatgatgagtaagcgcaccttctgtgtaagcgcagggtctgaaagccgccttttcgccctgtatctcctgcggcgctcatccgccttccttttgggcagtacatgccctaaagcgtccgtgccgtgcgttcctcttgagcttatggcagacgctggagctgttcctgccgatctctgccgcgatataggcaattgaccttcccttgtgccacacagctcggctatgcagtccctctcctgtgggctaagatgtgtgtagtggcacattccttctagggaagcgatgattaattcccaataatgtgccaaagaggatcagccacgtggccttacgcagccggcatgggaattaatcatcgtttccctagctttcgacgttgattgagacaaccaacatcgtagccttccggagtgtgccacgcttgcattcagcgagctatcctgttgcactcagaatgctaatccgccgctgcattggatggtgatatctagtcgagtccgaaatcgtgtgtaaattgcctcataagtaaacgctcctgcgagccgtcacgaagcgagtctcatccgccgctgcgtgcgggctatctcctcgagatcccccttcctcctctcatagcccctcgaccgccggcagccagtactgcttgctcttggcggcccacctgtcgttctcctcgatgaggtaggtccccacgagccttattagcgagcccttgctcgggaacacgccgatgaccttcgcccggcgcatccccttggcgttgagcctctcgaggcagttcgacgtcctggtgcagctacgtgtcgcctgcgggagggccatgagcgtcatcgcgtcctcgaacccggcgtccaggcgcgccaccgcctcgggcgcctcctcggctcagtccgcggcaatctcgtcgcggcgggccctggcctccttaagcgtggcgcagttgaacatctccacgagctctaagcgaaggcacgcccgcagccgcttggggtgcactgtccgaaaaaacgatacaggtcaagtcatccctgcgcgtcctcgtcgggaggcctgcatccgaagagcgaggcatacaacgcgaaggcatgcctcagacttcccgacggccggaactcgctttgcaggatcgacgaggggtacgggctgttcaagaagttcttcagcatatatggcagcctcagggcttccgacattcagaggatggctcgatctttgctaggtgtcgcgcaacgttgacagcagcatagccgagagagtggcatgggtgccgggcgacgcttagatagcgggactactatcataaggaggcaagctcagggagttgatatctccgtcagccagctcagctatgcaaattaggcttgtaagggaatataaagcatcaaaggaggacgcgctgaggtggttgaagcccggtggcaattgggcttcataggtcgtaacactcgcgtcgcccccgcctgcagacgtggctacgcagtgattggagttctttcagtgtatcaggtgagctatccgccagcaacgctattcctcaagccttgagattgtacttggctatgaggggctagagaaaatgcctggatgcagcatagactgcatccaggcattggtgcggttctgcaggctgtcctacagggtgtggcgtgcgcttctgatggcgcccttcacgatgccgtgcgccatgcgataggtgagtgccaggtatcccccatagacgagggtgaagattgcgatgccgagtccgacgctctcgatgatgctcgcatgtccaaacgtgaggagaagcttgttcacagcagcggtggcgcagatgctgtgggcgatgccgacgacaagaggtagtgcgaaggcaaagatgacctgggtcctgagcgaggagaagatagttttttctgagcagccgagctccgagagcgtgcggtagcccatggcagagtcggaggcgttggagagctgctggattgcaaggatagcggcgcaggcaatgacgaggacaaagccgatgtagatggccatataggaggtgaggcccgtcattgtggtgccttcgagtgcagcgtcggtctttgtctcggaggcgacgtagagctcgtcgtccgaagcagcaatcgtgtcctggagattcttcacagccagatcgccgttttcggtggagacgctgtagttaagatcgagtacccaatggtagttcgggagctcggcggcaatatcatctgcgacgacgtagatgcctggagtcttgcccacggagtcgttcaggggaatgcaggaattatcgtcgatcacggtggtgcgggcaggggtgagcgtgcgtcctgctgccgtgatggtgaagccctgctcaagagctgtgttcacgaagctctcgagctggtccatgttgcagagatagaggtactgatccttatcgagcgagaccgggtcgagccccttgaatgtgcgcagggcattgtagtcagaaagggagagggcctgtccggcgacgatctgctcgaagccctgagggatactcttacctgtgaaagcagacatctcctggagagtctggatcatgttgatgccctcgccgtctgtcatgtatccgatgcggaaggagacagtgtttccgatcgagttgaagttaactcctgccctctttgcaaaggcatcccagtcgaacgtcttctcctcgccagaggtgtcgacaacgtcgatcgaggcatcgaagggcacgccttcctcataagccttgttgagcgtcgcacagatgctcatgcccgatgtcattgctgtcatcgcgaagaagaggatgagtgcgatgaggcccatcgatgctgcggcggtgttgatgcgggacgcgatctggcgggtcgtgaacatgtggagacctgaccagtaatgcttcttcatgcgttggaggatgagcgtgatgctgcctgcaaaaccgtagaagaagatgaaggtgccggcaacgacaagcgcggtcgtgacaaggaagtcattggtcgttgtctgccctggctcggggttggagccgccgagaggaaagccctgggttgtgaggcgccagtatgcatagcccatgaggataaggccaagaactgtgagggcaagggagagcggcagatgccggacaaactgcttctcgttctttctgctagcgctcatgagctcgatcaggcgtacgtgggagagcgtgatggagttgaagaccatcatgacgaggaaggtgatggcaaagcagaagaacgtgagcacaaaggcatcgatggagaagaagaagcggaagttgtcgactttcgtcgcgaacatgtctgccgtgacgaagagcaggagctgggagatgagggcaccgagcgcgatgccgacgacaaaggagatgagggccaccatcaaggtctcgagcgtgaggatcacgttcacctggcctgcacgcatgccgaggacctggtagaggccgagctccttctttctcctgcgcatgaggaagttgtttgcgtacaccatgaggaagcccatgatgacggcgaggaagaccgtgaggtcgttcatgatccggccagcctgttgcagagcttcggagaccgagttcgacaggaaatctgcctgcacggagatcgtgttgaatgcatagaagatagcgacgcccatgacaagcgtcaggaagtatacggcatagtcatgcatgagcttgcgcatgttgccgaaggcaagcttagcgagcattgttgacccctccctgcactgctacgatctgcatgatcttctcgaagaactcgcggcgtgtatcgcttccgcgcatgagctcggtgaataccttgccgtcacggatgaagagcaccctcctgcagaacgaggcagctgtctcgtcgtgcgtcaccatgagcaccgtggctttctgggcgcggttgatggcctcgaggctctcgagcaggagcttcgcgttcttggaatccagggagcctgtcggctcgtctgcaagcacgagctgggggcgtgtcacaagcgctcgggcgcaggcgatgcgctggcgctggccgccggacatctggtagggatacttgtcgaggacgtcggcgacgcccaaggacttggcgatgccctcgaccgacttcaggatctggtctgccggcacatgtccaatcgtgagaggcagcgcgatgttctcgcgggctgtgagcgtgtcgagcaggttcgagtcctggaagatgaagccgagttgggtgcggcggaagtcggcaagacctgagcgggagatgcgtgccgtatcggtgccggcaatgcggatcgtgccagaggtcggcgtatcgattgtcgcgatgcagttcagaagcgtcgacttgccggagcctgatgggcccatgattgcaacgaggtcgccgcgctgcactgtgagactgacgccgttcaaggcctttgtcggagcattcttgcctccgtagaccttcgtgagtgcagagatctcgaggacaggcgagttattgtcggggacaaaggacgatctggttctcttgagatggtgtggcatggtggactccttctttcgtgttgctttctgtcgcaatcatattcgccgaaaggggctctgcctgccatcgaagccgctaacaaaggcttacagttctgtaagcttggtttcttcgtcgaagcgcgagcgctcctgcgggaaagcgatctcgaaggccgtgcctttcccttccttcgagcacacggtgacagaaaggcccatcttctggcagagggtccggacaaggaagagtcccataccggtcgccttgctgtggcttcgcccgttctcgccggtaaagctccgctcgaagatgcggggaaggtctgccgccgatatcccacagccgttgtcagcaatccggagcacggcatgctcctgggctgtgcctgcctcctcgatgcgtgccgcaaacgagatctggggcgtccgtccgtcatgtgcctcgtccgcgcggtacttcacggcgttgtcgatgagctgccccacgatgaagtccatccactttgggtcgcagataaggatgggagaggtgccgtctttttctgtgaggcccgacatatcaactgccatatgcgcctcaatgagcgtgcgggcacgggagcgcacagcttccttcacgagctcgtcagcaggaatgctccggaccaggtagtctttttcgaccgaggtactccttgcatagtagagcgcctgctcgacataggcatcgatgcggctgatctcgcgggagacagctgctgtatcgggtgcgtcagtatttgcaagcatgagacgcacggcagcaagtggcgtcttgatctcgtgcacccaggtctccacatactggtggtattcctcgactgctgcctctgcctcgtggctttctgcctgggcagtacgcacgaggctttggatagcctgccaggagagctctccttcgggatagcttggctcctcgatattccgtgcataggcgagggtatctggcccttcgtctgcgagctcttcgaggtcgtgtgtgaactggcggctccgtgcatagccccagaggaggggcgctgcttcgaggatggcagcaatgatgaggataaggatcatgccgtcggtgctcacgccgaggggcggaagcaggactgccaaggctgcaaggagcacgagacttgcgataaggcgcagtgcatggcttctgatgtaggtcgtgaaactcatgtctgctccagtctcagggcatagccctggccacggaatgtgacgacagcagacttgagtcccaggcgcgagagcgtttggcggagtctgtttacgttcacggtaagggtattgtcgtcgacaaaggcatcgcttgtccagagggattccatgaggtcttcgcgggaacagatcccgccttttttcctcatgagctgctcgagaattcggagttcgtttcgcgagagctcaacggtcttaccctcgtagcttgcctccgagcgcacggtatcgagtgcgaggccgccattagagagtacagctgaaggtgcctggctcttgccacggcgcaggagtgcttcgaggtgtgcgaggatgagctgcgggttggcagacttctggacaaagctgtctgctcccatcgtgagggccatgagctcatcgagctcggaggtgcggttcgtgagcaccatgagggggattttgctctcctgcctgagcgccctggtcacatactggccatctgtgccaggaaggccaagatccaggaccacggcgtcaggctctgcgtcgaggatatcctccggtagatggtcgaagcgctcaagtgcttcgacttcatatcctgcatgctcgagcaggagcacgagctgtgaacgtacggcagggtcgtcctcgaccaggcaaatttttgccatgtctccctccttggctcgcttcttcctatctaccttagcgcaaaaaggcagaagcacgcttgtgccacgcgggtggacggcgccgctttctggggttctgtaaggtatcaaacaagggctttcagtgaaaacgacactagggaagcgatgattaattcccaataatgtgccaaagtggaccagccacgtggcctttcatggccggcataggcattaatcatcgtttccctagggaaacgatgtgaggctctcctgcaacctctggggcacctgctgcgatagtgccttgccactcttaaaggcgagatgtactagcgagaaggctttgcaacaagaaaggatgccacacatgcgcaagttgaattcattgagggctactacaacagaaaacgtccctactcaacgatcaacaacaaaattccagcgaaggtaatagatgctttctttgaaagaacgaaacctatatcagaagaggaccagatatcaccatccaatgcaatgcagcggcagattgtcaagctgagtgcaacatctccctaaagacctcgttggctgtcctgtatccaaggaccttcctcgctctgtcgcagatcagctctactgcatgctgcacctcctcgtttgtgaccttgccgaagtcgctgcccttaggggaagaacttgcgcaggagcccgttggtgttcttaactgttagcttctgccatagatggtgggggtcgcagaagtagacctgcacgcctcaaagggcatctgtgagccctgtatgccctgcgaactgcttgcccctatccggggtgagcgtcttaaggggacgtccctgcagcagcccgacctcggccttagagacactcccgctgtcgtgctggctctcttcgcggcaagcagcctcactgccctgtcagcaagcacgagcaggcacacgggtcccgctgccacgagtgtgtcgtctgccaagtcttcgaggcaagacctcgcatcggcctgcttggacctctcatctacgctgtgtaagatctcgatcttgcctttggtcttgaccctgttagaccactgtggatatagggaagcgaaaagatgtcacggggtaaccctacaatcgggttcgaccaagaaaccgacctgaagaagaccccgcatactcgacatgatacgacaactagcaaagtggctgactcgcaaggagaaggtcgcacttaccgccgacctcaagcagatgatagccgagaagctaacattgcaggccgacaagtccgccacatgcccgcactgcggatgccctgagttcaccaggcacgggcacgacggcgtctaccagaccaccaggagaggctacgtgggtatgccgattgcgtttcctaagtactgggagcaggcgatatgacctcatatccacagtggtctaacagagttttggtcttaggcctcttgctgcagattcgcttccccttcctgcgcagatgttgcctgcctgcttggggcttgggggaccaacgctcctccacgatgagcgagcgcagggtctgatgcctccttctcggcttttccctgccgtgagcgggcttgcgccctcctttggggcggcgcaggcgctaaagcgtttgtaccgctcggttttctcgaccttgtggcagacgctggatttgtccttgccgatcttgcgcgcgatgtatccgatgaagcttcccttctgccacacagctcggctatgcagttcctctcctgtgggcttgagatgcttgtagtagcacattccttctagctttcgacgttgattgagacaaccaacatcgtagccttccagagtgcgccacaactctgtggagctgggctatcctgttgcactcagaatgctaatccaccgtccgaaatattggcacagtccaacctgccacgaggcagagcggagcgatcacgatcatgttccgcaagatagagcttctgaatttctgccatgcttctatgtgccagttccttcccaccaaatatgtgagctccattatcgtgccagctcacgcttcacaacacaacgtcatagaatgtacaagcaatagagatcttcgggcaccttccgtattcgggtacctgcatgaaaaggggctgcccggcgggtgccggacagcccggaaggttggtatgtactgcgaggtcagttcgggagcctgcctttgagctccgagatcttggtagcatcccgcctctcgtcgagaagcgccatcgcgttcttcgctgcatcccagtcgctctgagcgcccgtgcgctcggctcggtcgaagagtacctcgaccgtcgcataggctgccttcacgagcgcatggtctgacgcaaggacgtgtccttgcgtctcctcttccgcggcgacgagcctgaacttgtcatgtgccatctcggagagaagctgcgtataggtgcaggaaaggtcttgcccgcctgtgtccatgcccatctcgacgagctggggcacgaatcccagggtcgatgatgtgtaccagttcccatcgaaggtgttgtggttggcttccgggtcggtcacaggggagtcaatcttgttcgtgaggtagacgatcacgaggtcctgggaaggatcaatcatcgtgagcgtgccggtccagccttgatgtccgattgtgttggaggatgattcggtcccgaagtaccaggcgcgctgcatgtcgccctcgcgccaccagccgaggccccacttcgctgaggtatcgtcttccttcttcggtgccgtgaatgtatctatcacatcgtgggagaagtaggagttcgtgccatagccgcccgtgagcatgacggaagcgagctttgcgaggtcggtcgcattggcgaagaggcctgcatgtcccgagacgcccgccatcgcatagtaagccttctcgtcgtggacctcgccctggatcgtgccggtgcgcacgccagtgaaggagatggcaccgtcgcgggtattgccgttaagttcggtcgcggcgcagtcatccttcgcaaagccatgctcgagcggctggtaggtgatatgtgagagccccatcggattccagaaggtctctttgaggaaggtattgaggtcctctccggtcgtcttttcgatgatgaagccaagaagcatgtagtcgacatcggagtagacagtcttcgttcccggctcatacatgagtggcgtcatgcagatggactcgagcgtcttttccctcgtggcttctgtgccgtcagagcccgagtagaggacatttgccgtatcggggtctggcttctgtgtgacttggttgaagcggtcgttgtggtactgcgggtctgcggggaagcccgcctggtggcggaggatatcgcggactgtgagctcagacttccactgcttcactgtatcgaggcctggatcttcgtatccgtcgtaggcgatatcgatcgtgtcgtccatgaactcagggccgatgatatctgagatcttctggtcgagatcgaagccttcgtttgccacgagatattggagggcatagttcacggagtacatcttcgtgttcgaggcaaggtcgtagagcgtatcgttcgtgacatcggcagagtcggttttcgaagtcccatcctggctgtaggagacgagctttccccaagcattctggtagacgaggcgtccatccttcacgatcgcgatctgggcactcgtgaagccttcatcgatgtctgcctgcacgatgtcagagattgcatccacggcatcctggctgattccggcatcttccaagctcccgtcgaggaccgtgggataggggacatgcacggtgatggcggactctgtatcgtgaggctcaatacctgtgaccatgagattgttcgtgccatcccgtgcgatgttcgagatatcgacggcgtaggtcccgcctgcctccatggaggaggtatcgattgcgtggttgttgatggagagattgaagtccgagacaccgtctgccacgctcacatagatcgtgccttggccatggtagtccttgaagctgtacatgttgttgagcgccagcgtgtcatccgtgtatcctgcccagtcagggaaagacacctctgcctgccagctgccttgcggaagcttgctcgatgtgacctgaatatcaggtcctgcggttgcttcgacccgcgcagactttcccgagcaggcagcaagcgacgaggcaagcgcaagtgctgcaagtacgccgagagcacgtttcatatgtttcatagcttctccttcaaggccacaggtgcggctttgcaatggcagggtctgagacagggcaaaaactctatctttgtggtgttttgtcacgcttcgcacagtgtttggcttcagtataggaagatgaaccaccctttcaacaggtcctggacgtcctggaacatcgtttcaaaacttggcagattcgctgatggaggccattcgttcatgcctccatctggcctcctgatgtgaagtttgactgcctctcgtctctctgtgcactatgagctctattaccatgggcttgtgcagagcctcgtgtacgaggggccctcagcatgcgtgaaggagccgatgcagaggagctggaatccctgtggccagcagtacacgaaagctcacctctctgagctgcatcctgaaacagccgagcttcaagaaggaggtgcagctttagatcttcgttggcgtatagcttaaggattgcgcagggcgcaatcccatgagcagagatacagtcatggacatctgcaaggaccttgtccaacatgtgctcgagctcgaagaagaccgctacgacttctaccagaagacaggacgaaacgagggcatctacctctgtatggagttgcgctacggcaagaagaagcccgtgattcctcaacccgctgtgtctgtggcagcgcagcctgcagataggtcggtcacgcttcagcccaagaagaagcgcgcaagccacaagaagacaccctcttcgtccaagaacgagacggcagcagaagaagctgtttccacacctgttctccagcaccgaaggtgcttaccgaggaggagaaggctgcagcagagctcagacgtcagcagcgcatcgtggcacacgagcgcgacaagggctcctggtgttaagcaatctgttgcctgcagctcaatctgaatagatggaatgaatgggtcccatacctcgggacacagagacctattctctttgaacagcaggggaagggagttctctgccgtgaatgcttatcgggggaaggcagcgctcagagcagaggtgcgctcctcgatgacaggccccataagcctgaactctgcctctctgcagccatttcttttggcaaagatcttccagtcccgtgtggccttagtaacgctggcaactgagcgagatgcagcggcagcagaaagcccacagacctctgccagctctttcatcccgtcgatttcgcccttcccggtctcgccgaagatcgaggtagctctccttcgcgtcgtatcggggttgatgttcacgtcgaagacaggtgccaggacccattggccacctcttcgcaagaatccaagattgcgcaggtggtcatcggtattgtgcagggcgacagagagcgcaatgtgtctgaacagtgcttcaagctcaggaataggcttctcgcaccaatcagacaaagcatcagcgacatctgcatagtcgttctgcgagccatcgcgagcacctatgagcgacatggcgctcaggtagggaagcctcggaccatccatgcgggagtcggtacggtcgaagcgctcgagtatgagggcggagtctgtgtcgagacatatgagacgtacttttggcacttcgagtccggcggcgttggcgatgtcgaggcttgtcttctcccatgccatgacatcccagctgtcttcaggatgggagaactttgcaagaagaagtctgccttcgtctgtgacagaagcctttggtcgggcaccgccgagtgagcccgacccagcatcgagcagttccttgatctcttctgtgcccgcgctgccaagcgataccttattcgatgcactgaggagacatttgagctcgataagaggaggtacatcctcgtgaagcgattggaaaccagtggtttcagggatacggaagcgcagtgcgccctgtcttgatgcatcgtagacaccgaggagatagtcgacttcatccagggttcgtggtctctgttccagtgtggcagcttcattcagcatgcggcggtctatgagatgatggccccagcggtccggtatggagtccctgagagctcctggaagcccttcgcagaagcctgctgcatcacggagtggaagcgatggatctattgcataagcatctgtgcgggcaagataggtatcgtcgtagctgaatgcagaagtcagccgtcctcttctgagactgaatcgacaggtccctataaatatgtctccggatacgctggacgcatatacatagatagtaggcgtcatttatttgctcctaacccgctgcgggagtgtctggtctgccctgatgcgccccagatccgtttcatacggatctgtcgcttccactaccgcatcgagtgtcgagagagcacggcacgcattaaggaatgtctcgaagctgacagtggggtctccgttctcgaggcgagaaatggtcgcgcgtgagacagcggctttgtcggcaaggccctgagaggtaaacccatagagcttcctccatgtcgcaatgttctcgccgatctgtcttgcggcaagcttcgtctttatcgttgttggtctcttcatagtattaacgtccaagatatgttacacaaacatttttagtgtctcatattataaatgttaaagagagtttctgcattatttgacagctgcttgatatatcggtatgagcgcatctatgcagaaagtggtgccctggcagagaagctgattgtcccgccatagcgtttggttaatagtttcccaatctaccggactatagctagccggcaggtaatggattcttccgcggacgaccacgcggacgtttcggcttcatagttgccgggtccttcggcttgggcttgcgtccacgcttcttaggttctggttttggagccggcttggataatccaagagcctccagctcagcaaatacggtcttgggggtatgtacccagcagccgtcgtctgttgctggttcggccggggaatccatcagtctccatgcagaggaagggtcgtccatcagttctgcataggacatgttatcgagaaggcctactttccctgccttcctgatgatcctgcaggtggcaactgtagagaggaagttgatgaactcgcttcccatcacagaaaagtcgccctggcagtcggtgtggtccaggcattcatcgttcttgtaacggttgaataccacttccagaagccaccggtcatcatagcaaaggtaagcagtctttagatcaaggtcctgatcggattccaagacgatcacgccaaagaggtccttcttgatggcgcacttctcgggtgaaaaggtatttttcttctgtgcgtttgccaggtaagaagcctcttcgcagcctgctttcttggtgtctttgaaggcatacaggaaccgtccgcccttgatgcgtttctttctgtagacgacatgcgcatcaattccatcaaggatgccttcaaaagaaaggctcttcgctacttatggtgggtagcatatctgcatccccttgagggcgtggcctttaaacggtaggattttccccgacaggaggctgcgttcctaaggtgcgatatggatgcttaaggcaggcatgctggcaaggctctttaagaggtcccatgggactcagcgacgaatgggaggtcacgggcgtctggtttaagaagcgcgaggaagcgcaagacgagctccatgtgagggtggcccacaggaaagggcaggtggtggtgagccccgtatgccacaggatgtgcggcacctgtgacacgcgcgagaggacctggaggcatctcgacatctggcaatacgagacgatcgtgcactgcgcgctgcccagggccgactgccccaaagacggcgtgcatgccacaaggatgccctgaaaggtgcggccgaagacgcacttcacagcgctcttcgaggcgcaggcgataagtgatggcgctctttggcatgaccgtctccgcgatagcgcatctggtgcacgagacagcccacgcgcatatggtgcctgctgggcaaggccgtcgacgaggcgagggatgccgccgactactcggatgtcgtgcgcgtgagcatagacgacaccgccaaaaggcgcggccagagctacatcagcatcatggcagaccttgaccaccagcgtgccatagccgtcacgcagggcagggacaagggggccttaggcaggctctgagacgagcttaaggagcacgcaggggacaggtcaaaggtccaggaggtcacgcgcgacatggccgaggcatactcgcttggcgtggcggcgcagatgccccaggccacacagagcgtggacaggttccatgtggtgcagcttctgatgagggcgacagaccctgtgaggtgcgcagagaggcgcgagtcagcggagaagcacaaggcagctcgcccagacgaagtacgtatggctcaagaggagggagagcctcacaaagcgccagctcgccaagagggaggagctcgatcctgcgaagacccatctcagggaggcacgcgcctgccagatggcagaggcgctgcaggacgtgtactcatgcgcagacagaaaatcggcggcagcagccccagagcgcctctgctcgtggatgatgcactctgccgtggccgagatgaagagcgtggcgaggacgctcaggaaggagcgggaggggatcctgaactggtggaagaggggatctaccaactcgttcctggaaggcttcaactcggtggtccagtcagtccgcagcgccgccaggggcttcaggagcattgcctacttcaggacgatgatcttgctcaggctaggccgtctggacttcacggcccagaagaagctggcatgcgctacccactagaaacagcgaagagcccgattttggaggtcgcgcctatgggtgaactttgccagctattgaagggattcctcgaagctcttgatcctctcgtgctcgtggagggccttgttcgatccacaatcgacctggtcgaggaggtgaggaggcgaaaggaggagcataagcattgaacagatagtgtagaggggaatacggcccggttgcagttcacagccgggccgttgaaccattggtactgcgccgcccgaagagcctgtcgacagcggatacggacatcgctggcgctgctttgtgtatgcccctcactgagtgggttcaggttgatgaggactgtcgcaaccaactattcattgcatgttggacaggcaggaagcaatgaaggccactggcataaagatggattccctggaaggtctgcctgcctgtatgctctgctgccagcttcatgcgtgcttgccaacagttctgattgaattttctttctaaatggccagtgcagcgactttgggaagagctgaggggtcaaatgtcttgagatcataggtggtctggagcttcatccagaattctggcgtcgtgctcagcgcttcggcaagcagccatgccatctcgaccgtgatggcccgcttcccgttcacgatttccgagactgccgattccgatttgccgattgcctttgcaagccgatactggctgatgccaagcggctcaagaaattcttccttgagaatctcgcccggggtgctcataaggtcacgcatggtagtcaacgaactcgacctccttcgcttcgccgttgctccacttgaagcatagacgccactgccggtttaccctgatgctgtattgcccttttctatctcctgcgagggcttcgagccgattgcctggaggaactttcaggtcgtccaatacgcaagcagcgtccagaatctgcagcttgcgcatcaacgccctgcgtacatccgaggggactctcctgggtgtgaagtttgtaccctcccaaaagtctcgtatgtcagcgtcacgaaattccaatggtggctcctgtacttccggataacagaagtatcacatagcagagatattaggtcaaggtgtcagaagaaaagtatcctgcagccttgcgggattcaatttcggacttcatccgaacggctacagaggtcagctacacctgcgcggataggtggtggaacctgtatggtggtggctggagaactccatcccgaggctgtaaggcgaaagagggagcaatatggcaggcggacggggaacattgaatctgacagcatcgttaccgtctgggttctgataactggcatctacaatttgtagctacaagatggctgtgacggcatggcacggacagaaggatcctcaaatgacgcgaaggcttacaggctgcagtgcatctgaggttgcaggcttcacgaagggagaaaagcttcagtccctggccggctgcgaaggcagggccatgacagcagagaccattggcagcgtggcacctcttctgggcgatgtctcgaatgcggagcttgcaagcgctctgggagcagacatcgtgctcctgaacctctccgacatcctgcattcagagatagaggggcttcccgagcatgcgccggaagataccatacgctttgtgaagaagctgacaggcaggctcattggcatcaatctggagccagcggcaggaggggccggcggcgcggacaatatctggcacatgacggaaggcaggcgggcaacggcagagaatgccagacatgcactcgatatgggtgtggacctcatcgtcgtgacaggaaatcccggcataggcgtctcgaacgaggatatctgcactgcgctcaaggagctcagcagtgctgtgggcaaggatgtgattctcgttgcaggcaagatgcatgcctccggggttctctcagagagcggcaggggagtgctcacgcctgaagaggtatgtgccttcgcagaggctgatgctgacatcaccctcatgcctgcaccgggtactgtgccaggtatgacagaggaggtcgtggcagagctcgtgcaggagacgcatgcacagggcaagttggctctttcctccatcgggacaagtcaggaaggtgccgatgtgcagaccatcagaagcattgcgctcatgagcaagatggttggggtcgatatccaccacatcggggattcgggctatactggcatcgcggtccccgagaacatcattgcctactcagagaccatttgtggacgcaggtatacgctgaggagcatggcaagatcacgcctgagatagatgagggcagggaaagggggagcgataggcttccttaaaagacgcttctcatcatgaggaagacagccacggctcaagctatggccgtcttcggtgtgcctgcgactgcgattgcatcatccgatccatcgagctggctctctctggtcacgtccgtaaagtggtgtaaatataggaacgagccagaggctcaggttccaagtatcatttgcaatcaccagagaacaagaagacttgaaggcccgaacatggctcagatcaatagtacacttaaccaggacgagataatgcggctgctcgaagattccagcggggaggcgttcaagctcgtgctgcaaaagtcgctcaacgccgatctgagggcggagtcgaccgagcagatcggtgcggggcgcttgcgagcgcgccgacagccgcaacggcacgagggcggcgcagtgtgcccttcaagaccatggtgttcgacaactacaagcgcagcgaggccgcccttgtgaccaccatggcaaagatggtcttgggcggcgcttcgacggcgaaggtgggtaagctcatagagacgatctgcgacaggggcttgcccgactcgacggtcgccgaggcctgcacgcagctcgacggggccgtcgaggagttccgcacgcggcgcatcgagggcgactagctgtttgtcatggtggacgcgacctacctcaaggtcagagtcgaccacaggatccgcccgatggcgctcatgatcgcgatggggatgaccagggacggggtgaaggagctcatagggtttaggcttaaggcctgcgagtcgcgcgagacctggggggaggttcctctcctcgctgcgcgcccgagggctttcgggctcaagcatgtttacctccgacgcccacgaggggctcgtgttcgcactgcagaaggtctactctaccccgacgtgccctggcagcgctttcaggcgcacttctcgcgcaacgtcttcgacgcggcccccaagcggctgcgggcgtgcctttgcttagagctcgtggagatgttcaactgcgccacgcttaaggaggccagggcccgccgcgacgagatcaccgcagactgagccgaggaggcgcccgaggcgctggcgcgcctggacgccgggtttaaggacgcgatgacggtcatggccctcccgcaggcgacacgcagttgcaccaggacgtcgaactgcctcgagaggctcaacgccaaggggatgcgctgggcgaaggcttcggcgtgttcccgagtaagggctcgctaataaggctcgtggggacctacctcatcgaggagaacgacaggtgggccgccaagagcaaacagtactggctgccggcggtagaggagctatgagaggagaaagggggatctcgaggagatagcccgcacgcagcggcggatgaggctcgcttcgtgacggctcgcaagggcgtttgcttatgaggcaatttacacacgattttggacttgactggcttctctgggcctgtcgggggtacgccttgaacttcgccttggtgtggccactcttaaggccacactcccttatggctgcggtgatgtgcctgctgctggagcagatcctgcacttggccagtgcccccttgtgctctgggtcccgtgatacccggtacttctttcctcgacggcgccagcgagagagtcttcgtgcttctcaggtccgggtgtgccgcgcaagcctgcagtaggtcgacctcggagtagcgagctgcttacatagagctgataagcagatagagtccggcactttccgctatcgcggctacctcagtgcgactatcagtacagccgtccttaaaatgtcgagctccatctttaaggtgcttgttcttccttgtaagatcgagggtacactcctgcttaggtgtgtggctgtttgaggcatgggtcgagttggcgatatcgttgtcggcgcctatctctgggcggactcttgttattgtcgttaagctcaacgatctggcgtttgatctctcctgagaacttcctggagtgcttgaggtccgccatcgcggccccctttcccaaggcctcagtctctcatgggcttgtccctttcactgtagccactccatgtcttcgcgagcaccatcttaggtcgtgcgggggtcgctacttcataattagttgttgtacttagcgtgtgggttctccattgatgtcgacactcatcgtaaggcgatacgcccgaggtgtcattctatacatggaacgaaacttgcgataaaagtaatccatattgctgattccgacttctgaggccacttcaacaatagtcttgttgctgttgagaagtaggtaggcagcttcgatcatctgctgtgctacgcgaatctcgctgaatgtttggccggttgcttgcttgagtagtgctccgagtctgctggggctatatccaaactctgcggcagttgacgagagcgtgcatgttcgatagttgtgctcgatatgatcaagcattctggatatgtcgtttcccccagtagactgaccaattctggtattgctatcatgggctagtcctcgcatgagctccatgaagagcgaggatgtatagcttttcgtcatgatttcgctgaatgcatcgggtgtttcaaactccaagaacaagagtgcaacgagcacctccagtcgtccgtttccggtgccgtgcacaactagatagctgtcacggcgccttctcgacgagatatattcgaagagcagggtagtgagcatacccccgccgggaagctgactgagaaataccatatcgaagaactctttccggaagaccatcgatattacgatgtcaccagcttccttgtacgtgggggaggacctcaccactcctggatcgaagatgatggcatctcctcttcccaatacgtaataggaatctctcacggcaaatccgcatgtaccgtcatagacgtaactgacctccatgtcctggttcacatgagcaggaacagaagtgaatctcgtttcctttatgaggcctacgctcctgtcgctcagcgttcccttccaatcgaagagatatgcttccccttctggagtctgaatccttggagttgtgtcatagatggggctcgctttgccagaatggtctaggtgccattgttcggatggtgtaacggtcctaagagcttcattggcatctgccaatgcatcatgcctgcgtatggtcatctcttaccttagatagtggaatctgacatataccacgaatgattatgacatttaatgcctcaccagcgatacgtaagctattcgtaagtaattgcgagtagcaaagtgaccacgtcatcataaggtggaggatacatgagaagcggattccaaccggatttcttgtggggcggagccatctctgcgtctcaggcagatggaggatggaatgaaggcggcaaaggcgtagatactcaggacttgcgttggcttgatggcagctggacccacgtacagatcgaggagaagcaccgaaacagtccattctccaaagcggagttcgatgctgcccttgcggatgacggaacgcgctattacccgttccgtcgtggtatcaatttctatcatcggtacaaggaag

SEQ ID NO: 322 - DNA, 30910 bp, Unknown
  Metagenome-assembled genome
tatcagtcctaaccgtagcggagacgtctcataagaagtgtatctcctcgccttctcaggagttcatgatcgcgtcaatggaagcttcgcaagccgcacggaacccgtgctcctcaagcgcacagactccgcggatcgtggtgccgcccggtgagcagacctcatctttgagtgcagcgggatgctcgcccgtggcaagctggagtgcggcactcccttcgatcatctgggagaccaaggtatacgcttggcccctgttcaccccatactttaccgcgacgtccgcgtaggcttcaatgaaaagatcaacaaaggccggagcgcaaccggtgatggcgcctgcgatatccatctggtcgctcgggatctcgacgatcttaccgattgaggagaagagcttgactgcccaagcatgctcctcttccgtgaggctgttcttgtcctcgaagagcagcaccccctcgtgcaccttgaccgggatgttgggtataattaactggaggcgcgcgccttgaggcagatgcttcgcataggcctcaaagtcccatcctgaggcaatggagagcagcgccttcccagagagggatccccccagctccttgagcaccccttccacctgcaccggcttgcaggccatcaccagcacctcgcttgactgcgtaagctcctgcaaggaggtgcaggggacaaacccgagacaccccgcattcttcttcagtttgtcctggtgcggggcaaaggctgcgatctcctgtggcttgagtgcctctgtctcgataaaacccgcggtgagcgcgagcgccatgttgcccattccgataaagccgagttttgccatcttaagctcctcttatttcgtagtgacagttaatctgtaaacacgtacttatcgagccatgagaatgcctcttcaacgcgtgcggtcggtgaggccaggttcatgcggatcgtgttacccgggtggagcagacgtccgtcctgccagatcacgctcacgtcccaacctgcgcgaatcagtttgttgatcgtgatgccatgctctttcaggtagcctgaacagtcaaggaagagcaggcagatactctccggacgggcaacgtggatatagtagggacgcaggtactgcccagccatgtccacattctcgctcaagaccgataccagccctttgatccactccgcccctttgccactgtaggcccccatcagggcatatctcgaaaggatatccatctcgttatagcgggtatcctccgccacggactcgatccggtcacgcggataggggttgtagataatgtggcgggagcccaccaatcccacaaggctaaagggcttggaggaggaatagagggcgatgcagcgcatcttggcatcctcgttgattgactgataggaaatgtgacggtagcccggcatgatgagatctgaccagatctcatcggagagcacgatgcagtgatgctttgcgaagacctcgcctgctttctcgagctcttctgtggtccacacgcgttcggccggattctgcgggctgcagaagatcataaggtggatcttgtactcctcgagcttgcggtccatatcctcacagtccatccaccagacgccctcgctgtcccgcaccagcggtaagtgggtgatcctgcatcccacacgcttgaggcagccggcaaaaccgatgtaggccaaactgtgcaccaagacggcgtcacccgcagcggtgaaggcggcgcttgcagacatcacaccacccaagacaccgccctcgtagccgatcgcctcacaggtgaggccctcaaccccattttgctgccagttgatgattgtgtcagagtgttcatcgcgtggggcaacgtagccgaagaacagatacttgatcctgtccaccatcgcgtccgtaatgcaggagggagctttgaagttcatatccgccacccacatggggatcgggtcaaacccctctttgaagctcccggcgctccccgtttccccagaatgtcgactgccattgcgtcgtggccgacacgctctggatccgtggtgtaatcgaacacttcactcatgctctgtttccttcccgaaacgcccagagcagtttggcgttcttttggtatcgttctctttagaggatacgcttgtatcagctgctaccgtaggcaaacttatacgctctaaacaaccatgaagcagtactgttacaaatacaatgtcgtatcctcaaggagatcaagtagcacgcccacagacaacaagcgaggcacatcccatgagactctctaatttctatgccggaaccgaattcaatgctgaggacttcctcggtacccacaagatccaagatggcacctacgtcttcaggaccttcgcgccggcggcgcagtccatcgtgctcaagctcgaggacgcctcagtcccgatgcacaagatcgaggacggcaacttctgggaggcacaggcgaaagtcaagcccggcgatgcctacacctatgcgatcgaccacgccggcaacactgtcgaccacgccgacccctacgggtttgcaatggagctgcgccctgcgcaccgctcccgcatcgtaagcctcgacgactacacctggcacgacgctacctggatgaagcagcgcagcaacgctgcggacaagccgatgaatatctacgagatccagctgggctcctggagaaagaagtccggcgacaaagagtcccaggatccgagggattggtacacctacgaggagctcgctgagccgctcacgaagtatcttaccgaggccggctacaactttgttgagttcatgccgctcaacgagtatccctttgacggctcctggggctatcagccaaccggcttttttgccccgacctcccgcttcggcaccccgaagcagctgatgaagcttatcgatacgctgcatcaggccaacatcggctgcatcctcgatatcgtcccagtccacttcgcaaaggactcctacggcctggccgactacgacggcaccgccctctttgaataccccaacgacgcggtgggcatctccgagtggggcagccacaacttcatgtactcacgcggtgagtcgaggagcttcatgcagtcctccgccaacttctggctcaagacctaccacttcgacggcctgcgcatggacgcaatcagccgcatcatctactggcagggtgacgagaaccgtggggtgaacaacgacaacgtcaagttcatctgtacgatgaatgccgcactcaagcagctcaacccaggcagcttccttgtcgcagaggattccacgaactacgagggcatcaccaaaccgaccgacgagggtggcttgggcttcgactacaagtgggacttaggctggatgcacgacaccctctccttcatgcagaccgacccttacttccgcgcgggcaactacaacaagctgagtttctcgatgatgtacttttggaacgagcgctacctgctgccgctctcgcacgatgagaatgtgcatggtaaggcgaccaccgcgcagaagatgtggggcgactacgacaggaagttcccccaagcgcgcacgctctacctctatatgatgattcacccaggtaagaagctgaacttcatgggctctgagatcgcgcagctgcgcgagtgggatgaggaccgcgagcaggattggttcctgcgcaagtacccgatccacgacgccttctatcactactgctgtgagctcaaccatctctatctgacgcttgccgccttctgggatcaggactacgagcaggccgggttcaagtggctcgacgtcgattctaagacccgcgtgtgctacgcgattgagcgcaccagcaagcggggtgagcgcgtcgcggcgttgatgaacttctccggtgccgcccaaaaggactaccgtgtcccgctgaagaatgcgaagagcatctccgtcctcttggataccgattggcagcgtttcaacggagcgacgccgcagggcaaaaccgatatcacctataatgaaaagacccaggaaatagcatgcacgcttccagctttcggaagcatcctgatcagcatcaaatagatctgtcggccctacccaaggagacacacatgagtgagattggctttaagatcgaagtcctcccgcaaccgctgtctgacgaagagagggaagccttacgtcagcactacctcgtctacgcaaaggcagagcgcgacgagcaccgttccctgcacaaggatctggacacgatctacagccagatcgatacgctttcggaaaatggggacatcctgcgcctagtctcgacgatgaaccaatccgctcacactgtggtctttgcgacggacgcctcaacgctcgccctgcgtgagttccagcaggcgatgctcgccgagggcaagacgatccgcctcgtctccgagtcttcctccgagatcaacagcgtgagagcgatgatgccgagcgaccttttgatcgtcgtgacgacctcaaacgggtttgcccgccgccagcaaaagcgcatcgaggcgagcatggcctacaaggcgatcgtcactgccaactcagaccctgaactccactcacacttcaaccaggtcctacagctcggcgacagcgcgcgggaaggctccgcgctccaccggatctttgcgaccttcggtgtgacctacttcttcgaccggttctttacgcagtacgcccgcgcctacgatccgcagcttaaatagcttacactacagagtttgcagtggggcctgcaccgctgagcggtgcaggccccatcctttcatgctttactatgtacttataggcgcatgctgtgcatccacgcctgcagtgcgtcgtcagtcgcatcccccggaatcaggcgggcgctgcgcacggtcgatccaggtgtcagagcctgaatgcgggccgggccgtcgcccatgcctgaaccattgctggtcgcaaaggggacgatgatcttccctttaaagtcataggtttccaggaaagcgtcgatgatgcggggctccataccccaccagatggggtagcccaaaaacaccacgtcgtaggaagcaagatcagtggcaagcggctccaccgccggccgggcgttcaggtccttcatttcccgggcactgcggcagttcgctgaatcaggccatctgaggtcctctacgctatacggcacctgcgggaagatcgccgcaatatccgcattgcgcagtttcgcaatgctctgcgcgatccttccggtggttccggtgatggaaaagtatgtcactatttcacgatgaggcatgtatcctcctcatatattctttttgccacttctcgcgcagtggccgcgctcttttcctgtagacgcgaatatgggataaagggcgtgcatgggacgcagggcgcttggtgtgttctgctggagtttggctcttgcagacggctggcgcctttggcccgcagctggacacgaattaggcaagatgtcgttaggcgatggatgtccccatgaggttgtgcctgcaaagaccagaggaaaaccttagcccctcagtcaagtaagaggtaggaggtagctgcatggtatatatcggcatagacgtcgctgagcgcttctatgtgctgtcagccgtgggtgaggatggagggaccctcatcgagtcgctcagatttgccaacaccgccggcaggcttcaaaaagctgctcgatcggctgaagaaggccggtatcggtccagagggcagcctggctagtattgaggccacagggcactactgggttgccctgtttaattcatggccgctcatggctacggcgctgcgcacgctcaagaccgatgcgatcggtgcagcccatgatcgcagaccttatgcgctacaagcgctatgagccctgcgcactggacgagcggagagctgctcgcgcttgggcgcgctactgcacctcgctcgttgagcgctcgaccatgctcaaaaaccgcaccacagccatcctcgacggcctgttcagcggctcgtttaggcccacccagcggacgctgctcaaacattgtgccacgccgcagcagacacacttaagcgacaggtgcacactgaaggaagctttctgctccaactgtggccaaaagaaggccgaggagctgaaggccgccacgaaagcgtcggttgcagtcggcttcggtccaaagacgctcaccttcgagctcagactcttccatgaggagtctgagctcgtctgcagccagatcgacgaggtggaattcgaacttacccgcttgctcgacaaggcaagcggtaggtggctgctcagcgtccctggcatctgaatcgcgctggccttaattatcgcaggcgagatcggcgcgctgagcgcttcaatggtgcccatcaggtccttggcctatgctggcatggaccctaccaaaagtaagtccggtaagagtgtggtatcgggtaaaagccatgtccaagcgcgctgcggcagatctcaggtgggccctcatgcaggctacagactgtgtgcgcagatacgacccgtaacttcggcgactactacgccaacagggaaggcgaagacaaaaagcaccactgcctagccctcgcaggtgttgctcgcaagctcatgggcgtgtgtctagccctcatgaaggagcagcgaccctgggagcccacggcaccatcaacccgaacatcttcaggagggggcaaggtagccttttctacatctgaatcgcacttgcactcccagcggggcgcgcgtcagcatgtctactctttatcccatattcacttctcaaggttcctatcgaaaatcttgggtttaccccttgactttaaataacaggtctttcttctgattcaaatctgagccgctctggagccaaagccctgcatctgcgctagacgtaggcacctgcgatatggtctacaatgtgctgtaccatttcggcataccagtcaccgaatgctttttcatggtgaacgagcttccccgcctctaaagcgtcatagctcacgcggatcctgcgatagcgagtcacccgtgagggttcatccttcgtgagacacccctcctgggtcttgaagggctgcatcttagaagtgatcgccggattgaacagtacgtggatgcgtccccggttatctcggtatgcgccgatcgccttcgggtacccgatctggttcgccgcaaggcatgaagcgtcgtccagtgaggccagggtatcctcaacatcctgggctactgcgctgtcttcagccgtagcaggttgcgccgctttcgtcagctctgcccggtctttcactaagtcgcataccatctccagattcccctccttgttgtgttagccctcctagtatgacacgcaaagcgcacatcttcaaagaaagcaggtagaggggcaaaaacactcaggtataggcgaccgaaaacttccgttccccatccacaacctcgagcggtttctcttcgacgagcgccgcctcaatccaggtgttgcggctggcagagagctcctggatgccctccttataccgctcaatctgctgaggggttccttggacgtggagcagcacgtcgccgttatcctcgtttctgacccaaccggtcaccccgacagattgggccaatatctccgcttgatagcggaacccaacggcctgtaccctgccgcggtacctgagtgacacccgccgcagtggccctgtgtaatggatcggtttgtgttgaggctctgttgttgaggacgtatctgaagcctgtgcgcagcgtttacggctccacggaaaatgaaatccaaccataccaatcaccctcttagaccatagtggggataccccttccaggatatccccaccaaacgaacctgtgcggttctatctcttagtgtcgcttatgcggcctcttggccggcatagggcttcttccagcgtgacaggatcagtgctgccacgatggagccgattgcaagcgcgagcagatacatgcccgggttgccgataacggcgacaacccacgcgccgccgtgaggagcggggctcgtgcagccgaaggctgccgacagagcgccggcgattgcggagccgatgatgcaggacggaaggacatggcccgggtcagctgcggcgaatggaatagcgccctcggtgatgaaggagaggcccatgatgtagttcacaatgcctgcgttgcgatcagccgcagaccacttgttcttgaagaaggtggtggaaagggcgattgccagaggcggaaccatgccgccaaccataacggaagccataatgatctggccggaggtggtaccggcagcaagtgcaccggtgccgaagacataggctgccttgttgaacgggccacccatatcgatggacatcatgccaccgacgatagcgccgagcaggaccatgttggtggtgcccatgccgttcagccagttattcagtccagtgttgatcgcaccgaagagcgggttcaggatgaacatgactgcgccgatcgccagggtgccgagcaaaggatagatgagcatcggcttgatgccttcaagcgaggagggcattctatcgcacatcttctctatacccaaggtgatatagcctgcagcaaagccggcaaagagcgccgcaataaagccaccagagacgcaggtggcagccgctacatccggatccccattcagaacggagaggtaggcgatactgtagccggtacgggcgaagagaccgccgacgataccaggggcaaggcccggtctgtctgcgatggacatcgcgataaaccccgcaaggatcggcagcatcatgttgaaggcttcagtgccaatcgttttgaagaaagctgccgctgggattgaggagccgtagtttgcagtacccaaaccaggctggtcgatcaggaaggcgatagccgtgaggataccgccgccgataacgaaggggagcatgtggctgatgccgttcatcaggtgcttgtagatcacatgccaggcggaatccttctccccaccctcagtagcgtggacaacgctgccctcctggatcggagctttgttctgcagaatgtcatcgatcagcttctccggctcattgatgccggcggagacgttggtggagagcacctgcttgcccgcaaagcgagagcggtcgacgtccttgtctgcggcaatgatgatgccctttgcgtgctcgatctcttcctgggtcagcacgttcttggcgccgacggaaccttgagtctcagctttgagggtaacgcccatctccttagcctttttctccaggttctctgccgccatgtaggtgtgcgcaatgccggtcgggcaggcggtgactgcgaggacctcagggaagcctgagtcggagctggtcacctgagcctgctgctcggccttctgagaggcttgctgcttggcggcctcctgcgtgtcacgctccttctcacccttatcgatcacagccaagaactcctctggggtcttggcagcacgcagggcatccgcgaactcctgatgcatcaggagtcttgagagctgcgcgagcatctccaggtgcgtgttgttctggccctccggggcggcgatcataaataccagggtggctggatccccgtccggggagttccaatcgacgccgcccggcagcgtcatcgctgccaaaccggggcggttcgccgcagccgtctttgcgtgcgggattgcgataccatccccgaccgctgtcgagaattctgactcgcgggccagaattgcctttttgtaggcgactttgtcattgatgttgcctgaagcgtcctgcagcgcaaccagttggttgattgcgtcatcttgatctttcgccgaagcgttgatcttgatgccttcaggcttgagcagatcagtgatcttcacgatgctccttcctttcaccacgctttgcttttctatccttcattcgctctttgcagatacgatcggataaagcttatttgagcgtcttcagcagcgcctcgacctcaggacgggttgccagcttcgaggagaaggcgcttgcggaacccgtgcacagacccatcttgaaggcggtctcgtagtcgcccttactctcttcgaatcccgtgatgaagcctgcgaccatcgagtcgccggcgccgacagagtttacaacgctgcccttcggagcttcgctcttgaggatgtcaccattctctgcgaccaacactgcgccctcgccggccatagagatgagcacgttgcgggcacccttctcctggagtctctttgcgtagggtacgacggagtcacggtcgttgagctcaacattgaagatggcgcccaactcgtggttgttcggcttgatcaggaacgggtggaacggcaaaacgttgaccagtaggttacgctcggcatcgacgatcacgttgatgccacgaccatcgagcctgcttgtgatgcgctcatagatgtcactcggaagcatcgaggggacgctgccggcgataacgagggtgtcgcccttctgtatcgtatcaagcttctggtagagggcctcgatgtcctcatcagtgatcttggggccgataccgttgatctcggtctcttccttggccttgatcttcatgttgatgcggcttctgccctctttgacctggatgaagtcggtcttggcgccgtagttgcccatcatacgctcaatctctttacccgtgaagcccgcaacaaagccgagcgcagtggactcgtggccgaggttggaaaggacgatggagacattgatgcctttgccgcctggcagcatgtcctcgtaggtgacgcggttgatctcacctacctgcatattgtcgaggcgaacaatatagtcgatcgatgggttgaacgtgacagtataaatcatgtcttttcctccaaagcctcccggttgtatccaacagtaacgcaccatatacgccaatcagcgtacaactccgcagccgtgcagatattagcccttaagcacggttttgatgttcttgaatcgctgaaatgcagggggtacctgcgtcgtgaggacggtcgctttctcaaggtccccaaacgagactgcagcacagtgaccgaatttgctcggatccgctaccacataggggcgctcacagtgctcaagcgagatccgcttgaccatcgcttcagagcagtcaggggtggtaaaaccttgcgtcgcgtcgatcccgttggagccccaaaagccaagggtgaaatggtagcgcagcagggtctccaacgcctccgggcccacgagggcttcggttgcgctcttgagctccccaccgacaagcacgaccttcatgttcttctcagcgagggaaagcgcattggtcactgaatcggtgacatagcgtgcctttgtcccatcgagcgcttccacaatcaggcgggtcgtcgtccccgcatccaggtacacacagtcgttagggccgacgagtttcgcggcaaagcgggcaatctcctgcttgtcatccttatgcaggcctacccgctcatcaagcgtcagatctctgagtgcctgctcgtcatcgagcgcagtcgccccgccgtgcaccttttcaagcagccccatggaggacagctcgcccagatcacgccggacggtagactctgagacgcccagcttgtcggcgagttcggagacagagaccgtgccctcctctttgagggaatgaaggatttcgttttggcgttggcgcgcaatcatagcgaccacccccaccatcccataaaaaacgcactgacaaagtccaacacggatggctttttgtgcatcacagagccaaccgccgtcaccggtaccagggcaaaatgtgtacgcaaagccatgccaactcccatccatcggatgagcaacgttcattggctatattcgactacttttgcgcacttttgacaagtatttggcggtattttttcaaccattcaccgattctttgcaaattcgtgcaaattatttcaagaatgagcaagttatctatttgatgagggcatcgataacgtccatggaggcactgagatcgataccattgtcggcgtcttccacatccttgttgcgctcaactaaggtatggaccgcatccatcgctttctgcgtggctaccgggaggctgtcaccgtacatcgtaagccccatgatcagactcgagaagatgtcaccggttcccgggaaatactttgggacgacgtggatcggataggtaaagtactgctcgctctccgcgtcgtaccccaccaccgaaggctgctcttcgacaatgcagctcgtgatcaccactgagcggacgccctgagagcgcagattgtccacgatcgagttagcgtgaagctggctgaaggagtgctttgccttcgaaggatcccggcttgacagcaggcaagcttccgtcacattagggatcgcgtagtcagcgacctccatgatgcgccgcgttctgtcgaccgcatacttggatactccgtcgtagagcgccccgtcatcccccataatcgggtcgacgtagatgcgggcaccttcaattcccttacgctcgcagaaatcagcaatgatcttggactcctcgtcggagaccacaaagccggagaagatagcgtcaaactggaagcccatcgcgtcccatgcggcgagggcgtcgcgcacatagagagtcgtatccatctgagctactttttcctttgagaaggtcgagctcacgagtgcggtcggcaacaccgacaccctaaatcccatccgctccaggatagggattgaggctcccagagagatcgttccatagctgcagtaatctgagatgagcaaaatacgctgtttcaaaaccaaacttccttacgcgtgaagaggatgatgcactattccctataacttttcaaggttaacgcatctttttggccttggcatcctacggacgcccgcattgtgccacagccacaaaaatcaaacgaaacggcacaagtttatcgccttattcgtgctaggctgaactgtgaaaggcgtgccgcgactgacggataaaacgtgggctaccatggggaagcgacacactaaaacaagccgaccgtctgggcaatctcttgtacacaatacgatgaagctcagaggggaatgtctctacgtgtcttcgttgcattgtgtcgcacaatacagaaagggagaccatgcaggacttatgtgagttgcttcgcgccaactcctatccgggccgcggtattgtggtcggacacaatcgcgtctactactggatcatgggacgcagtgtcaacagccggaaccgtgtttttaccctcactggtgacgggatcaagactgaagcctacgacccctcaaagctcgaagacccctcattgatcatctatcatccagtacggactatggacgatgatctcgtcgttacgaacggcaatcaaacggacacgatcgtcgagaaaaaggacttcgtcgccggctgccaggcacgccgctttgagccggatgcgccgaacttcaccccacggatctcttccatcctgcactccgacggctcctttgcgatctctatcctgaagcatcaggcaggagaggccgaccgctgcgagcggcagttcttcttctatgagggcgtcgatgcaggtgaaggctactttatcagcacctaccaacacgacggcgatcctctcccgagctttgcaggagagcctatccacatccgtatgggcgaaccgaaagaggtctgggaagccctcgatcaggacaacaaagtgagcctgtatgccaatgttgatggcaacgtcacgctgttcaatgcccacacgggagactaggagacacgcatgaattcactcgagcttaaatacggctgcaaccccaaccaaaaaccgtcccgcatctttatgaaggatggctccgacctgccggtcacagtcttgaacggcaaacccggctacatcaacttcctcgatgccctgaactcctggcagctcgtaggtgagctcaaagccgcaaccggtctgccttccgcagcctccttcaagcacgtgagccccgccggagccgcggtcggcctacccctctctgagactgaaaagaggatctacttcgtcgacgaggagggaccacttaccccgatcgcctctgcctatatccgcgcccgcggcgcggaccgcatgagctcctacggcgactgggctgcactctctgaagtctgcgacaagcgcaccgcccagtacctcaagcatgaagtctcagatggtatcatcgccccaggctacaccgatgaggcattgaccatcttgaaacagaaaaagaggggcaactacaacatcgtgcagattgatccttcctacaagcctgccccagttgagcagaaggatgtcttcggcatcacctttgagcagggccacaacacctcaaagatcgatgagaacctgcttaccaatatcgtcacaaagaacagggacctgacccctgaagccaagcgcgatatgatcgtctccctcatcacgctcaagtacacgcagtccaactcagtgtgctacgtgaagaacggacaggcgatcggcgtgggcgccggacaacagagccgcatccactgcacgcgtctcgcaggcaacaaggccgatacctggtacttgcgtcagcatccgaaagtgttggcgctccccttcgtcgacgacatccgccgcgccaaccgcgacaatgtaatcgacatctatatctcaaacgagcacgacgacgtgctgcgtgacggtgagtggcagaagtggttcaccgaaaagcctgaggtactgacccaggaagagaaggaggagtgggtggccacccagaccggcgtcacgctgggctccgatgccttcttccccttcggcgacaatatcgagcgcgcccacaagtcgggcgtcagctacgtcgcagagccgggtggctctattagagacgacaacgtgattgagacctgcgacaagtacaacatggtcatgtgcttcaccgggctgcgcctgttccatcactaatatatggatgaccgatacctacattgaggggcgcagttcatcggaacggcgcccctccttgtctcaatctgagtcgttacgactacttcttataggtgaggacagcctctcctgcctgaactgtaccggtcttgatctgatcgacagacttgagatcgtcagtgttggtgatggccataacgactacatcgtcgtagccagccttcttgatcttatcgtctgagaaggtcagcagtgcttcgcctgcctcgacgtggtcaccttgcttggcgaacgccgtaaagccgtcacccttcatctcaacggtatcgacaccgacatggatcaatacctcagctccatcatcgcctttaatcgcgatcgcatggagattaggagcgccgatagccgcaagctcaccagccaccggtgcgtacacagtctcgccagatggcttgatgccgcagcctttacccattacaccaccgctgaatacagggtcggatactttcgccaactcgatcgcatcgccatttactggagctaggacttctcctgcagcagcggatacgctcaacgcttccgggcgagcaggcttagacacttttttgaaccgatcaaagaaccccatggcattcaccctactctcttatgtgcgccgtctataccactgatctcagtgtaaaccaacttttcacagtctcagcgataaatgtgcccaggggtggtgaaaatagttaaccaatcgtaaagataggtcattcgttcttcttccctccatggcgggcagcctctttcttggcagcgcactccggacagaggccgttaaagatggtcgtgtgcgaataaacggtccacggataaccgcctttggccttcggtcttagggccgccgtggcctgggagtcgagagttgtgtcttctttcagcggcacatcccacacccttccgcactcaatacagatcacatgcgcatggttgtcggttctcaggtcaaaacgttccccgccaggagctttaatcgagagaatcaaaccttcttccgccagaaggtgaagatttctatagacggtggcacgactcagatgctcatccttttcatgcacagagacataaacctgctctgcagtcggatgatcggtacgtgaacggacctcttcgaggacgagccggcgctgtcgcgtattccttctctcagtcaaaacgctcacactcctttcggtcacttaaaacggtcacttaaaactaggcgagaatagcgtttctcagtactaataacatacctctctagagaaataatgccatgcttttattccagaaaaaatattgcttgactaattctttgttttatctattataataatcattcctaatgacagaaggggcagttacagaacctcagatcagaggtactgctgcgaccccaaacctgaagcacaaggtgccccagagaagagaggattgaattaattatgaagtttgtatgcccaatctgcggttatgtggaagagatcgacggagacgagcttccggccaacttcaagtgcccccaatgtggctgccctggtgacaagttcaccaagaaggacgacaagaacacctgggactccgagcatgtgttaggcatcggcaaggccaaaaacgtcccgcaggacatcgttgatgacctgcgcgccaacttcaccggcgagtgctctgaggtcggtatgtacctcgcaatgagtcgcgtcgcaatgcgcgagggctaccccgagatcggcctgtactaccgtcaggcagccagcgaggaggcagatcacgcttcccgcttcgcagagctgctcggtgaggcgctcaccaactccaccaagaagaacctcgagatgcgcgttgaggccgagaatggcgctaccaacggcaagactgatctggctaaacgtgcgaaggctgcagggcttgacgcaatccatgacaccgtccacgagatggctcgggacgaggcgcgccacggtcgtgcttttgagggtctactgaagcgctatttcaacgagtaagcgctcccgactacctcctccattcggcccttttagagcaaacgtgccacagctgatttgttacagtacattatttgtagttcctcccagtactaaaaaaatgttactgacttaccataattcactattccctcataaaactgggaactgtttttgtttcgatacttgttgcaatctgctccatggcctgagcgacgctgtcttggtcactagggccgatatgccacttcacccgggaagcgacagtctcatccgcattggctaccccaacactgttcgtgaccgcatcgagcattgcaagatcgttctctgagtccccaaagcacacagcctgctcattgtcgatgcccagagcctcgatcagagtcttgacggcagtccctttgtcgcagtcagccgggcagatatcgatcagaggggcgatgagcgaaggcagaacaaagctcaaatcagggaaggcttcgcacagttgatcacggacctcgcagcggtgctggtagtccccttcgatgtggacgttgcacttgattacccgctcaggtaccttcgtgctcacctccccttctgattcagagaagatgaccgggtggccatagagacgctcaggatgttgtgtgatcagggtagcccccttatctgccgccacgtcgtagacaccgagtgctgcgtccccaagcttatcgagataggagacgacctgcgtgagcaggtccgagtcgacagggacctcggcgagctttttgccattcaggtagacgatctgtccgttgcagaaggcgccagtctggtagagcgactcgtcgccgcccaacatccaccccatcgccttgggtaccctaccggacaccggaccgacgcaggccccgtcatcgagcaacgtatgcatcgcctttgcagcgcgaggtgagatgccgggtgcactatggggaatgagtgtatcgtccaggtcagtcagcacaagcttgatcacaactacctccgttcaacaccggtgagatgcagttagtctcttacacccattctgatgcctattggcacagatttggaggatattgccgctttaacaaagaccacaagaatacatttaggtatcatgcgtagcagtaactatacgttatgcccacactcctatgatacgcgagcaacagatggggatgtatccatggctaaacaggtaaagatcatcctactgaccggctacctcggcgccggcaagaccacgatcctcaaccatatcctcaacaacgaccaggggattcgtgcggccgtcatcgtcaacgatatcggcgaagtcaacgtcgacgcaagtctgatcagctccggcggactctccaaggctgacaagctgatcccgctcaccaacggctgcatctgctgcacgctctccgcggacctgcagaagcagctggactcgatcgcccagtccaacgatttcgattacatcattatcgaagcctccggcatctgcgagccgatccccatcgcctacacgatctcgagtttctgcgatgaggcgaccagtgcggctccgcttgccctcgacaatatcgtggcagtcgtcgactgcgcccgcatgtacgacgagttcggcggtggcaaagatctgttgcgcaaggacatcgacgacgatgatatcgagtcactgctgattcagcagctcgagttctgtaccacggtggtgctcaacaagtccgatctcgtgaccccggagcagatcaaagagctcaaagcgatcgtcaggggattgcagaaggatgcgaagatcgttgtggctgaccatggcaacgtcccgatggacgagctcttaaacaccggccgctttgacttctcaaaggcctatacctctgctgcctggctcgatgcgatggatcaccccgaggagcatgagaatccggaagtcttggagtacggcatctccaccttcatctatcagcgtcaccagccggtggacgtcgacaggttcaatgagtacctgcagcggtggccctccgcaatcatccgctgcaagggtgagttctggtgcgcgcaggatcccgatatgtcctacatctttgagcaggcgggccatcaggtttcactgaccgacaacgggctctatgtagcctgcgccccgaaagaggagcaggaagccatgatcaaagagacccctgaactgctcgatgactgggaccccgtcaccgaagaccgtgagaccaagctctgctttatcggccgcaatatggaccaagatgcaatcaccaaagccctcgacggctgcctggttgcctggacccccgaggccgacgaggcgtaatcaggcatatatatttattgcttaaggaagggattctgtcatgtgttaccgtgtgcagccactcaggttgccgcagctccagatggcactcgatctgtatcgaaagaccgggcatgctcgggtcaagccggctccagatcctccgaaggacgcctatcccggctccaaactgcccttgattgcgccgggcgatgagcaacagctggtagcggtcgaggacacctggggcttcccctcccctaagcagccgagccgccgcatcttcaatacccggctcgataccgctctgaaagagcagcggggagactacgggatgtgggccgacccgatctcacagggacgctgcctgattccggtccgctcattctatgaagcctggacccgccccagcaaagagcggccctctgcgcacagccaggtacaatttcgcctggcaggcttcaagttcttcctgcttgcgggcatccgccaggatggactgtgctcaataatcactacgacgccgaacgccgccgtcaatcagtttcataaccgcatgccgctcgtcttgggtcccggggagtcgagtatctggttgggtcccaacttcgcggatttagccgacagaagcggcatcaaccttacctatgcagtagagaaggagtaatagccgtatgcgtatcgcaatagtcaccggagcctcttcaggcctcgggagagagtatgcccgttggatcgacgagcacggaaatgtcgatgagatctggatcatcgcccgcagggctgagcgcctcgaagagctcaagaaggaactcaagacgacaactaagccactcccgctcgacctgaccgacacccactccatcgacaccgtcgagcatatgctcagagagagcgccgccaaagaccctgctttcgatgtttcgtttctgatcaatgccgccggcttcggtaagttcggtacctatgcggatatgacccggcaagaggtggactcgatggtcgacctcaactgccgcgcgctcgtggacttgacgcagatttcccttcccttcatgcacaaagggtcccgcatcatcgaggttgcctcgagcgcttccttccagccactgcaggggctcaatgtctatgccgcttcaaaggctttcgtaaggttctacacgagagcactgcggtttgagctgatggggaaaggcatccacctcacggcggtatgccccctgtgggtcaaaactgagttcatcaaggtcgcccgcgagacacagaatggacagaccgtcaagcacccatggcccatgcttaaccccaagcatgtggtgagctggtccatgaagatcaatgcaaccaactacccgatcgcaacctgctgtgtcccggcattcctgatgcgcatatgcgacaagatcctccccaatccggcgatcatgtggatctgggaaggactccgcaggatttagatcaacccgcaaacgtcggaaaaaaattcttcgctctctggggcatctgggtcacgaggatctcactgttctgacccacgatcgtggtgatcgacccgtttggcacccgcatcgtcagactcgtgagcaaccgcgacgtctttgtcatctcgctaaactccctcagaaccgagcgcagatacgccccatgccccaccacgaggatgctgtccccgctgtgagcttgctggtacatcttcttgaaagctttgcgggcccgtctacgtacctgctcgccggtctctcccccgacttcagagaagtcctgctgcataaagcagtgcacaaaggcacgccgattccttttgtagggtttaccgtccagctccccgaaatcaaactctgccagattatccatcttcttgatcgggagatcgaggctctggatgaggcgcttcgcagaggcaaccgcacgcggcaggggcgagcaatagcaggcagcaagcttgattttgttgagcgcctgagcggtttcatcgagaaccggataggcttgcggggcaagctctgagtcgacccttccgccttggataatgtgatccttgttgtacagggtttccccgtgccggacgtagtaaaacacgactttcttgctcatggtccacctttcctaaaacaactggactatatacctaaatacgtgaggtctgcgctgctctgcgcatcctcaccacggtttcaaaaacctgtgccagtcgccgacacaatccctcggcacgcccatacgcttgaatataatatcggggaacatgtgagaggggacgactatgaaataccaatgcaaggtaacagtacttgacgccaaatgctttcctcaactgcagaaaaagtatctcgccgatcccaagagcggaccgtgcccctgcttcaaaccggggcaggaattcctcttcaagcgcgacgaggaggacgatagcttctaccacctgggccgccatacccgtacggatggcggcgatttcccctgtggtgaagcctgggactgcgtttcacgctacatctacacagcgctgcaaggcggctccatcatgcacaggtggactaacgacgagcgcgttatgatcacctgctgcaacgatggcacccgtcccgtcatcttcaagctggagcgtatcgacatccctgagaacgagcaggaaaaggaagggttgtcccaacagaatttcaagaatagcgccaatgacgcctatacaggctgatagccttattgccaactccatctaacatcttttttcaaaagcaggtactataatatgtgggaggtacgacaacttcgaccagtcaacagcgcatcgactacttgcgtgaacgggatttcgtcttgcaaaactgatcggtcactttggatacatcaaggatgcatcgaccgtgatggatttctcaacctggtcggctccactatcgagcaaattctctctaccaaagtcgcaaccatgatagagaaacggctgaaaacgctctgtggcggcgaaatcacgccggaaacactcagcgcgcactcccctgaggaaattaagacaatcggggtgtccatgcgtaaggccaagaatctgaattacttggcggcccatgtgaccaacgaggatctgaacaccttgacaggcaaagatgataaagaagtctacacgtggctcaccgcactgccggacatcgatgagtggaccgtgcacatgttcatgatcttccatctgaaccgcctggacattttgccggtaagtgaccttaccttccgcaaatcatttgaccctgttagaccactgtagatatagggaagcgaaaagatgtcacgggatcaccctacaatcgggttcgactaagaaaccgacctgaagaaggccccgcatgctcgacatgatacgacagctagcaaagtagctgacccgcaaggagaaggtcgcacttaccgccgacctcaagcagatgataggcgagaagctggcagcgcaggccgacaagtccgccacatgtccgcactgcggatgtcctgagtccaccaggcgcgagtgcgacggcgtctaccaaaccaccagaagaggctacgtgggtatgccgattgcgtttcctaagtactgggagcaggcgacatgacctcatatccgcagtggtctaacagagtcaaccatttgagtggctctatggtgcttcgatgaccgacgaaaaggtacagcttgtcgtctgcgatctctggaatccctacagctcctacgctgcccgctatctctaccatgccctcgacgatgggccgatcgacgcaggcgacgcgaaagagcaattgggcctttaaccacatcaggcagcagttttctgctgcctgatttcatggatgtatttatattgacagctctctcagaaactacagctcacagacattggtgggtctccctgccagatagttctgtacattgtcgaactcgatctgggctcttctctccagcccctctttcgtgaggaacccaacgtgcggtgtgagcaccagattcggcgcatgcagcagcggatagtcagcaggcaggggtggctccacatcgaagacatcgacgccggcacccgcgagtttcccactccttagcgcgtatgccaacgcttcgttatcgacgattgcaccacgggcacagttgataaagaccgcgccatccttcatctgagcaaactgagccgcaccaaagctcttctttgtctgatcattgagcggcaggtgcagcgacacgatatcgctctgcttcaggagctcctcttctgaaacaaaagtgactcctgcatcgatcgcggtttgagaagtatggcgcgcatacccgagcactgttgcgccgaacgcggtaaagagtttggcaaccgcgctgccgatgtgaccggtcccgatcagacctaccgtcttgccggtgatctcctgcccaacaagccccgcggaggtcttccccatacgggctgcggtatctcccaacagcactttgcgcagaacatcgagcgtgagccctacggtgagctctgccacactcgtgtcagagtacccagcgcagttgctcacgacaatatgctgcttcctacaggcgttgagccccacgtgatcgatcccagcgaaagcgactgcgatgtatttcagctgtgggagctgggtgatcacagaatcaggtagcaggttgtttgcgatcattacgatctcagcaccgcgggcacgcgatgccaattcatcctcatcactagttttatccggataagcaataaattcgttgccgtcatccttcaacggttgtgccagctcattgagtttctcttctgagatgccgagcggttccaaaagtacaatacgcatgagattgtgcctccttgagtgtgcgcccttccctaaagggctccaccacctacgctattcccaccacacgtgtgtcctgactgtccccgatcaaaatccatgatcgccaagcatacggatcgcgccagatcacacgaggcgacacagccgtccatcaaacagacgagagaaagccacacgcgcatgccctctttgtcgaggtatctgtgggatcgtgatgctctccccggcagtggtcaagaccttcactccaggtatcagccgccatatcgattcgctccaccttgaagataaccgggcgtattccgtcattgcaggatacgataactataccttcaggataggacaagacttatgagcaagattgtcatcgttggcgccaaccatgcaggaacggctgcagtcaatgcgattctcgatagccatcccagagacgaggtcactattctcgatgagaacacgaacatcagcttcctcggcggcgacatggccctctggatcggcaaacagatcttgaagcctgatggcctattctaccagactgccaatgacttcagagctaagggtgctacgatccacctggagacccatgtggagtccatcgactacgacaacaaggtcgtccacgccgttgagagcgacggggactttttcggcgagtcctacgacaagctcatcctcgcaaccggatccctcccggtgctccccaagttcccaggttgcaacctcgagaatatccagaaagtgaagctattccaggatgcccaagccgccaccaacaagctcgacgaggtggcatcaagaacgctggcgtagtcgtcacggtatcaatctcgccttcggtgagaacggcaaggtcgcccttgtcgtcaccgacaagggcacttatcctgcggacatcgtgacactctgcgtcaacttcaagcccaacagcgcgctctatgagggcgccgatttcacggtgccgccgaacagggcgctcgttgtcaaccatcatcaggagacctcaaagccaggcgtctacgcgatcggcgatgctcttcctgcttcgacaacgcaaaagacggcgagcgcgcctacatcgctctggccacccacgcagtctgttccggcatggaccacagcgacggcagacaccgcgctcgagagcctaggtgagaacgactcctccagcatctgcatctacagcttcaagatagtctccatcggcttggcccagggcgcgggacgtggcgggctacaacgcggtgatctccgactacaccaaggtccagaaggctaccttcatcgagacctcgaacccggagttcacagtccgcatcgtctacgacacgacgacgagacgtcttctgagtgcgcaggtagcgtcaacgtacgacgtgtccgcagacatccatatgttctcactggtgccccaggagcatctcaccatcgatagacgggcgctcacggatatcttcttcctgccgcccttcaatcagccctataactactataggatggtatcgtatcaggcagtgttgaagggttagcccccaactcgacaccttccatgtgtaccccatctgcaggcgcaggagctcttcggttcccgcgcctgttctcttgtggtggtctgggttctcttcaggtgttgcgctgagccccgaggtttacaactcagtgcaacgattggctgccctacagtacctgcgcctgagcttcatcctctctcgcttcagcgaccgcctgccaatagccttctccccacacgttgagcgtgtcgagcacggggcgcagtgagtagcccggatcagtaagctcatactccaacccgaggaaagacctccggataacaccgtgcaggtcaacagccccccatcgcacgcaggttctgcgtcaggaccttctgggagatcttctcgaccgctttcttgagctccccgaagtgcatcttgccgttcaggagctcccggatgatcagaacgcgccaacgctttgagataagcgtaagcgtggtctcgactgagcaggccaagagcttctctggcaggaatttcggcgccggttttggcactaagacgaatctgtgtgcggtctgtgaagaggattctcttatacctacctcatcagtttcttttagatatctacagcactctattgtgcctacttctgtttgtatgcctttgagggcaaactatcaattagctcaaaagtgcacagcaaacagagaggaggcacgctacgcagttgtagcagcgaacggcaaagcgggaagactggacatccgtcaagcgtggacacgatgtgaccgcgcttgtccgccgcgagagtaagacgcaggcacagcacgccctgcagaaggatctcttcgatctgacgaccaatgacctcaagggcttcgacgtgatcgtcggcgccttcggcgagaggacccccgagaccctgtcgcagcaccagatccccctcaagcaccttacagatatcctttctggtgccaatgtccaccttatcgttgtcggcgacgccggcagtctctatgtggatggcgcactgaccaaatagctcgcagacagccctgacttcccaaacaccttcaagccgctggtaaccaatatggcgaagacgctggctgagctgcacaagcgcaccgacgtcaagtggacccacatctccccggctgcagacttccaggctgacggcaagtgtcccggctcctatcagctcggcggcgagaaggttccatacaatgcagcgagcaaatcccagatcagctatgcagactatgtaattgtaatcacggtggtcgaagaggctgagcacaccgatggtgcctccatccagaagcgcatctttgccgtagagaagtaaggcttttctctcgtcgaaggcctgagccagcggcatagcgacaggccaggtggtcgccgtgtagtgtgctgagtcctgagagctggccatatttggtttctctccccaaattctgcacgcccctgtcgcaatcgcgtcgcccaagtgaggcacttgatatactgagaggaactgaaaggagctttcgggcaatcagaccttaaataatctcgaaggagggcatatgagtcagaagaaagaccccaaggacacctgcgtactcgttaccggcggagcaggctttatcggcagtcacacggtggtagagctgctcaacaatgactacacggtcgtaatcgtcgacgacctctccaatgcatcggaaaaagtcatcgaccgcatcgatcagattgtcgggccggacaaggcaaagaacctgaccttctataaggcagactgcaatgaccgcgacgcaatgaatcggatcttcgatgaaaacccaatcgagcgcgtcatccactttgcaggattcaaggcagtcggtgagtccgtgcagaagccgattgagtactactccaacaacctcggcaacaccctggtactcgtcgatacgatgcgcaagcacggctgcaaggacatcatcttctcaagctccgcaaccgtctacggcgtgcctgacaagcttcctctgaccgaggagtcccctaagaagcctgcgaccaacccgtacggttggaccaagtggatgatcgagcagatcctgaccgacctccacaccgcagaccccgagtggaacgtcgtgttgctccggtacttcaacccgatcggtgcccatccttcaggactcatgggtgaggatccgaaaggcattcccaacaacctgctcccctatgtcgcacagaccgccatcggcctgcgtccgtacgtccatgtctacggcgacgactatgacaccccagacggcactggcgtgcgcgactacatccacgtctgcgacctcggcaccggccatgtggcagcgctcagatggatgaacggccgtaccggcgttgagatcttcaacctgggtaccggcaggggcacctcagtcctcgagatcatcaaggccttcagcaaggcctgtggccacgatatcccctacaagatcgagggacgccgcgccggcgacgtcgctgccaactacgctgactgctcaaaagctaaacgtgagatgggctggaccgccaggtacaacatcgacgatatgtgccgcgacagctggaactggcagtctaagaatccgaatggctatggagactagctgtgggatcagaaagtgaaccgtttgtagcctacctggctcagaaacgtcctctgattgaagactatctcgagacccatgccgcaatccccaactctgaggaccgcaccgcctcagatatgaaccgctacgcgtatagtccgctgcgccgcttcaccgcaagcggcggcaagcggacccgccccgcgctggtactgctcggctgtgaggccgtcggtggaaaggacgagcaggcgctctcctgcgcacaggcgctggagtacttccagtccgccgccctcatccacgacgatatcgccgacaaagggcagatccgccgcggtgagccctgcacctatctcaccgagggcgtgggtgtcgcaatcaatgtgggcgatctcgggatcgtgcgcacctttgcgggcgtgattgaggacgacagcctcccgacggagaccaagctcgacgccctgcgctatctcgcgaccatggaggagtgcacagtgcagggtcaggcgctcgatctgggctgggtccgcgatgggcgctgggacctcacctgcgaagattatctgagcatggcgaggcataagactgcctactactctgccgctaccccgttggcgttgggggccctgatcggacagggcacagcagaacagatcgagacgctccacggattcggcctggacgccggccttgccttccagctgcaggatgaccttttgaacctcgtgggggatgaggagtcccaaggcaaagacttcagaagcgacctcaccgaaggcaagcggacgctcgcggtcgtgtgggcactctcccacctcgacgagcagcacaagcaggaactgattgggctgctctcctcccataccaccgaccccaaagaactcaaccgtgccttcgatctgatcgaaggcgtgggcgccatcgacgcggtgcgcaactatgcgctcaagctcgttcactccgcacagaaccgcttggaaggcgtacactttgaggggaatacccgtgacattttggtggcaatgaccaactacttcatcagccgacgcgcatgatttacgttagccatatgcaacgaccttgttgatttgcatgcggacagccaccccattccagccttgatatgcgaggtgtctttaagaactatgaaagaaaataaaatggacccgattcttgagggcatgaaaggcgtcgccgtcgaagacattcaggaccgtctcacccatctgcactacgagattgacaagaaggagcgagacagcaagtactttggcccctcaaccgccaacgcgattgtgaaattcagagtggagcacaatctgcccgtcgggcaggaggtggataaggacacctggatcacgctcgtcgatgagtgctatgagatgggcgaccgtaccctctatctgcgcctgccgaacttccatggcaacgacgtgcgagagctccagaatgccctcaacatcctcggcttctcttgcggcgaggcgggtggctactacgatgcacacactgaagcggcagtgaaatcctttcaggagagcgtgggccaactcgctgacggcatggccttcccggagacctttgacgcaatcgagcgcctccaccatgtctgggccggcaagccggccgcgggcccccatccgatgggcgctatcggctatgcccgcgccgctaatgtgttggagagcgtacatatcgcgatcaccggtgatgacccgatcagcagaaatgtggcaggccgtatcttcaacctcgccagcgccaccgccaacgactccggcttggagctcgtagatgaccctaaccacgtttcaaaagactgccaggcaatcttcatgattagctcaaaaccgcttccggaaaactccaccaatgtgccgaatattgtgctcgatgatatcgacacgctgggtagacgtatccacactgcgcttgcttcctccgtcgagaaacagccgctcttgcgcgttgagctgccagtgggagaccactacaatggcacctttaccacgagcgatgcgcagaccttagcggtctttctgcttgacgcgatctgctctgcctttgcccaaaatggttgaactctggtgtagcgcaagaggggtacctttgctacactaaggaagcgctgaagttctgcttcagttgatacagtggtgcatcgtccaatggctaggactcgggtttttggtgcccgcaataggggttcgaatccctttgcaccagccactgtaggcccaaggctccgccctcctttaggggacgggaccttttcgcgtttcacagctacatcgttagccgcgagccctagcgttattgctgctatcgcaatcatatctagggaaatgatgattaatgcctatgccagccgcgaaaggccacgtggctggccctttctagcacatcattggaaattaatcatcatttctctagctcctacctaagagagctcccgccagcgcaaggccggcgggagtgaaaggcgacagtgggaggccttatcagctgaagggggttatcgttattgtttctcatctaggcgctcgtacacgtcgatgaaatcctgggcgacaaccctgaaggtttcagcttccatcagctgatcctccgcgtgcaccaagatgagtgagaaagcaacgttcttgttgtcgattgcagactgccggagaagcttcaggtgggcggagtggcctttgttgaactccttggtgccgctctcgatcatcgcccgagcaccct

SEQ ID NO: 323 - DNA, 32879 bp, Unknown
  Metagenome-assembled genome
ttccctaggatcatggcatagatcttctgctccaagaacatcgatgggtagctggcgtccgcgttcaataagatgatgaagcggatccggccttctgtacctacttctgtgagcgcttctatctgaaaccggaagggtgcacctttatcgacggcaaagaggacaacatcgtgggcgccaaagccgccggcatggctgcccaccgctacaccgattcccagaatttgaccgactggctgcaccaacaggatgtgcagttctgattcctaccacttatccgagcgaggcaaagtgtggctttcctactatgtagatcttctttccctgcatcagttcagtgatggattgcagggttgggtcttgggtccccgcccgaaaacgcgcggctacggtcacctcagtggcgtagtcctggttctgtatcaatccgccacccgtctccagcagatgaattaccatgtcatgtttggcatacggaacggtgagtgtcacgtcgacaacctctgtcatttcgaccaacaggttatcttctcgcgcctgctcaatcgcttcctgagtgcttgtggcatacgcccgaaccaagcctccgatcccgagcagaatacccccgaagtaccgcgtcacgacgcaacagacgtcacgcaggccactgtcatgcagcacctgcagtatcggcatgcctgccgtcccatgcggttccccatcgtccgaagagtgggtctgcccgccggagaggacccaggcaggcacgtgatggcgggcagcggggtacttcgcttttactgacgcaataaaagcattcgcctcgtcgagtgtctcgacgtgcgcgagctttgcgatgaagcgtgacttcttctcacggtactctgcggttggattggtaccggccttcgatgtcataaaagattgttgagttaccacggctcgtaatccttattttcagagttgcacgaagtgggcctatgagccgggttctgtcgaggacaatcatctatctaggagcaccgttaccggtgccctcaagcgcacaacccggatgccgtgcgggtcacacgatcgcatccctatttgtgtttgctccagaaggggcttaccaagccgccgtgtcgccacgacgctggtggtctcttacaccaccgtttcagcttttctctgacctcaaagaggcagtgggagtcttcttttctgcggcgctctccgtcgggtcaccccgcctggccgttagccagcttctcaccctgtggagcccggactttcctcataacctcacctgtaggttccgcgattgtccggcccacttcgctcctatccattgtaccatgatcgcccagcacacacagaaactgccgagctaaaacagaagggccatacacttgtaaggccctttagatcgcttatatatgtcagatgcgattagtcgaggtcgtcgacgttgatgcctgcatggtaggcaggctggtcagtgaggacggtcttatcggggttagcatcgtcgtctgcacccacattgtcgtccgcctgatcgttgtcttggctgttatctacatcagcagaagccgcaggcgcgctgtagctgttgtcagctgcttcagagacgctggcgctcgaggatgcgtgatcatcatctgaagacgggaagactgcgtcggcgtcgtccataaagtgctggatcagctctttgtaggacttacggaagtcctcgagggacttcttgagacgctcggtctcgtcgatctcgctttgcttttcattaagtgcctggcggataatgtcgcgggccttctggtctgcctcatccttaacctgctcgccgtactccttagcgtcagcgacgatcttgtcagcgctctgctgagccacgatcatgacgcgggagatctggtcggcagaagccgtcgcctgcggcagctgtgcagacttcgcttggttgagatcccgctgatgttgctgctccaggttctggacctgtgactgggtagcggagagctcatgctctgcgctgttgagtctgctcttgaggtcggcgattttctgaagcatcgcgtcaacttcgctggaaagctgctctaggaaagagtcaacctcctcagtgtcatagccgtgcttggacggggagaatgtcaactgttcgatgtctgcgggtgtgatagccatctcaatacctttctatgtgcgtcagtgtacgcaccttagccgttattaacaacactagcaactataccaatacccttacaataagccttttgatcagccctaagaccaagaccgcgataatcggcgaaaaatcgataccgccgacgggaggaatgatgcgctggaagaccctcaggtagggtcctacgatcctgtcgagcaccgaggcgatatcgtcaatgacgctgcccgaccttctcgggatccagcttatcagacaccacacgatgatcagaatctcgtagaaataaaacagggaatcgataacgttagcaatgcgcacttctatgaactcctgctatctcttcaggtctccggtggaaatcagcttttcgatatccgcatcggacaggctcaggcccgccggcagcaccgcaaagacttcattggagagcgcctgcactttgcccttgataccacaggcaaggccgaggctgaagtccagaatgcgctgtgcaaccgcaccctcggtatcgttcagcaccaggatcacgggctggttggtacggacgcggcggatcaccatctgtacgtccacatactcctgcggtttcagcacgtaaggcggaagctgtccggagttgacgcgctgctcctgcggttcgggggccggctcctgctgtaccggtcccccatagctctgaggctgagcggagtagttcgcgttgttggcatacgaggtggccggggccgtgtcgttgttgtagacaggggtagaggccgccggcgtatagctcgatgagcttggggtaggagcgctctgctgcgcctggcgcggggcatagccggcgcgctcgttggagccgaccgggcgtccggatcgcgtgtagaccgaaaccgactctgcctccgggcgcggggtgttgcctaagacaccgctcccctcacggcctgcgttgttggtatgcgcagcgtggcggcgcggctccggctcatcgtcgacctcgtctaaatattcgtcatcatcgtacgcatcgtcgtcctcatagtagtcatcatcatgagaaaagcgattgcggaacttatcgagaaagctcatctgtgtgtcctcctagtagcatgcctgagggttattcgccaaaatacaggcactatattttcgtgcccatcttaaagaaggaatgaaccttcttagaaaatcctttagaaaatttcactgttcggacaagaacaggaaaacttcctgaattgttcttgttgctatcccatcgcacagtgcccccctgcctggatataggcaagcgcaccatggcgaccgcaggtcccgtgctcggcccgataggagtagaaccggtcagtgttggttgcggtcgagatacccgcgtcgacgatctgatcacgtttcatccctgcttccagaagcgttaccgtaatagccgctcccagatccaggcaccggttttcgcgacgtaccgactccccgaaatccgccacaaagccatcgagcagcccctgggaaacctggtaatcggcaccgcctatgtgcggcccgatataggcgcggacctcgctgacctctacgcgcgccgcacggcagagcgtcgtgagacccacctgggagatgcgggccttcgtccctctccatcctgaatggagggctgcaaacgcgtggggcgccactaataccaccggaacgcagtccgcgtagcacagaagcaccggcacttcgggggcggtgcagacgattccgtctgcccccttccgcgcctgcgacctcaccgcacggagttgttgaggctcagctgaatcgaccaccaagatcctcgagccatgcacctgcttcggattgaccaggcgtgggagcaggtcctcggcgcccagtgccgcaagcgcacggcggcggttctcagtgaccgcagcctgcgcatctccgcagcgctctcccagattcaaggaacggaaggcgccttgggatacgcctccggtacgttcggtaaagccgaagcgcaccgagcccgaaagcgttggcgctgtgaggtagctcaccccacggtgtgtgacctgttcaagcgtaggcgtatccattgcgaacaaccctaaatgcggctgttcttcaggaagtcagggatatcaaagccctggttcttcggagcaggcgtgcggttggctgcgccggcagagcgggcagcggcaccgcggtttgcggtacgggaggaacccgagcgacgagacgtcgaggccggtgccacatcgtgggagcctgccgggttgttcttcgcgtcgtcgaggccggttgcgataacagtgacgcggacctgatcgcccagcgactcgtcgacgacggtgccgaagatgatgttggcgtcagggtcgacgttcttagcgacgatatctgcggcgtcgttgacctcctggatgcccagatccttgttgccggcgatggagagcaggaccctcgtcgcgccatcaatggaggtctcaagcagcggtgaggagatcgcctcctcggcagcgtctgctgcgcgagtgtcgccggaggcgataccgatgcccatcattgcggagccggagtccttcatgatagtcgtgacgtctgcaaagtcgacgttgatgagacccgggaccgtgatcagatcagtgataccctgggtgccttgagccaggacctcgtcggccatgctgaacgcttcgagcatcgtggtcttcttctcggagaggtcaagcagacggtcgttcgggatgacaaccaaggtgtcgacgttctcagcgagcttctcgatgccgctggcagcagaagtcgcacgacggcgtccctcaaaggtgaacggcttcgtgacgattgcgacggtcagtgcgcccacgtcgttctttgcgatgtccgcgacaactggggctgcgccagtgccggtgccgccgccttccccagccgtaatgaagaccatatcagcgcctgcgagtgcggccttgatatcgtctttgctctcctgggcagcctgctcaccaacctctgggtcagcacctgctcccaagcccttggtgatatcggtgccgatgtgaaccttgatatctgcgtcagagatcgcaagcgcctgtgcgtcggtgttgattgcgacgaactcaacgcctctgatcccctcctcgatcatccggttgacagcgttggtgccaccgccgccaactcccacaaccttaatcactgcaaggtagttggatgagatgtcattgtcggtcatagaatgttcctccttgctaggcgacggttgacgtatccgccatatccggtagtgcccatgtttgccgtatcgcttacgcctgcgccagggcaaatcctcaagttcgaggcttcaacaaccctaaacctcaagttcagctcaacgtgttatctaaagcgacgtatacttgcacatttcggccgctctcgtcaacccttttgtaaaaaatgtgaatctcccaggtaaacgtctatttttatgctcattaataagtttaaggctcttcttgaagcttaaagttttgcacattgtcaatagaaggtttgagaaccttcaagtaccctgaggcttggcactaccctcacccaaacagtgcaacagttgctacgcctgagatccctgggatgcaaaggcatcggaggagccacgtgcagcgctggaaccactctgcgtgcctgatccggatgaggaggacgatgaatcccctgagctctgtggcgctgaagcagaggaattggagctactgttgttgggctttgccgcattcgtagtgctctgcgattggcctcccagcgcaccgctaccttgtccgatttgatcagagtccacacttctatatgaagggttggacgggatccgcacattgatataggtaaccttgccggcatgactagccaggatagtctcgatcgcggtttccttctctgagatattgttggccgacccaagcgacacctctaccccattggacagcacacaggacaggctcgccgtcgaattggccgagtagctcacgacctgtgcggcgaaatcagaggaaaaatcgtgttggaaggtggagactgcatcgatcgtctcatcattcgcctgtgagcccgaccggggctgtaccgaggccggtagattcttgatcacgacacactgttgagagcttgccagcgccaaagccgcctgttcgctcgtctgtccctgggacttatcgagctgcgccggttcaatccaggttccgtcatcagcaatataccaggctgcagatcccgaattcaggacgacaagtgctccgatgtggcgttcattgatgtgaatcgttaaggtatgtggaaagtcccgttcatagtcgacagaatccacccagggattctgttttagctccgaggtcactttgtcctcatcgaaattcagcaaggtagaacctgacggaacctgcgtgaggtctgagatctcttcctgagagatatggtccgtgggatccgcaaccacctgtgtaatggtaaaggtagggctcactctgaggatgagatagacaatgaagacaatgacagcgacagagatgacgatcttgatcccatggccgatctgtgaggcggtctccttgcggttggggacactctgcctgctccctgtgcgcgcatgctgcagcgtacgctcatgttttgggatataggtggtcttatcactatcgctggtcttgctagcaactctacgaaccgcttcagatttaggggcctgaggcttctgtgcctgagccttacggggctggactgccggacgctgagccggcttttttgcacttgtggtattcggttttctggctgtgcgacccggggcagcctcctgggctctgcgcttggccacgcgttcagactgagggagtggcgacaccccgcgcggagtcggcttgcgcttctctgattttctccgttgcggcattgtgcgctccctcagctccttctcatacgctcactgctcagtcagtctttggctcgttcttcgcttcgtcacgctctctcatcgccttgataaaggcggggcccatagcggtgacgtcgccggcgccctgggtgatcaccatatcacccggcttcactatctcgacgagccgtgcgatcagcttcttgcggttggggatgtactcaacctgatcgacgtcgccgtgctcctggacctcagtcgctaccgtcttgcctgagatgcccggaattggcatctccccggcagagaagacatccatcacaagcagggtgtccgccttgtcaaaggcctgcgcgaagagatccttgagcgcctgggtcctgctgtagcggtgcggctggaacaccacaatgatccgcttgaactcgagatcggctgccgcagacagcgtcgctttgatctcagtgggatggtggccgtagtcgtcgatcaccgtcacaccgtcaatatcccccacatgggtgaaacggcggcggactcccttgaacgcggagagcgcagccgcagccttatcgaggtctgccccgatcacatccgctactgccatcgccgcggtcgcattcagcatgttgtggcaacccgggttggcatgcagcgagatgtgctcgctcttcccgcctggagttttgacaatgaagtgagactccagctgatggtggctgtcctgcggggtgcagacgtagtcgttcgtgtccttgaagccgtaggtcatcacgcggcgaccggtcgagtgcgcgaggtcaaccaggtgttggatgtctccgaagataatgatcgtgccagcatcgcccacgaggttcataaactcgcagaaggtcttctcgatgttggccaaggtaccatagtggtcgaggtggtccgcctcgatgttggtaatcacacagatgttggggtgcagatagagaaacgacccatcggactcatccgcctcgcagacgaagtagccaccgttgccgttcttaccgttggtgtcgtaatcttcgacgattccgccgatcaaaaacgaggggtccatcccgatcttgtcgagcatcgtggcgatcatcgaggaggtcgtggtcttgccgtgggtacccgcgaccgcgatggttttggccccatctgagagggcagagagcatctgcgcgcgcctccacaccgggatcgaaagctgtctggcatggaccagctccgggttcgtctccggaattgcggaggacacaacgaccacatccgggttctctttgtcgatcgtgtcggcgtgatgccccacatagacatggatgccagcattctcaagctctcgcacgtagcgcgaagccttcaagtccgaccccgttaccttacagccacgctcatgcagcaccaacgcgataccgctcatacctgcgccgccgatgccgatgaagtgagcactatgaaacttgggcatcttttctgccatcgttcgtccttccctcaaaccagcgtttttgccgattctccattttagctgctttgcgccatctccaccgcatcagcaagtgcgcaggcagcatgggcctgacccaatccatgggccgcttttctcatcttttcgcgctcctcttggtggtcgatcaggtgcaggacttcctgcttgaatccctcgccgtcgatctcgctgtcgggggtcagcttcgcggccccgtggtccacaaggtagcgcgcattgatcgtctggtgatctgcagtcgctttcggatacgggaccaggatgctcgggacgcagagcgccgcgatctctgcgatcgaggacgcccctgcacgggagatcaccgcatcagctgctgccagcgcctcacccatcgagtcgatgtagggcataatgtggtagcgcttctgctcctgcgcagtgaggttcaggtgctccttcaccgcgtcgaagtcctgcctgccggtggagtggatcacgtagaggttcttgcggctcaaaagctcgtctttcatattcgcaaccgcactgttcagatggcgcgccccgagcgagcctccaaagaccaagagcatctccgcgtcctgcggtacctggaagtcgtcccgtcccttttcacgggaggcattgatcacggacctcctcaccgggttccccgtcaccatcaccgtcgtctccggcccgatgtcctttcgaaaggcgtccttcgctgccggaagcgagaggcatacgattgccgcaaagtgcgcgcagctcttgttcgcaaggcctggcacggagttctgctcgtggatcacgaccggcacgttgttcgcgtgacaccaccgcagaagcggcatctccacgtaagccccgaaaccgaccgcgacgttcggcttgccaaccttctcgaagtactctgcgatctgcttctccgcatgctccatacgtacgagtgcgaagaccagcgtccaggggcgggcacggtcaaagccggtgatgcgggtctcaaagaaggggaaaccagcctgaggaaccagggtggcttcgaggcggttcggctggccgaagaagctgacctcgtcccctctgtctttcagctcctccgcaagcgcgagcgcgggattgatgtgccccgcggtacctccagcagcgatggcaaccttgagcgccatgttatctcctccttgtgtgccgacggggatcgcgcgcgtccctcctgcggcggttgtacccagcatctgccttagagttcagcctcggtcgcgcagggcgctcacgcctttctgtcggcgcagacaccccactccctccactatagtacccctgtcctgcgctgttacggacgtcagatgaagaggcacggcggctgtgcagctgattagaggctccgccggggagcaccataaaggaggcacttgagacgcggtagcccttctgcgcctcagccccacggcctgctcccgaaccatcagtcacgtggaaggtctcccgggcacggtcgtgctcgtctctcgcaatcattgaggagcgcgacaccgagatgatcagacccaccagcatgcaggtggagatgatggaggatccgccgtaggacagaaacgggaccggcttgccgctcagcgggatcatgcccagcacgccgcagatattgaccagcagctggatcacgagcatcgaggcgctgccacaggcgatcaggcgccccagcagatccggagcctgattgccgatcttgaagctttggatcagcagaatcacaaagcccacaaggacaccgacgcagccgacaaagccacactcctcgcctacgattgcgaggataaagtcattgtacgccatcggcagatacgcgtacttctgatgcgaggagccgatgccagtgccgaagaggccaccggacccaaaggcgtaccagccttcgatcatctgatagctcgaacggtagcggtcgccccaggggttgagaagcgtctggatacgcgccagagagtaggaatcacgcagcgacaggagcaggaagagcgcaaagccaattgcgatcaggacgccgatcgttttaccacgcacccctgccagatagagcatacagatgatcgtcatgataataatcagggtcgtacccttatccggctggatcacgacgaagaagagcggcagggcgacaaagatcgcgagctggatcaaaaactcctttgagttggtcgagcgctcctcaaagtactgctcaaagatcatgccggaggtcacgatcagaagcggcttcacgaactcagaaggctgcagcgagaagccgccgatcgagatccagcgagttgcgccgtacatatcgctgccggcaatcggggtctgtatgataacaagcaggaccatcatcagcagccagaaccagaacgtgaaccgccgggccaagtcgtggtattcgatccgtgcaatcacagacgcgatcagaacgccgagcaccaagttgcgcgcctggctcttcaggaagaacgccggatcgttgttgtagtccgccgacgacatcgccacgatcgaggaggacgaatagatcatcatgagcccgaaggctgcaagaattcccgcgaccaggatcacaaggatcatcggccgcataaaacgcgcgggcctacccatgatggtacgctcacgcctctctcttctgctccgtattcttgatctggcttgtgtctgtgggtgtgcctgttggctcgcgtacgccattccttctattccctcgtctttgcaataaggtcagctacataggacttaaaggcccgtccgcgctctgccatgttgtggaactcatcaaaggaggagcaggcaggggacagcagtaccgtgtcaccgcttttggctacggctactgccttatcgaacgcctcgtgcatgtggggcttctccaccaccgtaagcgtatctgaatgctcgttttgcagcgcctcagcgatacggggtcccgctgcgccatagcacaccgccacgcggacgtccttcgcgacgtcgcaggccagatcggtcaagggcgtctccttatcgtgcccacctaacagcaaaatgatgtggcccggcttgaaggcggtcagcgccttctggaccgaatcggtgttggtggcttttgagtcattcacaaagtggaccccgttaacctcgccgcagggttcgatacggtgttcgagcggcttgaaggtggaaagaccggatctgattgcatctaagcccacgtgcagctcaagtgcgagcgcagaagccgctaacgcattctctacgttgtggagacctctgatcgaaagctcatcctgcgtgcagatgtgttgctcttccccggcacgccgcacgatcagctcagagcctctcaaaaaggccgcgtagggggtatcaggctcggtctggaccgtgagctcacatacccggataccgcgcgccgcaacgcgctcacagatggcccgggagtagtcgtcgtcgaccgagatgatcgccagatcatctttcgtcaggttctggaagatcttctctttggctgccgcgtagttctcgagtgtcttgtgccactcgaggtggtcgggggtgatgttgagcagcaccgccacatgggggtgcagcttcttggtcgtagccaactggaagctcgagagctctgccacaaaccaggagtctgccggacgctcgtcgagtctgcctgtaatgatcgtgccgatgttgccaaccgcttcagccttcatgccggcagcgtgcagcaacgcagtagagaggctcgtcgtggtcgtcttgccgttggtgccggtgattgcgacccagtgctccgggctctgccggtaggcaaactcaggctccccgatcacctcatcggcgtgcgcctctgcctcagcaaagaaaccagagaactcagagatgcccggcgagaccactgccagatcaaagtgcccctcgatctgctcggtgccgagcttcacggtgcagcctaggttctcaagctcacaagagagcttccccggctttgaggccgccccgccgatcaccgtgacagatgaaacagtggtgccgagccgttcggcgcagtacttcgccactgcccctccggtcaagcctaatcctagtatgacaattgatttctgtacaggcataagaagacccttcaggtgctaaaagtacagggcagctcccaggacgacaaaggccgcagagacgatccagaagcggacgacgaccttctgctcaggccagcccttcttctcgaagtgatggtgcaacggcgccatcagaaagacgcgcttgcccgtggtcttgtagctgacgacttggataatgacggaaacggcttcgatgatgaagaggccacccataatgagggaaaagatctcagtcttagtgaggatcgcgaccgacgcgaaggcaccgcctaacgcgagcgagcccgtgtcgcccataaagaccgctgcagggttgcagttgtgccacagaaagccgatgcaggcgccgacgagtgcggcgcacagaaccgcgagatctgccttgctctgggtagccgcgatgagtgagaaagcggacagcgcgaccgtcacggtcccggctgccaagccatcgagcccgtcggtcaggttcactgcattggagaagccggcgagcaacaggaagtcaaagagcatgtagagccaggggatctgaaccccaccgatcgcggtggtgagaactccaagattgacgacggcgccacccgggaagcgaatcgtcggcgcgatgccgcagacgttgaccgctacgagggtaaagattacgcagatgagcgtcagccccaccatcttctgcgaaggggtgagccctagggatctgccatgtgcgacggattcgatatcatcgagcgaacctaacgcgccagtggtgagcatgccgaagatcgcgagacctaagtagggggtcttgggcgccatgatcagtgtcacgacgagagcaacggcgaggatcacaatgccgcccatggtcggggtaccctgcttctgaaggtggcgcttcgggccgtccgcacggacctgctgtcccacatgctcacgccgcatgaagcggatatagggcacgagcgcgataccggtgacgaccgccgcgatcgccgcggcaaccaataccaacgcgctcgggtaggacgtacttccaatcagcggcattgctggagcaccccttctacgaatcggtcgagacgctctgccctcgacgccttcaccaggacgagatcctcaggtttgaggatcggtttgatcactttgagtgcggagtctacatcgtcaaacgagacgatgctgtcttcggagagtcccatcgtctcggccgcctcagcgatgcagtgcgccagatcgtggccgatcgtcacgagcatggcggggtggatcgcggcggcataggcgcctacgtagccgtgaagtttccgggcttcggagcccaactcccccatctcacccaggacaacgatctttctgcctgagcagctcatgtggttcagcacatcgagcgcttccgcctcggaagccggcgaggcattataggtatcatcgatcacctgcgccttgccgggtgcggtcttgacctgcaggcgcatctgctccccttggagctgtgtgatcgccaggaccgcttcttcacgatcgacgtgacagcgctcagagatcgcgagcgcgcagagcgcgtcggttaccgcatggcgtccggggatgtgcagggagacctgccgcttccagccgtcagcaaactcaagcgtgaaccgcgcgtagccttggttattgagggtgatatcgtgagcctgcacgcagcccttgtctccatcgacgtagaccacctcaacgccagcgggacgcgcaaaggtctttgcgatgaagtcagcgtagtcatcggtcgcgttgaggaccagacagggtgcaatcttgtggaatgcctgcgctgtcgggcgcatacccgaaagaatctcccccttggcgcgcgcgatattttcacgtgaccccagattgccgatgtggctcgtcccgatattagtgatgatcgcaacggtcgggcggactgcggcagcgagccgtctgatctcgcccttgtggttcatccccatctcgacgacaagcgcctgggcgtcatcgggcgccgcaaagagcgtcagcggcacgccgatcaggttattgaagttacctttggtagcgtgggtatggaacttcgccccgagcgcggcagcagtcatgttcttggtcgtggtcttccccaccgacccggtcacaccgcacaccaaccaatcggggtgctggtttctccaccaggttgcgagacgcagcatgaactcttcggggtcgccgttcgcagcgtggacaatcgcacagccgccccgacgggcgatatcgagcgcatcctgattcggcttgcgtgtgacaaccgcacaggcggcgccggcctgaagcgccttggccacataggtgtttccgtccacatgctcacctgggaaggcgacaaagagcgcgcccggcttgacctcacgcgaatcgatcacacagccggtcacggcgtgctccggggacccggcgatcagctgcgctccggtcacctgtaaaagttcattgactgatatatgcaacatggttcctactcctaggatgctcgcggaactccctcatcttttaatgcctcactcatgatactcgagaacatataggacgatgaactttccgcaaaatgtggcgtcccgttgaggcccacataaaccaatatatccggatcatcggcgttcgcgtagccgatcagtgaactcatatagattcctttcgcatacccagaatcctgcgaggacatctgtgcggtaccggtcttggcggctaccttgtagcctgccacgctcgcctgcttggcggtgcccttcgccacgacgtcctgcaacagatctgagatctgctgcgacacctccggggtacacacctgtcccttggctgcccaggtcacatcctgcccatctttttgaattaggaagtgcggggtcgcgagcgtaccgccgttggcgatcgcgccgaccgcctgcaccatctgcacctgcgggactgcgaggccctgcccgaatgccatgtccgacagcgtcatcgacgtatagtcgtcgtagtcagccacatcgcccgcaagctcacctgggtagtcgatgccggtgcgctgcccgaggcctaaggatttgaccgtcgaggagaactgctcggcccccacatcgcgcgccatcaggatggcaccgacgtttgaggagcgctccatcacggtcctgacgctcatccgcatcgcattgcgcttcacggagtcggtcacgtagtcgtcgccgaccttgatctgcaccgggacatcgtaggtagtgtccgcagtgaaggtattgttcataaagcctgaggcagcggtaatgatcttgaagattgagcccggctcatagatatccgaaaccatcctcagcttcagttcgtcgttggtgagactatccggatcggtgaggtctgcaaagggcgtcgagcaggtcgccaggatctccccggtcttggggttggtcaccatcgccgaagcggagtcggagtcgtaggtcttcggggcattgcgcagggtattctccatcacagtctgcacgtcgatatcgagtgacaggacgatatccgacccgtcagtggccttgttggtctcggagattccaccggcaatcggggttccgtccgcaccggtttccagcgtcattgacccatccgtgcctgagagcacatcgttgtagtagagctcgagacccgtaagcccctcattgtctgtgccgagcatgcctaagatctgccccgcgagagcgccatacgggtagacccgcttggagtcgtccaggtagtagatacccgcgatgtcgctgtctgacagcttttcacgtacctggtcagcctggtcaggatccaccttgcgcttcacataggcaaaggtcgtatcctggttcaggatatcgagatagtcctgcttgttgccgcccagtacgtcatacagaatctgtgcagcctggtttttatcggagacctggttaggattggcatagatcgtcgtggctgcttggctcatcgcgagcacattcccgttgcgatcgtagatcgtcccgcgcttggcgggcagcacgatctcgttggtccggttgtttgaggcttcttcagcgagcgccggccctcgtaagatctgcagatagactagtctccccacgacacagaggcacaaaacgatcaagacggtaaagaggacgactaaacgtcgatccacctccaaacgctttgcccatagcgccatgaaagagccaccctgcttgcgctttggacgtgaggaatgggtacgcccctcatcgtatgaagagcggcgcgtatctgtgcgtttattgccataggccaagcggtgcctgtggggggtatcggtgctcctctcactgtaagaagaacgatatgatcgagacgcacaggagcgcttctcgtcaaacgaggagcggtatggatcactgcgccctctatcgtatggggggcgctgtgcccgtgtgtgatgtcttcttcccgaatgtctcatgggaaaagcttacaccttacgtgggtgatcagttttgggtgttggcacaatccgtagtacctgcggatgggtcagcattcacaatcgcgctcatatccgtatcatccgtatccgtagaggcgatcagcacctcaggggcggcaaggtacatgccgtactgctgggtcgccagacgctcgatccggctgccgtttgaaagcaccgagcgacagacccgaaggtcattgttcagatcctgcgccgtggtgacttggtcttccaaggcatagttcgcctgaagtgaagagactgtcgcggcagagagcgtgatgcgagcaaagccgattgtaagaacagcgcaggcgatcgcgattgcgagcctcacgtgttgcagaaattgtgcggagacgccttggcgggcctgctggtccaagcctgcgccctcgattacgtcgaaggagggagaggtagaggtagcgtacctctgggagctgtcaccaaaatcatcgaggctgtacgcctcagagaaatcgtacctcataccttatttcccctcattttttaagctgcgttgcagatgcaaatgtagtgtgtttaacgtgcgttggtagtacataggtagtgcgtcatatgcaaacaactctgtcgagttgatcacatcaattgcgcatcttcggtgcaccggtcgtatcaagcctacgagcgacccgcatcaaagcgcttcgtgcgcgtgggtttgcctccacttcttcttcggttgccaccagaggctttctggtgaccacttcgattatcggcacgtgtccgcacacacagaccggaaagtccggtggacagatgcacccctgcgaaaactcgtggaagatgtgcttcacgagtcggtcctcaagcgagtggtacgagatcgcgcagagcctgccgcccggattcaaccagtgcatggcttgacgtagcccgtcgttcagagcgtcgagttcaccgttgacttcgatgcgcaaagcttggaatgttttgcgcgcgggatgctgacctgctcgacgtgccttggcagggatgcctgccttgatcacatcgacaagctcgagcgtcgtattgattggactcttggcacgacgacggaccatctgtctcgcgatggaggaggcgaacttctcgtccccatacgtgcgaagaatccgagtgaggtctgcttcgttgtaggtgtttacgacctcgcgtgcggttaaggtattgttcctcggatccattcgcatatccaacggtgcgtcctcatggtatgagaacccccgcgctggtatatcaagttgcggcgatgagacacccaaatcgaagagaaagcagtccacaccaggcacttgggcttcaacgagcagcttatcgagttgaccgaagttgcccttcaaaaacttgtgccgggcctcaggcacctcacgcgcaaagcgctcgcgcgcagcggtgagagccatatcgtcctggtcgatcccaagagacagccccgttggggcaatccgtttggcgagctcgaccgagtggcccgctcctccgagcgtgcagtcacacactgtctcccccggttggggatccaggtgagagagcaccatcttgagcatcacaggggtatgccgatattcgactttcaaagaaacattcctccgtcagcttaatcaaacatcaggttgtcgagttcgtcgtcgtcttcggtgttgagttcattgaagtgatcgaggtcccacacctcaaaatgatccttgttaccgaggacctccacatcgcgggaaataccgagacgctcaagcttatccttgggaagcttgctcagcgcaacgcgtcccgcggagtcgatctcgaccgttacggttcttctcatgagtgttctttgcaacgtatcctgttcccgatcgcggggattaaacccgttggggaaataggatgctgtccaagcctgatggccttcgggggtaaagccccacacagcgtccttcagaggcaccaaacaaacgcgctcgccaaattggtgacgaaagtctgctggcaaggtcaaacgcagttttgcgtccaacctctgttgcttttcgccagtcaggtacatctgccacctcccgacgtttgcgatgcctcctagagcgtgtattcaactataccttcacgagagcccattttccaacactttcctacactttctcccacctttttatatctgcccagctcaagtggggtgtgacacagaatattgtttgaccactatatataggggaagagatccaactcgaccacaaatattctgttcaatgtgggagattgattctcaacgtgcatccactcatttgttggatttgtgacgcattggacgactgttggctcgggggtgggccgaaaggtaggtcatccggatgtggccgcggtcaaggtgtgtatagagctgcgtggtggtgatggaggcgtggcccaaaagctcctggacaaccctgacgtctgctccaccctccagaaggtgagtcgcgaaggagtgccgcagggtgtggggatggagcccgctgataccgacagtgcgaccggtgcgctccacgatcgtatagacgctctgccgagtgagcctgcccccgcgaacatttaagaagaccgcatcgtgtgagtggctcgatacgagctcagcgcgccagtgcgcgagatagtcctgcatcgcctcctgcgcggtccccaaaaggggcaccatgcgctccttggacccctttccaaagacccgaagcagctcgtcgtcgagcagcactgcggagagatcgagtccacagagttctgagacccgaagtccgcacccatagagcacctcaatgatcgtacggtctcgctgcccgatgggagtttggggatagggttggtcgaggatcttgagcatctgctcgacgcttaagacttccggcagtcttcgttccttctttgggagtgggacccccgcggcgggatgggtcacagcgatctgctcggccaccataaaccgatggaagctcttgatcgcgctcaaggcccgcttgaccgatgtggtggcaagcccctccccttccaagtgcctctcataggcttcgatatcctcacgcttgatctggtcgggctcctcgatgtcgcgcttcttcaagaaagcgaggtagccctgaagatcgtggcgatacgcttcctgggtatgaggagagctaccccgctcaatcgcaaggtagcccagatactcttcaagcgcttgttgtaggttcacagcgattcggttctaatccggcgtaacgtcgtggcgatcaacaccttcgtgctggccgatcgcggcgcggacaaactcacggaacagcggcgccggcttggtcggacggctcttgaactcagggtgtgcctgtgaggcgacgaaccaagggtgcacgtctggcggcagctcgatcatctcgactaaacgctcgtccggggagagaccaccgatcacaagaccggcctcctgcaacttgttgcggtaagcgttgttgacctcatagcgatggcgatgacgctcgtagatcagaggctcaccgtaggcctcatccgcaagcgtacctggcacgatcttgcacgggtaggcaccgaggcgcatcgtaccgcctttctcggtgatgtcctgctggtcgggcatgatatcgatcactgggtaggagcaatccggcgcgaactcggtggagttggcgcccggcataccggcgacaaagcgtgcaaattcactgactgcaacctgcaggcctaagcagatgccgagatacgggatcttcttggtacgtgcgaagtgcgctgccaggatcttgccctcaacgccgcgctgaccgaagccacccggaacgaggataccgtcagcgtcggagagcacatcctcgacgttgtccttggtgagttcctcaccgtcgatcagcttgacatcgagattgcggccgaagtagacacctgcatgtccgcaagcctcaatcacggagaggtaggcatccggcagctgtgtgtacttgccgacgatgcggatcttcgtcttgtccggctttgcctttgcggcatgcatcgcggtcgtgtagtcgttccagtcagacatatccgaggtacgtggatcgagcccgagcttctcgcagacctttgcgtcgaagccctgcgccgcgaggtgcaccggcacgtcgtagatggacgggcaatcggagttctcgaagacgcaatcctcatcgacgtcgcagaagtgcgcgatcttggcgcggatcggagcctctacctcgtggtcggagcgacacacaatgaagtccggctgaatgcccatcgagcgcagctcctttacggaatgctgcgtcggctttgtcttgacctcgtgggccgctgcgatataaggcaccaggctcacatggatcacgagggtgttgcctgggccatcttcacgtctgaactgacggatagcctcaacgaaaggctgcccctcaatatcgccgatcgtaccgccgagctcggtgatcacgacatcggcacccgattgctcctcgatacggcggaagcgctctttgattgcgttggtgacatggggaatgacctgtacggtaccgccgagaaaatcaccgcggcgctcgcgcttgatcagcgaagagtagatcgcaccggtcgtgaagttggaattgcgcgtaaggttctcatcgatgaagcgctcatagtggcccaggtccagatcggactcatagccgtcttcggtcacaaagacttcaccgtgctggaagggtgacattgtacccggatcgacattcagataggggtctgccttctgcatcatcaccttatagccccgtgattttaaaagacgccccagcgatgctgccgtgattcctttacccagcgaagacacaacgccgcccgttacaaagatatgcttggtcatgtagacccttccaaataaaaacgcgatcttctacacgggattatattctaatcctaaaaccggtctaaaaggccgatttcctaccttcaccaccctacttatttaattgttaacatgtgcatgctcgagcatctcccgtgcatggttgagtgaggcttcagattggtcgccggagagcatccgtgcaatttcgcgcacgcgcttctccccttccaccttatggatcttggtttccggaacatcgccctcggtcttatcgaccacgtactgggtatccgcgacgacggcgacctgcgccaggtgggtcacgacgatcacctgatgggtctgcgcgagttgcgccaacacctgtgccagagccacggcagttgccccgccgacgcccgcatccacctcgtcgaagaccaaggtgtcgatcgcgtcggcgttgccaagtactaccttcgaggcgagcatcacgcgggaaagctcaccgcctgaagcgatcctgcgcagcggacgcagggagagtccggcgcccggacggtacatgagctcgatcgcagagggaccttcctgagcccactcctcgcggggcagatcctcgatcgagaaggtgactgcagctccatccatctcgagctgtcccatcaccgcggtgatggccttggtgagcttcggtgctgcggcatggcgcagcttctgtaaagctgcagcagcagctttgagcttatcctctgcctcagcgatctttttctgtgcttcccgctcacgctcatcgccgtcctggattacagagaccaactctttggcctcatcccgacgcttcaggacatgttctaggtcagggccgtagctgcgcagcagaccctgatactgagagttgcgctcttcaagctgctgcagctcctccggatcgagctccaccgcatcgcggtagtcacgcagttctgaggcggcgtcctccgcctcgatcagggagctttccagattgtccgcataggttttgagcttctcatcgtagcgcgcagcatcctgcagctgttggatcacaccgcttaaaatatcggagacgccaccgtcctcggtcactgcccggtgtgcggcatccgcggcgctcatcagcatctctgcgtgctctgcacgcggcagctcctcttggagctcctcgtaatcttcctgagagggatcgacctgctcaatctgattcaagacaaaggcggcctgctcggcattctcctggctatcggcgcgggccttctggattcgcttcagggcacggtgtgccgcctgagcctctttgaaagcgcctctatagcgctcaagtgcgctcagggtcgcctcacccgcgtaggcatcgaggagctccgcatgggtcgaagtgtccatcagccgctggtgttcgtgctgtccacacagatcaacactcgctccgagcgtgtctgccaattcatggaccgtagcgagatggccgtcgatctcaacccgaccgtgcccgtcttgggagagccttctgcggacgatatgtccgtcctcttccttatctcccaaaaagaagcgaccttcaacttccagctcggatgagccttcccggatcgaagaagtgttcgcacggtctccgatcaacagcttcagtgaggagagcaacgcggatttgccggtaccggtctcaccggtcaacacggtcagcttcggagaaaattcaagcgtcgcctctctgatcaaagcgacattgtccgctttaatctcatcgatcatcggtagccactttcccgtagaagactctggaaaccgattcatagaagctctgtgaggagcggtcgagcaggataatgtcaccggggccgcggcgcactctgatgtgcatcgctcgtccaccgcgctgacccatcggctgaccatccgccagcacggtccgctccacagggcgctcctgagacatatcgatctcaacgatttccgactcagaggtcaaaaacgcccgcgccagaatcgtgtgtggagcaatcgggacgcagaccattccgttgaactcaggggtcacaatcgggccgccggcagccagcgcatagccggtcgaaccggtcgcagtcgacacgacgaatccgtcaccctggatttggtcgatgtggttcccggaaactccaacgtcaaacgagatcacatcgcctaagctccctcgggtgagggccatatcattgagagcgaatctgcgctccgtgtagctcgtcccatcagggaagtaatagtcggcttcaatggagagggtcgctcggtgtgaagcgtgcatctcaccttcgagcgcctcactgacggtccggattaaattggagggcctcccagtcgtcaaaaagcccaggtgcccataggagaagccgatcagcgggatctctgcgtagcccacgatacgtgcggcacgcaacaaggtgccatcaccgcccagggataccaccagattgcacccctgcgcggtgacatggttatattctttgcttgtcatatccggtgtccacactgcttcgtggccttggctcttgagccaggcatcgagtgtgtttgccccctttaccgctcccggacgggaataattgggaactataagcactttcatgccgcgcacctcacagcctttcttgcaaccattcaggcagtatatcagccaccgggatcgattactagtacatgtgttctgttttgggtaaaatcgacgttgaagacctcaccaccgactccagatccaacgtgcctgtgacagccgtcttccggtcacccaacaacagatattcctgatttcctttggtccccttgatggggctcggacaggcaccgaccggtgtgagccccgcctcctgaaacgcagaggccactctcttgagcgcttgcaggcgcacgtttggatcgcgaacgacaccaccttcgcccacctgatcgcggggcgcttcaaactgcggtttgactaaggtaagaaggctacctgtatcggtcaacaattccagaaccgcaggcaatacggtgagtactgaggtaaaagagacgtcacacaccgccagatcgatcgtgccttgccgctccggggtcggcacatccaccatgttggtgcgctccaagagttcgacgcggcaatcattcctcaattcccaggcaaactgggcgtagcccacgtcgaccgccagtacgctcttcgctccgcgtcgcagcagcacatcggtaaagcccccggtggagcagcccacatcgaggcagcgcaatcctttcgggtctaccttaaatgcatcgagagccccggcgagcttcagcccaccgcggctcacatagggtcttgttcctctgacgtgcaacgctaagcccggtttgaccgcctcacccggatggtcgaggcgttcacctgaagcggagacctcccccgccagaactgcgcggtaggcctcatccttcgtagaaaaatagccttgtgcgaccagttcttcgtcgaggcgcctgcgctttgccacgcctattcgcctgactttgcattgttggtactgcctgccattgaagaggggtccggcgtatccaccagattgatcgcctttgaccctagtgcaatcgcttcgtcgtagatatcgagagaacgctcaagtgacgtatctttattttttacctctgcgaccagttcatccagccgatccgagatcgcctgaaatgaggtatagtctgcggcatcaatctttgccatgcccgccaccctgagatgcttgcgtggccggcgtagcgttgagacgcgcggcacgttcgcgctcaacttgacctttcaggtccttgccttggtcaagctcacgggcgatgtgccctaagacgccgttgataaagcgggaggactcgtcggtgccgaaggcctttgcgagctccacgcactcgtcgatcgtgaccggcagcgcgacgtcgtcgacctccaggatctcatagagcgccaagcggagtaggttgcggtccaccgccggcatccggctcagggaccagtttgtggagaccgcctcgatgatgcggtcgagttcggggatgtagtcccagcatccgcgggagagcctctcgccgaaggggtcgagcggtccgtcggagatcacatagtcacccgccagcacctcatcgacgctgcggccggttgcctcagcctgaaagacgagctgaagggcctggctgcgcgccaaagttcttccaccaaaacgatgatgagccaaaacacttactccttgggaaacacaaggctgtcgattgcgatatcgatcgaagcaacctcgacaccgatctgctcgctgaccgcacgggcaacttcgttgcgtaccgcatcggcaagctcacggaacggatacccatagaacgcagccagatggacggtgagtttgagcttaccgccttcgacctcagcctcgaccgcgtcggtggtgttcagctgtttctgcgtaaagatgcggatcaggctcgaggtgatgttcccgttacctcccacagaggcaaccccctctactttttccgctgccagtgccacgacacttgcgacaacctggcgtgagatgccgatgcccgcgattgagagctcgtccatggacagtccttccattaaaactaaaacaaaagcacactgtatgcacttaagtatacgcaaaactgatgtgctgtgtactcaacacaacgaaagcgcctcaccgaaacgataaggcactgaaacattcaccgcatgcagtaaaacctagacacgctggacgaacttgccgtcacgggtgtcgaccttgatcttgtcgccctggttcagatagagcgggacctggatctgcgcaccggtggaaatcgtcgcgggcttggtgccgccctggactgtatcacccttgaagccgggatcggtctgcgtgatctcaacggtgatgaacatcggaggcgtcacgcctaaaagctcgtcgtcggcgtagagcagcgagcagttgtcgttctccaccaaccacttggcattgtcgccgataaagtctttggagactgggatctgctcgtaggtgtcgttgtccataaagtaataggagtcaccgtcgttgtagagatactgcatctcacgggtaatgagctggacgctctcgaatttggtgcctgcgttgcaggtttgttcgatcgtgcgaccgtccttcaggttcttgatcttatagcggacaaaggcgccacctttgccgggcttgacgtgctgaaactcaacgatcgtgtagtacttgttgccgatcttgagacccatgccattcttaaaatcagcagtgctgatagtctgcgttgccacaaataactctccttcaccaaaaaactgttgtgtgaacgatagtatacgacgctcccttagcgcttggaggcactgtatcccattcagcacacaaggtatagaaaacttatttcaccggaagctcctgcagctcgtgcggagactgcgtaaagacttcatacccatctttggtgacctgtccgaagtcctcgaggcggattccaaacttgtccggcagatagatgcccggctcgaccgtgacgaccgcaccagcggagatcttcttcgcgccaacggcggcacgggtgaagagtgggagctcgtggatctgaaggccgacaccgtggcccaggccgtggttgaagtacttaccgtagccagcgtctgtgatcaccttgacggcgaggttgtggatctcgttgccggtgacgccctcgtggattgcagcttcacaggtctcgttggccttacggacaaccgcatagaccttcttctgctcctcggaagcctcacccacgcagaccgtgcgggtcatatcggagtgatagtcgtggtagccggcgccgtagtccataacgatcatgtcaccctcctgaatcacgcggctgcccggctgggcgtgcgggttggcaccattcggaccggaagcgatgagcgagtcaaaggaaagcgcatctgcaccgtggctgaacatgtagccctcaagctcggtgcgtacctggagctcagtcatacccggcttgatgaagccacagatatgctcgaaggccgcatcggtgatggactgcgcgtgcttgatcagggagacttcttcggcgtccttgacaatacgcagggctgagacatccccgtgcatgtgaggcagcaagcacccgagtgaagcatggttgagcgcctcggtgagcgcatcagcgaaggctagatcctgggtgtcctcaagcgcgaccacgcgggcgtgggtctccagtacgcgctgtgccacccagtcagcggcgccgatatatttctggtcgatcacccaaggagtatccttccccaggcggtcgaggaaggtaccgtagtagcgggaatccgtatggagccactgcccatcttttgcaacgaatgcagtgtgcgccacttcgtcgtcgaaggtacgctgcgcgccagtgagccagcgcaggtcagcgttgttgcgcagaactaccgcatcgtagccctttgccgccatgacccctctcagtcgctccacacgctgagcgcatgcttttgtatcaaccactgtgatcactcactcctcatctaattgtatctgtctattgttcgctatcagtctgcagtttggcatgctgggcacaccaggccgcaaggttttctttcaggctctccggatcgagcgtagcgagcctcacgcggccaaagcccctcggcagcgccaccataaagcggtctgaccgcatgaaggcaatacggtgcatcgcgcggaagaggtcgtccggatcgatcgttgcttgaacggtacccaatccaaaggtctcaagcacctcatcctgggcgagcatatcgtcgatcgagaacccctcctcgacacaggcgagccgtgccatgaaccgcagcccttccgcaaagagggttgagttagggaactcatcgccggtgagttccttgagggcccgcgcgaaggtttgcccatactccagcgactgtctcactgcaatcgaagttgaggagacgatccgtccgcggctcctgagactctcgttgaactggtcacgccacacgatctcattgttgtctgccagatcctgccgtctgttgtagagcaattcgaaggcattctgggtatctgagaccgccgtagccaccatcgtcacaagcgcccggctgcgctgctctgacttctccaggctcatcaccgcgaagtccgcaaacacattcctaatgctgttgcgcccctgaaccatacccggatggccccctaccgtgagtcctgccggcgtaaccgtcgcacacatgagcgcttccacatcgagcgggatcgctgcaaccggggtacctccgcaccagccgcctgccacaaaagagatcaggtcaagctgagcggcgtcaccgacaaccacgatcgcatcgtcgcttgtgatccccgactcatcgagcttacggtagatagcaggcgcgctctcaaccttgagggcttcctccccatccgggattgagccccgcttcaccgagaaaccctcgctcgtcatctctgtaaagatatgttcaactaactcagcggaagcattctcaccgctcaggagcatcgctttgtggggcttgcccacaaaggtgatcaggtctgagccgaaccgttgcagattcccatgcccgatacggacattgcaggaattttgggggatcgaaacccactggcgggtcgcttccagcttcgggtcgctatcctccgactgtactggctcttcgggagcagtggggttgtgttctttgtcactcatagcaaacctttctcccagaggagctgcgcggccgcatcggccacctcttgaaaactcttgttatggatatccaacgtatagtccgcggtcttctcatacagcgggcggcgccgttcgtagcacgcctttgtgtctttcatacagcagcccagatcgggtctgccttcggtgtggcggatctttttcagggaatcctcgagatccccatccagatagaccactttccccatctcgtgcatcagctgtgcattgccggggcgctccacgatgcctcccccacagctcacgagcagggacttacgacccttcaggctgcgcaggacttcggtctccgcatcgcggaaaacctcttcgccgtcctgttcgaagatatcgcagacacacttgccgaatttgcgttcgaccagacggtcggtgtcgacatagccgcgacagaagagcctgcctaagttgcgcgcgagtgtcgacttccctgctccgagaaaaccgataaaaaagatatgatcacatccttggtgatgaacatatccttccccgagcgaacccaacgtgcaacctccatgtacacaaatatctaaacaataagtttaccacgttacacacaaggctcacggagcggctttggtactccacatcagggagcgaacattaaagcaagcagggcactataaaatccaactgaaagccagggacctgcagcaaaggtctcctgatgccgcaaccaggcgacgagcgctccggcaagcagtgcaatgcacagcgctggcaggatccactctcccagaagaggcgcccaggcgcttgcgtacttcacatcgcccaaaccgaagccggcctgctgagtgaaccggcgatagaggaactcgatcgcaactgcgcatgttaaaaagagcatcgaaaacaggatgcagaacgcgggagtgttgagccgctcagcaaaccgaccccatccgggaacggacagtaccgcttcaggatggagagccctcaggctttgaaacgccagcccgatcacggttataaaaatgcaagatgcgttatcaatgattctcgttcgggcatcgcgcacgctcacgccgatggctatcgcgagaagacaaatcaccgatgcgggcctttccggtaccggtgatctttcagtaccggcacctcaagctttcttaacaccttagtgtagaacagatccgtatctgactgcggtttgaccaagattgtcgctatcccagctaaatttcccgccaccacatcggtgtagacttgatcccccacgagcactgtctcgtctttggtatagtcccgctcacgcatcgcgttgaggagcgcaaaaggtgagggtttcatcgccgcatagatcgcagacgagttgagcttgtctgcggaagctttcacagaatccccgaagatgttgttggagacaaggcaggtctcaaagcccatggcttgcgctttggcaaaccagcgctcgatagcgggagggactgtaaaggtattcagcggcatgcaggtattgtcacggtccatcaagaggaaccgatacccatatgctttgagcgcgtcgagatcgatcagatccacgcactcaatataagcagaggctgtcagcagcgacatagagactactggccctgttcttcgtcctgcgtctgggcatccgggtactgctcctgcgcagccgcaatgttggccaggtgctgatcgtagtcctcagcataccagctgtgggaatcgtcaccatctttgataatgtagaagaagtagtagtcggtctgggcgggattgagtgcagcttgcagggaagcttcaccgggagagcagatcggggtgagggacaatccttcgttcagataggtgttgtacggattgttctgctgcagatcatccggcgtcaccgcgtcacccttgtaatattcgctcgtggcgtctgactgcagcggcataccgtcacgcatgcggttgtagaaaactgaagcaatcatcggtctgtcatcgtcgcttgccgcctcgcgctcgatgatggaagcgagcttcaggaagtcatagtcactgaagtcgagcccgtaggtggtggcgatattctgccgcgcagtctcaaaatcaagtgcgccgatctcgctttggtactggtcgagcatcgcgcggatgaccgtatcggcatcgacgtccttgtggaagttgtaggtcctcgggaagaggaacccttccagcgagtcgtccgccgcatcggctaagaacggatagtcgctcacatagttggaggctttcgcctgtgccatgaagtcatccgcagagatcgtggggatgttcttctcgatcgcgttggcgatcgcttggacggtgtatccctccgggatcgttaacgtataggccgcgttgtactgaggacccgctacgagggcttgagctaactcctccggtgtcatgccgccggtaaaggtataggtgcccgcctgcatattctgggcgttgttaccctgcgcgagcgccgcgtgcataaagtcgctcgactgatcattggtgagcaagccggcatccacgagcgcaccgaagatcgactggccgtcagccccctcagggatctctacgtcgacggtcgtgcccggagcaacaagggtcatcgcctcatggtcgcgtgccttctgaactgccgcagggatcaccacggcgcagaggacaagacagacgataaggcccaggatcaacaggagcatatagagcccggttttgtgcttgggctcaggctcgggcactgacatgtgcctcccacgcccggctgcctgatgttcttgagaaggaaaatggcttccacctgccagcttctgagaatgcgcagaatggcggggggcggtcgtgcttgaggagcgcggatagtgtcttcctgtcatgcccgtcctttgtgacagatacgcatacatataaatacgtatcggttgacgtttacagctatataaggataaaccggcacagcccacccgtgcaccctcagagcgcattcttctcacgatctctaaaatctaggtatctgacgtgcttgttcttcaactatctgcatttcccgagatcgtatggataccgatactactgagacagtaccgataccctgaaagttagtcgagctccaccaagttgtagtgctgggtcccagcccgatctcctctgcgtggccgagcgtgtgggtaccgtcacggctttc

SEQ ID NO: 324 - DNA, 13250 bp, Unknown
  Metagenome-assembled genome
tgtgctttggcaagaggcacatgctacacgcaaatatggtatcggtgaaactaccatatatggttgaagaaaacgatatctggcagaagagccgatggatgccgcagatcctgatgctagggaaacgatgattaatgccccataacgtgtcagaggggaccgaccacacgatttttcgcggccggtatgcgggaaaggcagggaaggatgctcatctagcacgtgcaggagccgctatcctggcatttatcctgccgcatgcaccgcaataaggctccaagatggatcaagcgacgctgagagccgggaggtgcagcctgccggcagagatgcacatgggtaaggtttgcaagggcgaagcagacatcgagcatacaggagttcttctctatcccctagtagcgcttccttaagtggccgaagcgccgcttcacgataaggaagggatgctctacctttgagcggatggaggccttcctggactcgatacccttctcggctgaaagcgcacagttaaggccctttatggtcgaaggtttccttgcaacgctttagcgcatagatgagaggtgtgggtctttatgcgtccttaagggcgcttcgctataccggtatagccggagtctgcatagcagaacctgtcatcttcccttacgagtacgtgtgcctgggatatgtcggacacattcgcagcggtcgtctctacagcatgcacaaggccgctaccggcgtctacgccgatatgcgccttgtatccgaaatgccagttcttccctttcttggactggtgcgctttaagggtcgcgcgcatggtccttgttcttcgtggagcttaagagcctcgatgaaggtcgcgtccacaatagagccaccccgcgccatgatccctgccttctcgagctccgaattcaggtcgtgaagcatagctttaccgagtccccgccgctcgaggctatgacggaatttcgcaagtgtcgttgcatctggcacctgctcagacatgaggtctaagtgcatgaagcgctgcatggaccgacaatccaggatagcatcttcggttccctcgtcttaagagagcaaacatgacctgcagcagatacatcctaagcatcgtctttgcactgcgcacatgcctgccacgcacctgagaatggtagctgggttctaccagtgcaatccagctatcccatggcacgatcgcatccatccgctccaggaatgcctctcgccgggtcttcttccttagaccttaggatttaaggtccccaaagctcatctggctgcccatatcttccttttggatatgctggaatacgttgctgtaattataacatatccgcaggcagataggcatttatgtgggtatgggcactgcgtggttcgagacattttaagccggcggcatacagcgtacagccccagctacctcatcgaggcgaattaatcatcgtttccctaggcgatcgtctctacagcatgcacaaggccacctgcgacatccacgccgatatgcgccttgtatccgatacggcaggctccccctttcttggactggtgcgctttaagggtcgcgcgcatggtcgtggttcttcgtgaagctttagggcccaggtgaaggtcacatccaccatggagccgctccgtaccgtgatccctgccttttcgagctctaagttcaggtcgtgaagcacaagctttgccgaactcctctcgctttaaggctatggcgcatcttcgcgctcgttgttgtatctagcacctgcgcttgcatgaggtctacgtgcacagaagcgcctccaggagcggcaatccaggatagcatccttaggttctctcgtcttaagagagcaaacattacctaaagcaggatacatcctaaagctttgtctttgcagcgcgcacatgcctgacaagagcctgtcagtggtagctagtatctaccagtgcaatccagctatcccacacaacgatcgcatccatccgctccaggagtgcctctcgtctggtctttctcctcagaccttaggatttaaggtcctaaaagctcatctatctgcccatatctgccttttggatatgctggaatgtgtggatgtagctataccatatccagaaggcagataggcatctatgtggatatgggcactgtgtggttcgagacattttaagccggcggcatacagcgtgcggccccagcgacctcatcgagccgaattaatcatcgtttccctagattgttagatctgcaagttagctaacaattgacattcccgtaaactgaagtctcgctgttagaccataattgacctgacgcccctgtccttccaatagctccagaagggctgctctatgtctatgagcgcacgcctggtatagaacatacctgcctcctgcaagctgtcctgagagtatatccttcttctcctgctcagaatgccttacctgctctatccacaggaagcaggcaagacaagtgccccagccacttcgtagaagaccccatggaagaaaagcaggaactcgcgcagccttcgctgcatcgcattgacgaggctaagctcgctgtgtgcttgaagaccccaagcgaaggagagccacgcgcgcatatcctgtatggtcgtcagtggcgacccataagctgtcgacgatacctgaaagggcatctgttagcttcccgtcctcggtcctgcccctgccgcagaggatggcatattcgtcgcttaagtcattcgcgcagcactccacgcagaccttctcattcgatatgccacagcaatgcactacatggccgtgcgtgtgcgcctcccttgagcatctggatgttgggccttgccctgttgcctgcaagcgactcgccgatgtagatcccgatcttttggcaggagacggtgggtccatacctgaaggcgccaagcgctgcctgcatcacctcgaagagcctcatgtgcataaaaccacaatgtccttaaggctcacatggcagctttcggcaagcttcttcaagcgtcatgcctgcaagcgtgccctttgcatatgcggcctatgtggcggccgtgggctttgacatagccaggacagatcttgtctttacaaagaaggtcttgcctcacgagcaacacttccatctctggaggccacacgcgtcgtggcccttgcaatagaaactgagcgatttgcacctcgggcaccgcaagggcagagcctgccatcttcttggctatgagcgccttcagtctctctaagagctcgcgcttctcggcgatccccatctttttgatctgctgcagtatcattggatccatccgggtcctttgatcctcgatgtctttgtttgatgacatgcattgtaggtaaaggcccggacacttttgggcccttctcaggtcaatcctggtctaacagcgagactgaagtttacgggaatgtcaatgtctcatatggagaggacggggttaatcccttgcagacacattttacagatgtaggagcagttaagtctattttgcgaactgtttgattgaggctgcaatgccctcaccgtcgagctgatatttgtgcaagagctttacagcagggccggattcaccgaaggtgtcttgcatgccgagcttcttaaccggtgtgggcatagcctcagagagtacgtcacacacagcagagcccagaccaccgattacagagtgctcctcgaccgtgacgacataccccgtcttcttagcagaggcaagaagagtatccttatccagtggtttggtggttgccatgttgataacctcacagctgattccttcatcctcaagctgtttggctgcttgcaaagcggaggtaaccatcaaaccggttgctacgacagtaacgtcagtgccttgtttttctactgtggctttgccaatctggaaatggtagtcatcactgtggacggcagggactgccaagcggccaagccttaaatagactgggccttctgcgttgtaagcggcctctactgcctgcttagtctctctgtcatccgaggggcaaatcacagtcatacccgggatcacacgcataagggcaatgtcctcgttgcactgatgggatgctccgtcctccccgaccgagatgcctgcgtgggtggcgccgatcactacgtgcagatggggatagccgatcgagtttcttatctgatcaaaggctcttcctgctgcaaacatagcaaaggagcttgcaaagaccttgtgcccggtagttgcgataccggcggcaacacccataaggttttgttctgcgatgcccacatctaagaagcgctcggggaactccgccttgaacaggccagtcttggtggcagaggctaggtctgcatccataactataaagtcatcgtgtttgtgtcccagctccaccagtgcctcgccgtagctttgacgggtggctttctccaatgtttctgccatgttccttaagcctccttttcaagctcagccatggcctgtgcatactgctcatcgtttggagccttgccatgccagcctactttgttctccataaacgagacacctttacctttgatcgtgtgggccacgatgcaggtaggagctcccttggtagctctggcttccttgaaggcagctctcagctgatcgaagtcattaccgtcggttacttccactacatggaagttgaaggctttgaacttgtcagtgataggttgtgtggagttcacctcaccgatcgtaccgtcaatctgcaggttgttgttgtccacaatcacgcaaaggttgtcaagcttatggttgccggcaagcattgctgcttcccagacctcaccttcctcaagctcaccatcacccaacaatgcatagactctgtaggtatctccccagtgtttggcggcatatgccatacccactgcggcagaaataccttgtcctaaggaacctgtggacatatccacacccggggtctcgctcatattggggtgaccctgcaggaaagagccggtgtgtcttaaggttgtaagctctgacttatcaaagtagccacgctctgccaacgccgcatacagtcccggcgcgcagtgtccctttgagagcacgaagcgatcacgatccggcttgcgtgggtttttaggatcgatgttttggagttcttcgaaatacaggaaggcaaagatatcagcggctgaaagcgagccaccggggtgcccggacttggctgcgtgggtgccttcaatgataccctcacggatatcacatgctacctttcttaactcagtatcttccatagctgtcctttcaagaaagggatttttgagatagaaaggggcatgcggcaggtaatatacattgtcctggcacatgcccctaaagggggacttacctagcgttgcccgtgacctttgcccagtcagctgcgaaaagcttaaggccacgctcggtcagcggatgatacacacagttctttagtgccttgaaaggaaccgttgcgatgtctgcacctatgagcgctgcctgcgttacgtggtacggggtacgaacagatgcggtgatgatctcaggtccgccttcctcatcccagtagccgtacttgtagttgtggacagccgtgacgatctcacgcaggtgatttagaccattgtctccggtatcatcgaagcggccgacaaatggtgagatgtaacgtgctcctgcacgcgctccaagcagtgcttgtggcactgagaagacaagagtcatattgaccttgataccctcttgtgccaggtaatgggttgcaggaagggaggcctcagtgatcgggagcttgaccacgatgttgtctgcaagtgaggctaagcgctcgccttccttaatcatgccctcagtggtctcagcggtgacctcagcagatacaggcaggcccttacagatctcgcagatcttcttcatgtggtcctcaaagcctgcaagtttgccgcccgccttagcgtatagtgacgggttggtggtaacaccagccaggcacccccagcttgctgccgtcttgatctcgtctaagtctgcagtatcgataaagaacttcatgacaatttcctttctggttaatttcatggttgtagtctcaagccaaccgcatcctttttacggttcgctctgctacacatatgattgcatcagtttgatagttacagtcgcagtgcctgcgtacttaggtgctcagattcataacaacgtggtgctgcttctaaaacgtgttggaactttacaccaattcaatgaccaaatacttgttggatggctgagcggctaaaatagctttacggtgttgagacactacgcgttatcatctcaaggcatacaacaacatcttttttggttccggacccaaaaaaaacaagtgtctaaggaagaccgacccggcatacattgagacagctcaaggcaccttatttcaaacgttccgcaagtttttcttcaagctcattcttgtcgagaatgttattcaaaataatcttcttctcatcaggaatgtcgctgacaaaatctttcagatcgccgccgacaacaaacaaatctgcagcatttgggttgatatcagagatggtagtgtgatcaacctcgatttccgaatgaccaagcttgtttaagatctcttcggcgttcatacgaactattaagcttgagcccaacccggaaccacaagcgcacatgatcttgcgaatagccattgtatcctcctcatcccttctcagccacatagaccgagaaaccgactctgccttgttagtggcagctataaccaaacagttcagacacatcaatcacggaacatgacaacaagcaatcagcacttcgagtaacagtgtttcactgcaatctatctgccgatcttcttctaagctggcatccgtatataaaagtccattcagatgtcagctatgcaacgatcactagaagctgactgtttatgagccaatcatttgcagatcttcgtacttgaagttcaaaaccttgtaccctacgcctctaccacagccttcttaggagcgacgtagttgtagatgataggaatcaagtagaggatcacgcagatagcgatcaacactccaccctgagcgacattgacaaggttgccgaagagaatggcgatccaggagaaatctgcatcggagaacgtagtcccaacatacccgagggcgctgaagacaggcattgcgagcatcggtaagaaagtgatgagaaggccgtgcgcaaatgcgccgactacgcaacccttgataccgccctcagcattgccaaatactccagcggtggcgccacagaagaaatgaggaacaacacctgggagaatgagggcaaccggaataaatacattgattccgttgagaagggccagaccaacgaggccgccgacaaaggaagaaaggaatccgatgatgactgcattgggagcatacgtaaatgcaaccgggcagtccagcgctggctttgcaccgggaacgagcttgtctgcgatacctttgaatgcggggacaatctcaccgatgatcagacgaacaccggaaaggatgatgtagacgccgcccgcaaagctcatgccggaagtcaaagcccacacgatccagtttgtctgggtttcggtgccgatgttgagcagcgtacccaaatttttaacggtcaggccatagggagcaagtaatgcagtagcttcttcggctgaaatgcctgcaggaacgatattgagaatacctcttccgactgcaacggctgtgatgatgataaagaagaccatcatggtaagggagatggatacagtagtatcacgcaggaaaataagacgtttcgggaaattaacctcttcggtgctcttgcgcttaggatcttttgcgaagagtttgccgatctgaccagcaaaccaataaccgatgccgccaaaatgaccaagtgctaccccatcagaaccagtaaccttacggaaggtaacctggcagtaagctggtgaaaggaccatgataagcccgagcaaacaaccgccggcaatgtagagaggaataccttcaagatgtcctgctccgccgagaattacagcgagcatacaggccatatacagcgtgtggtggccagtcagaaaaatatatggcatccgtgaaaaacgagcaagaatgatgttgaacaacatgcccaaagccataatgattgcagcgctggtaccaaagttctgaagagcgtcagctacaacagcttcattatttggaacaacaccctgcatgttaaatgcatagttgaaaatctcaccgaatgcatttaaggaaccggactgcaggaatgcagaacctgcagtcagaaccaggaagcctacgatggttttgatggttcccttaacaacgtcttctgctggtttacgttgaagtactaaaccaagcagagccaacaggccaaccagaatggctggtgtagacagaatgttgacaataaagtcaagaatggccattaactcctccttctttctaaacccgaccttttatgcttaaagccatcgcaaacatacccccctgttcgcgttagccatctgcactaacagtgaagttgacaaaaaagttgtagacatcatcggcagtctcagcgtttgccacacgcctgatgttttctgcatccgcaaacatcatcgctaagatgcgcatgacatcaagatgggaattggggtcagtggctgcaagcgtcacgagtacgcggacaggatcgccaccttctttaaaaacggtaccgtgacgtaaaacggttacggcaagttgctttttaagggctccctgttccggacgtgcatgaagaagtgccaaatcaggtaccagtacgaagtaaggcccaagctcaagtgcattgttgatgatgccgtctatatatgcaggcgtcacgtatcccccgtccaccagcggctgcgcagcaacatgtactgcctctttccagtccttgcatgagtcaacaatctgaacattctctcgtttgagcatttccttcattgcttccattgaattctcctttatgtgtatgaattgtggagcaatacttctttaattgataacaaacaagaacaagcaggatctcttttctgtttctccttcgaatgactttatattattccatattattccagttctttccagttttattttttattttccccatatttattgttcctggtagaaatgatccctaaaaatgggaaaattctattacatgagaaatacgaatgcgagcgacgtgatgcagggactaaagactctgcctaagttacgcaagcaataaacctaaacatggaatcaatgttgcaaggaggtaggacagaacatgtttcgcagcgaaagacgaaatgaaatcatgtctcttattcgccgcgatgggcgtgtgacggtgacttctttagccagacagtacggaataagtgaggatagtatccgcaaagatctgcaggaacttgcacgccagggcctctgtaagcgtgtgtatgggggtgctgtattacctgatggagaggaaccagaatcagacatccaagacgattcctatagcaatgtgcaaataaactcgcaaggggctgcatatgcaactgttccccgcgaaataccccatactccaagtttgcatgatcgtatatctcagttacgtcatgcaagatccgtatacccagtcaatgtcagccagaacaacactgctagtccgagatctgatacacaatccaaagagagtttggaaagttgtgtgaatacagtcccaacaagtgaatcctctcaggtgccatcaacatcccaacagcatttttctgcacaatcagcgttttcacaaacgccgtcatttgattcagcttcagagcaagccttagcagaaccaggcaaagaagatctcgggcgtatggcagttgccaggcgagcatactatgaaatcaatgacggggataccgtctttctggatatctcacgtacgaacatctatattgcgcagcttattgccgcaggcaacaaacgggttattgttacctcaaatatgctcgatgtattacgtatcttgtcaaatttacctcatgtcaccgcattgggcactggtgggtttttgaactcagaacttaatggatttgtaggctcagcaaccataagtcttatagagccgcttctcttctccaaagcttttattggtgccagcggcataaaccttaaacaaaatgcggtgacttcaaacgacattgattccggtgctacaaaggagcacatcattcaaaaagcatcatataaattcttacttgctgatgctgaaaagttcaactattcaagtgcctatcggttcgcttcgatcaatgacttctctgccgtcatcacggattcaacggaccctcacgtatttgccaggctgcggagattagcagtacctgtacttagggctggatcataagagaaaccatggtgcttttcttactctctgttagaccatgattgacctgagaaggacccaatgttgtccgggcctttacctacaatgtatgtcgtcaaacaaagacatcgagaaacgggaggacccggatggactcaataatactgcagcggatcgagaagatgggcatcgcggaaaagagtaagctcctaaagaggctgaaggcccccaccactaagaagatggctcaatctttgctagggaaacgatgattaattcgcctcgatgaggtagctggggccgcacactgtatgacatcggctcaaaatgtctcgaaccacgcagtgcccatacccacatagatgcctatctgtcttctggatatggtatagctacattcacacattccagcatatccaaaagacagatatggacagccagatgagcttttaggaccttaaatcctaagatctgaggagaaagactgggcgagaggcattcctggagcggatggatgcgatcgttgtgtgggatagctggattgcactggtagataccagctaccacggacaggctcttgtcaggcatgtgcgcgctgcaaagacgaagcttaggatgtatctgctgcaggttatgtttgctctcttaagacgaggaaacctaaggatgctatcctggattgccactcctggcagcgcttctgtgcacgtagacctcatgcaggcgcaggtaccagatgcaacgacacttgcgaagatgcgccatagccttaaagcgagaggagttcggcgaggcttgtgcttcacgacctgaacttagaacttaagaaggcagggatcacggcgcggggtggctccatggtggatgtgaccttcacctgggccttaaagcttaacgaagaacaaagaccttgtacgcgacctttaaagcgcaccagtccaagaaagggaaggagtagcgtatcggatacaaggcgcatatcggcgtagacgctggcagtggccttgtgcatggtgtagagaccaagcgcctagaatgtatctgacatatcctgtggcacacacactcgtaagggagtatgacaggttctgctgcgcagactttaggctatataggtatagcgaagcgcccttaaggacgcataaagacccacacctctcatctatgcgctaaagcgttgcaaggaagccttcgactagagagggccttgcctgggcactcttctccgagaagggcatcgagtccaggaaggcatgcgtttgcttaaaggtagaagcatctctttccttatcgtgaagcggcgcttcgaccctttaaggaagcgctactaggggatagagaagatgcctgtacactcaagtctttctcgcccttgcaaaccttacccatgtgcatctttgccggcaggctgcacctcccggctcccagcgtcgcttgatccgtcttggagccttattgcggtgcatggggcattaatcatcgtttccctagactgttagactgtactttatgatacttaagcgctacctcttgcacagacacatacagcacaagctgtagctgagacaagaaagcttgctgtatccggttgtcctgtcaagaccagcacaccaaacacaggcaaagggtctgcacagcacagagatgtcacacagacactgaaagctgattttctggttgtgtcgaaaaaagtggtatatgagagggaagctacgagaagaccatcgccggtcctagaatgtcggttgcatcgatgacgacacaaggaaacgacgatggtcagctcaaacagaatacagcgtggggacccgcagctgaaggaggtcctgctcggtttcttagacagcgcctcgagcctgtgcgacatgatgagtaccaccatggccgccatactcaacgagatcatgtccatccaggcaaacgaggcgtgcggagccgagggcgccacccgctgtgagagttgcgtgaacagctgctgcgactatcgcgagcacaagctaaagaccgcggtcgggacgctcccgctgatgatgcccaagctgtacagcggctcgtacttcccgaccgagctcttcaagcgctgcatcgcgtaccaagtgcgcgctggctgagatgtatgtcaccgccacctccacgcgcaaggtcgagaaggtggactccctgtccaaggaccagctcttacgcctgcgcgcggtggtagagggtaaggtggacgcgttgctggcgaggggctgctcgccgctccgcttcgcctagctgtttcttaacgccacctatgtgagctggcgcgtggcgcagggaggccttcattgtggcgatcggcgtcggcgacgacgatcagcaccacttcgtggggttcacgtgtgtgaattcagaaagctacacctcctgacgcgggtttttgcaggaccttgaggagcgcggagtgatcatgaagctggcgatttacaagtacgagagagcggcataaagttacgccaacgcaggaggctgccgatatcgagactggcgcggccctattcttacaccacaaaactcgacacaatcgattttctcttctgtctgccttgtcacccgtgacaaaaagcgagcgttgaaaaacacctatggccctatctaagagtacctcccaaagcatacaagctttcctgatatcaccttatctgaagtcagatagctctatacgaatgctaccaacctaagaccacaccagatgcctagctaacaagacaccctgggaagtctttcgctctcagacattgcagttgataggagaattcaagaaataatagaaatcattgcagctttggcatacggtaaaggtaggaattcgatttaccgacattggagcatacgctatggatctccctg

SEQ ID NO: 325 - DNA, 12571 bp, Unknown
  Metagenome-assembled genome
cataagagggtttcgctatgatagctgtcgtcaaatcgagcgccacgcccgagcagttggctcacttcgtcacgtggattgagcatcacggattcaaggccaacgtctccaaaggggaaaatgagaccattgtcggtatcatcggcgacacctccaagatcgatccgttcctgattgaatcgatggacattatcgaccacgtggcgaaggtctccgaaccctacaaaaaggccaaccgcaagttccatcctgagaactccgtgatcgactgcggcttcaacgttaagatcggcgccggcaacttccaggtgatcgccagtgtctccaccgacgatgggagatcggtggataacttggcacagcgcgcccataaagcaggagcggggcttctcaccgccgatgtctacaacatgaagatctccccctacctctacaaggggctacagcaggataacctcaccgcgctcgtcgaggcagcccacgccgctcagctgcccgccgtggcggagatcctcgacacccgcgacgtacaggccttcattgacgccgatatcgacgtcttccaggtgagcagcaagagtatggaggactatccgctgctgaaagagttgggcaaaacgcagaagcccgtcatcgtcaagcgcggcgtcagcgcaacggtcgatgattggctcatggccgcagagtacgtgatgagcgagggcaatgaggacgtgatcctgtgcgagtgtggcctcaagagctcagagcagcgctaccaccgcgtgctcgacgtctcctcgatcgtcgccgtccaccagctctcccatctgccgatcatctgcaacccctccaaagcctccagcttagcgcgctatgtggagccactctccctggcagcctgcgctacgggcgccgacggccttgagatcgatatcaaggcagacaacagcggtgatcccctcgatgagacggggcgcgcggtcgatctggactcttttgcttcgaccatgaagaagattgctgcgctgcacgcaaccttaggaaaggcgagcgagtagctatggagatggataagaagatcgttccgggacgcgtcggcgtcatcggtctcggccttatgggaggctcctttgccaaagcctttgcgaaggccggtgttgaggtctacggctacgacgtcgcagaagacgtgatggagcaggcagaggtagagacgatcgtggggcgcctcaccgacgacgtgatccccacctgtgagctcatcattatcgcctcctacccgaaggcctgcatcgaggagctcgcccgcatcgcgcctttggtctccgccggcgcgatcgttatggacaccggcggcgtcaagaaagtgatctgcgatcagtgcttcccaatcgcggcgaactaccccttcacctttgtgggttgccacccgatggccggcacccagcactccggcttcgcgcacgcccgcgccaacatgttccacaacgcaccgctcgtcattgtcccaccgaagatggacgactttgctcgactcgatcttctggagcgcatgaagaaactgatgaagccggtcggctttgcacggttcacactcacgaccgccgaagagcacgacaagatcatcgccttcacttcccagctcgcccacgtggtctccaacgcctatgtcaagagccctgaagcgaaggtccacgacggattctctgccggttcttaccgagacctgacccgtgtcgcgtgtctcaacgccgacatgtggaccgagctcttcttggacaacgcagacaacctgtccgcagagatcggctgcctgattgagaatcttcgaaagtacaagattgcgatcgatgatcgcaatgcgcactacctgcgcgagctcctcgctgagggcgatcgtcgcaagcgcgaaattgagggagagatagaccatgacagatacaccagacgccaccaccatcgaggtgccgaccgcctcaaagacctatctgtgccgtgtgggagcccacatcttgtcccaggtcggaaacatcacccgtgagacctgtgggggaaccaaagcctgcgtgatctcagagtcccacgtgatgcccctctacggcatggaggtgatggactccctcaaggctgcaggctaccaggtggtccctgcggtcttccctgccggtgaggcttccaaaaacctcaccacactcggtgagctgcttgagaccgtcgccaactacgagcttacccgcggcgatgtgatcgtcgccctgggcggcggggtcaccggtgatgtcgcgggacttgtggcagccctctatctgcgcggcatcaaggtcgtccaggtgccgacttccttacttgcaatggtcgactcctccgtgggtggcaagactgcgatcgatattccccaagggaaaaacctggtcggcgccttctggcagccgagcgcggtgattgcagatatcgactgtttcaagacgatccctcatgagcttttcaccgactcctgcggcgaggtgatcaagcacgcagtattggcggatctagaactgttcaagacactgcagaagacacccctcaactccggagagctcgacgagcgagcaatggcgaacatcgtggcgcgaaacatccgcatcaagcgcgatgtggtcgccgccgacgagcgggagcagggactgcggcagaccctgaacctcggccacacgattgggcacgcggttgaagcagcttaccacttcaaactcggccacggcagctgcgtggcaatcgggttgtgcgcgatggcacgagcttccgcaaagaagggctggtgctctcaggagaccgcgcaggctattgaagacctcgtccgcgcccaccagctcccctacgatacaaagatcgaccacgaggtgatcgaggagtatgccacccatgacaagaaacgccgcggtgactccatcacgatcgtcgtgccaacgaaaatcggctcagtgacgctcaggaagatcagcagagctgagctgcgtgagcttatcgatttgggatgcggatctggacggcaaccatgaatgtcactatctctcctcacgccctgtcgggcacgatcccttcaatcgcctcgaagtcggtggcgcaccgcatcttgatcctggcggcgttgtgccccaccgacgccgagatcgcctgctcgaccacctcggtcgacatcgacgccacaatcaggtgcctcaacgcgttgggggcagcgatcaccccaactgaaggcggctaccatgtggcgccgattccggcagttgaagagagaacctccccgcgcgggaatatcggccgaacgctcgactgcgaagagtccggctcgaccctgcgcttcctgcttccggtggtggcagcactcggctgcggagcccatttcacggggcacggcagactcgccaagcgtccactctcccctctctatgaactgctgcaacagggtggttgctcactttctccccaaggcacgtttccactcgacctatccgggaagctccagtcacatgagttcatcctgtcggggaatgtctcctcacagttcgtcacaggactcctgatggcagcgtcggtgatggacggtccggttaagattgtggtcgcggagcccatccaatcacgcccctatatcgatatcaccctcaaagccatggccgacttcgggataaagatcatgagcaccccggttctccacggtgacaaggcgtgcgttgagtacaccgtcacgccgacacacaccccgctgacctcccctggcctgctcaccgtcgaaggcgactggtccaatgccgccttctggctctccgccggcgcaatcggcaccgactcggtctgtgtcaccaacatgaatctctcctcggtccaaggagaccgctactgtttggccgcgcttgcactgtttggcgcccgcatcaaccgggcaccggggcaagtcagcgtctcacacggtaccttgagccctgtcaaaatcgatgtccacgatatcctcgaccttgtcccggttctcgcagtcatcgccgcctatgcccagggtgagacccgcttcacccatgcggagcgcctgcgtctgaaagaatccgaccgcctcgagagcactgcaaacctgatccgcgcgatgggcggcgaagtcgccacgactgactccgcactcacgattgcgggacacggcggacttcacgggggcggcccggtcgacaccgcaaacgaccaccgcatcgcgatggcagctgcaatcgccgcaacctgtgctgaggagcccacgaagatcctcggtgccgagtgcgtatcaaagtcgtaccccagcttctttgaggacttccaagcgctcggtggccttgtcaaaaaggaagtgtgatctatgccctctcatatgggtactacactcacagtctcggtcttcggacagtcacattcgcccgcgatcggctgtgtggtcgaggggcttccctcgggaatttcgatcgatatggataaactgcaggccttcatggctcgccgggctcccggacagggaaccttcacgacgccgcgcaaagagaaggacatccccgagattgtctcagggttgaaccagcacggcacaacctgtggggcaccgctcgcggcgatcatcagaaacaccaacacccgttcggttgactacaagaacatcgcctcggtcccccgccccggccatgcggatttccccgcctgggtcaagtggggtaaggatcacgatatcgcgggcggcggccacttctccggccggctgaccgcgccactctgccttgccgggggtatcgctctacaggtattgcagcagcacggtgtggaagtcgccgcacacttgagctctgtaggtcagatccacgacgagcggctctacacctacaacaactcccccaagggccgagaaaagctcaaccagcagatcgagacgctgcatgagcatccctacacgttgcccactctctcagaggtagcctcaaagcacatgctcgctgcaattgatgaggcgaggcgcaacattgactccatcggtggcaccatcgagtgcgttgtggcaggcctgcctgccggcatcggttccccgatgttcgatgggatggagaacatcctggcgcgtgacctcttcggaatccccggtatgaaagctttggaattcggccgcggcttcgatgtggcccggctccacggttctgaagacaatgacacctacgcgctcgacgagcagggtcaggtctatcccaccaccaacaatgcgggcgggatcctgggcggcattacgaccggcgccgcgctgtcctttagattggctatgaagccgacctcgagcatctcgcggccacagccatcggtcaatcttgctacgatggaggggacaacccttacagtgcatggccgccatgacccgtgcatcgccgtgcgcgccgtcccggtcgtggaggctgtagcggccctcgcgtcgctggacgcctggctctccttccctccccaaaacactgcgctcgatacacaaaagtgaggtacgccgtgcgtgatcttcctgaagtaagaaaagacctcgacagcatcgactctcagatgatcgacctatttctgcagcgcatgaagcttgcagatgaggtcgctgactataaggccaagaaccatctgcccattttggacagagagcgtgaacgtgagaagctcgcccgcgtcgcaaactcggtcccgatggaattccgtaactacgcgcaggtcttagagggccttctgatggaagccgcacgcgccagggagtacgaagacatcggcacgatgtccaatgttggcagccaaatctacgaggctatcaagcatgagccgaagcttttcccgcagcgcgccaatgtcgcgtgccagggggttgagggtgcctattcgcagatcgccactgaccggatcttcaagcatccgacaatcgcctactttgactctttcgagggggtcttcagagccgtcgaagagggtttctcccagttcggggtcctgccagttgagaactccaccgccggcaccgtcaaccaggtgtatgacctgatgatggagcatcacttctcgatcgtgcgctccacccgcatcaagatcgaccacaacgtgttggccaagccgggcaccgagatggaccagatcaaggatatctactcccacgagcaggcgataaggcagtgccaccgctttttgatcgagcacccctacatcaaggtacatgcggttgagaatacggcgatagcggcgagaatggtcgcggagagcgaccgcgacgacgtggcagcgctctcgagccgtgcctgcgccgaactctacaacctcaacatcctgatgcacagcgtgcaggacaccgggaacaacttcacacgcttcgcctgcatcaccaaggacctcacgatctatcccggtgcagacagaacctcgctgatgctgatcgtcaaccatgaaccgggcgcgctgtacaaggtactgtcacgcttctatgccctcgatatcaacctggtgaaattggagagtcgaccgatcccggaccgcgacttcgagttcatgttctacttcgatatcgaatgccccgctgaggccccggagtttgccaccctgatcaactccctgggcgatgtctgcgaggagttccgctatctggggtcataccgagaaatcatttaggagcacacacctatggatacatccagacacaccttcggcctgatcggccatcccttgggacacagctggtccccgctgatccacaaacagttggggtcaaccccctatgacttaatcgagctggaaccagacgaggtagagccttttctgaaggagggcgactggaaggggctcaacgtcacgatcccttacaaggaaaaggcggcacagctcgcagatgtcaccaccgagcgcgtcaagcgcaccggagcggccaataccttggttaaagacaaggacgggcgcattgttgcggaaaacaccgacgtgctcggctttgagtatctactggagcgcttctgcacacagaaactctacgccacctctaccaaacagctccttcagcaccaggacgtgttggtcttaggatctggcggagcgagcaaggcggtccaggcggcgctagaggatctaaatgtacacgtgagtgtgatctcccgcagaggtgaggacacctatgccacgatcacccaaaagcatccccacgtctccctgatcgtgaacaccacccccgtgggtatgtatcctaactgcccgaagagtccgcttgatcaggagaccctcgccgcgtttccggagctattcggcgtgctcgatgtggtctacaatccccggcgcaccaaactgtgcatgctggcagagtcgatacacctaccctcggagtccggcctcgcgatgctcatcgcccaggccttccattcaagcaccctcttccaggacaaagacctcgacgattccctgattgaaacgatcgagaatacgatcgtacgggaaaccgagaacctgatcctgatcgggatgcccggtagcgggaagacctcaaccggcaagcacttagcgcacctgctgcaccgccctttcctcgatatggaccaggcgttcacgatggagttcgggatcagccctgccacctttatcgaaacaaagggtgaagcgagcttcagagaattggagacgagcctgcttgccaagagcgcttcacgccccggcatggtcatctcctgcggcggaggtgtcgttacccgtccggaaaactatgagctgctccaccagaatggccgtatcattatgctcgaccgacctctgatcggccttgaaaccgatgggcgccccatctcacagcgtgacgggatcgccaaactcgccgagacgcgcatgccgctctatcggggttgggctgacttcgtgatccgcacaacgggcacgcccaagggtgacgcagaggcgattctctcgaggcttaaatgctccaaataaacgatctcctcacacaatctaccatagtacctgcacaaacaggtaccgaactgtgccgctgacaccggaatagcaccatttggggcatccgtttggcaaagcgcctgtttcacccatagactagagacatcatatacatatcaagtttattgaattttgaatctcattgaaggtttcccatggatgaacagagaacagccgagaaggtacttacagctgtaggtggaagaaagaacgtactcgacaatatgatctgcatgacgagactgagggtgacagtgaatgacccggcgcttgtggatagaaaagcactcaacagcatcaactcggtcttgggcatcgcccagcggggttccaacagcatcgaagtcgtcttcggccccaatgtgatcgaccgcatcttcaagagctttaccgacctcacccatctctcacaggacatgcaggtagagaggccacagcaccaatccaagaagagaagcgaaacgcccgaaaacaagcgctcctatgatatacaggtcaaagcgaacactgagcgagccgcacagtccccggacagcgcgagcatggataccgacgatatcgagctcttagagcacatgtttcccaatgcgcaggcaaagtcgcaggcggagacaggcaaacagggaacggtcgcccacatccatgcctcaaagcttgtaaatgcaccggcagtggctgcagctaaatctgtcaaatcgacttcagaaggcgagcgtctccttattatcaacggccccaacatcaacatgctgggtatccgggaacccgacacctacgggacggacacctttgcagatctgctcgagctctgccagcagtccgctaaagaagcgggcttcaaagactgcctctgcttccagtcaaaccatgagggggatattgtcgaccaaatccaggacgcttactacgtctttgatggcctgatcattaaccccgctgcctatacacatacctcgattgcgattctggatgccgtgaaggccatcaagatcccgacgatcgaagtccacatctccgatgtgccggagcgcgagagcttccgacaggtctcctatatcagagaggctgcctttgagacaattatgggacagggtatccaggggtaccgcaaggcgatcttcgatatgtggaaccacctgaaggcactctagtgcagggtgatcctaaaactgctgaactccgtgaccaacgtatcgactcgtacatcctgcggaccgatcgggagcgggttggagcttacctgcatcgagcgggcaagccctattttttcacccatatagaaagccaagtacttatcgtaatagcccccaccgtaaccgacgcggtagccatcgcagtcaaagacaaggcccgggacgatgcacacggaccccttctgcattttctgggtcacgatcttttttgtatcgacgtccggctcgaggatacccatatagctgggatggacgtcggcgagcgaatcgatcagatagaagttcatcttgccgctgtggcacttcggtaccgcgacctgtttacccagtttgagagtcttggtgatgaatccttttgtgtcaacctcattgccgaaggagatgtagctcaaaactaacggcgccgcctgatattcttcaagcttcatgacgcgctcgcagatcacctggtcgcaccgcttgcgtttaaccgatcctatcgcccggcgcataataatgtagtgctggcgaagagaggttttatctgcatcggagccagttgaacttggcatgcatcgctacctttctcttcgttgtgggacaaatatgggctgcggtgacttattatcgcagccaaaatgaataaatcaaagttaaactcacacttttttacctgctactatagtaacttgtgagtgctgagaagatagatatacacattgtatccgcagattttattaacgaggagttatatatcatgccgaatgaaggaagtctagacgctgcagggaagcgctctgagcgtatagccgccgatatcaaagcggggaatgtcgataactataccatgctgaccggagaccgcccgaccggcaggcttcacctcggccactatttcgggacaatccgtgagcgcgtccgcctccagaatgccggtgtcaacaccaatatcgtgatcgccgactatcaggtgatcaccgatcgtgacaccactgagcacatccaggacaacgtgtacaacatggtgatcgactatctagcctgcgggatcgaaccggacaagacgatgatcttcacccattcggcggtaccggcggaaaaccagctcatgctccccttcctctctctcgtgtctgaggcagagctcgagcgcaacccgaccgttaaggccgagcagcaggcttccggccacgccttgaccggtctgcttctgacctacccggtccaccaagcctgcgacattctgttctgcaagggcaacattgtcccggtaggcagagaccagctcccccatattgagaccaccgctaagatcgcccgccgcttcaacgaacgcttccactgccacgtattccccgaggttacaggactcctcacctcaacccagctgcttccgggtttagatggcagaaagatgagcaagagctacggcaacgcaatcgccctcagcatgaccgccaaggagactgcaaagctgatcagaaagtcaaagaccgactcccagcgcacgatcacctacgacccgatcagcagaccaggcgtctccgcgctgctcaccacggcaggcatctgcaccggccgtgacccgaaggatatcgccgcagagatcggcgacggcggtgccggccagctcaaaaggtatacgaccgaggctgtcaacaactacttcgccccgatccgtgagcgccgcgccaagtacgaaaaggacatggactacatcaaggatgtcctgcacgagggcaacaaacgcgccaacgagatcgctcagaagaccctctacgaggtgcgagaagcaatgggcatggtgtattaggcaccagccatcgagtgcgtacgccacggcactgtgttaccgctcaggcggcgagcacagtgccgctctgtatatctcgaccgagcctttgtggagataccatcgtactgtatacgatgcctcaaaacgcccgctctttgctctgaggccgaaccaaactcggcactgtattcgacacaacctcaacatgctgctcgacaacactaccttatagagaaaccggcacagtcagaaggccgcaccagtcaagaaaaccacttactgctgtaatgaacgagggtaagaactagtcagggtccttgagcgtcgcatacatcacagctttgatcgtgtgcatacggttctcagcctcgtcaaagaccttggactgcggcccctcaaacacctcgttactcacttcgagctccggcaggccatacttctcgtaaacctgctcaccgatcgtcgtgttacgatcatggaagctcgggagacagtgcataaaaatcgcatccggtgcggctttctccatcacctgcttgttaacctgatacggcttcatggtcttaattcgcttggcccagagttcctccggttctcccatggaaacccaaatatccgtatagaggactgaggcgtccttggcaccttcgtctacatcctcagtgaaggtgaggtgcgcaccggattgcttagcgatcttctggcaggtcttgatgagctcaggcttcggcatgctctccttcggcccgcaggcgcagaaatcgataccgagcttggcacagacgaccatcagggagtttccaacgttgttgccggcatcccccataaaggtcagctttctgccgctcagatcctcgccgaaattctcctgcatggtcataacgtcggcaagcatctgggtgggatggaactcagtcgtgaggccattccacaccggcactccggagtacttcgctaaagtctctacccgatggacgtcaacgcaccgaaatctcaatgaattttggagagcattatatggcgtgtcgtcataaaatctcagagtagagggcagggctataacttgaaacgtgggggccgcggcgacctcgatttcaccttcctgagaaatctactatctgttgtcgctcgcccacgacctgaagaaaaaaaaggaagcaggggatcgaccccgcgtgtccggggggggattgagttattagaggaacgaaggcgtccttatctttgtaagaaaccgctagaatcatacaagaactcactaccgctaagctaacctacatatcacaaccaaacccgccatcataggctttccccgggcaaactacccgctctgtcccgcgtctaagcttaaccggcgctgctttataaacataaaactacacggaaactcccatctcacccttcataaaccaaaacaaatagcaaccactcacgaccaaaccgacgtgagagatgctccttggttgggtctaagcggccatgaccttaggacaaaggggaggggggcatgtgtaaggtgaaaagaaacataccctggccccaggcccgcacagctcggcataaggagccctcaaggacaccgcacgggtgcttggccgtatgtttgatggaatcgaataccgcggcttcggtcaggatcggt

SEQ ID NO: 326 - DNA, 10441 bp, Unknown
  Metagenome-assembled genome
caggtcatcgatactattggaagatatggccgggatgtggacgacctacttgagctctgcggcaaacttggaggtccaggcatgcggcataaagggtggacacctgcgcccggttgtaggagccatacacgccgttggagcagttgattgcgtcgatgacccacccctctaaggttttggcaagcatacaagactctgcaatgcctccgccgtccacgctgtccacaaccgcggagaagcggctatgattgggaaatccggaccgatgttcttgcagaccttgtcatagacttccttcaaaaagcggcagcggttctgaaagcagccactgtactcgtcggtgcgcttgttctggaagaaggaagcctgcgatcaggtagccgttgctaacgtggatctccacgccgtcgaagctgtcggtcttcacgttcttcacagtgacgtcgacgtcgtgcacgatgcccttgatctcctctttggtgggctcctcaagcatctggcggttccaggtgcaagcaaaatgggaggcgctcttgaccggcaccccaccgtcgaccttgctgttggtctgacggccagcatggtaaatcggtgcaaagatcctggcgccgtacttgtgcaccgcatcggtcagacgatggtggccggggatcatggactcatcgtagatgcgcgccacgttctggtagccgcctgcatgggcattgaccacatagtcctcagcgatactgggaccatagctgcccttggcctttgcctcgcggtaggcgatgtagcgatctgtcgcatacccttgctcatcgcacatactggtgaccattgcagcgacgacaaagcgattcttcaatgtgtaggagccgatggacagcggctctagcatcttctcaaggttcatggatacccctccagacatgcggttttcttttcccttcaggtgaagacggtaaagccttcagtaactgtggggtcaagcgatcaacgcagcaattgtggagaaacagcggtgtagtgaaggtgctctgagatacggatcaggtgccatgaaacaatagggaggacacctacggcgagacgcaaatacgcgccaggcaccgtacgcaccatagctctagatctttaaataactatccgaagtactccgagctgctgacctgtgccctataacacaatgtgcaggcattacagcttgttttcttttcacaaagtcttttatggatcccaccacatttaggggtgtgattgggtagtttgtttattgataggtatacaagaaatacatatagcagctagatacgtatcttgaaggatgatatctatggcacgtaaactcagcgagggaaataagctgtacttctaccagcttattgccacccactacgggatagggaaacaggtattcctacccaagatagaagagctcttcaaagaggacaatatcttcccggaagacttaggcttcgatgatttcagagcgctcctcgaagcctgttccgacattattaacctcaccgatttcaaggggaaccgctcctatgcgacgttggtgcaagaccaacgcttcgacgacgccttggcacaggctcagtctgactccaccccagctaagggcgggggcaagccctggaaacaccggaaggccgccatcctcaaaccgcagaagccgaagcaagcccgtcagaagaagacggctgagaagaaatccgaagcaaaacttgaggagcagccaaaaccagctaaggctgaagcgtcaaagcagccagagataaaagccgaaatcccccaacagtcagaagaatctcagccgaccgaaccggagccccaagaaactgagccgaagtcagaagcccctgaggctcctgctgcagagactgctgaggttgagggtgtacaggtaaccgctgagataacggaacctcagtcagagcctgccactgaagcaagcgagcaatcggagcaagaacctgaacccaaaccggaaccagaggctaaatctgagccggttaaggctgaggccgccgacaaggaaaaagaggaggagacttcccagacgcagaagctcggcaaggatcgtgtctttaccctcgacgagatcctcgctatgccttcggaatctcagaagaaaccggaggaaggacctgctgagagccaggaggaagcatcagaggaaggcaaggacgcgctgcccgctgaggtacctgactatatagtgcacaaagcgccgacttctcattccctcaaagagcaggatctgaaggaacagaaacgtattgagaaagcccccaccacggctgagcctcgggtatcttccagtctccccacgtcatttctgcggggcgtccactgcaaggacgaattactgaacatggtgagccagctgatgccgatcgactgcaatctgttgcaggtcctcgaggaggactggcaggcggcacgcgccgcagggacaatagagggaacccggagccgcgttagcttcccgctccgcttcctccacgaggacgggacaacccagatccgcctcacgatacagaggagcgtgcagccaatctccggaaagcattggtacctggctttggtggacggaaacgacggaactcatccgctcaagcaggacttcggcctcgaagggatgcctgagtccaaccagggagcctggacagccttgcagaccacccccaatccccacgcgaagagcccacaacagcgattcactgagtttgcctcctttgaaggctgggacacgatgctcagcaacctctcagatatggcagaggatgagagctggtatgccactgcgctcaaaacgcctgacacggtttatccgatgcttcgggaatacctcaccacaacctttgtccgcctgatggcagagcacaaggtcttggagaaccctgaccacgactttgccgccttcaataccggcttggtgactgatcaggaagagccgatctatgcctgcttcacggcaggcggcgcagggcccgacccttaccagctgagtggcttctgcacggcagatgaaggcgagctcggcaaaaagttcgtacgtaccctcaatcccctccccgaacaggcttcctacctcagtgccattgaggaggtccagcctcgttcggatgcacatctcacggtcaactaccgcacgttgctgttagcagagcttgacagactccctcaggactttgtcgcacccttcctcagggatgaaaaagtaagtctggcgcttgaggaatcctgcgccgcaggtatctcaggacaacagcgtgcccaggatgttcagacagtcagagagtatatctgtgacacgccggatgtcttcaaccagctccgtgatgcactggcagacccgatgaagaagagctggcaccgtgcaaagcggaactaccgtctcgtacttccggtctacgacccgatcgccaacacggttgagatgctcctgccggtatctttgaaagacaacacgaaagttgccacctgtgtccacatcgagaagaagggcagcaccacctatcaggcaacgggtatcgtcagccttcctgaagcagcctgtctgggccgcatcgtcaacccagagcttcccgcctggctcaagtgactgggaacagccgatcaaatcctaaaagtagggggaatggcgctcatgcaccattccccattttgttagtcgctttgggctttagagctatccgcggcgctctttgatctcctcagtgatgtcagcgataaagtcatcgagctcacgagcgacggtcttgttagagcggtcacgtacggagatgttgtgcgcctgctcctccttctcgcctaggatcagcatatacgggacacggtcgatggagcgggcctcacggatcttgtagccgatcttctcatcacggtcgtcgaccttgacgcggatcttgtactcacgcagcttctcctccacctcgtgtgcgtagtcacgggacttctcggaaactgggaggatcttgacctgcagcggtgagagccaggtcgggaacttgccggcgtactgctcgatcagcataccgatgaagcgctcaaaggagccgaagccggcgcggtgaatcatgatcggctgcttcttggagccatccttgtcggtgtactcaagatggaagttatgcggaagctggaagtcaagctgaatggtgccgcactgccactcacggccaaggcaatcctgcaggtggaaatcgatcttggggccatagaaggcgccgtcgcccgggttgaccttgtagtcgaggtgcatggcctcaagagcgtcgcgcaggcctttctctgcaccctcccaatcctcatcggaacccatggagttctccggacgggtggagagctcaacacggtacgggaagccaaactgcgcgtagtacgcagtgatcaggtgtgtgacgtcgatcacctgctcagtgatctggtcaggacggataaagaggtgtgcgtcatcctgcgtgaactcgcggacacggaagaggccatgcagggtgcctttgagctcatggcggtgatcgaggccggcctcagcgagcttcagcggtagatcgcggtaagagcgcggacggctcttatagatgaggcaggcacccggacagttcatcggcttgattgcaaagtcctcaccatcgatcttgatcgtatacatattctctttatagtgctcccagtgaccggaggtctcccagagcttacgggagaggatcagcggggtctgtacctgctcatagccgtacttgtcctgcatgtcctgccaatactgcgtcagggcattcttgatcctcatgccgttgggcagccagaacggaaagccagggcccgcctctgacatcatgaagatccccatctcctgaccgatcttgcggtggtcacgaagcgctgcctggcggcgcagctccaggtagtcctcaagctcctccttggtcgggaaggcgatcccgttgatacgggtgagcatcttgttgttcttgtcgccctcccagtaggcgccggagacgccggtgagcttaaaggccttgagtgccttggtgtaggtgatgtgaggaccaacgcacatatcgacgtagtcgccctgcttgtagaaggtgatacgggcatcctcgggcagatcgtggatgtgctcgaccttgtacttctcgtggcggtcctgcatatacttgatggcttcttcacgcgggagctcaaagacctcaaatttgagattctccttcgtgatcttcttcatctcgtcttcgatcttggggaagtcctcctcggtgatcttttccccctcaggaagctcgacatcgtagtagaaaccgttgtcagtcgcgggcccgaaggcgaagtcagcccccggatagaggtggctgatagcctgagccataatgtgtgccgccgagtgacggattacctgcagctcttggtctttggggcagtctgctacatggccgtcgttgtacagaatcttcatctattctctcctgtaggtatacaaaacaacaacatcgaaccataaaaattgctcctagctagcttgtttgctaggagcgagcatctacatggcgcctgtcaacttgacatagtctctcgcctggtacgggacagacgcctatttagtttgcgtcgaaacacttgaaacgctcacgcggcaaccttctgcttgctttgtcttgtcgtgagttagttctaccacaaacaccgctccttggtaaattcggggcagctgagaaccccaatatcccgataatttctaaaagtccacgcacgagttgctactgatagggctgctttgcctccctcctgcaggttatacatctgatcagagcagctacggagcattcagggacccactcattcagaacaaacccccagcatctgtttgagacgccgggggacgatgagcggagtaccataccttcgctaagagggagaaggagtcacttcttctggacgtacttcaggcagtcaagcgtgaccgcgatcaggatgatgatgccggagaagacgaactgcaggttggtatcgatgcccaggatcgtcaaggaataggtcagggcggtgaagatcaggacgccgacaaccacgccggagatcttaccgatgccgccggtgaaggagatgccaccgaccacgcaggctgcgattgcgtccatttcccaaccttgaccgtaagctgcggagccggagccgaacatacggatgcattcgagccaggagccgaagccgtagaggatgcctgcgaggatgaaggcaccgatggagacagcgaagacgttgatgccggagactgctgcggcgtcagggttgccaccgactgcgtacatatccttaccgaaggtggtcttgttccagatgaaccacacgactgcaattgcgccgacagcccagaggatgatcgtcgggaaaggtccccatttcggggtgacaatttcaggaatgatcggatcgatagcgccgaaggaaacacccttagttgcataggtcgtgaggccgaagatgatcagcatgttggccattgtggacacgaaccagtgcatcttgaagcgcgcggtaaagaagccggcgattgcggagaagagggtgcagagtgctacgcagacaaccagcgcgaggaagatgcgtgcagggatcggcataccggagaagtcaaagacatagccgaaaacggtgccggtgttgggaccttggtgcataatgatggtcgcggcaaccatggacatgccgaccatacgtccgattgaaaggtcagtgccggtctgcaggatcaggcctgcgacgccgagagccagaaacattcgcggtgccgcctgctgcagaatattgaggacgttctgccaggtgagcaggtaggtacccttgattgccggggtgatcgcacagaggatcgcgaagacgatgatgattgcgatatagaggccgttgttgagcaggaaggtgcgcaggttgaagttgtacttgtagttttcccagcgctgggagaatctctcagaggcggtgaaacggcccatgcgcagcatatcgatcaggtggtagcaataggtgaacgcctcgtgctcacagtctttgatctgctgcaggcgctgctggtaggttgcctttgcgtcaaactgtttgttcttgtagacgtagttctcttccttaatctcctgcttgtcggagagcccggagaggttgttctcgtgctcctgcgcgagcttttccaactgctgcttatatttggagtcctcgatctcacgctgttgggcgcagcttgctttgaccggatttaagtactcggtgtcgtagtgctctttcaggtagtcctcggcgtcgccgatcaggcttgcaaccttatctctgttggctgcctcgacttgcttggccttgtccatctcgctctggaggccggaaaggacacgctcacgctcttcgccggtgagcacgttgtcccgcttcgtcgcgtcgatatctgactgcaaggacacgattttggtggtgccgtcggcgcgcagcgcatcgacttgtttctggatgccgccgacgtagtcttgtatgggctgaagcagctgtttttgctgtttcgccgtaaggatactatttgatgccatggtcctcctcctcatctacaggtatttggtgctcaaacgtagaagttcttcttggctggtatctttcgtattgacaatgctggacaggcgtccgtttgacataaccccgatgcggttcgtgatgcctaagatctccggcatctccgaggagacgacgacgatcgtggtgccgtgcttggccatctcaataatgagttggtagatctcgtacttggcaccgacgtcgatgccgcgggtcggctcatccatcatgaagacctgggggtgacgctcgagccacttgccgaagatgaccttctgctggttaccaccggaaaggcttgggatcagatcgtttggccccatgcacttgatgcgcatcgtcttgatctccttgttggtggcgtcgagcatcttctggttggagagagcgggcccgttcttgtagtggtcgaggttggcgatcgtggtgttgaaggtgaggtcccctttaaggaagaggccgttggccttgcgctcctcggtgatcatcgcgaaaccgctgttcattgcgtcgcgggcgctgtggaagttcatcagcttgtctctgaagtacacacgccctgccgcacgggtacggatcccgaagaccgtctccaaaagctcggttctgcccgcaccgaccaggccgtagagcccgaagatctcgcctttgcgcacctcgaaggagatgtcacgcagatgcggcgcgtacttggtggagaggtgctggatcttgaggatcggctcgcccggatggttgtctaccggtgggaagcgctgggagagcgaacggccgaccattgcggaaataagctcgttcatgttggtctcgttggtcggcttggtcataacgagcttgccgtcacgaaggactgacacgtcgtcgcagatctcaaagatctcatccatcctgtgggagatgtagatgagcgagatcccggagtcgcgcagcttgcgcatcatatcgaagagcttgtccacttcgttgtccataagcgacgaggtaggctcgtcgagcacgatgaccttcgcattgtaggagatggctttggcgatctcgcacatctggcgctgtgagacggacatgttccgcatcggttgcgtcaggttcaccatcatgtccagcctgcggaagaggtcgcttgccccacgtttcatgcggccctcatccacaacacccgcgccgttagtcggatagcgccccaggtagaggttatccaccacgctcctgtccaggcactggttgagctcctggtgcaccatagagacgccgttttccagggcatctttcggacctgaaaagttgacctctttgccgtcgaggatgatcgtgccctcatccttctgataggtgccgaacaggcagttcatcatcgttgacttaccggcgccgttctcacccatcagccccatcacggtaccgcggcgtacgtcgagatcgatgtggtcaagcacgcggttgcggccgaacgtcttgctcatccctctgatcgaaaggacaatgtcgtctggtgtcgattccgtcatatgtccacccctctattcccatcctgtaaaacactcgatcggtatgcgctgagagcgaggaggacactcactcctcccccgctcgaaaaacagaggactacgtccagaagaaacgctgatgtatagtggttactgccttaagattccggtgtaggaagccccgttgtcggtcttgaccatgttgattgcaaaggcgtcgtagtcgctcgggttcgccagtctgttggagaccgaagactcactctgtccgtcaccggcgacgaagtcgatcttgaagttcatgagttcctgatacttctgaagcagcggccggtaggtggaggacaggaagttatccgccgcgttgtagatggaagcccaaactttctttgtggggctggtagactcatcgagcgcggtctgtgcggtctcatagagcttggtcgaatccaggaagttctcgtaggtatcggcgttgaccatcaggttcatcgcatagaaggaacgctcgtcctcgctgtagcggtagtcatccggggagatgatgttgcccttgtcatccggcgtagagatgccggtctggaagtccaccccgtcaagggaatttcgggacaggcggagattgatgtaggcctgcacggccgggttctgggagatcgtcccgccgtagccattcgggattgcggcgaccgcgtcggcgtttgcgtcgtagccgaaagtcggaacgtggtttgagtaggaccaggaattgaacatcgccattcccataccgtcattgttggagacaaccaggtcgatctgatcgccgaaggaggctgcccaggtgccgattgcgttacctgcggtcggggcgtcccaggtggcgcctgcagtggtcttcatctcctgacttgccagttcacggatcttgaaggtcttgccgtcgacctcgatctcgccgtcctgcacgatgtctgaagaaccgtcagcgttggtgccggtggcaccggtgttgattacaccattctcctcaacggcagtgccgagtgctttacggacgccgcgagtacgggcgatggagtcgttgtggcccacgtcgccgattgccaggatgtaaccgatggttccgtctccgttgcggtcgaccgtgtcgatatggttcttgatgtagtcgacgaccatctggccttcaagctcgccaccttgctgcgcatcgaagccgacgtaataggtgtccttgttgaatgtgagcgttgtcatatcgatctcgccggtagaaccattggacggttggcgattaaagaagacgaccggcttttcagtattcgggaccacgctcgaggcggattccccgccgcagcccgcaagatttgttcctacgactcctgcag

SEQ ID NO: 327 - DNA, 51459 bp, Unknown
  Metagenome-assembled genome
aatgcgggaaaggcagggaaggatgctcatccagcacgtgcaggagccgccgtcctgccccatgcaccgcatgaagactccaagacggatcaagcgactctgggagccgggaggtgcagcctgccggtaaaagatgcacatgggtaaggtttgcaaggacgagaaagactcgagtgtgcaggcatcttctctatcctcctgtagcgcttccttaaggggtcgaagcgccgcttcacgataaggaagggatgcttctacctttgagcggccggatgccttcctggactcgatgcccttctcggagaagagcgcacaggcaaggccctctctagtcgaaggcttccttagcaacgctttagcgcatagatgagaggtgtgggtctttatgcgtccttaagggcgcttcgctatacctatatagggcgaatcctcactccgagtgcaacaggaaaatacgagctagccgcccaggcgtgacctatgatggtgcttgcaaagacatgcatccattggaggcacgatggacggctacagccatcttagcatcgcgaagcgcgaggacatcatggtttgctggaagggccacgaggggggtcagccagatacgagggagctcggacgggacaagtcgaccatatcccacaagatcaggcgcaacggatggcaggggccttccggaaggcccctgccgggcatcgagcgcgcaaaggcgtacagacgtaaagcggctgtgctgcaggcgtcccagatctcatggacgatccgcataggcgctctctggtcgtgcagctcatgctgaggagatagctggccgcatcgcgatggagcgtccggaccttgccgcaagcgacaccacgagctagcgtgtcgtggagtcgggacccctcgactgtgagctttcaggggcgcaggaaggccacaaggctgctcactcgtcacggcaagcgcaggcacggcaagggtggccaaaagcgcacaggcaagctgcgcatcacccacgacatctcgaagcggtcagaagaggctttcggcaggagccaaatcggcgactgggagggcgatactgtggcaggaaggcgcctgccttatcacccaggtggatcgcctgagcggataccttgtcggcggcaaggcggctaggaagaccagagccgaggtcaacgaagccacgaagaaggtgtttgccggcgaggtcgtgctgaccgtcacgctcgacaggggcaaggagttcttagatgcagaagggctccaggaggcgctgggagctcccgtatacttctgctatccccaccatctctgggagagggggaccaatgagaacactaacagccttctcagggactggttttcgaaggggcagattgtcaagctgagtgcaacatctccctaaagacctcgttggctgtcctgtatccaaggaccttccttggcctgtcgcagatcagctctaccgcatgctgcacctcctcgtctgtgacctttccgaagtcgctgcccttaggggaagaactttcgcaggagcccgttggtgttcttaactgttagcttctgccatagatggtgagggtcgcagaagtagaactgcacgcctcaaagggcatctgtgagccctgtatgccctgcgagctgcttgcccctatccggaagtgagcgtcttaaggggacgtccctgcaaaagcccgaaggcggccttagagacgcttccgctgtcgtggtggcatcttctcgcggcaagcagcctcactgccctgtcggcaagtacgagcaggcacacgggtcctgctgccacgagcgtgtcgtctacccactctccgaggcaagacctcgcatcggcctgctttggcctctcatccacggtgtgtaagatctcgatcttgcctttggtctttggcctcttgctgcgcaggtggtgctgcacctggccttcggggccggatcccggcaggtcgagggcgcctgtatggacctcacggtagaatagtcggcagactcaacgatgcacctgccaccaccctcgagcctgagatgtcgtctatctcctccagggaccagtgtctgtccatgatgagcaagcgcaccttctgcgtaagcgcagggtctgaaagccgccttttcggcctgcatctcctgtggcgctcatccgccttccttttgggcagtacatgccctaaagcggccgtggcggccgttcctcttgagcttgtggcagatgctggagctgtccctgccgatctctgccgcgatataggcaattgaccttccctctgcatgcagcgtggctatgcagtccctctcctgtaggcttaagatgcttgtagtggcacattccttctagctttcgacgttgacttggataaccaacatcgtagccttccggagtgtgccacgcttgcattcagcgggtcattgtgttgcacttagaatgctaagctgccgtctgatgtacggatatttttcggcaggcccgtacccaaatataagtgagcatagcgttcaaagctcacgtatcggatacgcgcaacgctatcgataccgcaggagtaagacaaagtccattgagttcgccttactggtaagctcaacggactccttgaatcctctatatgagccgaatgcgcatcaacgcatattggtgcttattgcgcgtgctcctgctcccagatatccgcaagcgttgtacgcttctcaacgagcttggccagcggatcaagatagtaccgctcatcctcagacagcccgtcgtaggctatctcgatcaaacgatctgccagtttggagacgtcttgaccgtatacggtggcttgatatccatcacgctccaggacatgctttgcttctacaatatcatcctcagtgacgccgtcgaacagggtatcgagcgcatcgagtgggcggtcctcatacagctcgcctttgatcagcgccgcatacgcaagcacgtacgggatcggcatcgcgtcagccaggcggatctcaatgtaagttttcaggcgcacatcattgaagagcatcgacactgcgtgcacggcttcttctttggtcatgggcctatccgcatagacttctccgaaggtcctatcgtcgtagcacacgttgccgtgtccatcgggtacggtgatcgccacagtatccagcacatgctccgccatacgctctaaggtgtagttgggatccatcacaccgggggcaatacctgaacggcccggatcaagtttctcccagttttcggtacgcatcagcttatgcgggcgccgcttcccctcaaagatcggtgagttattgcagatcagcgaaaggattggtactagtgcgtcagcgaggcggagtttacgcaggcaatctgcggtatctgagtagtcgatggagacctgcgttgaggtcgtccctctcatcatccgcggtccccacggggaaagcccgcccagatacttgttcataaagtcatagcgcttcttggggatcagctcggtgtctttcgcaatcgccttaggctgataggcgacgcgtgcgatctccgcgtcgatctcatcggcggcactagtcagatgcgattcaaactcgttgaagctgcgctctgtatctgccaaggttgtaaagggccctgcagaaagctccacctgtgccgccggctccaacgaaacgccttcggtgatatcgccgtgggagcgtgaaagaccgatcagatgatcgccttcatagaccttctttggatagtattcagcaagctgattcaacaaccacacggtcccctgtggttccgaatagcgcaccggcagcttggtatctttatgcacgacaaagtgctcgagttcgataccgacacggccacggacatcggtaaaaccacttttgtagtagttcacgagggtttcaatgttctgcgcacggtattgctgatgagcggtaccctgcgcgcctgtttgtgctgaagtatccatagcatgctcctcctgattgagagccaatggtatacagtgccgtgcacatatccttacgcccgttcaccatataaatactacatataccctcaagcatagggaaatatcgtctaactcctagtaatttacttctatatgtatcattgttaccaagaggaaacattgctcatgtgcgtgaacgcatagcgccggagggcatacctacagcacccgtgagccgatagcggccatcgaggtattgcatcacacatttatgagcatttaccggggatatacgcgtcggcaataccggaggatcagagcgtcgcagccttatatgagatagtaggcacgcaatgcagcgatctcctctgaggagatgccggacgcagtgtggatatagcccctgaggctcccatactgcttttcaagcgtgaaaaccgctgaatgcagaacgcatgctggcgccgctatttcccacttccgctatcggacaataggtattggtggcgaggtggtcatcttcgatgtcagcatacggaacgcccagggcggtctccaccagcatgctcaccatcccgcaccggtctcttcccagactgcagtgacagagtacggcaccttccgtacaggagaacaactcctgaaagaacttccggtatcccgcaatggccgcatcatcgaacagcagatgtggatacgacttcgccagaagatcgaggcaagcattctgatcgaggctcaggagtctccactcgatctcctttgatttgctcactttggagattcctgccgtgatggcagacagaacatcgatgtggacagaacggatgccggtcaacttgtctatcggatctggcatctccccgatctcatctgccctgcactggtctaccacaaggcgtaggttatattcgttgggtaggcgttcaacatcgacggcaggagcatgccacaatgcgcctaagcgaagcaacaaaccagactttaccgtgtggccatcggccgcagaaagcttcccaagatcacgggtgtcgagcagcccttggaagtcaatccacccgtagctccatgtccttgaacatggctcgctaccgggacttcatagccctctgctgccagtatctgtctgcgtttcttaaattctgcgatctgacccatccccaatgcctagtactcaatggctccgtataatgcctgcattgcatcaccatggaatgttttaaccggcatagaagctccgtgaggggcgcgttgcttgcattcctgaggcatatttgccagcctcctgtctgagcctttccgcctcggatttctcttcgtcggtcggctttggcaagtgcgacttcaggtcaaccggtatgtcttcaccggaacggatgacatcgttctcgaggacaaacgcggtatcctccggcaggtagaccgagagcattccatccttgcaggagaagtccgcattgccgccagcatctactgttgtgtctggctcaccgccgataacggcgacccagttctccccggcatggcgcttacccacatacatacgctttgtgccaccagtacggtcagtgaggacacaggctaaaccggagcctccatgacgtccatcaccttcacgagtccagccgatcacatccgggttgtcgatgtagtcatgctgttggccataggcgaaccgacgacgtaactccatcagcagcggcagctcacgcaccgccggcacatgcccatcattgggcatcccaaacagatccccatagaagacgcagggatacccttcctgacgcagcagaattaaagcgtacgctgcaggtttgaaccatgtctgcacaaaggattgcaatgcttgtcccggttgggtgtcatggttctcgacgaaggtcaccgcacgggtggcgtcacgctgcacgagaatgtcgtcaaagagatgccttaagtcaaagttgccaaaggagtttgaagctgaatagagatggtagtgcagcggcacatcaaagaggctcatcacccgctctgatccgaggtaagcttgtagctcatccgcactcggggaccagtactcccccacggtgaagagctctttgccgaattcctgcctcagtgtcgggagcaagcggagatagaactgacgatccatgtgctttaatgcatcgagcctgaacccatcgaggtcactgtttttcaagtaccactcaccccaacgcagcagctcatcgtagaccggctgatacatctcatcgacgtcgcagcccatcaagtagtcgtagttcccgttgtcgtggtggtctacctgctcgctccagtgctttccctgaaagagatagatcccgtttctgtgggttgcctcatcgtagtcgacaccgtggaagcaggtccagttccacttaaaggcagaatatttgtctccccgccccgggaaatcaaagcgagtccaggcggtgatatcgtgagggccggagaccggttgttcccggtcataggaggcaacctccattgcacttacccgctcggtgctgtccgcgcccatccgttggttaagcgctacatcgcctaaggcttccataccggcttggtggattgcatcgatcgcggctaagtattcatcccgtgtcccgtatttagtgcgtacagagcctttctgatcgaactcgcccaggtcataggtgtcatacaccccgtagcctacgtcgttggcgcctgcgatacctttatacgcaggcggcagccagacggcggtgataccggtatccgcaaaaagctgagcgtcctcagccactcgtttccaatgtttcccatctgcatcgaggtaccatgagaacccctgcagcatcgttccattcatgcataagcctccacaacggcagcttccaacaagctgtcttctttcatcctaattatctgcgtgtggggtgcatgcaaccgacaatggcgccgacaagggccaagatgatagatggcgcaaatccaatgaaccccagcactaacgacgcgacaaagagccaccaaaacaccctgagtcccgcaccgatgatccagcccaggatacgaaagataccgacgatagccgcaaaaaccaaccagatacctagcacagcgaacatggtcggagaaaatatgattgaagcaagtgacgctaacatgtatgagagcataagctatcccttcgagatgcggggcgcactgtcttacgactgatgggtccccatgtcagaggattttacccatccagagatccgctcccacccactcacaggctccccacaacttgataacacccacataacgcccgctacatagatgagaccgacgttttcaacagtgagagatgcaagacccaaggccacccctgagagaaagagtgcgattatcactgaccatagatctctgctttaccagtgtccgtaggaatggcctgcgtcgagtagcccttcctcctgtgcagcgataccgtcactgatgcgcagcgtgcgccggttcactacctgctctttccaaccgtaggaaagcgccggtggtttcggtgcttccaattcaacatgcccaaaggcattcacgacccgtgttccacagtcgaggacgcgctcgcgctgaaaatacggcatataggtcgcgtggacatggccgtgaaccataaggcctggcttccagtgctccattagatcgttgaagcattcaaaccccatgtggggcagatcattgaggtcccccaccccacgcgccggagcatgggtgagcaatacgtcgaagccacccaacaggcggatgcggggcgtaagtttacggatgcgtttgcgcatctccttctcggtcgacatataggcaccatcccggtagcgcatggagcctccaagccctacgatacgcaggccctggtagacatagaccgaatcgtcgacacagatacagccctgcgggggctttctcaagtatttctcatcgtggttgccgtggacatagagcaacgggactgggatcatcgtcacgaggaactcgagatagtccggatcgaggtctccggcggctaacaccaggtcgacatcttcaaagcgtgaactgcagaagttgtcccaaagaagcgtctcttcgacgtctgcgattgcgaggatcttcattcggaagacccgcctttcgaagcagcctcatcttcttcaggttttggcgggaccggcggtgcggtcgggtcaagcggatgcgcacgctcgcccgtggccactgaggtcacatccaccggatgccagttctcaggaaggtcaccttctatattgtcgttgagccagtccattgagaccacaagctgctcctttaaccgaggggaacctgctggctgcaccacgccggtctggctcctgagctccccggcaaagggatcgagcatcccataggtgataccatcaataagttgatcagccagtttacgcgaataatatggcaaatcgtttgagagtttcaacccgataactcctgatgacataccataccagtagttgaccgcatgcgggtgttctttatcgctgtcttcccgccaggcgccgttgagcagcccctggacgatcagattgtagtagcggccccagtcccagaccggcagagcaaggttatgcacaatcccacccacgagctggtagaggcctaaagcacacggatcatcgtacggcgccgtcacgtctgaccctgacatcatcgtcacaccctcatcggccatcctatggtagagggattcctccccgcgctttgaccaagccatgcgaatcttgaccttcgggtcgaccatagcagcaccgatcgcgaaggcgttgatctcagcgatcgagccgtacatcgggatgttggcttgatacccaatgcgatggctatccgagaggctagcagctaaggcaccagtcacgaacttcgcttcatacatacggccatagtaggagcgcacccgactgtgcggtaagttgcaggagcagttgagaaagcggatctcagggtgcttgatggcggcctttgccgtattggccataagcatcggcgagcaggtgaggatcacatccacaccctgctcaatcgccgctgcgacggcagtggcaaagtgctcatctgaggcgcagtcctcgtaggcaacggtttcaaccatcccatggaagtggccttcaacttctttgcgtcctgcatcgtggttccgcgaccacctcgacgtcgcaagcggtttctcatagagaaatgccaatttcaatgggtgcgccgaggagtacggggtgtggtaggccaaccgtgagaggacaccgtgtgctggttcggattccgctttcgtcggctcatccatgagcacgacttccttatcaggatcctccagggcaagctctgaccacaggcggttcaggcgttcgacaatgatcgagcccggggtatccaagaggtcttcattgggaaaatagctcaggtaggcgagcatcgcatcgccgcaggtagtgtcaaagtgcccaccaccgttacggagatagagggtacgaaagtattggtaggccgaggtgagctgatcaaccgcttcctccggccaaggcgctttcagatcgcgccccatcaattccgcaagccgttcatatgaacctttacgggtaaactcgatatcatagatcggcaccgcatgccagaactcgaggaattcgtcgtacaatttgcgctccggagcgtcccactctttggggagtaaccgagtgacatcagcggcaatggtccccgcatccagatagctcataacagagacgcgcttgttgccttcctgcacatagaagcggtgcatgtactcaaagcatttgatcgggtcgcgtaagccctcagtggtctggatgtcgtagaggttggaccacttggaagcaaactctgtttcagttccgaggatcggcataaacgtccgtgagaaagcgcgttgacgtccctcagtgcgggtaccaatcaccatctccagcgggatctccatggtaccgatgtgcacttcgcctttgatatcactttgctcgatgacagaatcaagggcgggaagataggggtaaatgccagcggaagtatcacggcggaaatcacgctcaccgcgtttgagtgctttcttgtactcttcttcactcatacgggcaggtccctcccctcacaaacggctacacgttacagcggacacagacacgttcatctgtgacagaaacttgtttatacaagataaatcttccagccgagggtggtaacgtaaatccgtaccatttccatcgataatcctaagctgccagggccaagcccaaagccttcctgaactccattgggctcacgcctttaagcgagcacttgtgccttgtcgtattgtacctgacgatacagtgatcgatgcactccttcaaactcgtctaagcggtgccgtcccacttgcgcttgcaaaacatctttgtcttgagcgcttcgaagaaggccttaaccccttctggttgtggcaagggcagcctttgggtggcatcgatgtggtgatacccgcctcggaaaagatctatatccactctggccagcagcagtggtgcctcctgtcgctgctgggttgcgagatgcttttcgcttacctttgcctatcgcggtgatagcagcgcgcagcactaagtttgctatctgaggctaggaggcattaagacagtttaaggataaagcttaaagtagggcttgtcggcgaatatctcaaactgcaagatgctagtgagccacaaggaagttggacaggcctgctctgaggtcttgcttcacaaaactgtcagggttgtctgatatcttgcctgcacaggagttgcaagacttgttcttccttagcttcttacagcttaaggccaccttgccctcctcctttaaggatgtgagatatcctgtgcttgccgactaccatgttgatctttaagatcggctgctatcttatcgcgtatgtagagcctgccgtagggtcttcttattcgtatcgaatatacctgccaaccccgtctttagcgtttagcaccacgattcttcaggatccgggacatggcccggaaccgcaaaagccagccctgagctggcttttttcatgcctgtatgcttgatctggaaatcgctccctgatagaatatatacatggtgctatggtgctttacgttgacagggagtggcagatggcctacttcctcaagcagacgcgcaacaagaaggggctttatctccagatctacgagagccactgggaccccaagcgcggccataccgcgcacaggtccgtgaaggcgctgggctatgccgacgcgctgatggagaagggcatcgccgatcccgtctcccattacaagcgcgaggtggcccgcatgaatgccgagcgcaaggccggcatggagagggagagggtgcgggagatctccgatgtcccggcgacgaggcatctcggccacttcgcgctcaaggcggtggacacggccctcggcacggcggaggacatggcgctgctccagaccccctcgggcttgcgcttctcgctgcacgatctcctctcctcgctcgtctatgcgagggccgtcgccccctgctcgaagctcaggacattcgaggacgtgctgccccagatggagggcatcgatgcgcagttcacgctggaccagctctgagacgggctcgcctatctgggcgatgagtacgacaaggtcgtcgagatctacaatgcgcacgtggaggaggccttcggccacgacatgtccttggcctacttcgattgcacgaacttctacttcgagatcgaccgcaaggacgatttcaggaggaagggcccctccaaggagcacaggccggagccgacagtcgcgatgggccttctcctcgacgccaactgcatcccggtggcgatgagcctgtttcccggcaacgagagcgacaggccgcagctggggagatgcatcgcccagatgaaggagaggggctccatatccggcaggaccgtgagggtcgccgacaaggggctgaactgcgcagccaacatcgcggaggccgtgcttgcaggggacggctacatattctcgaagtcggtgaaggcgctccctgccaaggagcgcacgtgggcgctctcgggagatggctggacggacgtcgccgacgggaagggcgagacatcgtttcgctacaagatggcggacggcgacttcgagtacacggtagagggagaggacggaaggaagaggaaggtcgagctcctagagaggcgcgtcgtcacgtacagcccctcgcttgccaggaagcagaaatacgagatagaccggcaggtggagaaggcgaggtcgcttaaggcggcagccgcgaaaaggtccgagtacggcgacagcgcgaagtatgtcacgttctcccccgtcgacggcgagggcgaggtcagggaggacatgaaggtcgcggccatgctcaaccacgaggcgatcaggaaggccagggcccttgccggctacaacatgatcgtgacctcggagaccaggatggacccccgcgccatatacagcacctaccacaggctctggaggatcgaggagagcttcagggtgatgaagtccgagctcgatgcgaggcctgtctaccttcagaggcagagcacaatcacgggccacttcctcgtctgctacatcgccgtgctgctcatgaggctcctgcaggtgaaggtgctgggagatagcttctcctccaaggacatcatggggctctgtcgcggcctcgatgtgtgccgcacctccgacaggaggtatgccaacatatccaggagaagccccatcatcgaggagctggcgtcaaggacagggctgccgctgcttcacttcaacctcaccgagggcgacgtgaaggcgatctcctcctgcacgctctccatgctccgcggtgaagggaaaggcccctctgccggcaggaagcgcggctgaggggcctcatagcaccatatcggggatcgaaaaaccaaagtccggtatcttatcgcgtatgtagagcctgctgtagggtcttcttattcgtatcgaatatacctgcgagcagctccctgacatctttgtccctgtcggctaccaaggcgacaatctggcaaaagtagctagacttcttcaggcaggcggcgcgccacaggctggcaaaggagcctccttccttttctgagcagcgaacaggatcgtctttcccctatcggtgaggtatcctgccggggcagcgcccatccttttccccactggttctattgtgccctgcactgtgtcgcgcatctgttcgaactaaaggttggtcctcttttgcctgcgcttctggagccgttgtcattgggctctagtatggcgggtatcttctttgcgagcagctggtacttccacaagcagtgtaccttacggctcaagctcttttgccactttcctcgcgaagccctgctcaccagaaagccttgagggtgccttttgctttaagctccatggtggcgatactttggggcctggcgacgatccatcttcacaggagcccctttgaaggaaagctaagcctgcggtgtgtgaaggtgatgtatctgccgtggccgcggtagtggtcgatcgcagcgcacctatgtccgtcggtgtagctgttcttgctgtggccgtcctgcgggacggtacctagcgtcttacactctttgatccagttgtacagagatatgcttgtccgggtaggtgagcttgccggttacggcggtgattttcctgccgtagtggtaatagagatcgatcgcctttttcttgtccttgtagctgaatatcaatgacgcctttgcgtacgtctgttcggtatggatttgcgttgccacactcaataccccaatctttgagtcagatgtacggatttttgtcggcacctcccttgctcgctctatgtcacgactctcccgatgcagcgacaacccagcttgcaagggtctctttggtagattaaaggatgaatcctcctacggacgtaattggtctaccatcacatcgaacaagttcatcagccagctcaacgactacatcaattggtacaacacacagaatcaaacaatccctcggctggaagagttctgtagaatacagacaggaccttgaactagcagcctaacatgtacgggaaaatgttagcaggcccttgtctgaagatacagcctatagaatgcagcgttatccaacatcaaatatttaactaatactgagacactcagcatgtctttaagaccattccaatcatgggagaaaaacactccaccgttgcaacaacatcattttctttgtcacccatatgccattcaaaggctgctccacacagatatgtcagaagggtttttgacaccttagggacattcatatcttgattcagttcaccccgtctgaatcccttcattcagtagcgcttccatctgagatagatcaatgtagtagcggtccaagttcttgtactgaataaccagctcagtctatatcctgcagaaatcgatgccgatatcgtcccgcatgatctctgcgtaccgtctcatatacagcatgatcctttgggcgattggcaggtctttttttgcttcttgccttgttggaagcgtcgtccacattcaagcctctgatcgcagccatcaggaagtcattctttgaagtgaagtagtagaagatgccttttgaaaatccacacgtgtcggtgatatcagaaacagaggtattttgtatcccctttttcaccatcaacttggtccctactttaacaagctgctcttttttgcctgttttagaagaagttgactttcatgcctcctgagcaaagctatcgtgtgtgcgcggctcatagtacgtatgcccccttctgtttttggctgaaagtctagggaaacgatgattaatgccccataacgtgtcagaggggaccgaccacacgacttttctaggccggtatgcgggaaaggcagggaaggatgctcatccagcacgtgcaggggccgctatccttacatttgtcctgccccatgcaccgcaagaaggctccaagacggatcaagcgacgctgggagccgggaggtgcagcctgccagcaaaagatacacatgggtaaggtttgcaagggcgaagcagacatcgagcatacaggagttcttctctatcccctagtagcgcgtccttaaggggtcgaagcgccgcttcacgataaggaagggatgcttctgcctttgagcggccggagaccttcctggactcgatgcccttctcggagaagagcgcacaggcaaggccttctatggtcgaaggcttccttgcaacgctttagcgcatagatgagaggtgtgggtctttatgtgtccttaagggcgcttcgctatacctatatagcctaaagtctgcgcagcagaacctgtcatcttcccttacgagtgtgtgtgccacaggatatgtcagatacattctaagcggtcgtctccacaccatgcacaaggccacctgcggcatccacgccgatatgcgccttgtatccgatacgccaggtcttccctttcttggactggtgcgctttaagggttacgcgcatggtccttgttcttcgtggagctcggagcttcgataaaggtcgcatccaccatggagccgccccgcgccgtgatccctgccttcttaagttctaagttcaggcgtgaagcatagctttgtcgaactcctctcgctttaaggctatggcacatcttcgcgctcgttgttgtgtctggcacctgctcagacatgaggtctaagtgcacagaagcaccgtgtggaccgggaatccaggatagcatctttaagttcccccgtcttaagagagcaaacatgatctgcagcagatacatccaaagcttcgtctttgcagcgcgcacatgcctgccacgcgcctgtcaatggtagctgggttctaccagtgcaatccagctatcccatggcacgatcgcatccatccgctccaggagtgcctcccgccgggtctttctcctcagaccttaggaatttaaggtcctaaaagctcatcttatctgtccatatctgccttttggatatgctggaatgtgtggatgtagctataccatatccagaagacagataggcatctatgtgggtatgggcactgtgtggttcgagacattttgagccgatgtcatacagcgtgcggctccactggcctcatcgaggcgaattaatcatcgtttccctagcatatcgaacatatgctaacgcctgaagctgtggaatccctaagtggggattccgcttccctagcagaatccatgtgtttgagccacacattaagtgagcaagcttggcataggcaggtctgctctacagcacattgttcaaaggtttatatgctgacgcccaaaaacgctgggactctcccatcgaaaccgtctcctccataccgctttgagagtatccaggcaagcgagcggacacatagctcgtggcctctgccttcgtgcaagccactgatagagagtgttgcgacctgttttggggctgagccatcagcgcttgcaatcctaatagggaatgcccctccagaaacaggtacagcatcggttgtcccctgagacaggcaggcccacaggctggagtgccctgtcttcagaaccgcttcacgcttcgtctgcatgaagccgaggttccgcactgccttatcgtcgtccatccattggaagaggacaagtccatcggattctcgtgtgatctgcacgccgattccacgctccgcgtggcgtgcaaaataggcgaccgcgtctccgagctcgagggcttcatggcttccgaactgtttatagacaaggtcatgctcctgccgttccaacaccttcaggttttccgactttgtgctgaagcgctgccaaacctgatgcaatagagtggcatcctctgcagttgcgctgagcgacatgatcggggattctttaatgccctgcttcctcagatcgcagaagtgcgcaatctcataggagaaatccgctccctcaccctgcatggggtaatagaggatcctatcttcaccatcatcctccttgatcgttgcatgtgcagcgcggtgcatgttgtcgataatgatggatcccctagtgccgttaagcacggcggtgcagggtttttcacggtcgtagccacactcaagatgcgccgggatgccagcgcgcttaaacctcacatcggtgtagatatcgacccgctcaccatccggggcgaagatgccggttggggctgcaggattttgagcagttttaactacaccggagaaggtctcaaacgagagtttcccctgcggtacaaaatcgttgatcagacttgcacagtaggtaccgcaatcaagcagggcacctccacccttctgggtcggagcacatcggaaattcttcacctcgagcatgctctgccagatattacagcaaaaacagacgtccacatcggtgatcgtcccgatctctccggattcgaccgcttgcttgacctctcggtagcacggcgtaaagcgggactttatcgcttccataaagagacgcccatgggactgggcgaatgctttcacctctgtagcatcatcggctgacaagaaggcaggcttttcgcacagcacatcttttccgactttcagcgcctctatggtccaggggtagtgcaatgtattgggcagtgcgatgtagactgcatcgatatcaggccgcttcaggagttctctatatgctttatcggtatccccaccgaaggcctcaccggtatagacgccctcagcagctactccaaaccgctccgcaaaatcatggcctttcttttccgaccggcaagcaactgctaccaacttattgccagggaccattgcaagcccctcagagaaacgacctgagatgcggccacaccccaagattccccatctgtctgtatcagccatgattaccaatccccttgaatccagcgactcatccaacgaggtatgagggttatagattgaaccgcttcagcccctgcaacaagcaggctgcttctatggtatccgaagcccctccctatagaggattggaattccgatagaggcagtagacgctgttctcacaagcaatgccctgtcacagtggcaacacctcactattcaccgttgaaatatgcgactggcgatcattgcgtagtggcgcggcagataagccggcaatattgacaaacggggattggatctgccctgccagctgtaacaccgccaacaaaggtcccgtagctcatggtccccgccaggattccatagccgcaccatatgatacccacgaggtaggccgcatctatcatgccgccgaaaccgatgttgcacaggttggagaagcggatgcggcgcatacatgcagcacggtgttcgtcaatgtagccctgcacctcacgctcggattcctcctctttcccgaaagcgcacactacgagcacacccaagagtcgctcagccagaaacccgcgcagcctgccatttgcctcctgaatattcttatggaggcatctgagctgcttgcagaatacataggtgaggataatgaggacgatgccgccaggtaccacgacaaacgccaatcccggcatcaggtagagcagaagcgcgatcgcccctcaccaaccacaccaccatctcggcaacgccgggaatgatcgatacgaggctatttgccacgatagcggcatcaggagttagccggtttatccactccccggaatggatagcgacaacagagaaataatccttagtcaaaagtgtatggaacagacgctccttaaagcggttttccagggttgtgcgcattgattccaaaagatggcgatttgcggtctgtgaggcaagttcgccgatgcgcagtgagtaggtccagaatccctcacggttgcccgccactgcggcatcgataacgccacgcagtagccacgctaacaacacgatcatggccccaatcgcaacctgtatgagtgtcagcaccccaacctggtacatgttgcgtccggcgcccaaaacaggccggcaccgtgccgaatcgttgagctgaatagttgcagaagcgctctgatgtggtgcatcggtggcattctttgtttgtatgagtctgctctctgttccatgtacattcaggagcgagcccaaaaagctagaaaactgattcctgccaatataagggacagaggggtcccagatctctatgcagtctgcgtggccgccagatcggatgaagggccctctcgaagcgctcgaagagctcctgtctggcctttttgcagatacgcacctacctatggagtcgtgcggacaaaagcggttgtagttacgactcgattgagcccgatggtccttgtgctttgtggtgggatgtaggcgcttgtggtggtaccacttgcccttgagtgtttcgagaagcgattctgcttgtgcactgtcgtggaagtccccggtgtgcctcacatcgtgcaaggtcgcctgggaggcaagcttaaacgcttatgtattggctgtcctgctcgctgtgggatatgaccccacaggcgatatatccccacacacgaataagccatcttttaagggaaaagatgataaggcttgcttaaaggtgtccctgcatgctttagccgagggctataaggtactcacagctttattgcgacgctaagctagataaagctttttgtggtccttaaagatagctatgttgcctgtaagctttatggtcgcaacaaaggcttgtgacctgacaaggttggggtgtacaggggtatccctgcccaaagccggcatctcttgaaagctctgtggcagatgccacctatccttaaaagctcaatctaacagtctagataatattattatccatatcggtagcgcacacatagtgagctgcaggaactgtctagatttctctcattctgagcaagccctctgatttgtagatgtccctacgattgttactacggactatgccgaatacttaagacacagcttaccgtacggattcccgaagctccgcgtacctgaggtatgacggtcgttggtaacctcatatgggaccttaccggaaaccgccacatcccaacaggcgcgaatggccggaaggtcaagttacagacagcctcaaccatgatctcgaacgatccattgtcagggtgctgttatcaatctcactaggggccgctgcttctctgtccgcattagacaactgataactttagaataataggggtgtattaggtcgtgcccctcaagcgtcactgtcatcttcgctgaacgagacgatgatagagataatctccgagagctctttgcttcaaaaggcgaaaaaaaggcccctcactttgtcccttcagatcgaggaagactttcattgccttacgagcatcggtaactgctcggcggaggggggtcaactaccacgggacgcatgatcgtatcgtacggggatctttggtcggagggtccccatctccaaaggtccacagggtgtttgagggtttgcgacggcccaagcatccacccgaggactagtttgtaggcaatgtgggatcgtcacgcatgacacgggtcgcactcgagaccggtcggcttaatctcctcacgctcggatcacggcgtcggcataagttcatcttgcacatagttcagatcgataagcctttctgggcgagtgtggctagacacctcgtcgcttgtctgcctgcatcaaggccgctatcactgccgcctcatcgattttcatgactcctcccctggacaaaactcatcattacatttttttaattctttaacataacgcaatacaaaaagaccgtctccccaaggctaatattatttggggaggacggtttttagcttaatccgtggtttattaggggctctgtgctagtgagcgcgtcttttaaagccgcttgggtacgtggtgcgtctcgttctctacgcgccaaatatttccagtcgatgctcttcgtcaacatcttcggcctgcaacgttctcctttgcgtagccgagcgcccagcaccaaaggatagcactcagcctgaggtcttgaagtcccaattctttgttaagtctttatgcgaagttcgtgcatgatgcaaccaccgagggcttgggacctggaccgctaaaacgtaatgtcttagcagctgataccaacatcatagcacgggtacggttgggtgaggcccgtcacttcgggaccaggacagaattataagcgtgtgtgggcgctctccccttctttagggccgcccagtctttatagttggcggcccatccgagatgggagaaaactttggagcagtccctttccgcttaccatctggaatctcaaagcttgggtattgttgccagtgggccaaagcgagcgtcaggtcaacgatgcggtccagatccgctgtccacaccggactgccttcatagaatctgcgataggtgcggctgggtcttgaccagagctcataaaacttcgtactccatagccgttcctttcatttgtaagggtccacctctacaatgcgtgcaagcgctctttaatctctccagaagcagcaccaaagccaaagcggacattagccttcaccgtgcgagccaaacgcgcaggcagggttacgatcacgccagtcttctccatgagatccatcgtgaacctcactgagtcggtgtagccctctgtgtcgtgttcctcccagtttgcccacacaccgcagtacacgtgacagttggacctttcccagccgaaatcgggccaactatcgcaacagggcgtccggtcgacctgttctctgtgcggccagcccgacgctaccgatgccgtcgaggttcttccaaacaactaccgcaaccttctgctcaactaagacttcccgaagtccacctgccttctgcgctataggtagcctggacaatatcttttctacccccagggaaactcagacgtacacaccagtcacgtcgagaacttgagggtgaagaggaactcaacgcctactccatagtgcctggatagctgaagaaggtaccccactcttaccctcaaacacccgtggatgattacgatatcgtgcttctttgcgaaggcgatgatctcctcgtagaccccacgcgttcccacagaactcactaggtttgccaggaacacaataatgtacttggttttgtctgccacctcatcgcgaatactagggaaacgatgattaattcgcctcgatgaggccagtggagccacacgctgtatgccgcctgctcaaaatgtctcgaactacgcagctcccatacccacatagatgcctatctgcctgcggatatgttataattacagtaacgtattccagcatatccaaaaggcagatatggacagatagatgagcttttaagaccttgaatcctaaggtctgaggaaaaagacccggcgagaggcattcctggagcggatggatgtaatcgttgtgtgggatagctggattgcactggtagataccagctaccactgacaggctcttgtcaggtatgtgcgcactgcaaagacgatgctttaagatgtagcctgctttaggtcatgtttgctctcttaagacgaggaaacctaaggatgctatcctggattgtcactcctagtggcgcttctgtgcacgcagacctcatgtctgagcaggtgccagatgcaacgacactcgcgaagatgcgccatacccttaaagcgagagggactcggcaaagctatgcttcacgacctgaacttagaacttgaagagggcagggatcacggcacgggatggctccatggtggatgcgaccttcacctgggccctaaagcttcacgaagaacaaggaccatgcgcgtaacccttaaggcgcaccagtccaagaaagggggagcctggcgtatcggatacaaggcgcatatcggcgtggatgccgcaggtggccttgtgcatggtgtggagacgatcgcctagaatgtatccgacatatcctgtggcacacgcactcgttaagagaagatgacaggttctgctgcgcagactttaggctatataggtatagcgaagcgcccttaaggacacataaagacccacacctctcatctatgcgctaaagcgttgctaagaaagccttcgactagagaaggccttgcctgtgcactcttctccgagaagggcatcgagtccaggaaggcatgcgtttgctcaaaggcagaagcacccttcctcatcgtgaagcggcgcttcgaccccttaaggaagcgctacagaaggatagagaagatgcctgcacactcgagtctgcctcgcccttgcaaaccttacccatgtgcaccttttgccggcaggctgcacctcccggttcccagagtcgcttgatccgtcttggagccttattgcggtgcatggggcaggacggatgtaaggatggcggctcctgtacgtgctggatgagcatccttccctgcctttcccgcatgccggccgcgaaaaagttgtgtggtcggtcccctctaacacgttatggagcattaatcatcgtttccctagactgctagattttaaaattgtgctgcattgtaggagaggtggcgtcccaatctgttcgctttagggatatgttcacgcaaccatagcacacgcaaaataaaggctcttcactgtttctagtgggtagcgcatacgagctttttctgggctgtgaagtccagacggcctagcctgagcaagatcatcgtcctgaagtagtcgatgctcctggagcccctggcgatgctgtggaccgactggacgaccgagttgagcccttccaggaacgagttggtcgaacccctcttccaccagttgaggatgccttcccgctccttcctgaaggtcctcgccacgctcttcatctcggccacggcagagtgcatcatccacgagcagagcctgccgagggctctcgccgccgattccctgcctgcgcatgaatagacgtcctgcagcgcctcggccatctggcacgcgcgtgacctctaagaccttcgtgcggtcccctgcgtgctccttaagctcggcgcagagcctgtctaaggccccctgtctctgccctgcgtgacggccacggcacgctgacagtcgaggttggccatgatgctgatgtagctctggttgcgccttttggcggtgtcgtctatgctcacgcgcacgacatccgagtagtcggcggcatccctcgcctcggtcacggccttgcccagcagcttccatatgcgcgtgggctgtctcgtgcagctgctgcgcgaccggcgtcacgctcatgccaaagagcgccatcacttatcacctgcgccttaaagagtgctgtgaagtgcgtcttcggccacacctttcagggcatccttgtggcatgcacgccgtctttggggcagtccgccctgggcagcgcgcagtgcacgatcatatcgtattgccagatgctaagatgccacaaggtcctctcgcgcgtatcacaggtgccgcacttcctgtggcatacggggcactcgactgcctggccctttcctgtgggccaccctcacatggagcttatcttgcgctcccttgcgctccttaaaccagacatcgcagaactcccactcgtccctaagccccctgggatctcttaaagagccttgccagcatccctgccttaagcatccatatcgcaccttaggaacgcagcctcctgtcggggaaaatactgccgtttaaaggccacgccctcaaggggatgcagatatgctacccaccagaagtgacgaagagccaaaataaaggaatacggtacctaccttggccaacacacacgtgctgaattttaatcagaagatcgtgtgaaatttggcgaatggatgtcaaatactcttaaatatatttggtcgtgtcgaacagtttttcaacgcctttctgacccccgccgatacctgtgcggatgtgtgtcatcaacaaataatcaacaagcttttaacaatatattgttgtcgttcatggaactgaacactagcggtagtatatgagttgtggcatactaatcagtagagcatgagggtgcacactagaaataagcaaaacagagctcaaacagaactacaacccccttgtgttcaacgatacagagagctgttaagacacgcagtgtgtgcctatatgggaggggatcatgaagataatcaagcgtaatggctcagaagtcgaattcgatatcactaagatcgagaacgcaatcaagggagccaacagagaggtgaaagacgagcagcgcctcacggagcgcgagatcgtctttgccgctgagaacgtcactgaccgttgcaagcaggcaggacataccgtctgcgtcgaagaggtccaggacatggttgaggacgagatcatggcgctggaccgctatgaggtagcccgcaagtacatcatctatcgctacgtgcagtctctgaagcgccagaagaacacgacggatgacaagatcttgtccctcatcgagtgcaacaatgaggaagtcaagcaggagaactccaacaagaacccgcaggtcgtctccgtacagcgtgactacatggccggtgaagtctcccgtgacctgacccgcagaatgctcctcccaaaggatgttgttgaggcagaccgccaaggcatcatccacttccacgacgctgactactatgcgcagcatatgcacaactgcgacctggtcaacctcgacgatatgctacagaacggtaccgttatctccggcaccctgatcgaaaagccgcactccttctctaccgcctgcaacatcgcaacccaaatcatcgcacaggttgcctcctgccaatatggtggccagtcaatttcgctgtaccacctctccaagttcgtcgacgtctccagaaagaagatccgccgtcaggtcgcagcagagcttgatgcaatcgatgcgcgtccttcccaggagaagattgatgagctcgtcgagggacgcctgaagcaggagatcgcccgcggcatccagaccatccagtatcaggttgtcacgttgatgaccaccaacggccaggctccgttcatcaccgtcttcatgtacctcaacgaagcccaaaacgagcaacaaaagcacgacctcgcgatgtgcatcgaagagatgctgcgccagcgctaccagggtgtgaaaaacgagaagggtgtatggatcacgccggccttcccgaagctcatctatgtgctcgaggacgacaacatccatccggaagacccttacttctacctcacgaagcttgctgctaagtgcaccgcaaagcgtatggtccctgactacatctccgagaagaagatgcgtgagtacaagctctccaagggcgagaccgtaggccacggcgacgtgtacacctgcatgggctgccgttccttcctgaccccggacaagaccggcaacggctacaacaatatcgccaaggctaagaactacgagccgggcaagccgaaatactatggccgcttcaaccagggcgttgtgacgatcaacctgccagatgtcgcactttcagcccacggtgatatggatcagttctggaagatcttcgacgagcgtctggagctttgccacaaggcactgcgctgcagacacgaccgtctggtcggcaccacttctgatgctgccccgatcctttggcagtacggtgcgctggcccgcctcgacaagggtgagaagatcgacaagctgctctacggcggatactccacgctaagtctcggctacgccggcctctacgagtgcgtcaaggccatgaccggccacagccacaccgacaaaggggcaaccccgtttgccctctctgtgatgcagtacatgaacgacaagtgcacccagtggaagcaagccgaaaacatcgactactccctctatggcaccccgcttgagtccacgacctacaccttcgcgaaggctctgcagcgccgcttcggtatcatcaaaggcatcaccgacaagaactacatcaccaactcctatcacgtccacgtgaccgaaaagatcgatgcgttcaccaagctcaagttcgaaagccagttccagcgcctctcccctggtggagctatcagctacgtcgaggtcccaaacatgcaggacaacctcgaggcagtcatccgtgttatccagttcatctacgacaacatcatgtacgcagagctgaacacgaaaagcgactactgccaggtgtgcggctacgacggtgagatcaagatcgtcgaagacgacggcaagctcgtctgggagtgcccgaactgcggcaaccgtgaccaggacaagatgaatgtggcgcgccgcacctgcggctacatcggcacccagttctggaaccagggccgcacgcaggagatcaaagatcgcgtactgcatctgtaaggcatcgcttcatacctgatgcggggatagaccggaaggcctgtccccgctctttttgtactctgccgcgttcgaatgttcctgttggcagagcctactagggaaacgatgattaattcgactcgatgaggccagtggagccgcacgctgtatgacatcggctcaaaatgtctcgaaccacgcagtgcccatacccacatagatgcctatcggtctttctggatatggtatagctacatccacgcatcccagcatatccaaaagacagatatagacagacagatgagctttcaaggccttacatcctaaggtaaaaggagaaagacccggcgagaggcattcctggagcagatggatgtaatcgttgtgtgggatggctggattgttctggtagataccagctaccactgacaggctcttgtcaggcatgtgcgcgctgcaaagacgatgctttaggatgtatcctgctttaggtaatgtttgctctcttaagacgagggaacttaaggatgctatcctggattgccactcctggtagcgcttctgtgcacgtagacctcatgcaggtgcaggtgccagatgcgacgacacttgcgaagatccgtcatagccttaaagcgagaggagttcggtaaagcttgtgcttcacgacctgaacttaaaagctagaggcagggatcacggggcgggatggctccattgtggatgtgaccttcacctgggccttaaagcttaacgaagaacaaagaccatgcgcgcgacccttaaggcgcaccagtccaagaaagggggagcctggcgtatctgatacaaggcgcatatcggcgtggatgccgcaggtggccttgtgcatggtgtggagacgattgcctagaatgtatccgacatatcctgtggcacatacactcgtaagggaagatgataggttctgctgcgcagactttaggctatataggtatagcgaagcgcccttaagggcgcataaagacccacacctctcatctatgcgctaaagcgttgctaaggaaaccttcgaccagagaaggccttgcctgtgcactcttctccgagaagggcatcgagtccaggaaggcatctatccgctcaaaggtagagcatcccttccttatcgtgaagcggcgcttcgatccccttaaggaagcgctactagaggatagagaagatgcctgcacactcgagtctttctcgcccttgcaaaccttacccatgtgcatcttttgccggcaggctgcacctcccggctcccagagtcgcttgatctgtcttggagccttcttgcggtgcatgcggcaggacggatgtaaggatagcggctcctgcacgtgctggatgagcatccttccctgcctttcccgcataccggccgcgaaaagtcgtgtggtcggtcccctctaacacgttatggggcattaatcatcgtttccctagggtaagacaagagagagtgcagaggagaggctggtgggtgaactactccgagatcaaatactgcgacagtgcgaacagtaccagcgtgaggacgacgctcttcgtttccagctgcaagaggcgctacccgttctgcttcaacgaagtggcccggaaattctctgccagcaagccttttacgaaagacgttgaggacaccattatcaagagcatagagcccttctatgtggacggcctctcgacgctcggcgatgagtcgatggagcccgagaaccagcgtggccttgtggacttcctcgaacacgtgaaaagacctatccggagaagccgatctggctctactccggtttcacatatgaggagcttgccggcacagagcccgtgcatgtcccctatacggggtctccacgctgcgagatcacggaccgcatcctccagaccaggacctcaagggcatctcgcttcgtctccgcagctcctcggaccagcgcctcctcgatataccgaagacgcttgcggccagtgtgcccacgatctggcacaatgacccgatcttcgagacccattcgatgtagagcagaacacagagtgcatgccaagagggtgccttcgggtgccctcttccttaccgagccactgcccttccctgaagcttcgggttcgaaagatagatctcgtggaggcccctgagcgtgagcgtcgcatccgctgtcacctcatgcctgagaagagctgtaagctctcgggcctggcttcccgtgactgcgacaagagcttcgcctccaagctcatcgaagacgcagtcaatgagaccatcgaccttcgcaagctcccccagcacaaggcccgaacacatcgcctcagctgtcgaggtgccgatagcatgcactggcaccgagagctcgatttcgggcagccgtgcagcagactcgctcagcgccttcgcgccgagcgaaagtccgggtgctatgatgccgccacgaaacgaaccatctacccccactgcctcgatgttcagagtcgtcccgaagtcgacagcgaccgcaggcgccccgtagcgcgcacgcactgccaccgcatcggcaagccggtcggggccgatctctgccggatccttgtaggcaaggcgcatgccgcttttgagccccggccccacgacaaggggacgcaggcctgaggtaacgcccaggccctcgcgccaggcttccgtgaggctcggcacaacacaggagaggatggaaccgaaggaagcaggtgctgcagtccctgcgtcttctgccatgagctgcagaacttccctgacagagagcctgacttcatctgccgtgagatgctttttcgtcgtgagcgcgaaggtggcaaggggttctgcatttggaccggtttcaggcgcaaagaacccaaacgtcgtctcggtattgccgatatcggtggcaaggacaaagagactcctgttctcgggcataacacgctcctatcttctagttgttgcatcttgaggccgaataccgaatgcttcagggtgcaatgcagattctggcgggcagagttgccgacatggcatatgaaagctatgcatctcgcgaaggagtcaggcagcctgccatagctaggggaagccgcagattagctggatgagggcgccgaagtggggcaccttggatctcttccaggagcctgcggccccgagtgagcatggaagtgagcccgccagcgtctgcaaggagaggcaagatggtgtatgcaggtatgcacatcgcgaagacgaaccacgtgatcggggcagcagacgatgtcagcagccagatcggcaggccgctgccggattcgagcgggccttacatggttggagtctgtggacgaaagcctagacgatgtgttcgtgagcataaaggcgagcgggcactgctggagagcctgcttctccaggctcgtgtcggtaatctacaggctctgtgtcatcagcccccatgcaggtgcatgccatgtgcagattcgatggcgcaggcggctcaaggcagaaaggatagacagcatccttatagccaacacactgcaccaggacaacttcgagcaagatgcagctcgccacgctgaaggcccaggccatctgcgtactgggctcctgcttcccgaaatatgcagggtgcctcaccgacatgttcgggcccgcctcgctgaagctgctccgggaaggctaaaagggcaggctcggcgatgcgaactcttctgtcggcatcaggttcaacaagtctggtacatccgttccagataaggtgcatggtcttgcagatagagttcctgaaatccaccatagaggtggtcgagggaacagatcttcgggctgctcgcgaaggtcgagcccactatagccgcgataccccacgcaggcagcatgaccggctcccacatcggcaaggcgaagcgattcgacagcgccgcgtcgatcgtcaggtatgccggcttccattcaggcgcgggtgagtcggataagttcgcggctgtccatcacgaagcacgactccctatacctcaggcgggcactgtggctcgccgtgagccgggtctggcaatacgacccaatactttgggacttctagcgcaagaagcgggcgcagggcaagccgcacaggatcgctgtgacccgtaagctttgctacatcgtgtatgcgctcatgcgcgacgggaagcccttcgatccagacagatggtgcagtgctctcccctgtgccgcatccagaagcattcggtattcggctatcaaggtcccttggcggccccggcagccatgccgcaagcctccgtcgaacgatcggtacagaaggctcagtttggtcttgacttcatatagctggtctccttctgaagatattttcggcgcagtccccacaacgggaccttgcttgtatactatagtcgttctgccagcgtaacccgactctccgctgagggagagcggatatacctcaaggagcgtacatgcaagaacacaagctttctgcctcatggcagaggcagctcaccctccggggtgcccttatcggctgcatcggctgtgtcatcatcacggcctcgtccgtctacacggcactgaaactcggagcccttccctggcccatcgtcttcgcggccgtcatctccctcttcttcctgaagcttctgggacacaccaccttgaacgaagcgaatgtcacgcatacaatcatgagcgcaggcgctatggtcgcaggcggccttgccttcacgattcctggcacctggatgctggggctcggtgaccagatcggctggaccgagatctttctcgtcgcgcttgcgggcacgatcctcggcctcatctccacagccctgatacaccgccatttcatcgtcgatactgcactcgaattcccaaccggtacggccgctgcagagaccttgcgcgcgaccgaagccggcggcgagaccggacgccagctcttctgctcgatggggatagccggcctctggagcgtcctgcgcgacggcctaggtgccctgccgacgatgtttgccacccttcccatccccggcatcaccttcggcatctatgactcgccgatgatgctttccgttggcttcctcgtcggctgggtgccggtcctcttctggttcgcaggcgctctctttgcaaatttcggcctcattgtcggaggctctgccacaggcctctgggatgtgaccacggcccagggcatcgtctcttctctcggcatgggcctcatgatgggttccggcatcgcgaccgtcgtgaaggacatcctgcccgaggcgaagacaatcttctcgggcctcaggaatgaagccaccgaggagaaggactctccctactctctcgccacaggatccatccgcctcgatgccggcatcttcggagttgctgtcgcagccgtggtgctcctcatctgcttcggtctgggcttgggaccccttcccgccattgtcgtcgtggtctttgctttcgtcgcgacgatcatgagcgcgcagtcctgtggccagaccggcatcgacccgatggaaatcttcggcctcatggcccttctcgcagtggctgccttctccgatatcgcgcaggtaaagctcttcttcgtggccggcatcgtcgctgtcacctgtggccttgccggcgatgttatgaacgacttcaaggctggtgccattctcggcaccgacccgagggcccagtggctcggtcaggccttgggcggcatcatcggcgctatcgtggcagcagccgtgatggtggcacttgtcggtgcctatgggcctgatgccttcgggccaggcaaggaatttgtctcagctcaggcttcggtcgtcgcgaccatggtgtcagggatcccgagccttcctaccctcttcgtgggccttgtggccggcatcgcgctctattgggcagggcttccttcgatgcttataggtctcggggtctatctgcccttctacatgagcttcacagccttcttgggcgcgcttgccaagcaggtctacgacaggatccagcgtgagcgcaggaaggatatgactgaggccaaagctcaagaggctgcgaaggaggcagacgagactggcctcgtcgttgcttcgggagtccttggcggcgagtccatcgtcggtgtcatcatcgccttcatcgccgtcgcggcaggcctcgctggctagactgattcctacagaaagatgcaggcagagcgcgcctggtctgggatttccttctgaatcgatatcttctggatttctggagactaggccttcttgctgaagggatctcccccctcacgaagagatcgatcatccagtttgtcatgttcgacgtgtcctcatgcgttgtggggagatccttcctctcgacccattcggcgaggctgagctcctctccgtcgactgtaagctcatccaggccgtcgagcttggcgaagaagccaacgaggagggtatcagagaaagaccaggactaatccgtgacgtatgcgagattgcgcacggaaaggcctacctcctccttgatttcgcgccagcagcactcctccagggtctcgcctacctcggtatatcctgcgacgagcgcatggtgtgtggcacgtccacctgcatacttcgtaaggagcaggcgctcgccgtccacgatcatgacgatcacgccgatattgatgcgcgaatagacgatgtttccgtacgaggggcagacgagctcgcaggagcgcggtgtatgcgcaagcgacgctacacagacgccacagtaggttgtgctaccgccagtcccagagttggtagccataatgacagcaaaagcaagccagtgcggtgcatagaagaggcagcctgagatggaaaggtagcgggggggagcccttggcctcgacgagcacgtcggtcgtcaaaaagaaagggctcagacctgaaacctgtgtgcagacccatcacgcaccagccctggaagccttcgagtagcgcctgctggcaatcgaatatcttgaggaagaagtattcgtcgttagggtatccctagcctgccctcctgagcatcttgatcatgcagttggtgccttcgaccctacccgaagagatccggtgcctggcgtgcgcgacgattccctccatgtggccctccacgaggcgggcaaccctggcgaaatgcctgtctttcgtgccgtggcagacctccacgatcctctctatggcatcgcgtatcgcatccacatcggtgcacgaataggcctgcgcgagcatctcatctacaatgtcgcaggcaaagggcagctcgttttgggatatgagctcctcgtagcgcttcctggctcctcccttctgcagagcctcctgcttgccgaagagggcgcttccccttgagacgaccttgccggcgtgtgcatagcgctccttcctcttcctggtgtcggcacaggacttgaggatgtatgtggagcgcttgagggaccttgctccttaagtcttgcctgctcgtccttcctgaccttacagatcaccttctcgttgaagttcttcacgatatggaagtactcgtaaacgatgtccaggtgcgaaaacctcttaaggaatgcgcactcgaagtctgcgttcatgtcgcaggcgattgtctccacattggatatccactcagcgagcacaaagtcacagaattcatgcacgacctgcttcttcttggaatgagcgagctacagcacatggcccatcttaaggtctatgactacggtggcatatctgtgcctgttgtgcagcttgaacgtatctgcgcccagataccttgcctaccgctccggcttccggagtctggtctcgccgtcctcgcccttctccgtatagagcgcagagagcctcgcgcggtcgatcgccttcaccacattcctgttgagccctatcatgagggacactgccttaagggtctaacccagggcaagcaggtcacacacgaatgcgagcagcaacagcgtgatgcgctggcctggggccctgaagggcacctcttccgtgagggtgctcccgcactccctgcatgctcatcttggtcgcaagacctttatcctcgcccttcccatccccagaggggggtgccgaagcgcaatgggagccttcccgtttttctccatcgcctttccgcagcaagggcagcatggtgcatccgacactgccggcctgcccgaaaccgtgaggatctgcaccgccttcctgcatcttttggtcgacgtgccgaactccttggtgcacacgccctctctgggctttcccgtctgcacgaagccctcgagatgggaggggatccagaagaagacagagtcttctccggtatgggaaatggcggacagctgggctgccgcagatgctacacttgtcagcgcgctccatccttgttcggagtctacatgttgtgatgcaagattctagaggatggccgcttttctgtctctttgagtatcaagccacgatcatctgcccacaggttttaggattggaccaaagaaagctcttcgacgtctctactgggtagtacaggccagctgtctctgggccgagaagttgagttttccagtctgaggaagatcatcgccttgaagtaggacatgttcctgaagcccctagcagcactttctgctgactggacgagggagttgagcctttcgagaaatgaattggtcaaactccccttccgccagttcaagattccctcatgctcttcctaagggtacctgccgccctcttcatcttagccacgacagagtgcatcatctacaagcagagccggtctggggccttggctgtagattttctgtcagggcagccataggtgtcctgtatcgcctctgccatctgacaggcgcgcgtcagcatgtctactctttatcccatattcacttcttaaggttcctatcgaaaatcttgggtttaccccttgactttaaatagcaggtctttctcttcagccgcgagctgccttgtgtttctctgccggcccgcgcctctccgcacccctcacagggtctgtcgcctttgtgaagagctgccaccacatggaagctgtccaggatctgagtggcctggggcatcgctgcggtgactcccagggagttatgtctttgccatgtcgcgtatggcctctaagcccttcgtcctgtcccctgtgtgctccttcaaagccttcacaccgctcccttgttctttgctttccgtgatggtgcgctggtggttgagatcggccatgatgctgatacagctttggtcgcaccttttggcggtatcgtctgtacccacacgcacgactctggaatagtctgctgcatccctcgccttcgatgtcgccttcccaagcagcctccatatgcgcatgggctgtctcgtgcagaggcttatggccacaacactcatgacaaagagcgctatcacgtatcagctgggtctcaaagagcgccgtgatgcgtcttcggctggacccccagggtatccttgcggcatgcacgccgtccttgggggcactcggtaccgcgccgtgcacgatcgtctcgtattgccagatgttgagatgtttttagatcctctcgcgtctgccacaggtgccgcagcgcctgtagcagacagggctcaccacttacctggccccttctgtgcgctatccgcacagggagttcgttctgggctcatctgcgcttctcgaaccagacgccgaagagctccattcgtccctaagccccctggggcttcttaaagagccttgtcagcatacctgccctaagcatccatatcgcgcctcaggaccgcatccgtcgccaaaatcttggctgtccgggtaccacatgctcaaggaggtgcaaggagtgctgcccaccataagtagcaaagagcccagagacctccttgtgtgtgagcttcctgtcatcgagcacaagctggaccgggatgccaagccaggaatactgggagaggagcgtgagcgccacaggcgcttcgagccttgtcatcgagaagcaatagaaggaggaagccactgcagagagtgcaccgaatgtcatgagctttgctgcctcacagaccggcaggcgcataaggtgcgtcccgcaaagggcttcgatcagtgccaggagcacgaagagactgcatcctgtccaggcctgcgccgccatgatctactaccagctatagtctgccgtataggccagcttgtatgctgttgccatgaacccataacttactcctccgagaagcatctcgaaagctgccagattgtgcctgacgcctctcttctaccatgaaacctcccaacccggcatctacgcacaaaaaagcgccgcacagcccagatagctgttcggcacaaagatgacagagtccggagacgaccacgaatcgtttgcatccttatcgtagccgaggaagctcatccctgcaagcaggcctactttccctgccagacaatgcggggcttcaggtcttcgactcccgtctcgccgagatagtgctcgacgattgcaaagctgaaatcaatggccgtacccatgccacgggaggtgatgatgttgccgtcgacgacaacaggagcttcagagtagatggcaccgccctcgacgcatgtatctttgaagttcggattcgacgttgcatgcttccccttgagaagaccaagtttcgcgaggacggaaggcgcagcacagatggcagcgatctccttgccggtctgggcgaactccacgactttgtctgtcagtgccttgcagttgccgaggttcaaggtacccggcatgccgcccggaaggacgagcatgtcataatcgtcgaaatcgaggtcctcgatcctcttgtctgccacgatgcggatctgatgggacgacgtcacgtccttcgtacccgtgatggatacggtatcgcaggggatgccagcacggtagagaaggtcgcacaccgtgaggccctctatttcctcgaggccattggcaaggaagaccgcaaccttcttgtcagatgtctgcctgaatgtcacagctgctcctttcgttaagaaattgctatctccactcattataccctcgagtcttctggcctccatctggccattttctgaggacaatgaccatctgcaaattcaaaatggcacatatctgtgttcgcagtattatcggtttagcaagctgtgccttggctcatagggggtttgaggccgattgcatttggagaggagaatccatgcagtattccgcagaagtggagaggatgtgccccgttgccaagggcgcagaccacggacctgcaccaattcccgaggaggggaaatgggttcaggcgaaatgggaagtggggtccaggccaaggagatcagcgacatctccggctacacgcacggtgtaggctggtgcgcaccgcagcagggtgcctgcaagcttagcctcaacatcaaggaaggtggtcgtcgaggagtgcctgacgagaccatcggctgctccggcatgacgcatccgctgcaatggcagctgagatccttccgggcaagacgattctcgagtgcctcaacaccgactcgtctgcgatgctatcaatgtcgctacgcgagcgatgttcctccagatcgtctacggccgctcccagaccgcattctccgagggtggtttcctatcggcacggcctcgacgacctcggcaagggccctcgctccatggtcggcaccacgtacggcacgaaggccaagggtgccccgtacctcgagctcacgcagggctacatcacgcatctggcactcaacgagaacggatgaaattatcggcttcgagttcctgaactcggcaagttcaccgatgccctgaagaagggcgtcgacgcccagaaggctgtagacgacgcaatgggccgctacggtcagtgggacaaccccgccaaggtcacgatccgcgtgtcgagtaaccaggaaaggagctgataaacatggcagttacgttcgaaggctatgagcgccgcatcgcccagatcaacaaggcatgcgagcagtatggcatcaaggacctcgaggacgcccgcaagatctgcaccgacctcggattcgatccgtatgacatcacgaccggcattcagtccatcgcattcgagaacgcaaagtgggcctacaccctcggctgcgctatcgctgtggaagaagggctgcaagaaccgctgctgaggcagcttcctcaatcggcgagggcctgcaggcattctgcgtccctggctccgttgcagacgagcgcaaggtcggcttggccacggcaaactgggcgcaatgcttctcggcgaggacaccgagtgcttctgcttcctcgcaggccacgagtcttcgcagccgtgagggcgcaatcggcattgccaacaacgccaacaaggcccgcaagaagccgctccgcgtcatcctgaacggcctcggcaaggacgcagcacagatcatcagccgtatcaacggcttcacctacgtccagaccaagttcgattactacactccaagtcgagatcgtccgcgaggttccgtattccaacggcccgcgtgctgcggtcaagtgctacggcgctgacgacgtccgcgagggcgttgccatcatgtggcacgagaacgtcgacatctcgatcaccggcaattccacgaacccgacggcttccagcaccccgttgcgggcacctacaagaaggagcgcctcgctgccggcaagaagaagtacttctcgtcgcttccggtggcggcaggccgtaccctgcacccggacaacatggctgctggtcctgacatcctatggcatgaccgacaccatgggccgtatgcactccgacgcacagtttgctggctcctcttcggtgccggcacacgtcgatatgatgggccttatcggcatgggcaacaacccgatggtcggctgtaccgttgcctgcgctgttgctgttgagcaggcactgaacaagtaaggcttccgcaggctacaccttcgaatcatacgccggctttcaccttctggtgggagccggctttttgcaccggcagattgtcaagctgagtgcaccatctccctaaagacctcgttggctgtcctatagcctaatacctttcttggcctgtcacagatcagatcgaagacatgttgtacctccttgtgtgagacccaggaaaagtcgctacacccttaggggaagaactcacagatgaggacatcggtgttcttaactatcagcttctgccacaggtggtgcggctcgcagaagtaaaactttacacctcccaaggcttttgcgaccttagccctgccgggagagctgcttggcgcaaacaggtgggagtgtcttgagcggggacctctcaaggacgctgagctgggtagtgcacgcgcccttgctgcccacgagcagccacaaggagtgcttgggcaggacctacaggcacgcagaggttggccccacgacagtgtcggtttgcccacttacccagatagaagcgcttagaaggcctcccttagcctttctaagagcttctgggagacctagggaaacgatgattaattcggctcgatgaggtagctggggccacacgctgtatgacatcggctcaaaatgtctcgaatcacgcagtgcccatacccacataaatgcctatctgtcttctggatatggtatagctacatccacgcattcctgcatatccaaaaggcagatatggacagatagatgagctttcaggaccttaaatcctaaggtctgaggagaaagaccagacgagaggcactcctggagcaaatggatacgatcgtgccatgggatagctggattgcactggtagataccagctaccattctcaggcgcgtggcaggcatgtgcgcgctgcaaagacaaagctttaggatgtatcctgctttaggttatgttcgctctcttaagacgagggaacttaaagatgctatcctggattgtcggtccacacggcgcttctgtgcacgtagacctcatgtctgagcaggtgccagatgcaacgacgagcgcgaagatgtgccatagccttaaagcgagagggactcggtaaagcttgtgcttcacgacctgaatttagagctcgagaaggcagggatcacggggcggggcggctctatggtgggtgcgaccttcacctgggctctaaagctccacgaagaaccacgaccatgcgcgcgacccttaaagcgcaccagtccaagaaaggggggagcctggcgtatcggatacaaggcgcatatcggcgtggatgccgcaggtggccttgtgcatggtgtggagacgaccgcctagaatgtatccgacatatcctgtggcacacacactcgtaagggaagatgataggttctgctgcgcagactttaggctatataggtatagcgaagcgcccttaaggtcacataagacccacacctctcatctatgcgctaaagtgtcgctaaggaaaccttcgaccataaagggtcttgcctgtgcgctttcagccgaaaaaagcatcgagtccaggaaggcctccggccgctcaaaggcagaagcatcccttccttatcgtgaagcggcgcttcgaccccttaaggaagcgctacagaaggatagagaagacctcctgtatgctcgagtctgcctcgcccttgcaaaccttacccatgtgcatcttttgccggcaggctgcacctcccggctctcagcgtcgcttaatccgtcttggagccttattgcagtgcatggggcaggataaatgccaggatagcggctcctgcacgtgctggatgagcatccttccctgcctttcccgcattccggccgcgaaaagtcgtgtggtcggtcccctctgacacgttatggggcattaatcatcgtttccctagatcttgctttaccttttctcgcgggcaacttccccttccagccgctcgtttgatcgggtgcagggagagtccagggcgccaaagtcgcacacggaagatggccgcaaagctcacgacaccaagatcctgcccaccacctgctcgggcgaccaatgctcatccacgatgaagcggcctcacctgtgcagccagcctcttgtgcgccctgcaggtatcgcagtgcgcacttgccctcctttggggccgtgcaggcaccatagcctctcctgtgggctgttcctttcaagcttgcggctcacgttggagctgtcttttgtctgatgcctttgcgatgctgctgggtgagtagtgcctgacgtgtatctttgcgatcttgttgtgctcagcggcgctaagataagtgtagtggtgcatttcccctcgacgttcgatgatggcttatacaaccaacatcgcagccttcgggagtgtgccacgacctctgcctggcgctatcctgttgcactcaaaatgctaattcgccgtaccaaactatccattttagggcgcaaagcttcccttatgacaagacagcaccggagatgtatcctgatgccgcccatacatgaagccttcgtcgtctcgccttaggcgaatccattgatgctatagaagatgaagttcgctgtgaagatggctgcagcaaagatcggccccgcaagagagaagaagcgccagactggatcagatctgcgcttcttctgcacgaagtagagcacgacgccggcaagaggatagatgtagccaagcacgaacgaagcaatgcagagaatctgctgcttgagaccgagaccaaggaaccgtctcgcaatctttcctgtgcgggccctgagcgattcgtgcgctgtaagctcctgattggtgcctttcattatctatcctctctcgtatcgaagcttccggggaaggccacctgagagatggcctcccatatgttcctacttgagttcaggccagtagcccttgtttgcgacgatgtagtcgtcaagcagcgcctttgctgtatccttatcattcacgaggcggttaagtgtcagcgcctgccaggccttgcggtagctgccttcgagatttgcatcgaccgtaagcttctcgtaggcaaactggttctcgaggatgcccttctggaaggtcggaatctctccgacattgatggcctcgggaccatggacgcccatatggcagggaacctcgaccatagcgccctcggagaagttcgagatgatgccgtggttctccgtcatgcacaggaagacgtcgcccgtgttgtgcgagagcgcataggcaagatccacgatgtaagtcgcgtgctcatccttattgtcggagggatcgagctcgtacttcgtgcccttgagcttgccggctgcgatgacctcatcgatcatctcgaatgtacgcttctcggagccatccataacctcgtttgcacgggtatagttcgggttctcagtcgagagcatatgccgcggatagaggtagtactggaggtacgtattcggcagatactcatccggcatctcgcggatcatcttattcatgaaacggtatgtctcagcccaagaatggtcgaggccgtgatcgtctggatcctctggcatgttcgaataaatcttcctgatctctggcagatagtcgtgaccggtctccttgtcgtagacatgggtgaaccagccgaagtggttgaggccaaagtagcgagcttcaagctcgttcggcttcttgtgaagcgtctccgcatacatgctcatgataccgacaggcatatcgcagatgttgatgaccttgtagtcgcctgggaagatgcgcttcgttgcctcggcgacaattgcagcaggattcgagtagttcaagatccaggcatcaggcgaatactggcgaatctgatggatgagcttcacgacagccgggatcgacctcatgccgtaggcaaagccgccggcgccacaggtttcctgaccgatgcagccatgcttgagggcaatgtgctcatcggactcgcgcatcttcatgcgtccagcacgaatctgcatcatcgcaaagtcgatgcctttgaaagcctctgcgggatcggtcgtgtcaacaatctcggttttgggggcatattcgcgcatcaggatgcgggcataccctgcaaccctatgctggcgctcatactcgcagtcatagagaatgaccttgtcaagcgggaacctccccatctcatgcaccatcatgcgcaggatgcccggcgtgtaacgcgagccgccaccaacaatgcagattgtgaaatgctttccttcattgagcatgggatacttcctttccttccagacgcacaggccatcctattcagtgatggcaccgagcttctggttgattgcttcgcagacatcgtccaccttgaggccgatgatgatctggacattgtctttcttcatgacaatgccggagttcttgaagcggttgatcttgtccttatcaaccttcgagatgtcatagacatcgaccctcagtcttgtcatacagttgatgaccgccttgatgttgcctttgccgccgaggccatcgataatgtcctggacatcacccatgctagcaacgcccttggcattcttgaccgcaccggttccagtagctacatagttctcttcgcgaccaggaacatggagatcaagcttctgaatcaggaacacgaatgagaagtaccagacggcgatgaagatgacgccgacgatgaagaacacataccacttggtcatctcagctggtagggcaattaagccagggatgatatcaaggatgccacccgctgccatgagacggaatccaagagcgaactcgagcatctggcccaagccatcaagcagggagtgaacgagccaaaggagcggagaagcgaagagatagaggaactcgagcggctctgtgatgccagcgagaagggcaacgcccattgccggaagcatcatggccttcacatcgtctttacgctcaggacgtgcacaatggatgaaggcgaggacagagccgatggaaccccagatcttcgaaaagccgaagagcccgtacttgacagacggatcgattgacgtaatagcagacgcattcccgagttctgccgtgtaaattggaacggcaccctcataggtctgaccggcaatagtagccgtaccgccaattgccgaatacatgaacggcatatagacaaggtgatgaagaccagttggaatcaggaagcggttcaggaagccataaacgaagacgccgaagagtccagaatcctcaatgagagtcgaaagagcactgatgcctttattgacaaacggccacacataggagacgacaatgccaaaagcgattgccatcatcatgcagcagaaggcagagaagcgcgagccaccatagatgcgcagcgcctccgggaactgcgtgtcgcaggtacggttgaagatccaacccgtaaggcagccgatgatgatgccagcgaagacacccgtatcattgacctggagaccaagcaccatgccttgtccggtaccagccagcgtatccgcctgaatcagacgtcccgtcatcttgagaaatgcattgttcgcatagagatagacgaggaacgtaagaatcgagacgacagcagcatcggtctttttcttgtgggcaaatgcaaccgacagtcctatcatgatgatgaccggcaaattagagatgccagctggaagaaagacattgaagaagaatgtgccgattgtctgaatcactgctggcatgaacgaaagcctgagaatcacgcagacagcaaggacaatgccaacaaccgaaaggaacacgatcggctgtatgatggcaccagagaagagcttcatgacgcctaaagcgctccgcttctgcttgacagcagcatcctgtgatgtagccataccttagtttctcctttgcaagcaaattcccccagcaaagctcagatgaggtcctatctttgagatgaatatacgaccgtccgtaagattcacgtctgtctatgctgacaggagtgttctaatttagttggtagtgaacacagtttgatttttagaatcaaggaagcatcagcatgggatacgaggtcttgtcagagctttcaacaactgaccagacaatcatgagcgcaatcaactaccacatttcccagtcagagtatgtaagcatctccgagcttgccgatgaatgcgatgttgcaaagagcacgatagtcaagctagcaaaaaaactaggctataccggatatgccgatatgcgcgagaccctttgtgcaggcaaagaagacgaggtatcagatagctttctgccgctcaacacgacacaggacgaggacaccctcgatgctgcgacgcggcttgccacgcttttctgggacagacgctacaccaagcatgttctagcttcgaatatatgctccgtcgatgcaatactttcagcctatcttgctcgcaagcttgcaatgtttggtatctatgcgataagcacatatgactatgcatccataatcgccaaaagcactgacccgggaattgctctcttcttcgagcacaatattgaccagaaagcaggagccggcagcttcgtactttctgccttcaagccacttttcaagcttgcccagcaagaaggctattgcaccgtgcttatcactgatgtcgtgaaagagacctctacttctcagctcacagacgaagtatttcgcatcaagccatcgtacgattcgagatatgattttttcgcgccgcgcacaatcgtgctcttcgaactcatgctaagcgagctctcccgattggcggccagtcacaatgaagacccagcgtctctcggggagaatgcatgttcaaaaatatgacagaaaagcagcagcatgcctggaggacagcggctgacctcgcaagaaagaatccacttgtgaccattggagaagtggcaaaagatgctggctgttcccctgcaagcatcactctgctggcgcgccgtgttggcttttcaggctggcctgagctccgtcgctatcttgtacaacagtcaaagccacctgcaacaccagattcccccggcggatcaatagttctccctgaagttcagaacctcttgctcgacaataaagacaagtcgattttcgtctacggagcaggcgatggagcattcgcggcagactatctcgtctccaccctcttgtctcatggcttctgctgcctttcgtatacacgacaggctctgatagcgcaagctcgccgcaaccacacagggatgcttttccttgtcaatgaatcgggcattgccctcgcagacgatgcctgtatcgcacacgattttggttactgtatctgcgcaataaccggtaatccctcctcgcccgtcgcacgccttgcaaccattacggtaatccttcgatcgaacaaatcgaaaccacagagctatgagccagactttttctgtgcgagggcgatgacattcacatcctatcttgaggcgagactcccctacctcttcgagaattcaattgctgaccatatagcactcagcaacatcaggaagatggaagatgcgggctgatagctgtatttgatagcctctaagttgcgtgccgggggtggtgacggaaatccgtaccaaacggtaacgtttggaggatagatgtacatcctcgaggagaggacgagagctgaagaactctatgtcaggtatggcaggaaggcggccgcgcaatacgcgagctagaatatccgagccacgtccaacttatggcatggtataaggaatgggagacaggcaaaggcagcttggcagaagcgcagccatgcggcgctacagcccagggcagaagtgctccgctgtaaagcactatctctcccatggcagatacaatccttcacctgccgtgagattggctacccaggatgctcgcaggttcttgccagctggatcgacaagctcgcgcctgtggagcgcaggacgtcagcggcaaagtcattcagcgtcgggaagaagcacgggttggcaacatctatttggacggaatcgtgaaggactcttccctgaactcgactgggctcatgtaacttagcttcgagtgtatccgctcgtggttgtaccaccacatgtgatcgctcagcttgacctgtaggtcgtgaaggccctcgaagcactctaggaaaacgatgattaatgccccataacgtgttagaggggaccgaccacacggcctttctaggccggtatgcgggaaaggcagggaaggatgctcatctagcacgtgcaggagccgccatccttacatttgtcctgccgcatgcaccgcaataaggctccaagacagatcaagcgacgctgggagccgggaagtgcagcctgccggcaaaagatgcacatgggtaaggtttgcaagggcgagagagacttgagcatacaggaggtcttcttatcctcctgtagcgcttccttaaggggcagaagcaccgcttcacgataaggaagggatgctctacctttgagcggccggatgccttcctggactcgatgcccttctcggagaagagtgcacagttaagaccctttatggtcgaaggctttcttgcaacgctttagcgcatagatgagaggtgtgggtctttatgcgtccttaagggcgcttcgctatacctatatagcctaaagtctgcatagcagaacctgtcatcttcccttacgagtgcatgtgcctgggatatgtcagatacattctaggcgcttggtctttacaccatgcacaaggccacctgcggcatccacgccgatatgcgccttgtatcagatacgccagttcttccctttcttggactggtgcgctttaagggtcgcgcgcatggtccttgttcttcgtggagctttaaggcccaggtgaaggtcgcatccaccatggagccaccccgcgccgtgatccctgccttttcaagcttttaagtccaggcgtaaagcacaagccttgccgaactcctctcgctttaaggctatggcgcatcttcgcaagtgtcgttgcatctggcacctgcttttgcatgaggtctgcgtgcacagaagcgccactaggaccgacaatccaggatagcatctttaggtttcctcgtcttaagagagcaaacatgacctaaagcaggctacatcctgttatgaagtgaccgttgtcaagaggtaatttcaggaaatttcccccctggctggccacatttgtgtttctctgacagcatctggaaagagctctgatttaacagttcccggcatgtggccactctgttatacgtggattggctaccaacaggctaatggttttgccgtgagccctgcgatctaaaagcgtggattactgtttccagtgccaacataggatggacgcggatggcttaaaccttacagtgatcacagcttcctccagatgctgtcaggtatttactttgtctattactgcataaatccgcagattcctgtggatttatgccttggctgcccatagacatcatggacagatggctgtcacaggacttgccgcgtaagcggtgcgtagcacccttgacagacaaatggaccagatgttactcatgctgccttctttccggcttctctgggagcgatagtgcctgtcatcactgcccatataaagcaggcaagttccctggcaactgcagcaaccgctacatttcttttttcccatggcggatcatccggtaatacttgctttaaagtcttgtgtttgctctgtcagcatatgcaatgacatcagctgtatttccgtcctgcctgcagcgcagttccttggatttatgtccgatctgtcccttgcagattccttttgccccttcaatgagaagcgtacgaagatgactgttgccagcttttgaaattccgctacgttggatctttgttccactggaagattctcccggcgcaagggcgaggaatgcagcgtaggtattgcctttggcaaaacgactgaaatcgccggtttctacaatcagtgaaggtgccgtatgagtctttataccgacaagacagccaagctttttgacactttccttgtaatcatcatcgccagcaagttcctcgatccgtttgtcgaagcgttcgatctttgatgagtgttccttataggatgccagatactcgtcgagggtcttacgcagcagatcatccacctccaagtgtcttcagctagctccagtgcttgattgtccatttgttgccatcatagaagaagccatgacgcaggcagaaagcattgatctgctgtttgatcttcttgagtgccagtttgtggtcatccctcatacggagatattcttttacagagtcatccttatcggtgggaacatgaaccgcaagatatccgccatagcaaagacactgagcgatcatgttggcatcacgtgcatccgtcttcacccgcttgccctgaggggctagcattgtgctcggcgcaagaatgacgcattttacaccggcgttcgttagctgatggtataaggagtatccaagacatccggcttcgtagccgcattcaacagaataagtatcggtaaggccaagtttctttttaaggttctcaataaattggagaacgtttttataatcagggggtacctggatgttggcgaagaccctgtcctttgccccaaccacaggctccattgcacacaaagtgtaattcgaactatggacatccattgcgatttttgagtattctattcattagtgatctgcttttgtatgtggtaaaccagcttactttattatgttaaacacctatcgtatagcggcaaatccacgttgctactaatgtgaggtcacttcatattatctaaagctttgtctttacagcgcgcacatgcctgacaagagcctgtcagtggtagctggtatctaccagaacaatccagctatcccacacaacgattgtatccatttgctccaggaatgcctctcgccgggtctttctccttagaccttaggatttaaggtcctaaaagctcatctggctgcccatatctgccttttggatatgctggaatgtgtggatgtagctataccatatccaaaagacagataggcatctatgtggatatgggcactgtgtggttcgagacattttgagccgatgtcatacagcgtgcagccccactggcctcatcgaggcgaattaatcatcgtttctctaggaggctggctagaaaaaccagtcgacagagctatagggacacctcccttctcgatgagatgttcgcccttgcagccacttaccagctctttgtc

SEQ ID NO: 328 - DNA, 19118 bp, Unknown
  Metagenome-assembled genome
aatggctagatattgtctatgaccatttccatctgatcaaaaacttcaatgacaaggtggtatcaaaagtccgcaaagaggaacagaaacgcctgatagaagaaggcaatacagaagctgccaaagctctcaaaggctccaaatatgtcctgatgacaaatactgagaccagcaagcagaaagagaaagctgccaaagcgggcaaaatcattgccaaaggaagcgatctgttcaaaaagccaaaggtgaagcaaaaaagcaggaattgaagaagaatacaagaagctgttggatgaaaacaagctgttcttcaccatggatctggtagaagaacagcttaataaagcatacaaagcaaataccgaaagaggcatgaagattcatattaaccggatcatacgcacctgcaaagcaactaagaacaagcatttcatgtggtttgccaagctgcttaagaaccacatgaaaggaattatctctcatgcacgagttcatatctcatccggcaaagttgaaggaaccaaccagatgatcaagacactgagacgcaaaggatacggctatccggatgatgaatatttcttcctgaagatcattgatgccagcaggaaattctcatgacctctgaggttatctatcaacaggaattatgactgaaccatttttatacatgcattttaccacgcgaggctgctaatagcgatgaatggttaaggacttgcggcatagttaggctccatgaactgtaagctgcttagatacgggactttgacacttagccgacaatcatcgaactaattcaagccacaaatttctaggtctacctgggatttgtggcttttcttatacgtcggtttatggtagacgtatctgtggtatttggtggcggttgcatgtggattgggtaaagatatgaaggttcagctaacaaggaccaagaccagcgagaccttctatatagccaagacctatcgggacaggaagaccggcagatccacctcaaagatcgtaaggagactgggcactagatccgagctcgagcagacacttccctttggcaccaacgtagtggcatgaacaagacagcaggcaaagaagatgagcgagcaggagggcgaactcacctgcaaagtcactatcttctatgaccccacaagacagatagaggccggcaaacgacgtacgttcaactgtggctacctcttcttgcaggatatctacacagcgctcgggcttcctgaagatatgcaagggcatacagtcgcgaagcaaggccgaatatgatctggactcgatactctccagactcgtatacggacgtgtgatagagccctcgtccaaaagggcgactgcacagttcgcgcgtgagctgacagaaggaccctcctgcgatgctcaccacatctactgggcgctttctgtgctggcagagaactcaaagcagatacaaaagggctcttcgataagagcaagaggctgcttgaccgccacctgaagacgatgtattgcgactgcacgaactactactttgagctcagcgaggaagatagcttcaaaaggtacggcccttccaaggaacaccgtcccaaccaatctgtggcatggggctcatgatggacaaagacgggcttcctgtggcctgcgacctctacccaggcaacgagtccgagcagccgacccttatgcctttggaggagaggctcgaaggcgagttcggcctctcccaagtttatcgtctgtaccgatgctgggctctcgagcgtggccaagcgtacctacaacagcaaaggcaggctccagttcgtgtgcacggtgtccttgaagagccaaaggaaggagatcagggactgggcacgcgatccttcaggctggtcatgcacagctcagggcggtacctttgaccttgatgagctgaggcgctccgcagacgatcctctgatcccaaagaagacgaggcaggtccttttctccaagaccttctacaagacaaggtgggcctcactcagggatcctaagacagatgaggagctgggacaaaatctcatctgcaccttctccctgaagtagcgcgcctaccagaggtccatcaggaaggcacagctagggcatgtgcccagagggcctgcgaaacaggtgcggccaaaagacagcgcaaaggtctcaaagatcccatgcactttgtcacatctgcctttgtgaccaaggaaggtgagcttgcggacaagacgctcttttccgttgatgagcgaaaggtgtcagaagaggcaagcttcgatggcttctgtgggctggcaacctctcttaatgacgaggatgtcttgggcatcgtgcgcattgcaggagggcgctggcaggtcgaagagtgcttcaggatcatgaagagcgagtttgaggcccgtcctgtgtacctctcacgcaaggaccgtatcgaggcccacttcctcgtctgctttctggccctgctcatctaccggatcctggagaagaagctgggtggcagattcacctgccctgagattgtcgacaccttaaggagcatatacatggaggaggtcaaaggcgagggataccgttctctctgcctgcgtacagacttaaccgacgccctccacgatgcctttggcttcagaaccgactttgaaatcgtgccccaggctcagatgagaaaaatcatcagaaagacccgccagaagcagtccattaccacaaagaagaaggccagcaaagacagcagatagctatctctaccagtccttatgtgcaagctatgtagggttaagtgtcaaagaccggacctcatcgagccaaattaatcatcgtttccctagactgttagaaagatattgaatgcgaatctcaaagctttggagaagaatcagctggtgcatcgcgaagagtacccgcagactcctccaaaggtggaatacagtctcacagagcgcgggaagccgctcatacagatcttggatgcaatgtgcgattggggggaggagcaccagctttagcgcttttgtgatgagcgtgtgtgcctacgaataaggctaaagagtggaatgcggatcagctgatcgaagagggttgccactgcgataaaggcggctgagaagaggatgccggtcccgaagaagctgccccagtagaccggagctgaagctaggataccggccagggcagcgccgatgaaggcttgccaactggtccagctgagtgactgaatgatatagaatgctaaggttgactgtgcggtcttcagaacgatagcggttccaacagattgtttcggctggttcgtataggtctgtgcgaagcagaaaactgtgagtgcgagcagaaatgagatcagcgaggtcgatttgtaggagagcgcgatgagcacgttaacattgttgctgacagcatagataccacataccgcaatgctgaatgctgctacgacaatcagggctgtccggcatttgcggcgtgaaagcggacgttttctagtccagtcagaaagtgcggctcctccgacataggtcatacagtaggtccagccgctcatcagtttcctccaggagaggagtgagcgcgctgcgtcatccggcgagatgaaggcgatgtagccgttgaccagataggtgagtacgaagagcacgagaacaatcgtgctgcgatgctttgaagcggcctgccacaggagcgctacgatcggcgtgatcgctatgaacacgatatagagccagataaattccaggttcatgccgagccaggagagcgaagctgctgagattccggggagcgggacgatccaggtgctgatcgcaaacaggatcagggcatagaagagcaggatcgctaagagtctgagggcgcggccaaagcttttggcgcactgcactctgaaggctgcccatgaaggatgcgtgagggcctgtgcacagcggggaatcaggaagtaccctgagatcaggaaaaagacgtggttgcctgcggctccaagaaatccgatccagcccagcacggtgagtgctcctccgttatagatatgtgagagtgcctctgccgtctcgttatagggcaggaaggtatggaagattgcgatcgcgatgatcgcaatcgcacggagcagctctatagaatattgacgggtggaacgctgggccatgaaatgacttcctcaagttgtggcgggtccatgtaggatggatacgcctgggtgcgtggtattttgacaacagcggccgaggatcgtaaagtatctgcttgcgcctattctgggtgatgtcgtgctgcatcgcctctatcataagcgtgatgacaatcttaggttcaagaaggagaacaactttgcctactattaatcagcttgttcgccaaggtcgcgcgagcgttaagagtaagtcgaaaaacgctgcattgcagcacaatcctcagaagcgtggtgtgtgcacccgtgtgttcaccacgaccccgaagaagccgaattctgcgcttcgtaaggttgctcgtgtccgtcttgtcaacggcatcgaagtaaccgcctacattccgggtgagggccacaacctgcaggagcactcgatcgtcctcgtccgtggtggacgtgtccgtgacctcccaggtgtccgttacaagatcatccgcggtgcctatgactgcgcggcagtgcagaaccgtatgaaggcacgttctcgctacggtgctaagcgcccgaaggactagaacgtacccgagctatctgaaaatcgattgaaggagatataccatgccgcgtcgtgcagcagctaaccaccgcgaggttcagccagatgcgaaatacaataatcgcctcgtgactcagttgatcaacaaagttcttcttgaaggcaagaaggcaaccgcagagcgcatcgtctatggtgcgttcgatatcgttgccgacaagaccggtcaggacgctttgaccgtgttcaagaaggcgatggacaacattcgcccgaccctcgaggtcaagcctcgccgtgtcggcggcgcaacctatcaggtgcctatggaggtcaactcccgccgtgcaaccaccctcgcgatccgttggatggtgaacttctcacgcgcccgtaaagagaagaccatggcagagcgtctcgcaaacgagatcatcgacgcttctaatggtgtgggcgcttccgtcaaacgccgtgaggacctcttcagaatggcagaggcaaaccgtgcgttctctcactatcgctactagttgagggtcaaggagctaaaagatagattatggcaaaaaaggttaagtataaactcgaagacctacgtaacatcggtatcattgcccacatcgatgcaggcaagactacgacgaccgagcgtatcctgtactacaccggcaagacccacaagatcggcgaggtccatgacggtgcagccacgatggactggatgccgcaggagcaagagcgtggtgtgaccatcacctccgctgcaaccacctgcttctggaaagatcacatcattcagatcatcgataccccgggccacgttgacttcaccgctgaggtcgagcgctccctgcgtgttctcgacggtgcagtcgctgtcttcgacgccgtcgctggtgtacagccgcagtctgagacggtgtggcgtcaggctgagacctaccacgtaccgctgatcgctttcatcaacaagtacgaccgtgtcggcgctgacttcttccacgctatcgacaccatgaaggaccgcctgggcgccaacgctgtcgccgctcagatccccatgggctccgaggcgaacttctggggcctcatcgaccttgtcactatgaaggcgtgggacttcaaggaagacgacaagggcatgatttaccccgaggttatggatgagatccctgacgagttcaaggacactgccaacgagaagcgcgaggagctccttgaggctgctaccaactacgacgacgacctgatggagaaggtcctcgaagaccaggaagtcccggtaccgcagctcaaggccgcgcttcgtaagggcgtcctgaaaaacgagctcaacctcgtcttcgtcggctctgcctacaagaacaagggcatccaggagctgctcgatgctgtcgttggctacctgccgagcccgctcgatatcggtaagactgagggcaccgatccgagaaccggcgagaagatctaccgtaaggctgacttctctgagccgttctccgcactggccttcaagatcatgaccgacccctacgtcggcaagctgacctacatccgcgtctactccggacaggctgaggctggctcctacgtctacaacgttaacaaggacacccgtgagcgcttgggccgcatccttgagatgaatgcaaacgaccgcgtcgaccgtgacgagtgctccgcaggcgatatcgttgcctgcgtcggcctcaagaataccgcaaccggcaataccctcgccgacgagaagcacccgatcctgcttgagtccatcaccttcgcgaagccggttatcgacgtcgccgttgagccgaaatccaaggctgagcaggagaagatggctgtcggccttgagaagctggctgaggaggatccaaccttccaggtccacaccgatcaggagaccggccagaccatcattgccggtatgggtgagctgcacctcgagatcatcatcgaccgtctgcgccgtgagttccacgtcgactgcaacgtcggtaagccgcaggtcgcctaccgtgagaccgcaggacacgccgtcaagcatgcccagggcaagttcgtccgtcagtccggcggtcgtggacagtacggtgacgcaatcatcgatatggagcccaacgaggagggcaaaggctatgagttcgtcgacgcaaccgtcggtggatccatccctaaggagtacatcccctctgttgacaagggtatccaggaggcgctgcagtccggcgttatcgctggctacccggttgaggacatcaaggtcacgctcgtcgatggctcctaccatgaggtcgactcctctgaggcggcattcaagatcgccggttccatggcgatcaagaaggccctcgaagagtccgatccggtgctgcttgagccgatcgagcgcgtcgatgtcgagacccctgagcagtacatgggcgatgtgatgggcaacctttccagccgtcgcggcaagattgagggcatggaagaccgcagcaacaccaaggtcatccgtgcgaaggtgcccttggctgagatgtttggctacgcgacagaccttcgttctgagacgcagggccgcgcgagctatacgatgcagtttgatagctacgagccggttccgaagaacatcaaggatgaaatcgtagcgaagaatgcaggaaagaccgagtaatagactcgtgcgtctatgctctaaaatggaggtaccaccgtggcaaacgaaaagattaggattcgcctgaagggctacgatcacgaagtggtcgatcagtcctcaaaactgatcgtggacactgcacagaagacgggcgcccgggtctccggccccatccccctgcccactgagcgctctctgtacaccgtcatccgttcaccgcacaaggataaggattcccgtgatcagtttgagatgcgcacccacaagcgtctgatcgatattctcgatccgaccaactcaaccgtcgattccctgatgagacttgagctgccggcgggcgttgagattgagatcaagctctaacggctgtttcatataaccaggcaggagagaggatcttccacaggctgggaggtcctctttttggcgccggtacacgcgccctagcatctgttgattttctcgctttaaatgcgtatatattgtgaaactcacagattgagtgtaaagtaaaaaagctgctgctaggggatctctgtgtcaagtctcgctgcagcgcgagaagaggatgtagtccgctggggaggacgttagtgtacgtctttgggtcccatgactaccgaagggtaaggattgagtatggtcactacgattctcggccgtaagctgggaatgacgcagatcttcgacgaggatgacaacttcgtcccggtcaccgtcgttctcgctggtccctgcaccgtctctcaggtgaagaccaaaggcactgacggctatgaagccgttcagatcggctttggcgacatcaaggacaagaaggtcaacaagcctatgtccggccactttgagaaggcaggtgtcaaaccgatgcgctatctgcgcgaggtgcgcgtagacgacgcaagccagtacaccactggcgatcaggttaccgtcaaggacttcgccgatgtgaaggctgtcgacgtaaccggaacttctaagggcaagggtttccagggcaccgtcaagcgctggaacttctcacgcggacctatggcccacggttctcgcaaccagcgtgagcctggctccatcggccagtgcgcatatcccgcacgtgtccgcttaggccttcatatgtcaggccacatgggcgatgagcgcgtcacggtcagaaacctcaagcttgtgcgtgttgacgctgagcaaaatctgatgctcataaagggcgctgtccccggcggcaagaacgctttagtttctatccgtatggcctaaggccaaaatgccactttaggctaataaggaggacaggatgtcccgcattgatataaagaatatggcaggtgagaaggttgatgctgcagatcttgcagaggcagtcttcagcgttgagccgaatatccctgtaatccatcacgtcgtggtgtgccaggcagcatcccgccgccagggcacccattccaccaagaaccgctcagccgtctccggcggcggcgtcaaaccgtttcgtcagaagggcaccggccgcgcccgtcagggcaccatccgtgcaccgcagatgaacggcggtggcgtagtcttcgggccgacaccgcgctcacatgagcgtcgcgtgaaccgcaaagaggtcaagctcgcacttcgcggcgtgctctccggtaaggtgaaggactccgagctcgtgctcgtcgacgagttcaagtttgacaagccttccaccaagcaggctaaagagaccctcgcaaagctcggtcttgctgacaagcgcgtcaccctcgtcgtaaacgacgaggacgtaaacacctatctgtcattccgcaatctgcccaaggtagtagtcattggccagacggaggcgaatgcggagtatcttatcgacaacgatgctctcgtaatgcctgtggatgtcgcaaagcatttcgaggaggtgctcgcgtaagatggactcccagtacaatgtgctcgtccgcccggtgatctccgagcgttcatttgaccagatggagcaggggaagtataccttcgaggttgctccgaaggtcccgaaagaggagatcaaggacgcggtccagaagctcttcaatgtccatgtggtgaaggtcaacaccctgtgggtcaagccgaagaccaagcgtgtccgctatcagcccggccagacccgcacctggaagaaggccatcgtcaccctaaaagagggagagacgatcgagcttttctccaaccagcagaagcaggacgacgattcagcgtctgagtaggtaatgatgccctcagatatacttgagggctcaatgtttggtgccgtatagatacgcgcggtaccgtggtaatccggtgtcagcatgctttgaggcatgaagcctcattcccttaagtgtgttggccaacggaacagaagggaacaagagttatggctgtaaggcacttaaagccaacaagcgcaggcaagcgcttccagacggtatatgacttcaaggacattaccgttaaaaagcccgagaaggcacttctcgagccactgccaaagaaagccggacgcaacagcttcggccgtatcacaacccgtcaccagggcggcggacacaagcgtcagtatcgtgttatcgatttcaagcgccgcaaggacgatgtcccggcaaaggtcgccgcaatcgagtatgacccgaaccgctccgctcgcatcgccctgttgcactatgcggatggcgccaagtcctacatcttggccccctgtggcctcgaggtcggcgacaccgtcatctccggtgatcacgatatcgatattcagccgggcaatgcgctgccgctgtctgagatccccgtcggtactctggtccacgcggtggagttcaagccgggcaagggcgccgcaatcgcccgctccgccggcacctccatccagctgatgggcaaagagggcaactacgcgatcctacgcatgccctcctcagagatgcgccgcgtgctgctcacctgccgcgccacgatcggtgaggtcggcaatgctgaccactccaacatcgtgatcggcaaagcgggccgtcagcgctggagaggcgttcgtccgacggtccgtggtacggtcatgaacccagtcgaccacccacacggcggcggcgagggcaagaaccacacttccggtcgtccgtctgtgaccccgtggggcaagccgaccaagggctacaagacgcgtgatcctaagaaggcttcgaattctttgatcatccgtcgtcgtagaacgaaataaccgtcgagaaggagtgaataaatgagcagaagtctcaagaagggaccgtttgtggagacgcgcctcctcgagcgggttaccgcaatgaatgagtcaggcaagaaggatgttatcaagacctggtcacgttcaagcaccatcttcccggagatggtcggccacacgatcgcggtccacaatggccgccagcatgtccctgtctacatcaccgagtccatggttggccacaagctgggcgagttcgccccgacccgtacgttccgtggtcacagagttgcagagtaggaggtcacgactagatgaagcagattgaaaacggagccttcgccaccgcgaaatacgtgcgtatggctccccgcaaagtccgtttggttgttgaccagattcgcgataagtccgtcaaccaggcactcgagctgttgcagttcgcaaacgttgccgcagcaaccccggtcgagaaagtgctgcgctcagctgtcgccaatgcggagaacaacaacaatcttcgtgcgaacaacctcgtagttgccaaggcctatgtggacgagggaccgacgctgcgccgtatccgtccgcgtgcaaagggctctgcatcacgtatcaacaaacgcacgagccatatcacgatcgttgtcgctccgcgaagggaggcgtaaggagatgggccaaaaggtacagcctacaggattccgtttaggtattactgagaattggcgttcccgttggtacgctggaaaggactactccagcaagcttggtaacgatttagcgatcagaggattcctcgagaagagactcgcccgcgcagccctctcccgcgtcgagatcgagcgctacggggacaagatccgtatccagatcttcaccgcccgtccaggcattgtcatcggcaagaagggctctgagatcgatgccctccgcaatgaccttgagaaggtcgccggcgtcaagaagggccagatcaacgtcgacgtcgtcgaggttaagcgccctgagctcgatgcaaacctgaccgctcagtccatcgccgagcagctcgagggtcgtgtcgccttccgccgcgcgatgagaagagcggtgcagtctgcccgcaaggcaggtgccctgggcatccgtatccagtgctctggtcgtctcaacggtgctgagatgagccgccgtgagtggtaccgtgagggccgtgtccctctgcacacgatgcgtgcaaagatcgacttcggtgaggctaccgcacacacccagatgggttcctgcggtgtgaaagtctggatctatctcggcgagaagcttccgggacagccggttccgaacccggcgctcgaaggcccgtcgcgtcctcgccgtcggaataacgagaggaggggcagataatgctagctccgaagctccaaagcgtggtgcacaccgcaagggttcgcgtggggatctcatggaaggggccaggcccaaagggcaacaccgagattacatacgcgtggtggtgtgcctccagctctcgtgagactggatcaccagaccgccagatcgaggctgcccgtgtcgccatcacgcgttatgaagcgtggcggccgcatctggatcacacattcccggacagccgaacaccaacacacgcgcgcgagcccgaatatggtgttcaggcaaggaacccggaagagtgggtcgcggtcgtcaagcctggcgctcatgttcgaggtcggcgaggtccgaggaggaccgcaaagaagctctgcgtcttgccagacaagctccatcaaagcacgatcgtcaagacgtggggaggagtagaacatgaaccaggaagtccgcgcactttccagacgaagagctctcttcaaacttccacacgctcgtgccgcgctctttaaccagcgcttccaatgcgacgagccgctggaccacaccgcacgtgtgaagcagttaaaagccgatatcgccgtgtcctcaccgatcagcgtgccgcggcgttgatgagctcgcagcacaaacgacatcaggacaaagatagatcgtagtagagttgacaaatggtctgagaccgttacaacgaactctcgtaaggtccgtccggcgtcggtctgcgctatctctggctggctacaagacggttgtgtgagatgggcatacaaagcgccatcctaataacggcaagatggattatcgatcatgaagaagctgcagctgccacgacgaaaaaacgtgccacgtgggagatcgtgtccgcgtcagttgagaccgttgcccttagcagagacaaagcgtttggcgctagtagaagatccttttaggcgcgctaagtagcattgtttttggtagtcacgcgagtgtgcgtcctaacgatgagggcaccctctggtgaggtgtaattcggatgactttcatgatgtcagatggagcggtcctcaacgtcgccgacactcggcgctcttgcgagtgaaatgcaatcaaagtgcatggcggctccagcgtcgttactccggaactcgtatgaataccattcgctgcgctgtgcaaggatcgacgccccgtggcaaatgtaaagaaggttacctcgtcgcacctgcgttgtcgtctccgcactgtcagatgacacgtcgcaaggcggcagctatatcaagtgtttgatcagaacgcaatgcgtctcttggtccaaaattggacggcaccggaccgtgtgtgcaccggatctcgggcggtgccgtgagcttcggtgactctcaattcatgaagatcgtcccgctcgcaccgagacgctgtaaggatacgaagaggtcatggcaaagattaacatcaagaaggcgataccgtcgtcgtcctttccggcaaggatcgcggcggcaatcaggggcgagggggtcctggcatgtcctatcctgctgaatggtaatgtcatcttcggagagcgtcgccaacggaacagaaggccccccccgcacagcactccgattcagcatgtgccaaaacggcggctttcgtgtgacgctcgagcaaatatcgacgtgttcccaaggcgtttgaactcatctgcccgagctgcggcacgggccgacccgtggtgggccacggatgtggatgccacggcaagagaggcccgtgtctgcaatctatgcggagcacagtttctctaagtttcttgcagagatctttcaatacgctcttggagtgcaaatacgcgcgcggcctctttgtttgttaccggataacgggtgcagggctgatagagtagggagtgtcatgacgcaagggaagaggagcacagcgtacggcacctcaatatcttggtcgttcttccgtaaatggaaaaggagcgcagcggtttcgggcgatagccgccccaggcacatttcactttgtcgctgctcagatgagcaccctgagtcagctcgccaagacccggatcggttttggactacagatagtcgagacgctgacattataaatcggcatgtagcgtccgagctctgaccctgtcgataagctgggcatggatcctagaagcgcgtgcgccgatgcctatttgtgactccgggcgcgctcgccggatcgtacggccccgcatcaccacgagcgttggtgcgcctatggtccgtcgtttcgccgagcacgcgttggcgcttctcttgtactgatcaaagaaggcttcccgagactcaatatgcaggagattaggaccatgctgggaaatctcggacaccttgtactgacctcgccgtttcaatcagttgctcgtgattgagccggggataatcagcctgcacttcgcaaatgggcccacgggcgtgggccgcccactgcattggcctaccgtcagcaccaagcccgcaggagctcttgatgaatatacgaggcctgcgcctcacgagcaccaggtgagcacctgggtcctacacgtcctggcgctgtagtaatctcctgcggtgcgcgagctgtcctgtcctgcctaccacgccctgagacccattgggctagtccacaaggaggtttcaatcgatggcgctgcccaagagtgccttatcggtgaacgccggcatgggcgatcggattgtagagcaggtgatctgatcgacgacattgacgaggcgggggatcttggcaggagctgcgctcgatgtccaccagaggagcccctgcagagggggatccgcgtcttgtaggcgcccgccttctgatccctccgcacaggtcgcgggataactggcacctaccgcaatgacgcgtgagcgcttggtttccatctcaacagaggaccttcaagtcctatatatcgggcaaaccgttgcgcacgaggtgacccgtggtaagccttgcgtggcatacgcaacgttctctgcccaccagatcgagggttcctttgcgtcacgggggagccgcttttccttttttttgacatagcacgtggacaccgggtgattggctggcgggcagcaaactacgacgtatcccgaagcaccttgtggtgcttcctcgcccttcctgaatgggtgtgtaagtgggatgcattttctctgatagcaaaggggtgttcgatcagggcaacaatgcaagcgatcaactaagggccctgctcaaccaaggagcttgtacctactactgtttaagaacgccccgacgagtcagaacaccggggctatgtcctgaaaagggtcaaagcctttggcggtgaacgatcgggcgctccgagccggaaaggggatcctctcggacttcagctatcccccgcatccgcggcgtatcgaggtgcaggcgaagttgctgagtaggtgaaggcagcccctttcatgtcgtggaaaaaaggggtccaatgtatgtgcgtgcctggtggacgtgggatcgcgactggctccctattcggagttacacgtggtcagagaggacaaagcgtggattccggtcaaacgtcgatccccctgtgatctgaggggtggatcccttcgcttaatgctccatagccgctacggtatcacttcatagggtcttgccagacagcatgcaggcgacatctgtttatattattccgtgtggctctcagccgtcgccactcatgggatgacgtcatccccggggcgcaaggacttctcgatggtcctgggtcattgcgacaaacgctgcagagcagaaacttgctccgctcaggagctattgcgcagaatgtgcggggctcgacgacgatgagctgcctgaaaagatgggctcgttcgctgtttctagtgggtatcgcatgatagcgcatgccacttcttctctggctggtggaagtccagcggggcccagtccggaggagatcatctgtcctgattcaagcgatgccctgaagcccctggcgatgctgcgggcggaactggccacgagtttgagaccgtcgaaggaacggagttggtggagcccctcttccaccagttgaggataccttctcgctcctgcctgagcgttctctgccacgctcttcatctcggcactgcagagtgcatcaccacgagcagaggcgctccagggcccctggccgccgattttctgtccgcgcattaataacgtccgctgcaagctgcagcccatctcccatctggcagtcgcgtgcctcgcctgagatgggtccgtcgcattgtctactccgtccctctcgcgagctggcgattgtgggaggggtctccctcctccccccccttgatgccatacgtactggtcttcggcctgcgagcttgctgcgcttcgagggcggacctcgcgccgctctggcgcacctcacagtgtcgaagatcgctctgtttcctagtatctgtgcaccacatggaacctgtccacggtctgggcaccttgggcatctctgcagctactccaagcggaattattgcgctcggccagtgtcggctcttgtacccggggggtcctgaccttgagcctgtccctagggtgtccattctccttatctcgcgcagagccctgcctaagcgcccttgtcccttcattgcgtgacggtcccacggcgctctggccgttcgaggtccgcccatgatttgctgatgtagctctgtccggcgcctcctgcgggtgtcgtctattccgcacacgcacacaaccgagtagtctctgcatccctccctcgtcgaggcgccttgccagcatccgtccagtatgcgcgtggctgtctcgtgcacagctgcgcgttatcgccaccccgccagtccctatagcgtccatcatatcacctgcgccttaagatcgcccgtgaagtggcgagttcgggccgcacctttcatggcatccttgcggcatcatggccgtccttgggggccgtcttgccctggcacgaacgccagtgcaacttggtctcgtattgccagatgtcgagatgcctcagtccctcgtcgcctgtgtcgtgaggtgcctgggggggtcgaggtcgtcctatggcatctgggcactccaccgacctgggccctgggggtcctgtggcgaccctcacttgagctcgtcctgccgctcgcctcggcgggccttccttaaaccaacatcgcaggctcccattcgtcgcttgatatcccatcgacctctcgaaggagccttgctagcatccctttccctgcctgaacatccatactcggcactttgggaccgaagtctttcctccggcaaaaaaaaccacttccgtccgggcgccagcgtgttcaggggattgcagaagtgctaccccaccaaagtgaaacgaagagccaaaagatggcggcgatagtcaccgtttggtggtgttgggacaaagtacttgaaactctggtcgatgggcttcgacgggcccttgccaggatctcttggcttttatgcggcaggtggctacgcctgcgttaccggagcgttgggtgtctggacggtacctggccggacttctctccttcagcaatcccctaaggggtgttgcctcacgagtttatgatgggccggcgaatgaatctgtcccgccagcctcaactttgtgttggtaaagcggcagcaggggatatcaaatcccgattgcgccggtttaccatatccctctccgaggtaggcaaagcgcagggaacatcgaatccgaaaattgcctgagtaactcccatagttaggctccctgaactgtaagcgcttaaggtggcaagatcggaaggcatcttcgggctgaccgtccggtgctcgatcgaagagcaagaacatggataaggcacatctcgtgcagcagcctcctgcagccatcccttgcattcctgtggctgtatcttagctgacatcgattctcgcaaggagatgcatggggccttgggaaggccaatggaaggcggcccgtcaacgtaggccttgaagttggatatcaccgctgtggaccatgggaagggatgcatccccgccgctctgtccgtactttctttctttatacggagcccgcaaagcgatgagagtcgtcaaatctgccgctccagccatccatccgcccttatctgtcgatgtatggcagagctggtcatgggccccaccgtggcccatcaatctttcgatcagcactcctttgcgcagcgcagggggcaggactctgcctgccgctgtagcaatctgcctgctgctttgttgcgcgccccgctttgcctgtgccttggcgccgataatatgaagtcgtcggcaggccttaacgggtcgctgcaaggacactgacgcaactggcgatctgacccaaggcgattataaggggtccttaaaaggacccgccctgccggtcttacgcttcatcctatcctgccttctcattgtcgcaggcgcggatcattccttctgtgctgacatgagccatatcgctacgaatccacttcctgagctgcgagatgcgtgccttccatcaagaggtcctgcgctcacgcttcactgatgcagcacttcgtgtcaactgccacttgttgcgccgcctcatgaccttcgagtcagggacgtattgttggcgtccgaccgggcagacaaagcgccgtagaccttcgtccacgataagaagccagggtcccctcgcacgactcgctcgtctgagaagccatctccagaaggcctcatcaatgtctctgtgctctcgcattcacgcggtctgctcaagcgcctgaggtggccccttccgccatctgtctttttttgccctcgactcgggattgcatcaccttgcagcctcattgtaggtttgaggtcgacaggaatccctgcgttatgctggagttacgcagtccatttccggagattcgtcggtaagcacgtccggttgtgctggaccgactagcttgcaatagcttaaagtggaaatgcgcagcgtgcgcaggggcttcgctgggtgcgtttttttggtgtcttgctggcatacttagtttcgcatgtttggccaaatattgcgacaatatggtgaaattctttctcaaaaaaaaaatagatgagctgccactagcaattcgccgacatcaaaaccgtatgatgagtaactgtgtctctgtggctggttatcctcccggtacataggggcatctctggtcttcctggcacccggccaggtaggcgttaggta

SEQ ID NO: 329 - DNA, 21285 bp, Unknown
  Metagenome-assembled genome
tcgtggcctctcaggcggttgggacaaacggcactggcacagcggagggcaatggcgctgtgcagaccccctcgcggtctttgcgcttctcgtgcacgaattcgctccctcgctcgtctagtgcgagggccgtcgccccggctcgaagctcagggacatcgagggcgtgtgctccaagaggagggcactgcgatgcgcagcacgcgtgacacagtctgcgacgggctcgccctatctgggcgacgacgtacaaggtcgtcgagatctaacaatcgccgtggatgcctctctctgtcgcagacatgtcctttgccctacttcgattgcacgaacttctctctcgagatcgacccatcaatggaccgatgtcaggagggaagggcccctcgaaggagcacagccacgaagcgcagtcgcgattgggccttctcctgacgccaactgcatcccgtggcgataaccgttttccggcagtggagagcgagagaagccgcagctgggagaatgcatcgcccagatgaaggaagggggctccatatccggcggacgtgagggtcggccgacaagggggcgaactgcgcagccaaccgcggagcggtgcttgcaggggacggctacatttctgcgaagtcgctgggaatggcgctccctgccaaggagcgcacgtgggcgctctcgggagatggctggacggacttcgccgacggcaagggcggacaatcgtttcgctacaatgtgggcggacggcgacttcgagtaccggtagagggaagacggaaggaaagaggaaggtcgtagcttccagagaggcgcgtcgtgcagcgtaccggcccctcgcttgtccaggggaagcagtaataccgagatagcccggcagtgtggaggaagcgagggtcgctcagggcggcaccggcgaaaaggtccgattacgggcgtacagcgcgaagtacttcacatacctcaccccgttcgacggcgatggcgagaatctcaggaaggacgcgaaggtccggcaccttaaactcacgaggcgatcaggtaaggcaggggcccttggccccggctaccatgatcgtgaacctcgaagaccacaatggcccccatggccatatacagtagcacctccacagggctctggaggatcgaggagagcttcagggtgatgacagtccggagtctcgaacggaggccgtctacactcaagcgacaggccgatatcgggccattcctcgtgtgataatcgccgtgctgctgccatgagactcctgacaggtgaagggcttgggagtatagctttcctccagagactttggggctctgtcgcggcggctcgatgtgtgccacactcttgctcacaggggcttcagccaacccatagtccaggagaagccccatcatctgaggagctggcgtcaaggacagggctgtgccgttcaatcttcaacccatcttaaaactctcactcgaggacacgtaccgaggcgaccccgcgtctcatgcgccgaaggggctcgcggaaaggtctgaggccccatcctgggatcaaccaagcgaccttattcaacaagacctccacaaactgcacaaccacacagaacccccaggctcccctaccataaccgcaaccacctatagctaagcacccatatacccacccaccactctcactcactcccgcgtcgaactagaaatcgctcacacaacacttaaacccccccaatacaattaagaaaaccataccctacccgtaaaaaataatcgacatgactgatccccttcatctcccctgtccatcaatatattttttaggaaaaacgttcaatcatcgaccgatcgtcatcataagaaaaatggacacttcttctgggttgctccataattttaggctggctatactgagtgagctatgcgcccttagcccagctggatagagagagggtacttctaatcccaaggtctgcgttcgagtcgcattagggcgcaccacttaaaacggtaaggacggaaaaggaaaaaattatcacctgtcctctttcgtctttcctctagagccgtagtgcaatggcctgtgccgcaaagtgatggttttggtctgcctcgatgagacccgagtcgttggaccgcagccagcacatctcgaggggaacccaggcgcaggtgaggactctcctggtccgatgtagaccttgtccggatggggcccgtgcgcgagacagacccgggtcctccatcagtaaatccgatggatgcggctgcagagggcagatgaaattcaagctgtcggaggttatagtcctgtctcgttccttgagcttcagctgcgccagcgacttactccgaagtttcgtccagctccaacttcccgcagggatccctacagtgtcatcgcctggattgactgcacccgatacttgtctccacaaggacaacttactgtcccttatagagcgccaccccacagccccgtgatgataaggcaaaccgctcccctcgccgccctcggtaccacgtcctcaacgcgactccaggatatcaacggagaaattccctccccttccatgatggtgatgcgcagtgactgttcgataaggacggatcagctttcagcaactctcggattggtcgggagatttccttcattggctttgctgtatatccaatgccgtacgatccggacgctaagtctcttctagatgctctgatgcttccctacacattaagggagcatcctcattcggtttttgtggatgtggccggttgcgctacagccatggtcaccataagcgatggaggctcgtaaaatcctatgatacttgcaagttatgaaaaatcgggacaaatccggtttgattcaatctggtgcgccgtcaggggaaattcgaaccctgccttgaggggattaatacgagcccctgctcgccctgagctacacggcgcgactgtgtatgaagaaaaacacgcgcagtttgaatgtggtgcgccgtgtcaggggattgcgaacctggaccttgggattaagagtccgcttctgggccagctgagctcaacggcgccttaggatcaaagaaatggggtgggtgcaagggtcgcgaaccccacccaccgggagccccacggtccggcgctctacaacaatgaggctaacgcccacccattctgccttttcaggcagcgcgttttatctattactaacggattatcctttatacaagaggtaatctcattttttttcgaaggagccctacatcccaccactgtttaaaaaagcgggcggaccaggtgtggtccatacaagaaatcttcaaaacagataccattcaatgactttttatggcgaatcccgcagatagtatcaacgactgggatggtagaccctcccagggacactcctttcaggcgcttgcgcggtctttggttgagtgaacgcttataccctctgcacttctcggtgacatcgtctaggctcttgcctcgaaaaccatcccctgagaaggcgttggtgtttcgtggttccccctcttccccccccccccaaagatggtgggaggcaaagtaattacgggagtcccccacgtctcctgcagccttctgcatctacaactccttgccctgtcgagcgttgacggtcagcacggccctgccggcaagcgccttctttgtgcttcgttacccgcggtccgtggtcttccctagcgccttgccgctgcacgatatccgctcaggtgatccacctgggtgataaggcaaggtacctcccttgacccaggtcccacctatcgccctcccagtcgctcgagccgtctcctgccgaaagcctctctgacgcttcgagatgtcgtgggtgacgcatgcttgcctgtgcgctttttgccactggctgcccttgctgtgcctgcgccctgaaagctcgcagtcgagcgatcacgaccatacagcacactagatgctaggatgctagcgtcgcttgcggcaaggtccgagcgctgcatcgcgatgcgccccgctatctcctacggggaccagtgctcgccagcatgagcctcacggaccagcgagcacctatgcggatcgtccatgagcctggggcctgcagcgcagccgccttacatccgcacgcctctgcgcgctcgatgcgcggtaggcccctgccatccgttgcgcctgatctcgcgagatatggtcgacttgtcccgtccgagctccctcgtatctggctgatgccctcatggcccttccagcaaaccatgatgtcctcgcgcttctcgatgctaagatggctgtagccgtccatggtgcctccaatggatgcatgtctttgcaagcatcatcataggtcgctcctgggcggctagctcgtattcccctgttgcacttgctctgaggattcgccattgaaaaacaaggcaaacgcgattggacggcgtttcatcccgcgaactaaagttcacagttcacgccaccgattcctataaatcaactgtaccggaataaatcaactgtaccggagtgtttaaatcggtagctattctcaagggattagtagcgatgtctacgagctgctcggttgccgccttgcggggctccacccatgccgcccatctgcgcctgtctcatcattgcctgcaattggcgcacctgggctttggagttgttccgattcttgcctttgccatggcgcttgccgccacctcccacgttctgggacatctggcgcatcttgcccatcatcttgttcatctcactccactgtttcaggagctgattgacttcctggaccgtatgaccggagcctgccgcaatgcgcttcctcctctgcccgttgatgagcttaggccgagcgcgctcctcttttgtcatcgagtaaatcattgactcaactttcttgagtcccttctcatcctcgatgttgcccacctgcttgagcatcttatcgccgcccggcagtgaactgattatcttcttgacgccgcccatcttcctgatctgctgcatctcggtgagcatgtcgtccatcgtgaagccctcacgtaacatgcgctgcgcgtcttccagggactgctcgtcagcagtcttctcagcctgctcgataataccgatcacatcgcccataccgaggatacgcttagccatacggtccggatggaagacctcaagcgaatcaggcttctcgcccatcgagacgaacttaatcggcttgccggtgaccgcacgtacggacagtgcgccgccgccacgggcatcgccgtcaagcttggacatgatgacgccgtcgaagttgacgcgctctgagaaggtctgtacaacgttcacgatgtcctggccggtcatcgcatcgacgaccatcaagatctgatccggcctgaccgcgtcgcggatgttgacggcctcctgcatcatctcctcgtcgatctgcagacgtcctgcggtatcgacgattacgatatcgttcatacagtcgaccgcatactggatcgactccttggcgactttcacggcgtccttaccgtcaccgcgatagaccggcacgccgatctccttgcccagcgtctccaactggtcagctgccgccggtctgtgggtatcgcaggccgcaagcagtggcttatgctcctggccctttaagagataagccagttttgaggcggcggtcgtcttaccggagccctgaaggcccacgagcatgatcacattcggggtcctgttgggcgccagggtgagcttagactcggtggtacctaagagctcggtcagttgatccagaacgattctcacgacgttctgagagggtgtgagggagtccaagacctcagaggtcaggcacttctccttgcatttcgccacaaagtccttcacgaccttgtagttgacatccgcctcaagcagcgccatgcggatctcacgcatcgcgacgttgatgtcatcttcggtgagcctgcccttgccacgcaagttgtcaatcgtgttttgcaggcggtctgagagagagtcaaacatttacactttcccttcgttttctcctacgagcgcacggcagaaatcgagtgcatcgaacggttggaagtcgtcgataccctcacctacgccgatacggtaaatcggaagtttcagttcatgggcgatagcgacagcgatgccacctttagccgtgccgtccagcttcgttacgatcagcccgtcgacatcgagggcatcgttaaactccttcgcctgaagcaggccgttctgtccggttgtcgcatcgatcacgagcacgactgacaccggcgctgagctccgttttctggtgacgcgcgcgatcttctgcagctcacgcatgagctccgggctcgtgtgcagacgcccggcggtatcgatcagcgtgaggtcggtgccctctttcttcgcacggtcacagacgtcgtaacacaccgcggccgggtccgccccgcgctcacgggtcacgatcggcacatccgcacgtctgccccacacatcgagctgctcgatagcggcagctctgaaggtatccgcaccaccgatcaaaaccgacttaccctcctgcttggcggcagccgcaagtttgcccaccgtggtggtcttgcccgcgccgttgatacccacaaagaggacgaccgacgggctctcctcaaaggggtcgtactcgacctgcgggaatacctcagctaagcgctttgcgagcgcctccctcagctgtggggcagtcttcaggttctctttggcggcctgctcatgcaggtcatcgctcacctgcatcgagacttcggcacccatgtcccccatcacgagggtatcctcaaggtcctcccagaagctctcatcgacttcgccacccatgtagaagagctcgtttaatgcctcacgcgagcgtgaaaggccggatttgaggcgaccaaagaaatttttcttcttttttgccatctcaggcttcaaccacctttccatctcttctgtccaggcgctgcgaaaccacgtggctgacgccgtcagcctgcatagacaccccgtagaggacatccgcctgttccatcgtccggcgttggtgagagatcacgatcaactgtgtattctctttcagcatatctattgccatcaacaacttacccaaatttgattcatcaagtgcagcttccacctcatcaaacagatagaacggaaccgtgcgcgtcttgtacactgcgaagagcagggcgagcgccgtcagtgacttctcaccgccggacatcagcgtcatcttcgtgatcttcttgcccaccggctgtgcgacgacttcgataccggtctccgcaagatgatctggatcgctcatctcgaggtaggcgtgcccgcccgggaagagcatcccgaagatctgctggaagttcgcgttgacctgctcaaagatcgtgaggaaccggttcttcatcttccgctcgatcgccgcagtgatcttcttcagcgcttcacgcgctttctggagatcctgcacctgatcgtggatgtagtccgcgcgctccttgagctttgagtactcatccattgcgacttcgttcaccggcccaatctcggcaagctgctgtttgatgtctcgggccctgacttccatctcaggacggttctcaggctccgggagctttaaggcttcctcgagtacagcaccggtgtcggtgattgcggccaccgcgttgctcacctgcacttcaagcttaccctgttcgacttccagttcctgtgcggtcttcctctctttctccagcgtatcagtcgcgtcactcactgcctgcttcacatcggcgatcgtcttctttaaggacgcggtatctgcctctgcgaggcttgcacggtcacgcagcttcttggcccactcttctgcagagtcgataaaagcctgcgcctggtgcttcaggggttcaaaccgtttgaggcacccctgcgattctttaagtgagtgttcagccctctcgatattctttttcaagttgatgcggcgcgaggtctgttcctgtacctggatgtgcacgtgcttcaggtgttcggtcactgtagcaagctgcagtttggcatctgccagattgcgctgcacctgattctcctcgtgtgaggcatctccaccctgctgtatggcttcatttaagtcctgggtaagcttctcaacctgcttctccgcctcatcagctctccgcttgtgcgcagagacttcgctcacatcttttgcatgggcttcctcggactccttacgctgcttctcgactgtcacctgctcagcgttgagccttctctgctgtgcctcgagtcgggcgatctctgagccgacagagttgatctctgcctgcagggaggcaagctgtccctttgccttggtctgtgcctcacgggcatgtacgagttcacggtcccgcttggagagcgcctcattcgcgttgtggaaggcatcttcgaagtcgtccatgcttgcctcaagcgcgtggatacggcgcttgcgctccagaagccctcgttcacaggcggaggtagccccgacgatcaggcggccatcacccatcagtactgccccgtcacgggtcgcataggtcgccgcaggcacactttggtgcgccgtgagggcctcttcgacgctgtcgacgatccgcacatcccccaagagtgcctgtaagagctgctcgcttccctttaccgcatgtattgagtcgagcagtgcctcgccgggagcattatcaaactctaaaggctgcgccttcagatcctccgagaggatcgtagcctgccctttggtgtcgccgagtgagagagcggtctttgcgatgtctttagctttatccgtatccgtgaccacaagcgcccgcatatcgtcaccgagaagccgttcaacgagcgagtcaagttcctgtggaacctccagaacatctgcgaggtgacactgaaccgcacttcggacatcctcgtttttggcaagtgaagcacttaagaggttcgcatcctgttgtgaggaatcgaccgaacgcaaagcacgcagggtagcctgtgcctggttgagcttcttctggacatcgtctcgatcggcatgcgcctgcttagaggcagcctcagcatctttgattttctgaacagcctcgtcgctttcctgctgcgctttagcctgcgcctcgttgagcccctcctgccgtcccttacgctcggtcagcacttcctgagcagtacctaaggtctccttgatgcctttaaggcggccctcgaacatctttgcttcgatatgcgcgttcttgaggcgctcctcgagctgtgcgtaagccaacgattcctgatcacggatcttctggacggcgcggacctcattgttcagttttgagatttgctgtgagagctctcggcgcttctgggcagcctggttggctctcggactcagttcatcgatctgcttagtgagggcggccttcttctcttcgaccgtctcctgctcctgctgggcctctcgcaaggctttatcagtctgagcatactgctcacgcatcgcgtcatggaagcgcgtcagttcctcgacgcgggattgggtgtgggcctctttttcattgataagcctgaggtctgcactcatgcgggactggatctcacgcatgcgggagcgctgctcccccagatcccccaccaagagccccttctgccccaggaggctctggagcttctccagctcttgcctcttctggtcgagcttataggaggcaacatcgatcgcggcagaagctccctgtttgcgtttgtccagccgctcggagcgcagctgcaactggcgcagatcgtccgtggctaagattgtggtgatctctttcagctctgcattgagcgcatggctcttctgcgccttaccgacctggcgctccaaagggcgcagctggcggttgatctcccgctgtacatccttagcgcgcgtgagactttggtccatcgatttgatcttgcgctcggagcgctctttacgcttccggtgcttggagatccctgccgcttcctcaatgagctcacggcggtcttccggacggctcgcgagcactgagtcgagcttgccctggctgatgatggagtgggtatccttgcccaagccggaatcgtgcaggatgtcctggatgtccatcaagcgggcgggagacccgttgatcagatactctgactccccggaacggtacatgcggcgggtaatcccgacttcgtcgaagtcaatcggcaatgtgtggtcatggttatcgagcaccatcgtaacctcagccagtcccaccgcgggacgcaccgaggacccggagaagatcacatcctgcatcgcctgtccgcgcagcatcttggcagactgctcgcctaagacccaaaggattgcgtcagagatgtttgacttgccggagccgttcagcccgaccaccacattgaggccaggatcgaacgtcatctgcgtcttatccgcaaacgatttgaatcctttgagtgtcaatgacttgagatacacgcgcgaaacctttcggtcacacaaaaagatggaactagtgttctgatttaagatattcgagggcattttttgccgcggcggtctcggcttccttctttgaggagccgaccccgcgcccgattctgcgtccctgcaactccactacgctcgtgaaggtgggatggtgggcaggcccttcctcgtcggtcaacttatagactggggcgcagcgcagatcgtgctgtgccacttcctgaaggcggctcttcggtgagatcggacgctctgcgcgctccgccaccatgtacggggtcagggtcttcttgatgaacgtgtgggtaacctccgcccctgcatccagatagagggcacctacgatcgactcgtagacgttctccaaagcagagtgcaatccacgagaaccggtccccttctcggattccccgaagatgatcatgtcgccgataccgagcttgtctgagacctcagagagcgtctcccctgagacgagcgagatcttgagccgggtcagctgcccctcatccatctcagggaacttctcaaaaacgtcggtggcgaccatcgcccccaaaatcgagtcccccaaaaattccagccgctcgtaagagtagtagaccggcttgttctctaccgcggaggggtgggtcaaggctgaggtgatcagctgcctgttcttgaagtgatagccgagcatctcctccgcctttttgatctttgcttgtgtgtcgtttttcgacaacgttatccttcttttcgtaactctgccgtctccgtcccgattacgcatcgggacggagacggtataaaactctcaactctattgatcttgtgcttcatgcgcttggatggtcttgctgacctcgtcgaccaaatgggcccgcacgatctcagcgcagtgcagtgtgccagctgtgaccgcatccacactgcttgcaccatggcctttgaggacgggtgccttgaggcctatgaggatcgcccctccatacttgtcgccggagagctctgaagccaccttcttgagggcgggcttcaacatcagtgcgcccagggcaagccgcggtgagccttcgatggaatccttgagcgcccccacgatgaacttcgcggtgccctccacgctctttaaggccacattgccggtaaagccgtcagtaactacaacgtcaaaggaacctgacaggaggtcggtgccctccgcgttccccttaaagttacagtcagcctctgccagtgccttgtgatactcaagcgccagctgggagcccttcgtgccctcagaaccattgctcaaaagccctaccgtggggttctgcgtaccggtaacgatgcgcgagtaagctcgccccatctgcgcgaactgcacgagcatatcgggcctgacatccgcattggcgcccatatccaaaaagatcgtccgcttgccgttcggtccggggatcggcagcgcgattgcgggtcgcttgattcctctgatgcggccgataatgaacgtggaggcggtaagcactgcgccggtcgagccggcagagaaaagcccctccgctttgccttcgcgcaccgcgcgggccgcgcggacgatcgaagcgtccttcttcttgcgtaccgcagtagctgggtgctcatccatatggatgacttcggaggaaatcagcggcatagccccctcgtgccgctcacagaagggtgtgacatactcgcttgaccctgccacgaggaccgagagattcgaatcttcttcgagggcctgcgcgatgccctgcagcactacttcaggaccaccgtcagaactcattgcatcgacgcaaatggtagtcatagttcttctcctccttatacatgaagggaggccgacccagaaggccggcctcccaggccacatctattcaaacgcctgactactcagtgacaatgacctcacggtccttgtagtagccacagttagggcatacatgatgtggaagcttaggcgcgccacaacgcggacatacggagcgtgccggtgcagcgagcttgctattagccgaacgacgtgtatgcgtagcaccgcggccttttttctgcttaggtactgccatcttgacctctcttacctgcttttagtcccacgaacttgccagtgggacggatttacctcgaatcacacagatagaaattataccacgctcacaaccagtgttggactgaagatcagtatttctccatctatgcacgcatcactgcttgttgccgtccaaatgaaggttcttgagcaccgcgaagggcgaatcctcaagacgaccttccgcgtacttggtggcgcagccgcagtccccctcgttgaggttgtgaccgcagtaggggcacaaccctttgcagtcgggcttgcagagcacgacaaaaggggtgtctattacgagcgccgcgctcagtgcgtcggtcagatcgatcgtcttgtcgtccgacacgagtgcgtagtcgacgtcttcctcgtcgccctcgtcctcttcttgagggtcctcttggggcgcctcaaagagaaagtactcgttgacctcgcttgcgatctcaaaggtcgccttatcgaggcagcggtcgcacagcccttcgacatgggcgcgcagcaacccggtcaccaggataccttccccggcattcgtgaggatcaggtcgtaatccataccgttgggaagggtgaagtcccggccacccactgagtagcccccaagtgcgatgtgccccttgagcggcagcgagtcacccgggtttgccaggcgctcatcgagttcgacaactaactgaaaatctgtggtcatagcatctaccaggagccgttgttggctgaatcatcgccgtgcgaagagacattctcattgagcgtctgtcgcgtacgggtaacggtttgagtcagagactttaagttgtcttctaaatgctgcagcacggtatcggcatactcctcagcgttgtagcgggtatcctgctgatactgatcggctttctggcggatactatcagcctgctgctgtgcaagcctgacgatctcctgatcccctgccaggatcgccgcctgctgtcgggcatccgcgatgatcgcatctgcctgattttgggcgttcctcagggtctggtcccgctctttcacgatgcggcgggcatcggaaaactcctgcggaaagatacgccggatatcgtcgataatcgcatagatctcttccggatctatcactttattgccacttccaaaggaagacttagcctcggtgacggtctgctcaagttcatcgagcagatccatgatttcagcacctggctccattcaaagctcctttcgtggtaagcaaaagggcaccatgccccatcatgttcacaatctctatcatactagcaaaccatgcctgctctccatggtttgttcatgaacgtttaccgccgaagtgcacctccagagcagccgccacattggatggtaccagctgacgcacatctgcgccgaacgaggcgatctcgcgcacgattgaagaggaaaggtagctgtattcgggtgtggacatgatgtagatggactcgatgtccggggccagcttcgagttcaggctggcctgctgcagctcgtattcaaagtctgtcatcgcccgcaggcccttaacgacgccttccgcaccgacctggtgacagaaatcgaccagaagcccggtcagcggcaggacatccacatccttggtgcgctcatcagaggccagcgcatcttgtgcgagcttgacgcgctcctcgagcgtaaacattgtgcccactccgcgcttgttacatgaggcggccacgcccaccgtgacgcgcgggcagatacgcaccgcgtggcggatcacatcgatgtgcccgtaggtgatcgggtcaaaggtccccggcaccacgaggtgtgtgatcgaattcatgtcttcttgcatctacgactcctcaagacgccacagctcaaccacggtcgagccgtatcgtttggatttctcgcattgagcgttttcaagcggtaagggcgcgccttttcccgcccgctcgtacactacaacgcagcgcggtgtaagtacatagttttttcgagctgcatctacaatctgggcaacctgggcagcttccattctgtagggcggatccagaaagaccgcgtcaaagggtgccccagcagggctttcagtacccatcagccgcaccgtcgaacctgcaagcaccgtatagctttccttgtctgcccggaccttattcaggttgcgcctgacacgcctaaccgcttcgcggtcctgatcgataaaggtcacgtgcctagctccccggctcaaaagctctatcccaaccgcaccggagcccgcaaaggcatccagcactgagcaggaggaaagatccaagttgaaggccgagctcaccattgagacgatcgactcacgcacccgaccggtcgtcgggcgtgtcaccgccctgccctccggagcttcaagcggctgtccccgccatttcccgccgatcactctcacacatgctcaacctccttgaagtaggccccaaagcgtgagcgcatctcaaagcccagaagcgcatgcagaggctcactcaacgcctggtcgtgtgccgcgatctcgcgggcatccacgtaggcgtacttgatcagatcctcgtcgttttccagatccgccaccttcagggtgaccccgccagactgccgataacccaggagatctccctcatgcctgagtttcaggtccatgttcgccaactcataaccgtcggaagttttctctaagacgctcaagcgcttgcgtgccagagttcccttcttagcagccgcttccaagtagacctttcctgtgactgagcctcggccgacccgaccccgcagctggtgcagggttgccagaccgaagcgatctgcatcgagcacgagcatcactgtggcattggggacatcgacgccgacttcgatcaccgtggtggagacgatcacgtccaactgcctggtgcggaattgctccatcacctcatccttttgctgcgcgctcatgcggccatagaggaggccgatgcgcatgttcgggaagacctcggtcttcagacgctgataggtcgggatcgcagcgtggggcttcgtgacttttgacttcacattctccggcacctcgtcgagggcatccccttcgtcgctctcatcaaccagcgggcacactacgtaggcctgttgtcctttggccaccgcggcgcggatcgccccaaaggcgatatcggcattctcgggggtgatcactttcgtcttgatacctgcgcctctgaccgggcgcttggtgatgcgggagacggagagatcaccgtacaccgacaacgctaaggttctcggtatcggcgttgcactcatggtcagcatatccacgcccacgccttttgaacgcagcagaacgcgctgtcccacgccgaagcggtgctgttcgtcgactatctcaagtgtcagatggtcaaactcaagattctccgagaggatcgcagccgtaccgaagacgacggtgattgccccctccgcgataccctgtgtgctctccgcgcgctctgcctgcggggtcgctcccgtgatcagcacccagggaatcttcgctttgtccagaacagggccgagcttctccgcatactggtgggccaataccgacgtcggtgccatgaccgccgcctgggtaccgctgtccgccactgcgccgagtgcgagtgcggctaccgcagtcttgccggtgccgacatcacccagcaaaagccggttcatcaccgtagaagaagccatatcagtgaggatttccttaccggcctcctcctgctcatcggtgagcttgaagggcaaggctttccgtaaggctttaagtttgagtccgtcgattacatgctgcgtcggcctgatgcccttaagctccagcgagcgccgcgtgagcagcgtcagctgccacagcagcagctcgtcgtaggctagacggcgccgtgcttgctgcgcactgtagaggctctcagggaaatggacttcgcgcagggccctgccttcgctcatcagtttgtgttttgcgacataggaggcaggcataaagtcgacgacgtctccgtagtccatgatcgctgagctgatgatgcggcgcatccaggcgactgtgatcccctcgccgaccgggtagatcggcaggatctttgtcggctgggcagctacctcctcggcaccgaggttctcaaagaaggggctattcatctgtttgaagccatagttgaaggtgactttcccctgcaggagaagggtgtcgcctttcttcaattggtctttgatccagggttgtccgaaaaaggagacccgcatcacgccggtctcgtcaaccacgtagacctcgacaatcgtgaggcggggacgcggttgcttgaagttgatcctgtccacagtcgctctgaccgtagcgaggttcccgatctccgtctgctcgatcggagttaaggtcgtaagatcgagatagcgggacggcagatggagcaggatatcgcgcaccgtatggatgcccaggtgttccagggcatcccggcgtgtacctttggcataccggagccgacctataccatcgtcttgtgccagactgcgcagaatgcggtcggatgcgtagggtataccaatgcgactcgtcacactatcactgattcaaatgaagttttattcgatcgagaagatcaccggatagagcggttgctctccacggtgagcgtcaagctccagatccggctgagcctcagcgattgcgtcctgcagtttctggaaggtctcgtcgtcctcatccttgcccgcaaggatcgtgagggtgtcaccctcttcttcgtcctgcatgcggttgataaggtcaacggtgacctgctgcacggacttgccgaccacgacaatgtcaccgttctcgatgcctatcatgtcgtccttgtggatcggggcgccgtccttcgtggaggaatctcggatcgcagtagtgacctcgccgtcacggatatcgtcgagggcggcggtcatcgcccgcacgttgtcctctacagaggcctcagaatcgactacgaacatcgcagagaaggcctgcagtacagtcttggttggcacgacgtagacctttgcggtatcacaagcggaggcggcagcctctgcagccatgcgtatgttaccgttgtttggtagcacgacgacgttacgtgcgttgactttctcgatggcagccaagatatctgcggtagaggggttcatcgtctgcccaccggagacgactacgtcaacgccaagggacttcaagatgtcttcctcaccggaacctgcagcgacggccacaaagccgagctccctcttctcttctggagctttcccggcctgactctgtttgtctgcaacgatcttctgggtccgctcctgggcctcaatatccatgttgtggacaaagacgttgtagatctggccttcctcaagcatgtgcttgaatacctggtcaggatggtttgagtggacgtggatcttatagtcaggattagagccgaccagaagctcacagtctcccatggaggccaagaacttcagatttgcttcctcgtcgaagtcagggctgtcagccttgaacaggaactcaatgcagtagcggtactgggagcctgcccagtcatcgttcaccacgaagtccatctcgtcagcgacgcgggcctttgcctgatcagtggcgctggcctcttccttcttgccagtgccgacttcaccgttaaaatcacgaaccttaccgccttcacccttaagggcgttcacaaagccctcaataaaagttgccaggccaaaggcaccagagtcgacaacgccgttctctttcagaaccggcagaagctccggggtacgcgcaacggactcataggcttcggtcacgattgcgtcaagggtgtctcccacgcttgcacgtctcaactcacactgatctgcctttgcggagacatctttaagcaccgtcagaattgtgccttcaaccggctttctgaccgctttgaaggcaaccttgacgccgcgacgcagtgcgcgtgcgatatccgcagtcgtggcattctcaccctttgcatcgcacagcccctccgcgacaccatgtaggatctgtgaggtgataacgccggagttgccgcgtgcccccatcagcgagccatgcgtgatcgctttagtgatatcccgcatggaagcgtcagcgggcagcgcctcaacttcttttacgacggtgttgagcgtcagcgacatattcgttccggtgtccccatcgggtaccggaaagacattaagcttgttgatctcctctgccttggcggctaacgcctgggcggcgacagggaagcatgtgcgtacagcggtggaaatcatggttgaatcccttatattccttctcgatcagatttgtatgacagacaaagacctcgtggatgctagtgtatgcgcataccgtcaatatgtacgtgcacatccacatcgtccaattcggcgatcttcttcagcaggaacttgaccgagctgatcagattctgggagacagagcccatattcacaccctgttcgacgattacgtgcagatcgattacgacacggccgtctttcgctgagacgccgatgccttttctcagcctgtcaatcgagagaagctgaatggcaccattctctttactcgtctgcgccatccctacaacgccgtaacactccaacgcagcatagccagcgaggtcggctatacagtcgttcgaaacccttaagcctcctggtacagactttgccatcttcactcccctcacgcattcgacagggaatgcgtaatccgtaacatatctttgtaagtatataacttttgcctgaatttcttaaagacctatcggtgcttcacacttgaaacgggagaaccggacacctcaggctctgagcgtataggatctccatcatttcggtgctcttgcgcaagacgataagcacagcgtctatcgtgggagcgctcaagccggatggttccgcaaaagacaaatccattacggaaaagaagcatgcgcatgcttcttataggtaccaatcaggtatcaatccgcacgcctcggccctcagtctgtgcacgcctgcagacccattggagcataaacgatccgacaccgcgtcgcggggtgagcactgcggactgatggatcacgcagtaggggccggaatccttctactctccctgatagatcgtggtatagctctggtccggaccttgggtcaataccatactgctctgagtcttcacacacatagagcacccctgcctctatgtcatgctcaatctgtactcggtcagtatacccatccttccactgatcaggatttcccatctcacacataatctcacacatacataatctcacacatatagtgacgcgcatgagcatagatgtggtctatctgatccgcatcaacacttgtcgcttatcttatattcagcacaattgtgtgtcccaactatcgaaataggtgccatgtgcagcgcccaaacacagctttcagtttatgagatgtctgaaaacgtgcgcgtgcctttagaaaaatcagataaattcgctataatagcttagcgtgtaagagagtcgccctatggctgccctgctccgcaaaatgagggttctcttcatagatacaccaagaattcgtctgtatgtgggtatttttgtatacctatgctatagttgtacagctatacgaactcaagtgagatacccactcatgggaggtttctagaatgtctaaagtctgtgagatctgtggtaaacatgctgtggccggccgttctgtcagccactcacaccgtaccgtcaaccgcaagtttaagcccaatattcagcgtgtcaccgttgtggtagacggcaagaagcgtaagatgaacgtttgttcaacctgcctgaagtccggcaaggttgcccgttcgtaactacgcacttttactgaatcatcggaaggtcaccacccccaagaggtggtgaccttctcactatctaaagcaattgtgttgtggtggcactcactgctgcttcatagcctctgccttctgcctgagcaggattgctgcgacaagtccctgttcacagacaatggaagcatccttgtcctgtacctgattggatactccccgatcatcgagtaccccaaactcggaatgtgtggggcaccacagcatcccctgttcggttaaaatggtctttgtgtcaagcgagatcgccgagagaacatggcccgatgcatctaaaggcaatacccaacgctctccagggcgcagaagcctgcagaggaaatcgtcttcctgcagatgcagcgtgcactgttgctctgtagtcgttcgagccagctgtgccagaaccccaaagaccccgagcatgtggtctacccggccgccgctcgcacaggtaacggtgaagttggcccgccggttttgctcagcggcatgcttcatacccattttgagcgctaaacccaggtcggtgtcgtccttgtaccacgaaaccttttctacagccacattgttttcatccaaccagacaagcgtctccgcattgagtgagtcctcgtccccacacagcaaatccggtactcgatcgagcttgaagagcatattcgcccctgagtctgccgcaatcagataatcagcggtgttgcagagcttctcgacgaaccgggggctgctcggttccggtgatccggcgacgattacaacacgcatgaatacacttccttctatagcaactaaaggatcattgtcgactgtactatcaacttgaacacctaa

SEQ ID NO: 330 - DNA, 7125 bp, Unknown
  Metagenome-assembled genome
ctaccatatatggttgaagaaaacgatatctggcagaagagccgatggatgccgcagatcctgatgctagcgacagtatgcgggtgaagcgagaaaagcttgcctttgcgagcttaaagcctatgtatatgggttagaccttggggtgcagtgctggaagagacgatgaaggttttaaacgccgaaagtagcaaagagctcaccggtcaggagaaacacaagctctccgatgcttcctcaacttgattttttgtaccagagcccctgcgggagtccaatatctcctccttacgctattgctgtgctacatcccacagcaacacccccgataagtacaaggaggccaaagctgccatacatgaaaagattgaggagtgcaatggatcttcaaggtcgctgctacatcaaacagaagccagaagagcgcaagtatcctctcaaagtctctggtaaaaaggtagcagggctccatgcggaaaagaggggacttatgtgggtctttgccaaatgctaatccgtccttgcgcaccgcgcaacagcgccgcagaggatatcttcggtaggctcaagcatgaatcctttttactactgggattggagccacaccatacgcagcgaatttatggatcagtctaacggctacatcatgtagtattacaacgaacgaccaaaggaatcattcggctggatgagtcctttggaataccgcctgtcactgggtctagcgacctaggttctccaactttttgggtccgcccccgatgcagggagttttgtgaggaggataccagtgaagccgatcgtttgcatcaccccttcgatcttcgaggggccggataaagaacacaagctcatcaatatgaagtatacgagcatgatgaaagcagtggggatgcttcctatcctgtgtgattacgacgacgaccccagtgacgtgagtgagcttctggatcgggttcagggccttatcctgaccggcggtttcgatatggaccctggcctctatgggcagagaccccttccgaacgcggatgctcctcacccggagcgtgacaacgcggagtttgagctgctgcgggaagcgctcgaccgcgatatgccggtcctcggtatttgtcgcggtgtccaggtgctcaatgtcctgctcggggggtccctctggcaggatgtgaatgagcagggggccactgacttcaagcactccatctacgatgagcctgaaaaagacgttcaccaggtgacgcttctggcggataccccgattgcaaaggcggtagggaagcggcgtcttttagttaactcctgccaccatcaggcaatccgggagctgagtccggtactcacatcggcagggtattcccacgatgggctgatcgaggccgtctatatgccggggaggacgtgcgtgtggggtgtgcagtggcatccggagtcgctctacctcaaccatcctgaggaatttggactggcgaaagggtttgcgcagaactgccgtgcctatgcgagccacccgcaccggctcttcagcgtggcctaaatctgattttctaagtctttctccctatgggtgcacaaacgataagttttgcgctaacctcaaccttgacaatttttctgtttccaaatgataaacagcgaggatagtccgtctttgctgcagggaggttctcttgaagcgtacgaggatctatgagctctataaggataaagaggcgttctccgagaagaatgtcacctgtgcgggatgggtccgctccatccgcgatatgaagaactttggatttatcgtcctgaacgacggatcctgctttaaggatctgcaggtggtcctcaataaggagatgctgggggaggagacctacgagtcgatcgtctcccagaacgtcggtgcagccctcattgtcacgggcactatcgcgcttaccccgaggcgcccgcagccctttgagatgcaggccactaaggtcgtcatcgagggcgcttctgccccggactatccgatgcagaagaagcatgcgacccgtgagtttctgcgtacccagcagcatctgcggagccggaccaacctgttccgtgcagtcttccgtatccgctccatcgctgcctacgcgatccacatgttcttccaggagcgtaacttcgtctacgtgaacaccccgatcatcaccgcctccgatgcggagggtgcaggcgagatgttccatgtgacgacgtttgacatggcgaacgtgccgaagctcaaagacggctccgtggactggtccaaggatttcttcggcaagccgacgaatctgaccgtctcagggcagctgcaggcagagaacttcgcgatgagccttggggacgtttacacttttggccctactttcagggctgaggattccaacactcgccggcatgctgcagagttctggatggtggagccggagatggcgttctgcgacctcgaaggggatatggatgtcgctgaggcgatgctcaagttcatgatccaggccgtccttgaccggtgccctgatgagctcaacatgctcaaccgctttgtggataaaggcctgctgaaccgcctgcgccatgtggccacctcgaagtttgcccgcaccacctacactgaggccatccagatcctgcagaaagcacaggagaacggttatcacttcgagttcccggtcaagtggggcatcgacctacagaccgagcacgaacgctacctatgcgagaagcactttaagcgcccaacctttgtgacggactacccaaaggagatcaaggccttctacatgcgcgccaatgaggacggcaagaccgttgcggcagtcgactgcctcgtgccgggcatcggcgagatcatcggcggttcccagcgcgaggaacgctacgacaggctcaagcagcgcatcgaggagctcgggatggatgagaatcagtacaagtactacctcgatctgcgcaagtatggcacgtgccaccacgcaggcttcggcctcggcttcgagcgtctggtcatgtatctgactggcgtcgataatatccgtgacgtgatcccgcatccgcgctttgtcggcaactgcgacttctaattgcttgagaacacagctatacaaagcgggaggtccaggcgtttgtctgatcctcccgctgcgtacgtataggggagactatgtgcaagggcctattcatattggattttgatgatggacaaggaatcattgatcccgcttgggaccagcctgaagaccatgttcctgaacggttactctatgcattcgtgccggaagaggatatagagcattttgtaggtggcatccctcatcgtgtgctcggacgattcgataccgttgcatttaagcccctcgtatatgaagtcgacatagatggattcaagctcaccctatgtcaggcgccgctcggtgctccagcagcaacccagctcttggattggctcattgcccatggagcacacaacattctggcgatcggcaccgccggggttatccgggacctcccggaaaataagctgttgctgccggtcaaggcgctccgggatgaaggcacatcgtttcactatgccccggcaaatcaattcatacgccttgattcgaagtatcttgatcatatcaaaggggctctagcttctttaggaatcaatttccaggaggtgaccacctggacaaccgatggcttctttcgggaaacgcctcagaaaatagtggcggcaaagcgtctgggcgcgagcactgttgaaatggaatgcgcggctctggctgcctgcgccaagtatcggcacgtgaattttgcccaattgctcttcagtgcggattctttggctgcggtgcaagcgcatgatacccgaacatgggggagagattcgcacagtttatcgttgcgcataggatgtgcggttctaacggctatgccggaaatgtcgtaaccatagcatggtattcaacgctcggcgcctcccgtgctgagcgtagcgggagggagtcagttaatagagcggcaggtcgccggtcaaaggatcaatctgctcggggcttagcggttcaaaggcgagacaggtataggttgactccccgtggaactcggtgatgcctgcatcccggatgagggcgacgatgaagccccggtctcgtcccagctgtgctaagtcgagcagctcctgctcagagtccacgtagacgcagacctttgcgacgcccgcatcaaaccagtcagagagcggcgtcggatcctcactctcgtcgtcgaggtagatccagctggggtcgccgaccatatcggtctcgactctgacctcacccaggcggtgctcccgggcaagggccataagtgttgcctccacgcaggcgtggcccgcctgggccgcgatcttgcctttgcgcatcctgaggtcacggcgcatcacgatcatctgttttgctttgtagctagacatgggacttaaaactcctttgttaggcagcgacagaggcgtaggcgtggtcgacggtgatcttgcagactgcgtccggcttgtgttccacgatcttcttcgagatgaggaccttcagttcctcatcgctcatattcacatcgtacggttttacgatatcgaatataacattcgtgtgggtggggccaggtacggttctgaggtcatgcatcgagaggcgtggattgatcgtcttgagcgtatcgttgatccaggcgcgcagctcgttgactgcagggtcgttgattacgatcgggtccaaatgcagtgtcatcacaaacccctcgtgctcccgaaagtactgttcgatgttatcgagcgtatcgtggccttccataatattgatggtggaaggcatctcgacgtgggcgcttccaaactgacgacccgggccgtagtcatggatcatcagatcgtgcattccgatcacattggggtagctcgtgatgaccttcctgatgtggtcgacctcctcctgtgagggtgcgcggcccagaagcggacttacggtgtccctaaccaggctgatgcccgagtagaggacaaagatcccgaccgcaagaccgcagatcccatcgaggtctatatggtagaagtatgagatcactgcagagagcaggactgctgcggtggtgatcacatcgttgcgggagtcgacgccggttgctttaagcggctcactgttcagtttggtgccgatacgtttatagaagtactgcatccagaatttgactgcaatcgaggcgagcagcatgaagaccaagaccagattgaagtcggtctcctccggattcaaaatgcggcgcccggagctgatgatcagttcgatgccggcagccgcgacgatcacggcgacgacaagccctgccagatactcaaagcgcccgtgtccgaaggggtggccggtatccgcaggccgatccgcgagtttgaagccgatcagcgagatgatggagcttgtcgcatcggagaggttgttgattgcgtcagcgatgattgagacgtagccgctcgcgagcccgacgatgcctttgccgagtgctaacgcaacgttgcagatgattccgacgatgcttgcatagttgccgtagtgggtgcgctgctgcggcgttggatcctgaggaatctcccgtatgacctgagagggaagaacagaaggcacaggtggcctcctttcgttacatgaaaaccgcgccgttggttctgcaacagcgcggtggcgttcagtgtacatagcttgtttagtttgtacctgtttttgagatatgcaaacactcactggtgaacaagcgtgatttcttcacccggacggatcaggaggcagttgtcagccagatccttaaagcggtgcgccagcttgtcactgtagaggtgatccggatagaggtggatcggggtcacgttcttggctccgatcaggttcgcgcagcgtgccgcctcgtcgatatccatgttgaagatgccgtcaccgggcaggaaagcgtagtcgatgtgctctttgggcatctgagtcttcatctcaggcacataggaggtgtcgcctgcaaaccacagggtgatgccctcggtgcggatcagatagcctacacactgatcgatcggatggttcttgttgcaggcgaccgtagcgctgatctctaagggtccaaactgcttggtgagatagacgtccttggaaggatgggaatccatattctgccagagctggcaggtgtgtttgcgggcgggaagctcgacctggttgtggtcgtagtgctgatgcgttaccagaatgagatccgcaggctcgtcgtactgctctccggcataggggtcgatgtaggtgatgtagttgtttacggcgagacggaagctcgcgtgtccttgatagagaagttttaccatgactgtatgctcctttccggatcgtcaggctgatagacccttagctatgatcttagcgttcagtgcgcctcaatgctgagttatgagcgctgtttttcagggagctttttgctcctgggtaaaaaggctcttgggtctctcttcgcacttatggtggggtaacactcctgcatccccgtgacactggccacccggaacacaagacttttggcgacggatgcgatcctaggtgcgatatggagctacggcaggtatgctggcaaggctctctaagagtcctctaggcttggggcaatggacctctcgatgtctggggaaggagccgcagatgtcgcaggactgctcccgtgagggttggtacacttccagggccatgtagtggtgagccctggctggcacaggcgctgtagccacctgtggcagaacgcggagagacctaaagacatctcgaacatctggcaagccactagacgcattgtagcacggctcattattgaagggccccaaacggcgtgcctgccgcaaagatgcctgaaaggtccggccgagacgccacacgcgctctttgaggccagctaatcgttttgtcaggagcggtggccataagccctctgcacgagacagccgcacgtgcatatggaaactgcttgggcaggcgacatcgaaggcgaggaatcgcactattccgaggcgtgcgtgtgttcacaggccgacaccgcctaaaagaccaaccaaattcttatcagcatcatgccgacctctaccgc

SEQ ID NO: 331 - DNA, 26679 bp, Unknown
  Metagenome-assembled genome
cccttaagggatgagtctgcaggctacgcagttgtgccgctcagtagttcccttgttacaggaagtgtaggaggtggacacagcagatgagtatctctgagatgtcctttagctgtaagagtctacagactcaggagcccctgtcagctgtgatggttttgaaagatagcgtagcggtgcttgctgcagtggtcctgtagctttctgaaaagcctgcatggcgtttgggcagctgttgtatccaggacagggacggatgagacactcacggctcaaacacttatacaaggttaggtgtgccttatcgcctttggtcttgtgccttaagaccgaatcactccctgtgcctaacctcagacgtgcgcattgtgtctttgggggcgcttttcaagcttgtggcgagctcttctttgttctgacaaacaggcggggcttgggcctgcacttttaagcttttcaggcaggctatagttgtggatacccagcaagctttggtcagtgtaggtataaagcgtccttctacacaccacaatcgttacggacaaactcccctgctgcccctgagcggttgcagcacgcctcaggtgaccagccaccttcgaagaggtagccctctacacagtgtgtgagctaaggcctcttcagaagattctgttctgtgacaacagctcttgcgtctttccttacagatgccctgcccttgtttggttctgtagcgcactgccttagccgtggcagagctcgaccctgccacgtagctgataaagcatacaggccggctgagctctcaggcagatacttctcagcaaagccatccttctcaggcagctctgtagtgtgacccgcttttcaaatgtagagcttctgatgcgcctcaatggtagaatgagggcagtccatctgttaccttcactagattgttgtcgtgtggtgatccacatactatcggacaggttcagctggacttttccccttaggtgttcaagttgaaaagtatgtctgataccaatggatatggttctagctccacatgaggacttgtggggcctcactcttttgctcattgctaagcctgggattcctctaaggcaaagtactgggggaagactttgagaacctcctccttttcgtcgagcatcacatggagatggtgttcgatgatgtaagccgcattgagtggttggtgcgctcggagtgcttgatagtagtcctggtgctccttaaggatgctcgtccagccgacgcttctggctttcacatggagccaccggaaccggttgaggtcgacgcttgtgcgggtaagccagtcccattcggttaatctgccggctgccgcaaacaccgcttggtgcatcgcgttatctgcctcaaggaagttccgttgatcgtgtgcgataagcgactgctcctgtgcctggatagagcctgccatctcttccagttcagaatccgtgatctgtgcagcggcatctattgcgacggcgcgctcgaccgtgatacgcaggaagtgggcgcattcggcatttttaagattgatcagggagacatagcttccgctcttgggcttggtcgtgacgagcccgtcctgctgcaggcgcacgatcgcttcccggactggcgtgcggcctaaccccatctgcttgcggatctcctttgcggagaggcgctgcccgggcagataggtgaattctacgatcccgtcacgaagcgtttcataggcttgctcttgttgtttttctggttgctcggtctctgtagttgctgtcactgtgtctgtcgtacccatagcccaaatccgttcgcaaaatattttccatattgattctagcatacctgtactaagtaaaactagcatgctagtgttagagacaacggggaataccaaacgtgtggcttcacggacgctacggaaagtgagggagctatgctggacgagaataccgaggttctgacttttggtgagatcatgatgagactgtcaccgccgaacaatctgcgtctggagcaggcccagagtttcgacgtgtactatgggggagcagaagccaatgtcgccctctcactagcataccagggagacaatgcagcctatgtctcagtcgttccgtgcaaccgtatcggcgcgtgcgcactgagaagcctcactatgtatggggtcgacacctcccgcgttgtgcacgaaggggacaggctcggaacctattactttgaggtcggtgcctccgagcgtgcgagtagctgcgtctacgaccgtaagtactctgccttcaatctggcatcccacactgtctttaattgggacacaattctcgaaggcgtcggggctttctatgtgagcggtgtgacgccggcggtctccgatgagatgatcatcgcggtcaaagaggcattggaagcttgtcacaagaagggtatcaccacgatctgcgacctcaactaccgcaagctgtggtctcctgagaaggcgcagaagacgatgaaggaatatctgccgctgatcgatatctgcatcgcaaacgacgaggatgctcccgcctgcttggacatcagctatggctcaggctcgctcgagaccggcatcgaagagaaggatgaatacgtccatatcgcgcaggatatcgcctcacagtatggctgcaagctggttgcctcagtgatccgtgatatccactccgtggaggattcctcctggatgggcatggtgtacagcgaggggaaggcacacttctccccggtccacagagagcacgtgctcgaaggtgtcgcctcaggtgacgcgtttgccgcagggctgatccacgcgctgctgcatcactacgatctggaccatgccgctgcctatgcaatcgcagcctcgatcctgaagctgaccattcacggtgactccaatctcgtgacttcagatgagattgaaagtgtcgctcaaaaagattcaggcctgcgggtcaaccgctagtcatacatacgcttgatacaccactgaagaaggagaaccacgctatgtcttatatggatcagttctacgggcaggttgagcgcgtcggcgtcgtaccggttgtcgtcctcgacgatgtgaagggtgcagatcccctggcgcatgccctggtagagggcggactccctgtggcagaggtcaccttccgcacgcctgaggcggctgacgtgattcatacgatggcagagaaggatcctgacattatggtcggcgccggtaccgttctgaccgtcgatcagtgcaagcgcgcggtcgatgctggcgcaaagtttatcgtctctccgggtcacacgatggaggttgttgactactgccttgagcatgagatcccgcagatcccggcaggtgtgacgccgactgaggtcactgtgcttgtgaacaagggcctcgaggtcaccaagttcttcccggcgggccaatttggcggtcttgcaacgatcgatgcgctcgcatctgtctttgtcggccacagatttatgccgaccggtggtgtcaatgcgagcaacctgaaggagtacctgagcgatcctgctatcatcgccgcaggcggtacgtggatggtgaaaccgaagatggtccacgcaggagacttcgatcagatcttcaagctcaccagagaagctgctcagatcgtccgtgagatcaaagactaaccgtatcgttgctgaaaacttgtatgcctcatttttcctcagtggaaggtagggcatttttgttgtgcatggatctctccaaaactgagaatcgacctgcattttgagggcagcaatagtgtcacacccatctgagatcataacgctagcatttaagttcttggttcagtcctgaaacctgtgtgcgggcctatcatgccgcagccccggaaggcttcgagtagcgcctgctcgcatcgaatatcttgaggaagaagtactcgtcgtcggggtattcctagcctgcccttctgagcgtcttgatcatctggttcgtgccttcgaccttgccgctgctgatatggtgcctggcatgcgcgacgatgccgtccatgtggctctcaacgagcctggcgaagtgcctgtctttcgtgccgcggcagacctcgacgaccctctccatcgcatcgcgcatgcgcttctcctgccaatagccgtaggccctgctgagcatctcacccacgatgtcgcaggcggcaaggagctcgttctgcgagatcagctccttgtagcgctccctggcccctcccttctgcaggacctcctgcttgccgaagagggcgcttccccttgataccaccttgccggcccgtgcatcccggtccttcctcttcctggtgcccgcacaggacttgaggatgtatgtggagcgcttgagggaccttgcagcctcgctgtctccctcctccttaagccttgcctgctcgtccttcctgaccttacagatcaccttctcgttgaagttcttcacgaggtggaagtactcgtagacgatgtccagatgcggatggcgcttaaggaaggcgcgctcgaagtcggcgttcatgtcgcaggcgattgcctccacatacaacatccactcgctgcccacgaagtcgcagaagtcatacacgacctgcttcctcttcgtataggcgagccagagcacgtgaccggtcttaaggtcgatgatcacggtggcccagcggcgggcattgtgcagcttgaactcgtctgcacccaggtagcgggcctggcgcttgggcttcctgagcttcagctccttgccttcgccttccgtgtagagcccagagagccttgccctgtcgatctttttcacgacgttcctgttaaggcctgccatgagcgataccgccttgagcgtctggcccagggcaagcaggtcacacacgaacgtgaggagaggcagcgtgatgcgctgccctggcgccctgaagggaacatcctcgatgctggaagtcccgcattccctgcatgcccatcttggccgcaagacctcgacccttgccctctccatgcccagagggaggtgccgaagcgcaatggggacctgcccgttgccctccatggcttttccgcagcaggggcatgagggggcttccctcgcagccagcctgcctgggaccgtgaggatctgcaccggcctgctgcatcgtctggccgaggtgccgaactcctcggtgcgtgcgctctcttgcggcgtgcctgtctgcatgaatccgtccagatgggaggggatctggatgaagccgggagcacacatctcatcggcatgggaaacgggggacagctgggctgccgcagatgctacacttgtcatcgcactccatccttcttcggagtctacatgttgcgatgcaagattctagaggatggccgctcttctgtctctgagggcgctatgccgctggcatccgcccacagcttttaggattgaaccaatttctttaggtaagcgatgcaactgcatgtggttgcgtcgtatcgatgggaaaggacacaatcatggtagaagagaacaagcagaataccagcgcagaaacggatgatcacgccgctcgcgtacctccggtaaaggatgtttctaatatatcagctactgatagatcttcgtaggcccagggcattgcgactggcgatacagataaggaagagaagttttggcataagaccgtgtggagtgccactgaggcctttatcgacacgcttgaggaacagatggatagcgagcaatatgaagcaaatcgtacctggttctaaaccatatctgattgaaacagtggcgccggaggagctgcgcctacaggccacccgctcgattgcggtcagtgacctgctcgaggctgccggggtctcccggaagcggcgggagcagatcacggaggaaggccgcctcatgagcgacgccgggccggtcaggctcaccgatacgcttgaggagggaagctccgtcaagctggtggcatcgcaggcgatagagcgtgaggtaaaagatcctgcagaaaatgcctcacagccggcgcacctgctctatcaggatccctttatcgtgatcgcttccaaacccgctggcatcctggtgcactcagatgggaccggcagggagcctgacacgctgaccgcgcaggtcaacgccgcgttggaagagcagggcctgatctctactgcgcaggtgctgcagcggctcgataaggacacctcgggctgcgtactcttctcgctttgccctgattttcaggcagccttcgatgcgctggtggcgggccatgcgatgcacaagtactacctcgccgtggtcaaaggctccttccccgaaggggtcacaaagctttcagctccgctcgggcgtgaccggcacgatccgcgccgcatgcgcgtcgcttcaagcggcaagtcctgcctgagcatcgtgcggcgggtgatgtatgagaaggggtattcactcgtacttgtagcgcccaagaccggcagaaagcatcagatccgggtgcacctggccttccggggattcccgatcgtgggggatccgctctacggtgcaggcggtggccctgcgcttccgcatcccgagcgggtacagttgccgaacggggagatggttgcaacaacgcttctgctccactgctgggaggagcgctttatccatccggttatgggtgaggaggtatccgtacgtgcaccgctcacggaaatgtttttgcgcctgttcgaggtaaaggagatgcgcaaagcgctccaaaacgcaatgaaactcgaggaaaagcgcggtatgtaaggagtgggtcggccgcatggctgcggggtagctacccgcgtagcctaacagtcaagtaaatgagggctgctagacccatgccgagctgcgaagacccacatcggccacaagcatatggtgcccttgcagtttcaacccatctgtgtcttgcacctctggcgcaaaatagctagacctaccagttgaggtagcttttgcatgttggccttagacatccctgtgaggcgctacaggtatctcttgagtcaggagcatagattgttcacaagcgccacgctgtccagatagtgcggatcgcgcacaactggccttgtaggattcagtgacagcccccgaatccctcatcagccctattgtgagcgcgcttgtgccttcagctcagtggcagcaaagtcctctgatcctttccgtggacggcttgtggccacagaccacggtataggggctcgtgtggacgtctgtgccaacctgctgacagggcacacttactcgcctgcctgaaggcgtaggagaggtgcgcatcagcgatgtaggccttgtcgatccagaggcacttccttgaggacgaaagacccaatgccaccatccccaagcgcttttgatgcgatatctgagcgctttgtctcttgcagttaaggggcacactgtagcgcatgagcctgatgggtgatacccacttcggcagggtgtgtgcctggtgtgcttaaagactgtccctgtaagcgagctgtacgtgcgcctgcagtcaggacactcccatcttggcacttagcttagcgaaggtagcaaagcctatgtgcttacagcagcagcactcgactgtggccttcttaggccggcagatcttggtatcttcggccttggcactgcgggtgtggaagggacttttgcgtaccatggatcctgacggttccactttctccttgaaggctagccgaagaggttgtcaccaaacacagagcccagtaggctccagggcacagctccctttggcatggaaagttgtatcacctgggctagccggccggcctgcatcagccctcatatacttgacggctagatatacttttactgaattaactcacataaaataggagccttcggtagtttctatgggaggcagtcccatctaggcggccctccttctcgcgcttttccctgacctccccggaagctgcggcttgctgtccgagcacctcagcatgagcagcccgatcaggttgtccgcgttgcgaaacccatagcccatcttgattgtcaccttgatcttgttgttgatcgactcgacgcggctgttgccgattccgagctcaaccgccgcgaccacgtcggccctgcgcctgtgcaccttcttctcgacggcgacgatgggcttgatcctgcagtacgcggcggcgcgcagccacgcgtcgagcaacgccgcggcctcgctggctcacccggccctgaacaccgcccgcaggtcctccttcaactcccatgtcctgaacaggcgcgaagctgccttcttcttcagcgcgtcgagcttggcgcgctgcgtgtcggtgaggttctcggggttcttcacgagggcgaagcggctgcccttgatcgcgtcggcggcctgagctgtaatcttttggtggacagtgggattcagggactaacaacagatatgctctgtccagatacccacccagcacagtcaacagattgaagagatgagatgtcgctaagcgcaagcgagatagagaaggcaaagtcccgcacgaagccggcaccacccaaacactacactgaggaagtattgcctcgaggctatcgactactgcaggaaggcacgtaaggccaaccctaagaagagcatcagagaatgcgccgcgaagcttgaggccaacgacaagaccttaaacgactggatcatcaagcactcaaagaccaaaagggtgacccaggtaaggaccgaggagcacaagcagctcgacagggccaacaggcgcatacacgagctcgagagaaagaacaagttcctaaaaaagaggcagccttcttcgccggaagcctctgttgaaggacaggttttagctcatgctggagaagagggcaacctacagcgtctcgatgatggagcgcgtactggaggtgagcagggctcacttctacagatggctcaaggccggaggcggtgaggacctatggggtcctatcaaggaagccatcatctagatatgggaggaaagcgacaggcgctttagcttttgctaggtctgatccaagctcacaggagatccgaagttacgcaaaatttacaggcacgacccgctaccgtgtgcgcaggtgcatggctaagcttgggcatctgtggcatctgatccaatgcatcgaagaggacgacgctgcccgcacctgatacccccgagcgccccgacctcacccggcgcggcttttcgtgtcccgtgccgacagccaagctcgtgggcgatataacctatcgcaggaccacggcaggctttatatatcttaccgtcgcacaccatctgtgcacacacatggtggtgggctgaagcatacaggacaacatgagggcaggccttgtcgtctttgccctgaagatggcatattcgcgcggatacgtggccaaaggggccatattctaagcagcccaggcagccagtacataagctcagagctgaccgcctgctcagctgcgcacgacgtgaggctctccgtggggagaaccggaagctgccacgacaacgcggtcgccgaatcgcttttcgccacgctcaagaacgaatggtactaccacaagcgcctctcggacgcatccacgaccaagcacaaggcacacgagtttaatcgagtcgtactacaaccgcttccgcccgcataagtccataggagatcgcgtgccggcagaggtgatgcaggagttcttcgagcgcttcgagagaggccttacatacgatccaaaggcgatgcagaccgcataaaaaatctgagatttctctgtccattatattgacagggctcagcctccttgagcgccctggcctccgccggggtctcctcgcccttccgcggccgccccggccggtctcgcgggggcgtcgttcatccactgcacgacgtggaaggggtccatgacccagcgcgcggtgtgggcagcggcgccggagtagcgtctttatccacttcgcgccgtcggcggtgacgacctcgatggcgcgcctctgctctcaggtgagctcgtccaggaaaaggcccagcacgtccttgccgtacccctcgtgggcccatatcagacatccccggtcgtggtcgacgacgacaatcaggtacttgtggcccttcttgtaggaggtcttatcgatcccgatgtgccttgcaccctcgaagcgcccctgctgcgtgtggcctgcaggtcggcgcagacgcgggcgcagacctcgccgagcgtgtgccactccacgcgcgctagctccgcgacggcgctggccggatccgcgccgtgccaggccacgccacctactccttaaagtcgcgcgtgaagcgcgacctgggcctcgcccagggcaccgcctcgaccagaacgccgtgctccgggcaggcgacccgcctcgtcgcgtactccagataagcacgtcgagcgggccaggtccatcgccctccacgatcgcgggctcggcgacctgtcgtagcagccgcatctcttgccgcagacggggcagcgcaggccgtccttcctccacggcctcaccccgacgacgactcggtcgccttcgatgcgtacgtattcgatcacggtgtgcgccagcgcgagcgcgcagcgtagtatcctgttcatgcgtcagggcctttccgctaggttgttgtagcagacgtagccctaccctgcccgacgcgggaacggccccagacggggccgttctcctttatttgccttgtcaccgcgctcccatctgggcgcttgggcggattccgcccatagaaactaccgaagagcctaaaatagaggctgtagcgccaacacagaggagagggttatcgcatgtcagacacaatgcgtggtgtttacaccaatatcaccgatattcgccgcacggtatttagggaagtcgcgcagatcatctacaaacatgcccagaacccggattggaccctgaaggactttgatcgggcgttcgacgagctgccgtacaagattttgccacatgagaaagcgacctaccgtacctccgtgttcctggaacgtgccatcatctccgagcgtatccgccttgccgcaggcctcccgctgcagaatatcaacaagccgaccaacatctcggaaggcttagcggacgtcgcagcgccggagcgctactacgagccgcccctcatcaacgtaatcaaatttgcttgcaacggctgcaaggacaatgtatatgaggtcacgaacatgtgccaaggttgcttggcacacccctgccgtgaggtgtgtccgaagcacgcgatcacctttgtggaccaccgcgcacacatcgatcagtcccagtgcatccactgcggcctgtgcgcccgcacctgcccctaccatgcgatctaccatcacgtgcgcccctgtgccgctgcctgcggcatgcacgcgattggctcagatgaagatgggcacgcgcagatcgaccacagcaagtgcgtcgcctgtggtcagtgtatgatcaactgccccttcggcgcgatcgctgacaagagccagatcgtgcaggtgatcatggcaatcctctcaaagcaggaggtcattgcaatcctggcgccggccttcgtcggacagttcggcgccaagaacgatgcaagcaagctgcgtgccgccttcaagaagatgggtttctccggtgtagaagaggtcgcttccggcgcagacctgtgctcggtggaagaggcggaggacttcctgcgtgaggttccggataagctgccgttcatgggcacttcgtgctgcccggcgtggagctccatggcaaaaaaggagttcccgaagtacgccgactgtatctccatggcgctgacgccgatggtctttaccgcgcggttggtccacgcgcagcatcccaatgccaagatcgtctttatcggaccctgctccgcaaagaagcttgaggctatgcgtactgccgtccgctcccaggtggacttcgtcctcaccttcgaggaggttatcggtatgatggaagcctgcgatatcgacctgaattcgcttcgaggtgacgacagtggtgacttcaccgaagcctcaactgatggtagaaacttcgcagtcgccggcggtgttgccaccgcggtcgtcaacgtaatcaagcgtgaccaccctggcgtcgaagtgaaagccgacggtgcccagggattggatgagtgtcgaaagatgatgaagaaggctgtgcgcggccagtataagggtttcctgcttgagggcatggcatgtccgggcggctgcgtcgcgggtgctggcacgttggtggcgatcaaccgctccacgaatgcggttcaccgctacgccaagcagtcttcgcatccgaacgctgtggacaataagtaccgcagctggatccccgagatggagtacgccgacgactaccagagcccgaagatggacgttgccgaccccgtggacggggggcagaaggaagacggaaaggatacgccgtctaacaagtagctttcttcaataggcgtgaatgattcccttgcttgtgaattcgcaggtaaggggatttttggttagaaaaagccccaagtgggaaacttggggcgatgcttgcatagagctgtttggtcaaatcaatgtttttcgtttatagtgctagtctttttgacctttgatagaggcgtagagcgtagctccgtcgaagacgtctttaatagtctgtccatcaatgaagggaagtgctaagaactcatccaccgtatcgacgagatctgaacagtcgatgtagtggccttttgaattcagctggctggtatcctgcgctctccatgcttcgtagttgacgtcggtcaaatagtagaccttgctaccgatcttcatgtatacggaatggttcttatgcaggtaatcggccagctggtcgtacgtgatgcccagtgcctctgtggcttttcttcccatagtgcgtcctttcatcgaaggaatagaccaaacgtctatgtccttttactatatcgaacaattcgcatcttagagcctttgagtaggccagtgacaggaaatcggaggatatgcgtaggcagttttgtccattcagtgaacctcttcgccggtgatcaggtgctcaagctcctgggggttgtcgaccaacgtcgtcgccccgtgggcgcgcaggaactcccgtgaacggtagccccacgtgacgctcgcgcagtcacactgggcgttctttgccgtctcgatgtcggtatcgctgtcgccgatatagagggcgtctttcggcttcatgtccagctgctcaagtgttaagttgaccaagtcaggcgccggctttttccggatacccgcatcgacctgctctcccacgacggcgtcgaactcaccggggaagaagtggttgatcagcttctggacttcgacatccgatttgttcgagatgaccgcgcagcggatgccccgcgtacggagatggcgtaacagcgctgggatgccctcgtagggggtggttgcgtccttgtagtgctgggcgtagtagctgcggaaattcaggaagacatgctcctgaagatcagcgggggcaccggcaggcagcgaagtctgaatcaggtgtctgaccccctgtccgatggatgctcggacctgggctttggtcctgaccggacatccggattcggagagtgcgtggttgacggcgcaggtgagatcgtccaacgtgttcagaagtgttccgtcgagatcgaatagtgccgctctgtataacaccgtgagcctcccttgcaggtggtcccatgccacggcgtgttcaaatatgccaggcaggccatctgagaaacattttgcgcatctagagtatcatgctcgggatttccatgcaaaaacgcagcataaaggtatggtaagggtttcaggtatggccgaagactttctggggagaccgcgtgtgtgcccatacaaccttcatcaaaaggtaacaccttcatcacgaacggtttgtttctttcagactaagagtacaatcgacattcacgtgcgagggcgctgtctacgtaccccgcaggcatctggtggggagccgtccgttacggcacgggacggcacagatgaaaggaatactatggaccagtacagtatgcacacccgcacctgcggtgaactccgcaggaaggatatcggcagccaagtgacgctgactgggtgggtctggcaccgtcgtgaccatggtggccttatcttcgtcgatctgcgcgatcgtgagggtatgacgcaggtgtcatttgaccctgagcattcgggtggtactgccttccatatggcagagggtatccgtactgaatgggtcattttgatcaaaggtaccgtgcgtgagcgcccggagggcatggagaacccgaagctcaagaccggcgagattgaggtcttggcttctgagattcaggtactcaacccctcaaaaaccacgccgttccagattgaggatcacgtggacacctccgaggatgtccgtctgcggtaccgctacctcgacatcagacggccgaagatggtaaagaacttagagctgcgttctgactttacctttgcaattcgtgaggccttccacaagcgtgagttcaccgaagtggagaccccgtgcctgttcaagtccacgcctgagggcgctcgagacttcctggttccgagcagaacccagccgggccacttctacgcgctgccccagtctccgcaactcttaaaggagctcctgatggttggcggcgtcgagcgctactaccagatcgcgaagtgcttccgtgatgaggacctgcgcgcggaccgtcagcctgagtttacccaggtggacgtcgagatgagctttgtgacccaggatgatgtgatgggcgaagtcgagcaggtgctctcagacgccttctcgaagatcggtgttgacatgccagttccactgcgccgcatcgaatattgggatgcaatggatacctacggtaccgataagccggatacgcgctacggtatgcacctgcacgatgtcacgaagatctttgcaaactccaggttcaagctgtttgcaggcgcctccaagaagaaggggcagtgtgttaagtccctcaatgcgaaaggtgccggtacttggcctcgcgccaggattgaccgtctggcggatgtcgcggcaactttcggcgccaagggcttggcctacattgccttccgtgaggatgggtcaatcacgagcccgatcgtcaagttcttctccgatgaggagatggtaaacctgcgtaaggaaatggacgtcgagccgggcgatctcgtgatgttcgcagtggcagacagactccacgcagaccagatcctgggcggtatgcgtaaccatatgacaaacgcccttggtatcaagcgcgagggtcacgacttcctgtgggtcatgaacttcccgctcttccactgggatgaggatcgcaaggcctacgccgcagagcatcagcccttcacacagcctgaggagtcccagatcgatcttctggacaccgatcctctggcgatcggctcccacacttacgatttcgttatggacggcttcgaagctggtggcggcggtatgcgtatccataacgctaagctgcaggagaagatcctggagaagctcggcttcaccccggagcgtgcccaggcacagttcggctttttgatggacgctctgacctacggtgcgcctccgatgggcggctttgccttgggccttgaccgtgtctgcatgctgcttacgcactctgactccatccgtgaggttatggcattcccgaagacgagctccggctccgacctgatgagcgatgctccatccgaggtcacgatgcagcaactgaaggaagtctcactgcgtctactgtaagcgctctggtccgtatttcagaaggcagatcgtcaaactgagtgcaccatctccctaaaggcctcgttggctgtcctgtagcctgataccttccttggcttgtcgcagatcagctccgctgcatgctggacttcctcatccgtaaccttgccgaagtctgtccccttcgagaagaactcacggatgaggccgtcagtgttcttaaccgtcggcttctgtcaggggtggtgtagctcgcagaagtagaactgcacgcctcaaagggcctttgtgagcttagccatgccttgcgaactgcttgccccgctcaggggtgattgtcttaagggagcggtccagaaaaagctcaagcttcaagacatcggcgctgtcgtggtggcatcttctcgcgacaaggagcctggacgctctgttggcaagcacaaacaggcatacaggccccacttctataagcgtgtcgtctacccagtcaccgaggagcgagcctacagctgcctgcttgggtctatcctttacgctgtgtgagatctcgatcttgccttaggtcttaggcctcttgctgcagattcgcttccccttcctgcgcagatggtggcacacctggcaactcgagggtggcggctacgggcctgactgcagaatagtcgagaggctcaacgacgcaactgacaccatactcgagcctgagatatagtctatctgcttggggatcaacgctcgtcttacgatgagcgagcgcagagtctgagtgcccccttttcggcttttccctgccgtgggcgggcagctgtcctccttttgggttttgggccgcgcaggcgctaaagcgtttgtgccgtgcggtcctggcgatcttgtggcaaacgctggatctgtccttacctgtcttgcgcgcgatgtatccgatgaagcttcccttgtgccacacagctcggctatgcagttcctctcctgtgggcttgagatgcttgtagtggtgtattccttctagctttcgacgttgattgagacaaccaacatcgtagccttccgaggtgcgccacgtctctgtggagcgggactatcctgttgcactcaggatgctaatctgccaacccaaagatagcatcttggtgagtgcggacatcaacgctgccgtaaacattgcacacaagcagaagccggcagaccggcaactgtgtagaggcgttttggcaacagctcagcaaattcacgtccacgccaaaatcccgtaactttagtttacgggaatgtcaactgtagcgtaatatagagactacgtcctgatacaagctatatggggaggatacatgagcgatagtaacgcacactgggatacgcaggccaagacagacgcttcaagcgagcgtgcagcggccgcctctgcgctatcagaagtgcatatgccccaagagctcggtcaaaatatggaattcttcttgcgcctcacgcgcaaggtcctgaaggaatacgatcctaagctctgcaagacctttgatgagctcctgagctatatggtgaaggccaacgataaggaactgccggagcaggagatcgaccaggcgtacaccgatgcggtgaacctgatcgataagctgaccctggagcaagagtcctatctggcccgtgcctttacgacctttttccatcttgcgaatatctctgaggaagcctaccgcgtaagctcccttaaacgccgcgaggggatcgtcccggtggattccgacgaggatccggtcaacgagatgacggtggcgtactaccgcctgattcaggaagtcggcaagaccaaggcaaataagcttttgaaccgtctagagtttcatccggtctttacggcacacccgactgaggcgcgccgtaatgcggtcactgcgaagatccgccggatctctaagctgttggatgagcgccgcaatctcgagggcatcgacgctgaggaaaacgagcgtcagctgcttgaagagatcgattcactctaccggacgaatccgattgccgcgaagaagccgacgccggtggaggagtccgacacgatcatcgacgtgttcgattacacccttttcgatatgatcccgaaagtctaccgtcgcttcgatgactgggagcttggcgacaaagccggcactgtgaagccgatctgccccgccttcttccgtctgggcagctggatcggttcagaccgtgacggcaacccgaacgtgactgcaaaggtctctcgccgtgtggcggagaagttccgcatccatatgctgcggaccctggcagaggtaaccgacaaagtgggcttgacgcttacgatggagggcggctccacgaagccttccgcggagctcaagagcctgtggaaccatcaggtggagatgaacgaggaactcgcgcaccgcgcgatgcaacactccgcccaggagctccaccgtgctgtgatgctggtgatggcagaacggctgcgcgcgacgatcacccgtactgcagatctcatgtaccccaacgctgaggagtacatcgcagacctcaaagtcgtgcaggattcgctcgagcaggccggggcgaagcgtgaggcgtatggccccttgcagaccctgatctggcaggcggagacttttggcttcaatatggtacagatggagttccgtcagcactcactcgtgcacacgcgtgccctcaaggacatcaaggagcacggccgtgatggggatctgcagccgatgacgagagaggttatcgacaccttccgcgcgatcggatcgatccagcgccgcaacggcgtcaacgccgcccgtcgctacatcatctccttcacgcagagcgcccagaacatcgcggacgtctacgagctggcaaggctctccttcgcccatccgagggatgtcccgactctcgatgtgattccgctctttgagcaggtagatgacctgaagaatgcggtcaacacgcttgaccagatgatcaagctgccggatgtaaagcgccgcctggcggcgacgaaccgtcggcttgaggtcatgctcggctactctgactcttcaaaggatgccggcccgacctctgcaaccttggtgctgcatgaggcacagaagaacatcgccgagtgggccaagaagaacgatatcgacctcgtgctgatgcacgggcgcggtggcgcggtcggccgtggcggcggcccggcaaaccgtgcggtgttggcgcagccaaagggctcggtcaactgctgcttcaagctgactgagcagggcgagatcatctttgcccgctacggcaatgaagtcctggcccgccggcacgtcgaatccgtggcagctgcaaccctcttgcacagcgccccctcgatcggcgagatcaacaccaagtacaccgagaagtacgaggggatagccgcaaagctcgagcgatcctcccgtgaggcgtacatgaggctcctgaaccaggatggcttcgccgagtggttctccacggtgaccccgctagctgagatcggccttctgccgatcggctcacgccctgcaaagcgtggcttgggggccaagtccctcgacgatctgcgcacgatcccctggatcttcagctggagccaggcgcgcatcaacctcgctgcttggtacggcttgggctctgcctgcgaggagctcaacgatctgggcatgctgcgccgtgcctatgcggagtggccgctctttaaaaccttcatcgataacatcgagatgtccctcgcgaagaccgacgagcgtatcggttggatgtatctgggcttaggcgaccgtccggatctctccgagatggtaatgaacgaactgaagctcacccgcaagtgggtgcttaacatcctgaacgaggacgagccgctgcagcactccaaggtcttaggaccggtcgtgcatgcacgcctgcccttcgtgaatgcgctttccatcatgcaggtcaaggccctcgacgcaatccgcggcgacgataagctcacgcctgaggagcgcgaacggttcctgttcctgattctgtgcaccgtctctggggtctctgcgggcctccagaacacgggctgaggttcttgtacatcgggtgtgtctcagtgccccgtctccctcgggaggcggggcactttttccatagtggggaaagggtaggtcggggaaagtgctctaacacccacaattggaacagtgtaaaaagttagtgataggctactttgttgttgattgaaaagttacaagaagtatactttattggtaagcatgagttaacttctagccgtactgtgaggagggcatagtggaagagacaatgagcagccagatgaggccgaacagtatgagttcacattcggcggcgaatttgccgctcatgatggtatctgagggggatgctgtggtggtcagccgaatctgcggatccaaagagctgcgccaacatatggcagcgatgggattcgtcgaaggcgccgaagtcagggtagtctcgcacgttaacggggactgcatcgtgaaggtcaaaggtgcgacctttgccttaaatcggcagatgacctcacacattctggtgaactagagaggaatgagcaatgccaacactcagagatgtcaaagtcggtcaatcctgcacggtcaagaaactggccggaaccggagcgatcaaacgccgcatcatggatatgggtttaaccaaagggaccgatatctacgtgcgcaaagttgccccgttaggcgatccggtcgagctgacagttcgtggctacgagctatcagtgcgtaaagatgaagcgagctgcgtggaagttgaaaacgtccacgagggcgagtaatcacagaggcgaagagcctcgttttctttggtcggcaagtaagcttcatctaacaatactgaggttcaattatttccgtgcgcgtcacgacaagaaaagaaaggtttgtgatgggagaaagtagcttcattgctcttgcaggcaaccctaactgcggcaagacaacgcttttcaatcagctgacgggctcaaacgggtacgtgggaaactggccgggtgtcacagttgagaagaaacaggcaccgtggctcgaggataaggacgtggagttcgtagaccttccgggtatctactccctgtccccgtattcaccggaagaggtcgtctcgcgtgactacctggtgaaggatcagcccgatgcaatcatcgacctgatcgatgtaaccaacctggagcgcaacctgtacctgacgacccaagtactcgagaccggccgtccggttgtggtgggcctcaacatgtgcgaccttctgaaagagcgcggagacgtcgtcgacgcccgcaagctctccaagatgctcggggttccggtcgtcgaggtatccgcactgcacaacaagaacctgaaagagctcgttcagcaggcctgcaccgctgcgaagaatcagacggtcacgggtggagtcgactgtttctcaaaggaagtctccgacgccctcgacaagatcagctccatcattgctgacaagacgaagccggagctcgtgacttggtattccatcaaggtcttcgagcgcgacgccgaggcgattaagccgctcggccttaccaaggtagaacttgaacagtgtgagaagatcatcaagaaggtcgaggaagaccgcgacgacgacgcggagtccatcatcacctctgaccgctatgactggatcgcgacggtcatggcggcgtgcgtgaagaaggctccgaagaagctcaccacctccgagaagatcgataaggtggtcacgaaccgctggctcggtatcccgatcttcatcgtggtgatctcctttgtgtactggctgtcaatcgcgacggtcggcaaggcagccactgactgggtcaacgacaacctgttcggcgatggtttctttgtcaacggccagagcgaggagcagtacaacaacgaccacgacgagtggttctctcagcactctgcggatcaaatctccggctacctggccgctgctgctgacgacggtatcgacaccgccggcgtgcaggacgcaatcgaggccgaggatccgacgccagaagacgagcagacggttcagacctttgagacggcagcttctgaagagggtgtggtcgcctacgatgtgccgattaccgatgaagacggcaacttcgtcgacaccgacggtgaggttatcaccaagctcgacagcgacggaaatccggtgctggcagagggacagaccctcgatacgataccgacggtcacctacgcggacttcaccaacgcggttgacacgctggaagacgagccggcccctgaggattactccggattcgtacagtccatccccgatgcagctgaggacggcctcacagctatcggcgtgtccgatgtggtcaaatcactcgtggtcgaaggcgtgatcggtggtgtgggatcagtactcggcttcatcccacagatgttcatgctcttcgtacttttgactttcctggaggactgcggctacatgtcccgtgtcgccttcgttatggaccgtgtgttccgtcgctttgggctctccggcaagtccttcatcccgatgatcgtttcctccggctgtggcgttccgggtgtcctggctaccaagacgatcgagaatgaaaaagaccgccgtatgaccgcaatgcttacgactatgatcccgtgctccgctaagaccccgatcatcgccctggttatgggtgtcctcgccggtggctccagcatgtggtgggtcgctccactcttttacttcatgggctttggcgcaatcatcctctccgcaatcatgctgaagaagaccaaacccttcgcgggtgagccagctccgttcgtaatggagcttccgagctaccatatgccatcaccgagatcctggtggctgcacatctgggagcgcgtgagcgcctacatcaagaaggccgctacgatcatcttcgcggctgcggtcggcatctgggtcctctcacgcttcggcgtagcaggctgggaaggcggctccggcgcctttggcttcctcgaggatatggaaggtgcaggggacgactacatggactactccctgctcgctggcatcggcggcgcgctctccttcatcctcgcaccgctcggctgcggtacctggcaggcaaccgcaacgaccctctccgctcttatcgctaaggagaacctggttggtaccttcggttccctctacggcctcggtgaggcaacggaatcctccgtcacgatgtggaacggctttgcgacgatgttcacagacgctacaggcattctgcacgtcggtgcgatgtgcgcgttcgttgccttcaacctgcttgatgcaccgtgctttgcagcaatcggtacgatccgcacgcagatggctgacccgaagtggttctggttcgcaatcggctacgagtgtggcttcgcttgggtcgtcggcctgatggtcaaccagttctgggagctcttcgccctcggcaacttcagcttctggacggtggccgctttcgtgttcctggtgctgatcgtctaccaggttgcaaaaccgactcctaagtggaaggaagacagtaagattttgaattcactggacgctggggtagcgtagaattaaatatggactggtgaatacctgtgccgagcactgtcgggaaatgttgccgacagtgctcggcttgctgtaaggagtaggagcctatggggtctgccgagttgccccgcgcctggaacagtgcgcagcaatattcaaattttttagtaactgacgaacaccatcaagcttctacgtccgtacatttcactttttcatcgcgtgagaacgcaaaggggcgcgcctcggtcatcgagctcttcccggggatcacgatggtgcagtttgagatcaaatcacgggtgttgggagcgttctatgatatcccgccgcagatcaatctcaggaattctatgaatatctgctactgcaagcagggctctgtcgagcttgaccgtgtcgacgagctctctgcagtcctgcaggaaaatgagatcggcctcggcgcgcttgcggaaaagaaaatcgtgatccgctgtccggtcggatacgtcgccggtgtggggttgacgatcaagaaaaacctcaaggccgcgacgaggcggctgctcacgagcttcggggtggatccgacgcagatcctctcactctgttccgcaacggagaagatgcaggtcttgaaccgatctgaggagcttgaggaggcgtgtgaagccctgtgcttcggccacaccagcgcctcgaagaatacctatcgcctgaaggtcctggaaatcctgcagcacttggggaaatccgatgccaagcccgcaaaccccaacgaggagaagcaccgccgctcaacgcacctgagccacgtggagctcgcttaccgcgcgcagcagatcctgatggacaatgttgcaacaccgatcacaatcaacacgctcgcgatgcgctgcgacacctcaggcaccgtcctcaaggaagccttccgcgagacgttcgggacctccatctaccagtggtaccgcacctaccgcatcaagcaggcggcgcagaccctcctggacacggatctcacgattgccgaagtagcctcttcagtggggtatgtcaacccctccaagttcactaaggcctttgtcgatacgatgggggagacgccgcgtgtgtggcgggcgaagcataagtaaggcagcaaacaccaaaagcagaacgctgcaaaacaataaggccgcgaaagcttgtaccgtggttgctatggcgcaagttttctttttatatactgaatgcaacaatgaatttgttcgtatcggtatacctgtgaaagaaaaaggagcttgctatggctcaattggatgcggaaaacgtcggcctcgtgtttatgaagccggtctttgtgaagaagatctggggcggcagaaagcttgccacggagtttggctatgccattccggatgggaacgtcggggagtgctgggcgatctctgcccaccccgcaggagactgtgcgatcgaaggcggcccctttgaggggctgtacttggacgagctctgggctgcccggcgcgacctctttggcaactgcctaggagatcggggtaagttcccgctgctgatcaagatcctggacacccatgagagcctgtcggtgcaggtccacccgggcgatgtctatgccgcggagcatgagaacggatccctgggaaagaaagagtgctggtatatcgtccacgcagactccggatcccagatcattatcggccagcatgcaaagaacgctgacgagttccggaagatggtggaagccggggactgggaccgtctgctgaataagatcccggtcaaaaccggtgacttctttgcagtcaaccctgggacgatccatgcgctgtgtggcggttgcctcgcaatcgaaactcagcagtcctccgatatcacctaccgtgtatatgactacgaccgtgtgcagccggatgggacaaagcgcgagcttcatatcgaacaggcctgcgatgtggtggacttcagccaggtgccgccaacctccggtgaggtcacggctcctgaggtggatggggtcactgagctcatgcgctgcgacaagttcgtcgtcgaccgcatccgtgtgaaagaggccaagtccgtagaccagaagtggcccttcatgtgcgtcagcgtgtatggcggcgagggtttggtgaaagtgctgggcaaagaatatcccttgaagaagggaagccacttcctggcgctctccgatgcagggactatggagttttcaggcgagctctcgatgattacctcgcaccttcctgagtgaaaaatgatcgtgggaccgcatttgtgtaggatgtgtgtacacaagtaactgtgggttaacttgctagggtcttgtgataagttatatatggttgacaaatgcggcacagaccaaccttgtttttaccagaggtcacctgtcggatcctctccctgacaggattggccattatcatcgccggtgggtttcccttcccactggcgattttttgttcttcaggacgaaacgcagcatcctgcgatataccctcggtgagcttgggcggtttggtatcgtgaaaggtcgaagtatgacttaagaccggactttggtttttcgatccccgatatggtgctatgaggcccctcagccgcgcttcctgccggcagaggggcctttcccttcaccgcgcagcatggagagcgtgcaggaggagattgccttcacgttgcctttggtgaggttgaagtgaagcagcggcagccctgtccttgacgccagctcctcgatgatggggcttctcctggatatgttggcatacctcctgtccgaggtgcggcacacatcgaggccgcgacagagccccatgatgtccttggaggagaagctatctcccagcaccttcatctgcaggagcctcatgagcagcacggcgatgtagcagacgaggaagtggcccgtgattgtgctttgcctctgaagatagacaggcctcgcatcgagcttagacttcatcaccctgaagctctcctcgatcctccagagcctgtggtaggtgccatatatggcgcgggggtccatcctggtcttcgaggtcacgatcatgttgtagccggcaagggccctggccttcctgatcgcctcgtggttgagcatggccgcgaccttcgcgtccttcctgagctcgccctcgccgtcgacgggggagaacgtgacatacttcgcgctgtcgccgtactcggaccttttcgcggctgccgccttaagcgacctcgccttctccacctgccggtctatctcgtatttctgcttcctggcaagcgaggggctgtacgtgacgacgcgcctctcggggagctcgaccttcctcttccttccgtcctctccctcta

SEQ ID NO: 332 - DNA, 8597 bp, Unknown
  Metagenome-assembled genome
cattcgcggcacaggagcttgcggcgcatggattctcgctgcgctatttcacatccaagaaagttggaagactcgactttctggcagagcaccaggacggcacaatcgatgcgcttgagataaagccaggcggatcgtacatgacgcatgcagcgctcgaccacgcgctcgaagtacccgaatattcaattgacaattcctatgtctttgcagaatcgaatatcttcgaaaagggcaacgtgctctacgtaccggtattcctccttggagctctgcatttcggattctgagcagtacagcatccttcagcattctttgatgaccgcggcacggctgagtacccagacagcctgcctccaaaagggcggcatgcactgcatggccgccctcatcgcatgtgcagactgtcaaagcctgttctgaagttagaggcagatggtcatgtacagcgggagcagccgatatccatcccgttctgcatacggaagcggatggatgatgtagcaggtgccgattcggctgccgaagcgtgctttgaacttgtcaagagatgcagttgcatatctcttgccagatttcacttcgattggcgagatccgcggcttcatggcagcatcctcaaaaggccgaacaatcaggaagtctatctccatcttgtccttgtcctttgaagggctgctgtagaaatgaagatcgtagccatttgctacaagctgctgcccgactgcattttcggtcagcatgccttcattgaccacagcatcccccagaaggacctgacggtacacctgaggcatggcatcgcctgtccccgagaacgccatgctcgaaagcaggccagtatctgccatgtagcatttgaccttcgtctcgtcttcgctgagagccaggccaagcgacggatcttcgctcagggtgcagaggttgactgttgccgcctctttcatccaagccagtgctgtcgcgtagtcacgtgcccgggagtcttcatcgatctgtgtatacacaagcctcttctcatgctttgaaagctgccctgggatggcatcgaatactgcctggatccgtttggcagcaaggcctccatacttctcgatgtcttcccgatagagcttcagcacaagacgcttctgccgatccgcttctgccagatctctccccttgacatatgcatccactgcttgtggcatgccaccgacgagcatgtactcgcgccagaatcgcatggctttgcgatgcagctcatcaggcagcgcttccctgcgggcaaatgaggagcggatgaattccgcaagaggctcctgccccatggcccagaggaactcctcgaaatccatggggtgcatatcgagcgattcctcttcggatggaatcaggatatcggcgacattctgcttcagcgaaacaagcgatccagtctctatatagtcatatctaccgtcagcgacaaggtgcttgatgaactcccgcgctttcgggaagagctggacttcgtcgaagatgatgagcgactcgcggggatagagcctgacaccatacgccgctgacagatagaggaagaacccatcaagatcggtacgcatatccagaaatgtctgcttgaactcatcagatgcaagggtgaagtcaaccagaacataggaccggtattctgactggccgaattcttccactatcgtcgatttgcccactcgtcttgcgccttcgacaagcattgccgacgatccgttgcttcgcttcttccaatccagcagctgctgatagagcttgcgcttgaacacgtgatctcaccgactttccgcggatagagtccgattaagatatgcatatctccatcagcatccattatggcagaattcacgttttgcagagttatgcaattgtcaaatcccatgctttatggtcttagcaagtacgttaaatcacgcgtttttcttgtttagctgacacttcattccacacgttttgatgatttagcaaatctaccatttatcacgttctgcaaagttagcagttgttcaggctcgcgcactctgaagcaccgatacgctcaccagggttacgaacacgttctcgccaacttcaatccgatacctgacagccggaatgatggactcgggatggctgatattcgtgttggcctctgcatgtattgtgagtcgctctcccaggcacgccagcggcagcgcctggcagacagcatcaatatccttctgtgtaagcgtgtgatagttccccgggactgcaaacccgcagtcatatgcttcgcaggcaagcccggagcttacatgatggatgcggagatgcccttcctcaagcggaatgacctctgttgtgacctcgatgcccggccaaggagaccagatgctctccgtctcccagagcatgcctttggctgcaagccccgaaacctcatgacagagagctggaggcatggtgtcttccaagccgagactttccacctcttccgtaccgagtgtgcgcacatatgacctatctgcacccctcgacacaaagatgtgccctacaatcgagaaggcaagcatgctgtcaggtgccgcttcctcgattgtttcctgcgagcgcgacaccgagaagccgaagcgcgtgctgtaggcgaacttcgcatacttggcaggagactgcacaaacggaagcgctggcagagtccctgtacgatagagcgttgcctcgctttctgcatcccttgcagcgaggccgagctcggtcttggcaagccggggcagctccggcagaggctccgctttctcttcctatgcagggtcctcggaaggaagtgccaggcaggcaaacgccatgaggctccaatagggagagccaggtgcgttgtagccttctgccatgtggagacaggggagccatagccgatgctctgggtgccgccgttatcgcagatatctcctggattccagcaggcaatgctgcgcttcacgagccccagaaggcatcctggcgtgaacatgcttcccagatccgtacgcgtggccaaagccacagaccagaagccagactgtgcaaagcgataggtcatggaccgtccgaacggcacggcctctcccctcttgctgaagagcaggatgtattcctgcgcaaattcctgagcacgctcgatatagcatttggcgcgtataggatcttctgcatcgaatagccctgcatagagaaggctcatgaagtggaagaccatcgcgttgtagtagtcgaagacgccttcagggccgtctgcgtaccagccatgtccccgatagaagctatcgagcgtatccaggtcttcctcgaggagtctctggttccaccctatgccccgctcgcgaagcgcaagattcacgagcgcacggaaccagagccagtttccctgagggaatgaagcatggttggcaaggtcaagccaggataccacattcttccgctcttctgcactaagcggttcccagagcacatcgggtgccaggagaagcccataggctatggctgccatctcgacgaagcgctggtcgtggtctctgccgcctctccagaacgaaggcgaggaaggatctgctccggccgcgagaccacaaacataggctctctcgaagaagccgtccttgctccttcctccgccatgccagaatggcacaagtccccagagcggacgtgcccatgcttcgatgggaatggtctccttctcgtagagcgccgctccgcccgcaagatatatccgcgagcagtcatcgctgaagtgcgtcttgagaggatcgagataggcaaagagcctatccacaagccaggagcggatcccgtcttctgccatgctacttcgtcgccttcttgagcacctctgccttcactccatcctcttcgacgacacgcgggcccatcagcggctcctccccctcgtagctcacattctcctggagcagcttcgctccctcgccgagctggatgcagggcttgcccacgttggcctcgtccggagcatactggagctggcagtcctcgagctcgagcgtgccaggcacatccgcgcgtcccttgaagaaggagctctgcgagatgccttctgccgtgcagcggacaagatgcagatcgacaagcggacgctcggtctgatagcccttcgccgagccatagtcgtagttgatgaggcggcctggattctcgaagcggcagtcggcgaagcaccagttgcaggcatcctcacggatcgtgtcgcccttgactgcgtagtacttgatagcagcatgcatatgataggtgccttcgaggatatggggatactcgcccggccccttgatgcggcagcgcgtgacaaagaggtttgttgctcccagacggaaggcattgcaggcggtattgagatagcaggagtcgacaagcacattcctcgcatcgaaacctgcaatgcagtcatcaccgcacttgagcatgcagcgcgctatctcgacattcgtgcagtggtggatattgaatccgtcatgtccgccgagcaccgtgacgccttcgaacaagacattcgtgcaggagtccacctgatggctccagttcgcgctgcgcttgaacgtatagccagaaagccggacattgcggcagcggcagatgcgcatgcccatggcgccacggaagccttcttcgcccgcaggatcggtgcagtcgacgccgtcaatcgtggagccctcttcgccggtgattgctacctcttctgcatctgcagctgtgatgagagcgcggatatagtgaggcagaatcccctggatgcgggcaatgaagggatcctgcgcataggcgagagtcgtcggagtgtcccagtcggtatagtcggcgatatctgtgctgcccataaggtgggcaccttcttcgagatggagctccgtatgcccgtagagcctcacagaaccgatatggtaggtgccttcaaggaccgtgacacgcgcgccaccttccccatgcgcgtgatcgagcacctcctggaattcctccgtgaccagtcggtcttcctgtccaagctcctgcggaatcttgagttcgatcatggctcatccttccttgctggtaagctcttcgatcttgcagatgaaatcggtcataacgaaggggcatcgaggtcatgatagacacggattgtgcgtgcttctggtccgccatcctcatagctcccgtcatcagcaatcacgggcgctggcatctcgtcccagcagtccttcatctccgccagaagcacggcaggagctgccatatcaccgaacacccagcttcgtcttagatccaggagtcctttgctgcggcgcatggccttcctgaagcgcaaaacccttctacaaaaatgctcacctaagtgaaccacaaacttcccaccccctgagctgtaatcttggtggacagtgggattcgggactgtcaccagatatgctctgtccaatacccacctaaccaacagcccacagatgaaaagagatggagattgtcgctaagcgtcaagcgagtagagaagggcaaagtccacgcacgaagccggaacacccaaacactacacggaagaagtattgccttgaggctatcgactactacagaggcacgtaagcccaacccgaagaagagctcagaagaatgcgccgcgaagcttgagccaacgacagacctttaaacgactggatcatcagcaactcaaagaccaaaagggttacccggaaaggccgacgagcacagcctcgacgcatgaacagcgcatacccgagctctaaatcggaataagttcctaaattggcagcctttcgccggaagcctctgttgaaggaaggttttagctccatgctgtagaagaggggcaacctatgcgtcctcgatgatgtcaaacgcgtactggagctgagcaggtctcacttctacagatggctcaaggccaaaggcggtgaggacctatggggtcccctcaaggaagcccatctggggtctgcgcgatatgggaggagcgaaaggcgctttagcttcgcaaggtcgatccaagcttcacagagatccaaattacgggcaaattacaggactacccgctatatccctcgtgcgcaggtgcatggctcagcttgggcatcttctcatctgatccaaaaatgcctccaagaggatgacgatatgcccgctacctgatacacccccggcgccccgccctcacccggcgcggcttttcgtgtccttggccgacgccaagctcgtgggcgatacaccctatcgcagacccggcaggctttatatatccatatctcgctcccgtccgcacaaccatctgtggcacacacttgtggtgggctgagcctacaggacaccatgagggcaggccttgtcgtcgttgccctggagaatggcaaatcgggcgatcgtggccagaaaggggcccatatctaacagatgcccaggggcagcccgtaacataagctcaaagctcgccgcctggctcaccgtacccgacgtgaggcatcttccgtggggagaaccggaaagcttgtcacgacaatgcgtcgcccgaatcgttttctcgcacgctcagacgaatggtaccgtatccataagccccttagcgcaccacgaccaatcataaggcacacacgagtttaatcgagtcgtacaacaagacaaaccgcttcctccgcccgcataagtcctaggagaatcgcgtgccccagagggtgatgcagtagttctttctttgagtgttttcgagagaggcccttgtcctacgatcggaggtgatgcagaccgcataaaaaatctgagtttcctctgtcccttagattgacagggctcacgccgcctgcaacaacgcgccgacaggccacctcctcaggccgacctcggcgaggcggacgtgtaaccattgggggcggggcgagctctcccccccggccgcatgaatgggggcgatcgtctctcaagatgaacgccccatcgccgccgcagggataggacctctcaacgctaatacgactggcagaactacttcttcgagagcgacggggacgactgcggccgccctgcgcgggcaaggagcacaggccgctgccgatcgtgcagggatgggactcatgcagacggcaacgggtggccagtggccttcaatctcttcccgggtcccggggaactacccacgacacgcccacgctgatcgacgccctcgccgggaggcgtaacgcgcgccgcgggctggggcgcgtggtcacggtcgccgacagggcatgaactgcgcgccgcaaacataatgccaccttggcccgagggtacgggttcgtggtctcgcagtccgattacgcggcgccagtccgcgccgctctctcaaggattgggtctctttctacttgttctactctttcttgtttacttcgagttcaagatgaagtccgccggacgtgaagctcgtccagggtcccaattgaggactcgcgcggaacggcaaggcccacgaggtcgagtccccggtcctcgtggtggcgttttttggtcgcgcaagtacgggccgagcgcgccctccatgagagggaaaaaagtgtcccccgaatccgagcagcttgtcaaatcccccggcacatacaaaccaaaaaaaaaaggccacccacctcgccgccgccaagtacgtgcgcaacgtcgagttagacgccgaagtggagagaggtgatcgacaatcccaagaagcccgagctcgacctgaaaggcgatagacgagacacgcggcatgcgacgggctactacttgcatcgatcgcccaccctcctagacatcccttttagcccgttcacttcatctacacctaccgggagctttggaggatcgcatgattcgttcaaggtcgaagtcgcacctgagggcgcgtcccgtgttcgtgtggacgagggagcacatccaggcccactcccttcctcacctgctcatagcgctcgcatcgagcgcggtcatcgagcacgcgcttcgggctgggcaccggcactgccggcgggggaaatcctgggcgcccccctcctcctgttccgctttcactcatccttcgctcttatgtcttatttttggcttggcttcctatccagcgcaacggacctcaaccgacgagctctctccctgatcggggaagaggccccgcgcaagtggatgacagcatgtccctcgctcaggccaggcctgttcaaaatggcaaggaagttcgctgaagcccgcgtaaccctacaacagaaaatatacaagggaaaaaggcgggtttaaaaaaaaaaaattaccagtcagaatagtaaaacacctttttaaaactgcaagtcagggtaatgtctgcaacgatgcacacatagatggtgcttcctggttgtactttcaatcccaatctgcatagctgtgctcgacaggggctctttgcagggtgtcctgttgggatatattgacgtcgaaacgcaacccgcaagatcttcccggcggggcttgcgcccttacgatttggtcgtcccttggcggcacgcctaccgcgacgatgggggactacacatgacatacgccgacagctccaaggctagctcgcctcgaggcctcgcagaaaagagcgcaggcggcatattgccgagcgtcca

SEQ ID NO: 333 - DNA, 39577 bp, Unknown
  Metagenome-assembled genome
atgcagtaatagacaagataaatacctgacagcatctggaggaagctgtgatcactgtaaggtttaagccatccgcgtccatcctatgttggcactggaaacagaaatccacgcttttagatcgcagggctcacggcaaaaccattagcctgttggtagccaatccccgtataacagagtggccacatgccgggaactgttaaatcagagctctttccagatgctgtcagagaaacacaaatgtggctagccagggggggaaaatttcctgaaattgcctcttgacaacggtcacttcataacaggaaggtgtgctcaaaatgatgaatttcaaggacaagaacgatgcttacgtcctctccaatggagttcgtattccctgcatcggatatggaacttataagacgccggcagatgacacagggaaagcagcagttctctccgctctgtcattgggctttcgacacattgatacggctacttcgtatcacaatgaggagatggttggacaagcgatagcggagagtggcattccacgcagcagtctttttatcaccagcaagctttggaatgatgaccaaggctatgaagaaacgcttgctgcatttgagcgcagctgcagatggcttgggacagattatctggatctctatctgattcattggcctatatgcccaggatatcaggacaattggcatgaaagggtctggggtacctggaaagcattcgagaagctttattctgatggcgtgattcgcgccataggtgtcagcaatttccttcctcaccatcttgatgcgctggctcagaaagctactcagaaagctaatgtcttgccgatggtagatcagcttgaacttaatccgtcataccagcaacgaggagcagtgcgatactgccaagagcacaacattcagctcgaagcctgggcacccctggtgcgaggcaaagcattctcgaatcagcaactgaaagacatcgctgaccgtcagggcaaggatgttggccaagtatgtgtcagatggtccctccagaagggattcctgcccttgccgaaatctattcatccagaacgagtcaaatcgaatgctgaagtctttgacttttcgctgagtgacgaagagatggcaatgctcgatgcaatgaatacaacgaccgaatataccttccatccagattattgcgacgagtggttcaaatgacatgtgcgataatctgagcgacatgcgctcaattctatggaggtatcctgatgagccgtcagcagaacaaaatgctagccgatgaacggcgagccaggattatggaagagcttgaacataaatccaccgttctcgttgctgatctttgcaagaaatttgatgtgtcagaagtgaccgtcagaagtgacctgaagaagcttgaagatgcagggaagcttcgcaggacacgtggtggtgccgtctcaataatgcgtaccatcacaatttcttatcctgatcagcgcatgaatgttaattcggctgcaaagcgagcaattgcttcaaaagctgctgagctcatatccgatggcgaatctctgatggtggatacaggtacgacgactttcgaatttgttcgagctcttaccgataaacgagatatcactattgtgaccagcgatctttctattgcgacatatgcagattcgaatcttccacatgcagatgtaatttgccttggtggtcacttacggaagaaccatcgctatatcacaggcatgatgacactcagaaatctgtcagagatattcgcggataaagccatacttgcaacagatgcctatactcccggcaaaggcttcacgactgagttcatgggaaacgccgaggtcaagcgtggctttttggcacaggcgagagatcgaatcatgcttatggatgcatcgaaggtgagagcgcctcgcttcgtcaaatttggtgacatcagcgacttcgataccgttgtgatggactacgatccagaaggtaaagttgcggagacaataaagtcctcatgtgcacagaccaggcttgagctcattgataaagacctcatcgttggaagagatgttgatagcgatataggtagagagcgcaccaagtttattgaagactaaagtcccgtatgtgatttttactgacattggggttttctatgcgctacaaatactgcgaaaatatggccatgcaactttcctctctcggcgtaggtacctggtccatggcaggaaggaatgcctatgggctcgtcttcggaagagccgacgaagcacgccccatcgagacgctgcgcgcgcttctcgatgaaggcgtcaacgtgatcgatacggcaccgatctatgggatggactctgctgcagagaagcttgtcgggaaggcgcttcaggatgactaccgcgagaaggtattccttgtcacgaagttcggcgactactgcaatgccaagactggtgcacgcgagatagacgattccagggaagacatcctgtgcgagatagaagggtcgctcgagcggctcaagaccgaccatatcgacctctacctcatgcactatcccgacgagaaggcccctgtgaaggagaccatggatacgctgaacactcttctggaagagggaaagatctcccatatcggcgttagcaatgtcagcgtccccgagctcgaggaatgcatgcgctatgcgaagatcgatgccgtggagctcaggtactccatggtggacaggcagtgcgaagaggccatgaagtgggcacacggcaagggcctggcgacgctcacatacggaacgcttggtggtggcatcctgaccggcgccttcaggacgcttcctcacttcgaggagaaggatatccgctatacgttctataccggcttcaaggagcccctgttctcgaaggtgcagaagctgctttccgatatggatacggttgccgtgaagcatggacgtccggtctcccaggtggtgcttgcctggacgatgcagaaggagttcgtgacgacggctcttgtgggatgctcctcccccaagagggcgcatgagaactgcgatgccacgacgcttgggctcactgcagacgagatttccttccttgacagctccatagagcgcaatctgtcctagggaaacgatgattaattcgactcgatgaggccagtggggccacacgctgtatgccgccggctcaaaatgtctcgaaccacgcagtgcccatacccacatagatgcctatctgtcttctggatatggtatagctacattcacacattccagcatatccaaaaggaagatatggacagccagatgagcttttaggaccttaaatcctaaggtctgaggagaaagactgggcgagaggcattcctggagcaaatggatgtaatcgttgtgtgggatagctggattgcactagtgaaacccagctaccactgacaggctcttgtcaggcatgtgcgcgctgcaaagacgaagctttaggatgtatcctgctttaggttatgtttgctctcttaagacgaggggaacttaaagatgctatcctggattgtcgctcctggcagcgcttctgtgcacgcagacctcatgcaagcgcaggtgccagatgcaacgacacttgcgaaattccgtcatagtctcgagcggcagggactcggcaaggcttgtgctttgcgcctgaacttaaagcttgaaaaggcagggatcacggcgcggggtggctccatggtggatgcgaccttcacctgggcccttaaagcttaacgaagaacaaggaccatgcgcgcgacccttaaagcgcaccagtccaagaaagggggagcctgtcgtatctgatacaaggcgcatatcggcgtggatgccgcaggtggccttgtgcatggtgtaaagacgatcgcctagaatgtatctgacatatcctgtggcacacacactcgtaagggaagatgacaggttctgctgcgcagactttaggctatataggtatagcgaagcgcccttaaggacgcataaagacccacacctctcatctatgcgctaaagcgttgctaaggaagccttcgactagagagggccttgcctgtgcgctcttgtccgagaagggcatcgagtccaggaaggcctccggccgcttaaaggtagagcatcccttccttatcgtgaagcggcgcttcggccccttaaggaagcgctactaggggatagagaagacctcctgtatgctcaagtctctctcgcccttgcaaaccttatccatgtgcatcttttgccggcaggctgcacctcccggctctcagagtcgcttgatccgtcttggagtctctgccgaatgcggtgcatgcggcaggacagatgtaaggatagcggctcctgcacgtgctggatgagcatccttccctgcctttcccgcataccgaccgcgaaaagtcgtgtggccgatcccctctgacacgtcatgggcattaatcatcgcttccctagcgtacaaggctgtttggacctgctctggccccgcttcgttttggcgatgggcccggaagctcagacggaggggcccgctaggcttgaaatcataggcaggtaccatacgggttctgcatagggaggatggcatgggggctccaaggagaaagatgtgcgcgaggctgacaagcgcttcaggggccggctgtgctgccgagggaggggaggttccggcagggcgccaccgtcgtctgcgatggagaagctgtagtttccgtccataaccgctgtgagctcgaccatgatccctctgtctatgcggagttctgtgcgacggtagaagcggctggaaagctcgggtgctggtacctttcgggctgcgtggtctatgtgacgtttgagccttacctcatgtgtgcagggcttatggtgaactctcgtatcgaccgctgcgtctatggggtatcggaccccaaagcggggctccgggaacgctctttgatgtgagtcacgatctgcgcctgaaccatgagttcgaggccacgccagggatcttggcagatgagtcggctgcacttcccgaggagttcttccagaccaggcgtgctgttaggaaggcagaaaagtgtgcagctacacgacctgtaacgtcaggaagtccagatagtgggtgtccggcatcccccagagaatcggatggtccggagcctgctgcctgagctcgatctgcttgagctgcacgttcgcattgcgcgctgcttcagcaactacctcttccaagagccttgttgtcatgaacctcgaacatgagcaggtggccagatagcctccgcggggaagaaggcgcatggcccactcgttgatctcgcggtagcccttctttgcgtgtgccacggcagagcggctcttcgtgaaggcaggaggatcaaggatgatgaggtcgaagggacctccctcctccttgaggcgcgccttgctcttcacaagctcgggcaggtactccatgacgttcgcgcaggtgaagtccattttatcctcgaggtggttgagctttgcattctcgcgggcaagcgagatggcagtgtcggagatatcgatgcagcgcacgaactctgctcctcctgctgcagcattgagtccgaaggggcctacatggctgaagcagtcgaggacatgcctgccctgcgcgagctccctcacagccctgcggttgtacttttggtcgaggaagaagccagtcttctggctgttctctatatcgaggtcgaagagaaggccgttctcctgtgccatgacccgtgtgctctcgggggcaggctgtcccggctctagccaccagcccttgtggaggccgagcccctcgagcctccttacaggagaatctgcacgctcgtagatgccgcggatcttctgaccatcagaacgtactacatcgaggatgagggggaagagcatctccttcctcatctccatgccatacgtccccacctgtgccacgagcacatcctcgtagcggtcgacgatgaggcctgggactccgtcagcctcgctaaagaggatgcggcagcagtttgtgtcaggctcgacacctggcaaggacctgtttcccatgacagctttcctgtgttcccaggcccagaggatgcgccgcctccagaagtcctcgtcgaagtggtcgttcgcgttcctcgagagcacgcgtacgcggatcttggactcttcggaaagaaggccagccccctgccaggtaccgttctcctcgaagaggtcgacgatatcgccatttttgactgcacgcccgtcagttgcgggctcgagagatttgacctctccctcgaagacccagagatagccctgggagagcatgcgtgcggccttcttcgtgatatatgcctttggataaggtcgtgcctgtttcatggggtagtactccttatatacttcagatcagcactcgaacttgtccacggtgtcggtggcgtgggcgtggagctgctttacagtagcggggatgtccttgaagtggtatggcatcatctggtagactcggatgagccagttccggtggaggaggttggcatgggctctccaggtggggcgtggctggtaggtaggatcgtctcccgggaagtagttcacgggcagcttgagcggctttcctgcattcgtatcacgccagtattcgtctgccagtgtacccctgccgcactcgaagtgtcccgtgaggtagatttcatggaagtcgagcgtcgcaatgatcgcaggtccgctcgtgatgccttccgagagtacctggagctcgggatggagcctgagctctgcctcgtcgagcatcgcgtgccgggagtgcggcatgtagaggagctcgtcgaagccgttcgtcaagaagttgtactcgtcgcagagcctctgtgagaagacaccgaagagcttctccggcggatcgctttcgtggacgccatacttgtagcagagctttgccatcgcgccccagcagagacgcatcatcgagggcacaggggtatctgtccagtcgaagatttctgtgaactcttgccagtagtccatatcctcgaagggcatctgctcgacgggtgtgcttgtgacgataaggccatcgtagttgttggccttcaaggtagcgaacgtctcatagaacttcacgaggtggtctctcgagtgcgtaacttcatggctcgagacacgcataaagttgaggcttacctgcagaggggacttcgagatgaggcgcaggatctgcatctcgatctcgatctttgtcggcataaggttcaggagcatgacatgaagtgggcggatctgctgggaggcagccactttctcttcgagggcaaagaagtactcgttgtgcggtatcttctttgtgggcaggccgtcagggatgttgataggcatgggtatccccagatttctttttcagggatgtgcggcagcgctccatgcgcccaaggggctagaagccctgcattcggtagaagagcgtcttcgggaagcttcccattgcgcgcatcccttctgaagtccaattgcgtatatgtggctagcgtaacacggattgaaagatgagttggcgttgaggtacggcaaacccacgtcaatactacagctcggttgccgctggccgtatcaaggggtaagcgacttctccaatacgctacgctgatgaagtttggagcttgcgctccataaaggctgaaacgtccatcgagggagcagggcagctgtgaccgtcgtagacatgttgtggcacaatgccacagcataccccgacgagtgtgctcttgtcgaggtgaattcggagaaatggctgagtacctccagcatagttaggctccctgaactgtaagcggcttaggcaagatcgaaggcatcttcggctggactgtcgcgctggctgcgatgccaaagagcaagacatggatgaggcacatctcgtgcagcagctccatgcagccatccccttacatccctgtggctgtatctttagctgaacgagtccgcaaggagtgcatgtgggccttgggaaggccatagaaggcgccttccacgtaggccttgaagttggatatcaccctgtggaccatgggaagggatgcatccccgtccgctctgtcgtactccctttagacgagcccgcaaaacgaggagaggccggcaagctttgccgctccagccatccgcccttatcttcgatgtatggcagagctggtcatgccccacctggcgccagcaatctttcgagcacccctttgcgcagcgcagggggcaggagctctgcctgccgctgtaagcatcggctgctgctttgtgccgcgcccgcttttgcctggtgccttggcgccgatatagaagtcgtccacctcgtgtgtgtcagctgcaaggacgctgaacgcactgcgatctgacccaggcgagtatatccttaaaaggacccgccctgccgtctttaagctgcagcctatctgccttctgcagggcgcaggcgctgatccttgccttctgggcggacatgagccatatcgcctacgaaccacttcctgagctcgaggtgggtcccctccatcaatagtccctgcgctcacgctcacctggtgcgagcacttcgtgcactgccacttgtgcgcgcggcctcagaccttcgagcaggacgtattggcacatacggggcagacaaagccgccggaaaccttctcctcgataagcctcccctcgcacgactcctcgtctgagaacctcttcagaaggcccatcaatgtctctttgctctcgcattcgcgcctactcagagcgcctgcatgcccctttgccatctctttctttgccctctcggatgcatcaaccttgcatcctcattgtacggtttggaggcgacaggaactcctgcggttatgctgggggtcctcagtcattttttaagattagcgccgacgacgcgatagaccaggcggttttgtgagtcgatgcgtcttgaccagaacccagaaagatcgcctcgtagctgttcaggctttcctgtgcccgaggacacgccattgcgttcgatatccttcacgagagcgtttatccgcctgagcgtcttcttgtcctgcgcctgccaccatatgtagtcaccccaggcttctggggcccagactttattcagcgccatcgtctgctgccagttcatggacgatgctgtggcctgcatcgaggtctgcctttgcctggcgaaggtgtgcctggttcttatccgagtagaagggatctaccgatacctcaaaggggatgcggtgctcgcgtgccacctttctcgcatagatcacgaacgctgtggtcatgctcatgcccagatcacggcaagtctcttccataccctttttggtctttgggtccatacggatatttaccattactgtagacgccatattctcacccccaaatagagcataatgctttacatatgctatagtatacccatacaaacgccaacatagtggtaatgttgctctgtagtttggtgggcgaatcctcagagcaagtgcaacgactggtgatggtagacctcccagggacacttccatttcagacacttgcgcggtcttcggttgagcgaatcgtacacctcctgcaccttcctgtcgtcgacatcgtcgaggctttagtccttcgaaaaccagtccctgagaagaccgttggtgttctcattggtccctctctcagagatggtggggatggcagaagtatacgggagcccccagtgcctcctggagcccttctgcatctaagaactccttgcccctgtcgagcgtgacggtcagcacgacctcgccggcaaacaccttctctgtggcatcgttgacctcggccctggccttcctggccgccttgccgccgacaagatatccgctcaggcgatccacctgggtgataaggcaggcgccttcctgccacagtatcgccctcccagtcgccgatccgtctcctgccgaaagcctcttctgaccgcttcgagatgtcgtgggtgatgcgcagcttgcctgtgcgcttttggccactcttgctgtgtctgcacttgccgtgacgagtgagcagccttgtggccttcctgcgccctgaaagctcgcagtcgaggggtcccgactccacgacacgctagatgctagggaaacgatgattaatgccccataacgtgtcagaggggaccgaccacacgacttttctaggccggtatgcaggaaaggcagggaaggatgtccatccagcatgtacagaagccgccgtccttacatctatcccgtcccatgcaccgcaagaaggctccaagacggatcaagcgaagctgggagccgggaggtgcagcctgccggcaaaagatgcacatgggtaaggtttgcaagggcgaagcagacatagagcatacaggaggtcttctctatcccctagtagcgcttccttaaggggtcgaagcgccgcttcacgataaggaagggatgctctacctttgagcgaacggatgccttcctggactcgatgcccttctcggaaaagagcgcacaggcaaggccctctctagtcgaaggcttccttagcaacgctttagcgcatagatgagaggtgtgggtctttatgcgtccttaagggcgcttcgctatacctatatagcctaaagtctgcgcagcagaacctgtcatcttcccttacgagtacgtgtacctgggatatgtcggatacattctaggcaatcgtctctacagcatgtacaaggccgctaccggcatccacgccgatatgcgccttgtatcagatacgccaggctctctctttcttggactggtgcgccttaagggtcgcgtgtgtggtccttgttcttcgttaagctttagggcccaggtgaaggtcacatccaccatggagccgccccgccccgtgatccctgccttttcaagcttttaagtccaggcgtaaagcacaagccttaccgaactcctctcgcttgaaggctatggcgcatcttcgcaagtgtcgttgcatctggcacctgcgcttgcatgaggtctaggcgcacagaaacgctgccaggatcgacaatccaggatagcatccttaggttctctcgtcttaagagagcaaacatgacctaaagcaggatacatcctaaagctttgtctttgcagcgcacacatgcctgacaagagcctgtccgtggtagctggtatctaccagtgcaatccagctatcccacacaacgatcgcatccatccgctccaggaatgctcctcgcccagtctttctccttttaccttaggatttaaggtcctaaaagctcatctgtctgtccatatctgccttttggatatgctggaatacgttgctgtagctataccatatccagaaggcagataggcatctatgtgggtatgggtactgcgtggtccgagacattttgagccgatgtcatacagcatgtggccccagcgacctcatcgaagcgaattaatcagcgtttccctagatcgtggtgtcgctcacggcaaggtccggacgctccatcgcgatgcggcctgctatctcctacggggaccagtgctcgcccgtatgagccccacgaccagagagcgcctcttctggattgtccatgagatctgggggcctgcagcgcagccgccttacatccgcatgcctctgcacgctcgatgcgcggcagggccgtccggaaggcccctgccatccgttgcgcctgatcttgtgggatatggtcgacttgtcccgtccgagctccctcgtatctggctgaccctctcatggcccttccagcaaaccatgatgtcctcgcgcttcgcgatgctaagatggctgtggctgtccatggtgcctgcaatgatgcatgtctttgcaagcaccatcataggtcacgcctgggcggctagcttgtatttccctgttgcactcgaagtgtagattcgccaatgtttcatcaccgatatttatgttgacaaagataatgcgaggtaatataaagtcatataacgtaatataacaacaaggaggtatagacaggatgaagcaggaacacatgcagcagatagcggcagctcgtcaggcgatcgaaggccgcatgaaggaggggaagatatcgcgcatctatttcgtggcatgtggcggttcacaggcagtcatgatgtcagctcagtacatgtttgaccgtgagttgaatatcccgtctgctacctacacatccaatgagtttaactacggtacgccgaaggcatttgacgcaagctcgatcgttatcacaatctcgcattctgggacgacactggaaaccgttgcagctgctcaacgtgctaccgatagcggtgcactttcgattgcattcagcaatgttgtcaattctccgctttggagagctgcaggatatcctatccattatgatcacggcgaggaagctgacgaggtcgacaagggaggaaccgtcgagctcagggcatggttcgaattcctgaaagcgctggatccgcagaatgttgcccgttggcaggctgcttcagatgcagtcgagagccttcctgacctcaaggcgaaagctgcagaactgtatcgtaccaagtgcacagaatatgcagacaggacaaaacgcgagaagcttatctataccatgggctctggcgcaaactacggtgagatgtattcgcttgctatctgctggctcatggagatgcaatgggtcaattctaactgcattcattcgggagagtatttccatggtccctttgaagtgacggactttgatgtcccctttattatttcagtcggaaatggcgctactcgccatcttgatgaacgtgcactggcttttgccagcgagttctccaaggaactccttgtgattgatgagcgggacttcgactattctggtgtgcccgaaaatgtgcaggaatactttgcgcctgagctgcttggcgctgtcatccgcgtgtttgttgaagctcatgcacatgatactggacattcgctttctgcccgtcgctatatgtggcagatggagtactaaagcatactatacagcatgagagtgcgcaaaggagggagggaattgcgatgaagcttatatcggttggcgactgtgtctgcgattgctacctggatgatggaatctactatccaggtggtcaggcagtcaatattgccgtcgacgcacgtcgcgctggtgcggaggcttcagagttcattggaatcttcggcaatgatgacgctgcgcaccatattgagtcttccttgatggaggaaggagtttccaccgggcgctgccggagagccataggcgccactgccatgcctggagttcgcattattgatggcgacagagtgttcttcagaggaaagcgagataccattgcccatctgatgcgcatgaggatttcgcaggaagatctggaccgtattgcaaggttcgatgtctgccacgctaccaatgaagcggggattgacgatgagctcgcccgtatccacggtgtcacttctctttcatatgacttttcaaccgagcacgagcactcgatgctggagaggctctgctccacggttgacatcgccttcttctctggtgcaagcctgcgtgaagaggagtgcgaagagctcgcaagaacggcggaaggcttcggatgcactgttgtgatcgtgacacgtggagctgaaggcagcatttgccttgcaaaagacggcatgcatcatcagggcattgtgagctgcgatgcaatcgatgtgatgggtgctggagattcctttgctgcggcattccttgttcgctatttcgatacgcatgatgtcgatagggcacttgcatttgcagccgaaagagcggccctgacctgtacttaccacggagccttcggccatcctcacccttgcaattaactgttattcaataaattgcccaactgggtaggcggagtctttctgcctgttttcgatagctatttttattgctctgaccaaatgatcgttaggctcgttggcggattggagtacaagatgaacttcaagtatggtatacccactatgagtaggcgtgacttcctgaaggcaggctctactgccggtcttgtgtttctgggcgcggggcttgctggatgtggtgacggtacaaaatcgggaacctctgcgaacgtatcagctcagaagacggtgaatattgccgtatcaagtgctgtcatggcgctcgatcctattgttgcaggagattccgtctcgatgggcttaatctcgaactgctgtgaggggctcttcgtcaaggatatcgacaatcagtcggtaaatggcctctgcgacacgtatgaagtgtcggatgaccagatgacgtatacattccacattcgcgatggtgtgaaatggagcaatggcgatcctgtcactgcagctgatttcgtctatgcctggcagcgcaatgccaaggcggagaatggtgctgctgacttccagtaccagatcgaaatggcggccatcaaggactacagtgacgtccttgcaggcacaaaggatgtgagcgagcttggcgtagaggccaaggatggcagcaccatcgtcatgacccttgaacaccctgtgcctttcctgcttgacctgcttgcatttacgccttgggctccggtccagcagaaattccgcgaggacaagggaagcagctttgcgcttacgaaagatgacatgctgtgctgcggcgcttatacgctgacgcaatacgatgtttctggtaataccattacgcttacaaagaatcctgattattgggatgccgtgaacgtcgatgtcgatgtcatcaatctgcaggtcatctcggatacccagcaggcagtcatggcatttgaaaatggcacggtagactatgtgcagctgacgggagaccttgtcaaccagtacaaggatactgatggatttgcaaaagaagcaggcaacttcaactactacctgatgatcaatacgacgcttccgggtctcagcaacctcaatttccgcaaggcaattgcatatgccctgaaccgtgaggatatctgcaacaatgtcttgaaggacggatccactccggtcaatcagatgtgcatggtggggctctttaccaaggaagatggtacagacttcgcagcggcaagcccgcagctctatacatacgacgtggaaaaggcacaagaaacctggaagcaggcgcagcaggagactgatgtgagggaattcacgattctttacgatcaggagaaggacttcgctcagacaacctgcgcctatatacaggacactctgcagaagacattggatggtttgaccattaacctggaatccacgccgaagaagaataggattgcccgggagggaacgcatgatattgaggtttgcttccacgcctggggtcctgactacgccgatcctacagcaattcttgccatgtatgaatctgatcatccttccaactattcgtgctggaagaacgacgagtttgacagcgcctatgagaaggccaacacgactgatgctggcaatgccgatgcgcgctgggatgagcttatgcgttgcaatgagatctgcaccgagcaggcggtctgcatccctatctatcagacaggggctgcaaccattacgcgcagcggcatcgaaggagtgacgcagcatatcactggcattccttgctattacaagttcgtgacttcgaagtagcagtttcactccaataatctgccggatcatgctggcgggcagagcagattgattgctactgctcgctagctattgcagaggggcattgcggtttgccaggagcgttgagcatctcggcataaatgcaaggagggcttcatgacagctagagccataaaacaggagagaaagtctgtcagacgtaatggcatgggacgctatatagtgaaacgactcagcatagcagcgattacgctgttcctcatccttttcatcctgttcttgctgctgtcattcatgccaggatctccattcaacaacgaggagaagctgtcgtccgatcagatagccgcgcttaaggcgtattatgggcttgataagcctctacttgaacggttcttcatctatatcgctaatatgttacatggcgattttggtgtgtcctataacatccagatcaatatgcctatttcggcaatggtcgggcccagaatctggacttccgtctccattggtctcgaagccggtatcttgggagcgcttgttggcctggtgctcggcgttattgcggcactgaaacagcacactggctgggatacagctgcaactatcattgctgttctcggtgtgagcctgccgtcattcgtctttgcgctggcactttcttatttccttggattcaaggcaaagctctttcctctgatcttcgattcaacgcatcccttcatctcgtcagttctgcctgtgatcgcgctttcgatgtttactctcgccagtgtcgagcgctatacgcgttcagaaatggtaagcatcatggaatcggatttcatactgctcgctgaatcgaagggcctttcgagggggaagctcatcctgcatcatgcgctgcgaaacacgcttatcagcgtgataacggtgcttgtcccgctgttggtgagccttatgacaggatcgctagtcatcgagaaggtattctcgattccgggattgggaagcctctatatcactgcaatccagtcgaacgactacaatgtcgtccttgcaatcagcttcatctatagcgtggtgttcattcttgccatgctgctggtcgatgtcttctatgtggttatcgatccacgcatccgtatcactggaggggaatagcgcatggaaaccactaatgacttgttccgactgagcacaacatctcatgaagaggcagacaaccgcgaatatacaaactactcatttgcgagagagaccatcaatcgctttctcgcaaataagggtgcaactgtcgccgttgtcattatctttctgatcattctgctcgctatcatatgccctatgctgagcccctatacctattacgatgtggattcctcccaggcgaacctgcctccacgtatccctggtattgaacagcttggaatctttgatggcacacgcaatgaagtcgactattatgctacttgtgacgctcaagatgcctaccactatttcggtacagattcgctgggacgcgatatctggaccagagtctggtgcggcacgcgcattagcttggccatcgcattggttgctgtcatagtcgatgtggcagtcggagtcgtctatggacttgtgagcggatactttggtggcaaggtcgatctggtcatgcagcgaatctgcgagattctgagctccattccgcagcttgtcatcgtcactctgatgattgtggtgcttcagcctggtctcggcaacattgttatagccctcttcattacaggatggatagacatgagccgcatcgtgcgtgctcaggtgctcaagctcaggaatcaggagtttgtgctggctgcaagaactttgggcgtgaagccgcatgacatcatcctcaaggagatacttcccaatacacttgcgcagattgtagtcaccttcatgttcagcatcccgaacgcaatcttccttgaagccttccttgcgtttgtcggcctgggcgtgccagcacccacagcttcactgggcacgctcatcaatgatggctacaaagcagcgaccatcttcccgtatcaggtagtcgctcctgttgtagtgcttgctgtgctcatgctcggattcaatttgttcggcgatgggcttcgcgacgctatcgatccggaaaggtcgtgacgagcatgggaaatgcacggcagcaggttctgaaaatgcgcgacctcaaagtgtcgttcaagacggcaaatggcatcgtgcatgctgtcagaggtgtcaatctcgatatataccgtggcgaaactgtcgctattgttggggaatcgggctcaggcaaaacagtcactgtcaagcagatcatgggcatcaggtcgcataacgagattgttgagtctggaacgattgagtttacctatacagcagacaatggcagcattaagacagtcgatcttatgaagctttcaaaccgggagcttacatcgctcaaaggctgccatatcgctatggtcttccaagacccgctgacttctctcgatccaactatgaccatcgagcggcagctggcagaaagcatcgtagagcataccgatctgcatggagacaagctgcatgaacgctgtgcggagcttctttctttggtcggtatcactgatgtggaagcacgcttgaagagctatccccatcagctgtcaggtggcatgcgtcagcgtgttgtcattgctgtcgcactgtcctgcaatccagatcttcttatctgcgatgagccgaccactgccttggatgtgaccatccaggcacgcatactcgagttgatactggagctccaaagaaagctcgatatcgcggtcatctttatcacgcacaatctgggtgttgtcgcaaaagtggctgactatgtgaatgtgatgtatgcaggaaaagtcatcgaagccggaacaactgaggatgtctttttcaatcccctgcatccctatacgtgggggctgctgtccagcatgccgtcagttactgccagcagggatgcgcgcctctacaccatcaaaggcaatccgcccaaccttctgaatgagattgtcggagatgcgtttgcaccgcgcaatccctatgcactcgatatcgattttgttcaggaaccacctgcattcaaggtaagcgatacgcattgggcggcgacatggcttcttgatccaagagcgcccagagtcgagatgcctgaacagctgaagcagcgtattgctacgatgcgcagggaaggagagcagtgatgtgcgagacgaagaatgatggcacgaaggccctcctgtccgtacgcgatttgaagcagtatttcgagattcctggtggacacatcgtcaaagcggtcgacggcatctcgtttgatatctacccaggagagacctttgggctggtaggtgagtccggttccggaaaatctacaacgggtcgggcagtgatccggctcgatgacattacatcgggatctatcacgttcgaggggatggatatatcaggcaggctgatgcctgatgtggagcaaaagctccgcactgacatgtcgatggtctttcaggatcccatggcttcgctcaatccctatcacaaggtcatcgataccatagcaactggattggacgctcattttccacatatggatctcaaagaacgggagacgaaagtcttcgagatgatggatcgtgtcggtctttcgcactcgcaggcaaaccgctatcccagccagttctcaggcggacaacgacagagggtcggccttgcgagagccctcattatgaacccgaagcttctcattgccgatgaagccatatcggcacttgatgtctcgatccaggctcaggtcgtcaatctcatgaaagatatccaggaggagacgggaactgcctatctcttcatcgcacacgacctgtctatggtccgctacatttctcagcatattgccgtcatgcatttgggccatatcgtggagcaggggaccactgatgagattttcgggaatcctatccacccctatacaaagtcattgatatcggcaatcccacgtctcaatcccatcactgagcgcatgagaaagcctctctcatatgacaaggatgaccttggtataaaatatgaggagggctgctatcatctggtggctactggacatgctgtactgggtacagatgatgagcttactcaatgggtgaattgaagttcttctctcacgggaggatatgtgaatagcatcaggcaggggcacgagcaggaagcgagatctcataccttcgattccaataccaatgggcttctgtatctccagcttgagacagagctcaagcaggcaattctggatggaaagtacggcgtaggagagcgcatacccacagagcaggaactctgcgatatgtttggcatgagccgcatcacggtacggcgggctgtgcaggaccttgtggaagagggcctcttaaacaaggtccgtggccgtggcacgttcgttgcagtgcccaagcacatactcggtgcacagccagcacctgaacgcggctttggcgatatgtcgagcaccggaagacgaactgttcataaggttcttgagaaaagtgtcgaacatgcagatacagatttgggcaagcttcttgggatagctcctggatccgaggtgtactacatacgtcgtcttatcctcgaagagaacttcccgatggcaattgacaatctctttgtttcggcgaaacgcttccctgatcttcctgatctcctgcatgatgacacgtcgttctatgaacttgtagacgagcactatcagtataagtttgggatggagagtcttacactggatgcctctacggcgcgtggagacgaaggaactctcttaaggtgtcctgtcggatctcccctcttcattttgcgcaagaagatgtactgcgccaatggagtcccgatgcactattcgaagagcatcgtacgggcggacagaatttcatatcacttcgaagtcgatcgtgatggacatgttgtcaaccaaggaaaggagttctctttgacagttggcggatcagccttatagctgtgcctgacctgtgtcaatattccggacggcagatttgagccctgtcaatataatggacagaggaatctcagatttttatggttcagtcataattcctgttgatagataacctcagaggtcatgagaatttcctgctggcatcaatgatcttcaggaagaagtattcatcatccggatagccgtatcctttgcgtctcagtgtcttgatcatctggttggttccttcaactttgccggatgagatatgaactcgtgcatgagagataattcctttcatgtggttcttaagcagcttggcaaaccacatgaaatgcttgttcttagttgctttgcaggtgcgtatgatccggttaatatgaatcttcatgcctctttcggtatttgctttgtatgctttattaagctgttcttctaccagatccatggtgaagaacagcttgttttcatccaacagcttcttgtattcttcttcaattcctgcttttttgcttcacctttggctttttgaacagatcgcttcctttggcaatgattttgcccgctttggcagctttctctttctgcttgctggtctcagtatttgtcatcaggacatatttggagcctttgagagctttggcagcttctgtattgccttcttctatcaggcatctctgttcctctttacggacttttgataccaccttgtcattgaagtttttgatcagatggaaatggtcatagacaatatctagccacccacagcgttccttgaaagcttcttcaaagtcactgttcatatcacaggccacagccttgacgtttttcatccagtcgatgccgatccagtcaataaagtcatatacagtctgtttcttcttgccacaggcaaggtagagcacatcttagctcttcatgtccatgatcaacgtagcgcatctatggcctttatgaagaaggaattcatcaatgccaagatactttgagtattctgtaggcttcttcagttccttaccttcaccgttaacggtatacaggccctgaagacgcttcttatcgattcccttgacgctattcttgcttaaaccggcaatgatggatagttccttcattgtcagtccaaagtaaagcagatcgcatgtatagttctcaagagcagctctaatcagatgtccctgagccttgaaatctacgggttctgtataagtgctgagcgcacagttcttattctggcagagtgctctttgcttggatacaacgatgtgagtatagatacctcccatagcaatgtgtttcaagtcaacctcgactgtgccgttatacaccgtctcctggccacagaagctgcactagatcggctgtttgttcagacgattcagctttcccttaaagaagtattcagtgactttgcgcttggcaggtctagatgatgtgcccacagagatctctttaacggccatctccggcataccaacctgggtaaaggagggcagacctgatgagaatgttaaaatgccactgtggagctgtatatcagaaattgaatcaatcagatcataggtatcagcacgaagatcttctgatcttgtattaagcaattctccctgaataagcggctgtgtgttaacagtgatatggatctcctattttgtatgtttggtcacacacaattatacgagattcatttttatattcgtactatatctctgtcccacatggcgtcatatcaacaggttttgggattgagccataagaaatgttgctcggcttaataagagactcgctgttagaccataattgacctaagcagggcccaaaagtgtccgggcctttgcctacaatgcatgtcgtcaaacaaagacatcgaggatcgaagggcccggatggatccaatgatactgcagcagatcgcaaagatggggatcgccgataagcgcgctcctggagagaggctgaaggcgctcatagccaagaagatggcaggctctgcccttgcgggaacacccaagaggtgcccgaggtgcaaatcggttagcttctactgcaagggctacgacgcgcatggctcccagagatggaagtgttgctcgtgaggcaagaccttctttgtaaagacaagatctgtcctggccatgtccaagcccacggccgccacatgggccgcatatgcaaagggcacgcttgcaggcatgacgcttaaaggagcttacggaaagctgccctgtgagccttaaggacattgtggtttcatgtgcatgaggctcttcgaggtgatgcaggcagcgcttggcgccttcaggtatggacccaccgtctcctgccaaaagatcgggatctacatcgacgagtcgcttgcaggcaacagggataaggtcggccatccagatgctgagaaaggcgcacacgcacggccatgttgtgcattgctgtggcatatcgaacaagaaggtctgcgtggagggctgcgcaaatgacctaggagacgaatatgccatcctctgcggcaggggcaggcccgaggacgggaagctgacagatgccctttcaggtatcgtcgacagcttatgggtcgccactgacgaccatgcaggatatgcgcgcgtggctctcctcgcttggggtcttcaagcacacggcgagcttagcctcgtcaatgcgatgcagcgaaggctgcgcgagttcctgcttttcttccatggggtcttctacgaagtggctggggcacttgtcttgcctgcttcctgtggatagagcaggtaaggcattctgagcgggagaagaaggatatactctcaggcaagcttgcaggaggcaggtatgttccataccaggcgtgcgctcatagacatggagcagcccttctggagctattggaaggacaggggcgccaggtcaatcatggtctaacagcgagataagagaagggattccgtcctagccgcggaatcccttctcttattcacaacgcttaggctactggattaagaccagctactactgcccctgctcggcgtacttgcgctcggtggcctccttggcagggcgccaccactcctcgtgctcgcggtaccactctatggtctgggcaagaccttccgcaaagtcagtgtggacaggcctccagccgagctctcgctccagcttcgtcgggtcgatagcgtatctcctgtcgtggccagggcggtcacgcacccagtcgaaggtatcctccgtctggcccatgagggagagaatctcgcgcaggacctctatgttgctcttctcaccgttggcacctatgaggtaggtctcgccgatggtgcccttcgtgaggatatcccagacggcgcgggagtggtcctcggtatgtatccagtcgcgtacgttctcgcccgtgccgtagagcttgggacgtatcccgcagaggatgtttgtgacctggcgtggtatgaacttctccacatgttggtagggcccgtagttgttggagcaattagagattgtagcgcggatcccgtaggtcctctcccaggcacggaccaagaggtcggaagatgcctttgtggaggaatacggcgagctcggcctgtacggatcgtccggctcgaagcgacgcgactcatcgagtgccaaatccccatacacctcgtccgtgctgatgtggtggtagcgaacatcgtacttccttgccgcctgcagcagcctgtaggtccccacgacatttgtctgcacgaagggctcagggtctgctattgagttgtcgttgtgagactccgccgcatagtggacgatcgcatcgtgtccggggaccacctggtccagcagctctgcatcacagatgtcgcccacgacgagctccacctgcgatttaggaagtcccgcaatgtttgcagggttccctgcataggtgagcttgtccaaaaccgtgatgtggcactccggatggttcctcgccacccagcgcacaaagttggagcctatgaagccgcagccgcccgtaacgacgatatttgtcggctcgaagatatctggcatctagccttcctccttctgaagcgtgtccatgtactgcgcgagctcttcctcccagtcgggcatgtggaagcctgcagcctcgagcttggcgagcgaaagggcggagtgcaccggcctgggggctatgggtcccttagcagatgcgtagtattccttggtggagacgggcacaacagcactgccgttgccgtgcctctgctggaagacggcacgtgctatgtccgcccagctcttcacagcccccgatcctgtgcagccgtagatgccatatgccgcatggatgtccagaagatggaagatagctgctgccatgtcacgtgtgaaggtgagccttcccagctggtcgtccacgacggtgacgtggtcaagagcgtcatcggggtctgcgcacctgtcggagagcgaagccatagtcttcacaaagttgtgaccgtcccctatgacccaagagctcctcaggatatagtgcttcgggcaccctgcgacggcgagatctcctgctgccttggactgaccatagacggaaagcgggctgaagggctcgtcttccgtatggagctccttcgtcccgtcgaagacgtagtcggaggagatgtgaacgagcacgatgccatgctctgcgcaggtgcgtgtgagcagggccgggccctgggcgttggccttccagcacaggacgcggccttccgcagtctcggctttgtcgacagccgtccaggcaccgcagttgatcacggtgccatagaggtcccagtcgtacttggagtaggaagaaggatccgagaagtcgaaggtatcgatgtcgcagaagtcgaaggaggagaggaggcccctgctctcggcgagcctcctcacggcgcgtcccagctgcccgttgcagcccgtgacgagcgtcctcttcggagccatcggcacgacgtccttgagatacggatggtggaggtcggccccggagagcgtagctttagagagcgggatcggccactggatatcgagctccggatccgcaaggttcacgaaggtgtaggtcttcttgagctccgccgaccagtgcgcatcgacgaggtaggtgtaggccgtgccgtcctccaaggcctggaaggagttgccgacgcctctcgggacatagatggcacgcgacgggtcgagcgtcgtggtatagaccttcccgaaggtggcagagccctgccggaggtccacccatgcgccgaagaccgatcccgtggcgacggagatgaacttgttccatggctccgcatggatgccgcgagtcacgcccctctccgcgttgaaggagatgttgttctgcaccacgtggaggtcggggatgccgagcgccaccatcttggccctctgccagttctccttaaaccagcctctcgagtctccatgcacggagagctccacgaccttgaggccgtctatgccagtcttctggacttccagattcttttcgaattcgaaatcggacattatctccttggcctttccgctaggatcgtcccactggcgacttccttcagatgctgtccgtataccgacttgccatagtgctccgcggcatccatcagaatacctctatcaatccaaccgttctcgtaggcgatctcctcaggcacagacactggcagatcctgcgcacgttcgacactcctgacgaactctcccgcctcgtagagcgactccatggtaccagtgtcgagccaggcgtatcctcgcccgagtgtcacgacagagagggaaccatcctccagatacatctggttgagggaggtgatctcaagctctccacgtgctgagggcctgacctgctccgccatctcgcagacgcgcaagtcatagaagtagaggccggtcacagcataggaactcttcggatgctcaggcttctcctcgatggatatagcattgaagtcctcgtcaaactccacgacgccgaagcgctcggggtcgtccacatggtagccgaagaccgtggaaccatcaccgcgctccgcacgctctgccgcacggcgcaagtgtctcgagaggccgttgccgtagaagatattgtcgcccagcacaagcgcacaaggtccaccgttaatgaactccctgccaataataaaagcctgtgcaaggccatcaggagagggctgctcggcataggaaaggctgattccgaactgcgagccatctcccagaagcctcttgaagtttggcagatcatggggtgtcgagataatcaggatatcccgtatgccggcaagcatgagggtcgagagcggatagtagaccatcggcttgtcataaactggtaggagctgcttgctcgtgacgctcgtgagcgggtagagcctcgttccgctgcctcccgccagaatgattcccttcaacatctgccaccttacgcattgtttctacgtcgataacttgagtctaagcaagcataaactagtaaacccgcatcatatacaacatgagcatacaagcatattgcttctctagggaaacgatgattaatgtctatgccggccgcaaaaggccacgtggctggtcctttctgacacatcattgggaattaatcatcgtttccctagacagccggttctaggttcttcttgtactgcattggacacattctagtaagtcattacttcggtgttggatccttgtgatatgtggcatagggggagctaaaaatatagttcatggctccactccaccttggacgggacaaagcgttagctccggcttttatgacaccgcaatgccccttttgagcagttcggctcattcacattaatgatgagcccaagactcccttctgaactcccgaacccgaatgtttataagacatagacagactcagatatcatcattagatattagatagatagtatattgtcatgcaagtattatacatatttattatataataaaagcttcccaatccgatgtactatacaaagtacctgatagttagcggctttctcgggtcagatgccggttgaatggcaagaaaacgcatagaatcaggcaattttgtggctaaaatgtcctcagatccttgacaaatttcgccataaatcccttaatatatagtactgtatatgatataatgtactatatataggagagggtattatggcagttccaaagtacatccgcgaggtaccaagaccggtcaataccgttgtcattgataacggaaaggatggcccgactcgctacgcagtgcgtgaacgcaagggcgttcagtatgtctccggcggcaacccccagcctcagaacggacgggtgatcgggcacatcgtcgatggtgtttatgtgccgaagtcacgagtcgttacggatgcggtagcgactatgctttcttacggttccgtcgcatttgtccattcggtatcatctgatctgatgaccgaactgcttcaggtttacaatgtcaaagatgcttatcgcattatggcgatcgcgatgctccgggttgtaaagccaaaagtaactgacggacggcttggcacgcactatcgcaggacatatgtttcaaagtattatccaggcgtagcgctgtccccaaacagtgtctgcaatttcatgcaacatctcggccaggcaggcaaacagcggaaagctttttaccagctccgcatggcaaaggtgatcgccaatcatcatatcgccatagacggaaccctgaagcaggataccagcgcggttaatgatctttccgcattctcctataaggcgaagaagaaaggctgccaggaagtctccgttctctatgcttatgacattgagaccacagaaccgatctgtgccgaagtattcccgggaaacagcacagatgccgcatcataccgctcatttatccgggataatgacatccggcgtggcattatcgttgcagataagggatttcctccaagcagtatcaaggaagaattatcggaacgtcctgatctgcatttcctgacgccgatcaaacggaacgatacccgcattgccaaaaacaggatgctggaattcgacagcgtcataacaggcgttaatgaccatgtcgtatataagaaagcagcgatcaaaggtggcaggtacctctacgcttataagtcctccaacaaggcaagagcggaagaagccgcatatctctcccgaagagaaaagaagcaggacttcacttcggaaggctatgccaagaagaaggaattgtttggtgttatcgtattcgagtcggatcaagatctcgatccgaaaacagcttactcctgctatgacgaccgctggctacttgaacttgtattcaacaggtacaagagcgatgaatgtcttgataaaactaatgtgcagggcgacttctcagttatcggatcggagtttgtaaacttcatctcaaccgttattacttgcaggttaatcaagaaagcacgtaaagccggattgctcaatgaggtgtcatatggtgatctcatggacgacctcgcttctgcatggcgggaagtcgacgcacctgacagcctacctgagaccggagacaagtattgggtacatacgttaaaaacggtcttcgaagagttggagacccttggtttatcaaaacccattccaaagccggggcccaagaaaaggggggcggccgagaaaggatccggttgacgagaagccgaagcgtaaacgcggcaggccgaggagaaagccatgatcacgcggtgcctatagtaccgcagtttgggaaactcttaatataatatacattcctgttatcctaaggtaggctttaagtccggaaagtccggacctccttgatttttgcaaggatcacacccttcttggctgcaagcaggaccactattgcaatgagtgcggtatagcgggcaataggatatgcatatataccagaaaagactattgaagcaatagtaagaaatatcgccataatccatatcgctttgccatttaaaatacgaagtcctgttttctccttagcaatacgctgggcaaagtaataatggttgatagcgagagctatatagcagacgagggttgtatatccggctacccggtaaccaaaaatggggataaagattgcattaagcactacgtttagcgccgcagcaacaatcgacgccacagtagcaatctttgtctcctcgtagaagaactctatattggaacaataagaataaaggtagataaagaatacgctcgccgctatcacaggaactagctccatcgcctcgccgtatttagcaggagcaagaatagctacgacatcgggagcaagtgcatccataagcagtattgcaacagccagaaaacccaagatctctagtccagtcctgttaactggagaataatccttcgaatcgagcttacgatatagccacggtatcactgtattgtttaaagaaccagtcagaatcgccatgagcatgcccgccgagtaagcgatgctatatatgcctgcttcagatgcgctacaaaactgacctatcataatgcggtcagacgaattgagcaaaacctcagagagataatggggcagcaaaggaatgttgaatgtaagcgtaaatttccaataattccagcaaaatagcctcttactgcggcgtaggatagctccccctagagctattgccatggcaagatatataaggatagaagacactatgcgggcaagaaccttatcctgagcaatgacgacaacgggaataccgagagcaggtacacctacagcaagaacaaccgcagctgccaccacttttttatactcgaagtcataacgcgcacggcaggcccatacgtcatagatttctgaagcaacgacctcaaccaacataagaagtatgtaggaatcaggcatccccataaatgccgaggcctgatcatgaaaaagcacggcgattaccgcccaggcagcacccatcgtacatatgagacccatgacagatgtggtgtatccctctcggtcataagggtaacggaccatcccgttgttaaaccctccgtaagccacaccgagcgtcactacatatacaaagatgctctcccagctctgatagacactgaaagacccatactcatccgttgtgagcaatcgcgtaaaaataggcacagttatgaaggagatgcccctcaagataaacccacttagggttatccacagagcagcgcgcctcacctgtgaaaggcctgcgtatttgtctttgagcttattgataattgatgccatgttctacatttcgacgagtattcccgggatatcaattgaaccattaaacatacttggtcgatcataaagaagaccttcatggagtcgcgacctagtcttttcattcagaaggacaccagctgcttcacttcacgcataaaccgtatcgtcaatccatatgaaaagcaagagggtcttcttattggaaggcgagtgaattctgccagcacgtacagcggccactgatgatcgatttccaatggcggattagcattctaagtgcaacacgatagcccgctgaatgtaagcgtggcacactccggaaggctacgatgttggttggctcaatcaacgtcgaaagctagaaggaatgtgccactacaagcatcttagcccacaggagaaagaccgcatagccgagctgtgtggcacaagggaaggtcaatcggctatatcgcggcagagatcggtaaggacagcttcagcgtctgccacaagctcaagaggaacgcacgccacggccgctttagggcctgcgctgcccaaaaggagggcggatgagcgccgcaggagatgcaggccaaaagggctcttcgctacttatggtgggtagcatatctgcatccccttgagggcgtggcctttaaacggtaggattttccccgacaggaggctgcgttcctaaggtgcgatatggatgcttaaggcagggatgctagcaaggctctttaagaggtcgatgggactcggcgacgaatgggaggtcacgggcgtctggtttaagaagcgcgaggaagcgcaagacgagctccatgtgagggtcgcgcacaggaggggccaggcgctcgagtgtcccgtctgccacaggaagtgcggcacctacgacacgcgcgagaggaccttgtggcatctcgacatctggcaatacgagaccatcgtgcactgcgcgctgcccagggccgactgccccaaagacggcgtgcatgccgcaaggatgccctgaaaggtccgcccgaactcgcacttcaccgccctcttcgaggcgcaggtgatcgtgatggcgctctcaggaatgagcgtggtagcgatagcgcatctgatgcacgagacggacacgcgcatatggaggctgctgggcaaggccgtggccgaggcgagggatgccgccgactactcggatgtcgtgcgcgtgggcatagacgacaccgcaaggaggcgcggccagagctacatcagcatcatggcagacctcgacggccagcgcgccgtggccgtcacgcagggcagggacaagggggccgtaggcaggctctgcgccgagcttaaggagcacgcagggtaccgcacgaaggtcttagaggtcatacgcgacatggccgaggcatactcgcttggcgtagctgcagagatgccccaggccacacagagcgtgggacaggttctatgtggtgcagctcctgatgagggcgacagaccctgtgaggtgcacagagcggcgcgagtccgcctcgaagcgctggcagcttgcccagacgaagtacgtatggctgaagaagaaggagaccctcacaaagcgccagctcgccaagagggaggagctcgactccgcgaagacccatctcagggaggcacgcgcctgccagatgggagaggcgctgcaggacgtctattcatgcgcagacagggaatcggcggccagggccctggagcgcctctgctcgtggatgatgcactctgccgtggccgagatgaagaccgtggcgaggacgctcaggaaggagcgagaggggatcctgaactggtggaagaggggctccaccaactcgttcctcgaaggcctcaactcggtcgtccagtccgcccgcagcgccgccaggggcttcaggagcattgcctacttcaggacgatgatcttcctcaggctgggccgtttggacttcacagcccagaagaagctggcatacgctacccactagaaacagcgaagagcccgaaaaaggcggctttcagacccttgcgcttgcgcagaaggtgcgctctctcatcatggacagacactggtccccggataagatagacgacatctcaggctcgagggtggcggcaggtacgtcgttgagcctgccgactattcttaccggcaggtccaagccatcgccctcgagctgccgggatccggccccgaaggcaagatgcggcaccacctgtgcagcaagaggcctaagaccaaaggcaagatcgagatcttacacaccgtggatgagaggccaaagcaggccgatgtgaggtctcgcctcggagagtgggtagacgacacgctcgtggcagcgaggcccatgtgcctgctcgtgcttgccgacagggcagtgaggctgtttgccgcggaaagagccaccacgacagcaggagtgtctctaaggccgccttcgggcttttgtagggacgtccccctcgagacgctcacttccggatagggacaagcagctcgcagggcatacagagctcacagatgccctttgaggcgtgcagttctacttctgcgacccccaccatctatggcagaagctaacagttaagaacaccaacgggctcctgcgggagttcttcccctaagggcagcgacttcggcaaggtcacaaacgaggaggtgcagcatgcggtgaccctgatcaacgacaggccaaggaaggtcctgaaatacaggacagccaacgaggtctttagggagatgttgcactcagcttgacaatctgccaataaaaatcccgccattaaagcctttcttggaacgctttgaaatctccagttctcaataaataagaggcccacgcaatagcggaacgtagtttcgcaggaagccaaggggcattacgtgatagattttgtttagctattcctacgtaacgcattgaatccgattgccatgacgcatcgtaatgatgtatagagtgggtcttgtcagtgatctccaaccggcctgtctctagattcatgggattgaagtaagcactgggccatatcgtgacacccaccacatgctgaattccagcctttgactcaaggccctcatgaagcaatatcgcagttacacgttctactaccgtctggaaattcaaggtgccatcttgattcagaaaatggtcactttcatatgattccagaacttctcgatatagccgattaccagagtctgccgccaggccgagcccgggattaactgccaaacaatcctcgacagtattattcatcggcatacccggcttcggatctacctcgaaccccataaatggcccatgctcgagaacatcctcgaatggcctgatgacctctacatcagtatcaaaatagagaccgccgttctcatagagaattttaaagcgtgcatagtctgaaacaaacgcccacttttttgcatcatatgcttcgctcacatagttgcagcatcgaacatcaaagttcgtttcatcccagcggcgaatctcgtaatcaggaaaaaacttgctccaggaaccaatacaagcaagttctttttcccctaatggatttcttccgaaccagcaataatgtataaccttttgcactagcctacctcaccatctgatagggatatgccccataccacccattgaaaaccataccgataacgttcatacataagaagaggacaaggagcactgtcccaagcaggaaacgcgcgtcgcgattcttgacgaacgaaagaagatacggcagaaaaacaatttcaatcgggacaaagtaatactgcacgcgcagagcaagcggtacgaagaacgacagaatggctgaaaccaaggcgagcatattcatgttcgtcaaaacacgatgtctgttgtcgtcttctgcagacgggcggtatacgcctgtcactattgctacagctgtcaatattgatgtcaacaatgtcgcgcctagcgtcggattgacaacatattctacggaacctaaataatagacataacgggtgaatgacaagagattcgtaatgagattatagaggtagttaccgctgacaatcagcactgccgttatgcatattgccttccaagaagtaattcttaccttgtcggcaaacaagcagactacgaccataaccaaggctgattgatgaaaaagcattgcaatcaagcacaaaatcacagccttaaatcgcttgccatccgcaagacacgatagggcgaaaaaagttattgatgcagcgatatactgccttagcccgttgagcgagtcgcaataaaagcccatagcaaagaacaacgcaatgcttaatgtataattctcgctcatgcgaagagcaccgacaaagaacatcgttgcaataagccaggcgataatgaagaataatgtttgctgatttccgttaaagagtaaaacaagacgattgagaagagtgtagccaggttcgagcgacttaaccgaatagaagctgcctgtagctccaattgaatcaaatatgcgcacatacagcatataatcggggccaatatcgtatctcacagcagccagccatgcggaaggaattccggaaatcaacaagagcaagagttgtcccttgcccctcatgtgactcgtaacatatgcaaatatgactgtgatgcatcctatagcgaaatatgctgccatagctcatctcccatcgcgtctagcaatgaatctgagataggtatgtttgtaaatgggcatacacagcgcaaagagccagagctgtgccttgcgtttccgagtcaagtcgttcgtctggctaatagcttttagatgtaaacgcacgaaccgctgacatttagctacagcactgccatcccaataattggagcgcagcatcatatttacaaaaacacaataccaaaacgagcatgctgcaccgattcgaggctctacctcaggatatctctcgctcgtataagagtattgagcatcaattccatcaagtaaatcgtagctacgtaccgagaagctcgaatggccaatggaaccttcgcgctgacgatagaaatagagtgggtcgggatcgaatacaaccttcttcgcttctccgattaaacggtacgttgtatgttgatcttcgtgaagtttcccctctgggcaacgtacattctcccagagttccttgctccaaaccttaccgcatacgcacacagtaagattcgtattaaagagatagcgagatagagcttctttcgtcccatagcattgcggctctgtagcaaaggtctcgttggggataaagcgtccatcgggatatgcaagattaaaggtcacgccacaagcatccgccttgaacgcattaataaggttcatgcagcgttcgatcatgtcaggagccagccaatcatcgctgtctacaaaagttaggtaactgccatgcgaagcagcaagccccgtgttccgagcacctgatagacccttattagactgatgcctgacaaagatattcttgctgaatgaagcaagctcatcacatagggcagagcttccatcagtggaaccgtcatccacaagaatgatttcagtattctcgtaggtctgcatcaccaggctatcaatgcattctcttagatatggtctaacgttatagacaggaacaatgatgcttacaagtggttgcatctttatttagaaccttcccaatagcacggagaggcatgcctcagcgttcccagctgctaatccacagttgaattcgggatcgctaattatgccaatctttttatgtgctgcacatttctgcagaaaagcacgatctccattggtaatgtcagcaccatgaatgtttcctactgcaatcgctagagcctctcgattccatctatggccagggttccagagcatgtcaagctcatggcgcaagcgtttaacaagtccggcacctccaggcgttaccgaggatgcaagtctacggtggagaacatggggcgattcatcaaaagccatatctgtcccggatataagcgcagcgattaccacatgttgatcatgtgaccagcatggtagcttccctatagaatgaatgtctgactggagggcatcgctccataccatagtatgaccggcgagcctatggcgaattagttcagctgcaatcgtatatgtaagacctggaaaatcattcctaccaatagtttcaagcttctcgtcgacaatttctacagtcgatgcatagaggctcgctttggctaagcatagggaatcaacagcacttaacagcttgttgggcaaccaaacatcatcctggtctgaaaaagcataccagtcacaacctgatgcagacatgaggagacgctcgaagctttccaagaatccaaggttttccccgtaggtcaaattccaagatgatatgcaacccttagacatggaagacatttccttcagtagcttgcgtgtgccatcagaagagccatcgtcacgcacaaacatttcaacctcgacgccttcttgcgccgcaatcgagtcaacctgttcctgaagatacttttctccgttgtaggtagacatcagaacagcaacacgtggcctgccgttagatcctgacggacagacctcttgggcctctgaattcaactgtataagtttgggagagctggccattaggcgactcctctataaagttccatgtatttattcgtaagctgtataccttgaatctcgatgtcataattcaggaactcatcacgttcgatgtcagcacgttctgcattagatttgggctcaatctcacagaatgcatccacccacacatctggttcatcgatgggcaggaagctgctcttacccgtcacatccacctcacgcgtgattacatcggaaaagaggcaaggcagacctgctgcctgtgcctcgacgccgacgaggcacaggccttcgtagaggctcggcagcgcgaatgcgtcaaatgcctggtaaagctcgtttacatcacttctttgtcccaagaacttcactctgtcggaaagtccgcattcggcaaccgaactctcctcgacgacctcggcttcgccggagcctacgcacacgagcactagatcgtcgcgcttcttgcatgctttggcaaatgcttcaagcaggaaggcatggttcttctgcggcatgaagcgcccgacatggccgataacggtttggttgccggcgaggccaagatcggctcgcacttttgtgcgagccgtctctgagaaccagaagcggctgaggtcgatagcgttatacatgacctcataaggcgtgccttccccgaagagccagtctcccgcaaatttcgagcaggcaaaacggtgcgtaggatagcggtttgcctgcatacgcaggatagccttgacgatattctttgccgtctcgcccttgccagctgtgctatgcgaatgagagatgcgcaccggcacaccggccttcttcgcctgatggagtgggaagacattgagcgcgttcatgtgcgaatggacaatcttccattcgctatgctcactgaagagaccatgaagcaccgattcgaatgcgggtaacttcgtatatgccggcacgacgaagacacgacctccgagagcctctatctcttctttcggcacgatggtagagctgtcagtcacgatgaagtcaaattgcaccttggaacggtcgacatgatggtagtaattcatgacgacctgctcgacaccgccgccattcatgtttccgacgacttggcaaacgcgtatgggttcctgcatggctatctccccaccgcagaaggcgtaacagatgcgctgtcaatcaaaatcagtagagcagtgtcgaagatgtacgaacatgcagaacccaaatacatatagcctctctctgaaagcagttgcaccggggaagcaatggctggctcagcataacgcagctgatatgcgattacatacgccgcagagcttgaaaatcaactgaacagctaacaagtataacccatgcttaagagaggtatctattccaaactgcctgtaaccacaccagcaacacagctgaagacatgagccatattcgtcccatcgttatatacagaactctctgttagaccacgattgacctgagaaggacccaatgttgtccgggcctttacctacaatgtatgtcgccaaacaaagacatcgagaaacgggaggacccggatggactcaataatactgcagcggatcgagaagatgggcatcgcggaaaagagtgagctcctaaagaggctgaaggcccccaccactaagaagatggctcgatctttgctagggaaacgatgattaattcgcctcgatgaggtcactggagccacacgctgtatgtcgccggcttaaaatgtctcgaaccacgcagtgcccatacccacatagatgcctatctgccttctggatatggtatagctacatctacgcattccagcatatctaaaagacagatatggatagcctgatgagcttttaagaccttaaatcctaaggtctgaggagaaagacccggcgagaggcattcctggagcggatggatgtaatcgttgtgtgggatagctggattgttctggtagataccagctaccacagacaggctcttgtcaggcgtgtgcgcgctgcaaagacaaagctttagataatatgaagtgacctcacattagtagcaacgtggatttgccgctatacgataggtgttcaacataaagtaagctggtttgacacatacaaaagcagatcaccaatgaatagagtactcaa

SEQ ID NO: 334 - DNA, 6511 bp, Unknown
  Metagenome-assembled genome
gcaagctatccatgatagcgttggtgagcttgccgtacacctcaatcggcgagcgcgtatattgcaggtcgtcgattggtccactgcgatgtcgcagctttgtgcttggacaggccgcgctttgcgggcctgcccggtagccgtccccggtcggcgaaacacgcgcttgttgcgctcacttcggtcatgcatcttttgtgggtgtcacccacaatattcttcctcgcgatgccccctaaagcacgtgtagcacatctcactcgacttgagctagatactaaaggttggcaggtccttcttcgattcgtcgaatatgtcgctcaagaaggcgccgtagtgcttcgtgcacgtcttaggcatcctgaatcgctggttacccgggcggcactcttctcctgtcatccagggacttttcgccgcacgaggggcacaacgtgccggcaactgtggcgtgttgcgatctcctcgaaggtctcaagcccgagcttctcctttgcatcctcgcaccgcccaggcgcccatccagtcgggacgtcgccaaacttaggaccagatggacgctcgggcaaatctaagttggcgggacaatcataccaactcacgccggcccctatgctcctatcaccacacttctaaactgtcagaatcttttattatgagtgcctataaaacgtgggcatagttgttctcgcttacacccagattactgctgtagatcggcactcttgcttcaagatccaaatggaaagctaagggcgtactataggttcacttgatggttcttgaggccttatcttcttgacacactgataaaactgaatgtatcagggtgatgatgaacttgagtgtattcgaacatgacgccttttgagttataagactgactttcaacgacagccacgcaattatagggtccaagatccatgttctggcggtcaagatccgttgcaagctgcacggtgatacggcgtctgctcgtaagaatgtgcattcccaagttgtgctcaaggtatccatagacagactctgtggcatattcaggggttaagcccggcacagcggaagcgagaaaatatccggtatcaacctggcgagcaataccgtccagtgagcgcacacggacaacgcggatgagcttgatgcctttagcaaaaccggagcgctgtgcgaggcctgggctgcacgttatctcatcaaaggatatgacctctgtgcttgggacgaatccatttctcttcgcatactcttgaaaggattcagtgccctcaagtaatccttgtgccctatggttttccttttgccatataacgcgtacgcctcggccatgcataggctgtacatagccatcatctgcaagctctgaaatcgcacgacgtatggtgtttcgagagcaatcgtacatttctgtcagctcaccttcagtagggagcagttcctgatacgaatacgtcccttgctgaattttgtccttcaggtcgtggtagatgctctcgaaaatcttttttggcatgatcgccttcttttgctagagctcgtcgctactctagatatgacaaaagctccgtgtgcctgaggccccggatatgccataacccctctgaatcgtgttggcaaaaacttgagcgattttaggaatgtatacagcaactgagcctgattaccagtatattactttcttacatttttaccgttcacctgaaaagggacaccgctcggtgaaaagttgtttaaacaagtccttcttttctgttcttctaaggtagattcttctaagctagaaactgagatggcacccgcgagagatccacgtctgctgtctctgcaaacaaaattaggtggtaatagcgccacctaatagacggcagtgggaggacgacgatgagtaacatttcaagaaagaacttcctaaaattgggtgcagtctcagcacttggcctaggtttggccggctgcggaggtggcggctcttcgagcaacaatcagcagcctgacaagaatcgttccggcagcgtttattggctgaacttcaagcctgagctcgatgacaccgcacagcagctcgcccgggattacatggacaagtaccctgatgtcaaggttaaggttcagaccgcagcatccggcacctatgagcagaccctgacctccgagatggataagtccgaggcaccaactctcttcaacatcggtaccatggctggcgtcaaagagtggagcccctatgctatggatcttaagggcaccgagattgacaatgcactctccacgcaggactacacctactacgacgatgatggaaagatggtctgtgcaggtctgtgctacgaggactacggcatcgttgtaaatgctgacctcatcaagcgggctggccacaacatggacgacatcaaggactttgactccctgaagacggtcgtagaggacatccacagcagggcgagcgaacttggctttgatgccttcgttgcaaccgaccttgacagctccgcttcttggcgtgtcaccggccaccttgccaacttcccgctgttctatgagtccagagacgacggtggctggaaagagtgccctgccacgatcaaaggcacctatctgccgaactacaagaacctctttgaccttgctatcaacaatgcagctgaggatccgtctacgctctccacgggcggacacgatcctaagaacgagttccttgacggcaaagctgccttcatcttctccggctccttcgactataaggacatcatcgcggcacagccgaacgcaacggtcattccgtactacggcggtgtcgaaggtgaagacaaagccggcctgaactgtggcactgagaaccgcctcgcaatcagcgataacgcttccgatgaggacaaaaaggccaccatggacttctggctctggatggtcaccgatcctgacgccggccagaagatggttgatgcactcggcgcgctaccgtacactgatgctcctgagggcaccaacaagttcctgaccaaggcaaccgagtacaccgacaatggttgctacaacatggactgggttaccaacttcgagccgaacgttgaccaataccgtaatggtctcgtctctgcactcaacgcttacacggcagatcagtctggcgctaactgggataacttccggactgcattcgttgagggctgggctaacaactatcagattgagaatggttaatagttagcttctgaatatttgcggaatcgggcgcagcccgcacccgattccgttctccttctcacagggagtgaagaatatgaaaagtaaaagtgtagcctttaaaccgagttcccagatcaggtctacgcgacacttctggtggctctttcttttaccggtaaccattgcgtttatcattggctttgtctggccgttcattcaaggcatctatctttctttttgccagttcagaactatttcgggcgcaaagctcatcggtttcggaaactatgcggcggctttttcggatatctcatttcagcattcattctggtatactgcgctgactgcaatcgtctcgttggtgtttatcaatgtgattgcatttgcagttgcgtatgcgctgacccaaggcatcaagggctcaaacatcttccgtacggtcttcttcgcaccgaacctgatcggcggcatcgttctgggctacatctggtcgatgatcttcgacggtatcctgcagcagtatggcacctcaatcgttctgaataccacctacggtttctggggtctcatcatcctgatgtgctggcagcagatcggctacatgatgattatttacatcgccggtcttcaggcagtgccggaggacatgatcgaggcagcaaagatcgacggcgcaacgagaagccagaccctcttcaaggtcatcatcccgaacgttatgccttccatcacgatctgtctgttcctgtccctgactaacggcttcaagctcttcgatcaaaaccttgctttgaccggtggtctgccgtatgagcagctggcagatggcacgaccatcaacaccactgagatgatggcactgaacatttacaacacgttctattcaggcacgggagctctgcgtggcgttgcacaggcgaaggctgttatcttcttcatcctggtcgcggcacttggccttgctcagcttcgttacacccgtagtcgggaggtgcagcaataatggcagcgagtcaaccagagacgctccaatcagagcagcgtcacatgaatatccttacggtcgtcttcaccattatttgtatcatttgggttctgccgatcgtatgcgtaaccatcaactccttcaagttgaacacctatgttaagactgaaaccttcgcacttcctaccgcagagagctttgctggttggtcgaactttgtcaccggtatgaccttcggtaactatccgttctgggcggccttcggttacagtgccttgatcacggtactctccgtcgcgctgatcctgatctgctgctccatggctgcgtggtacattgcacgcgttaactccccattctgcaagataatctatgcgctctgcatcttctcaatggttgtcccgttccagatggtcatgttcacgctctccaagaccgcggataccttgggactcaacaccccgtggacgattcctatcgtctatctgggctttggcgctggccttgcaatcttcatgttcgttggctttgtacattccatcccgttggagattgaggaagctgcctctatcgacggctgcggtccggtccgcaccttcttccaggtggtaatgcccatgctcaagcctacgatgatctctgtgggtatccttgagattatgtgggtctggaacgactacctgcttccgtacttggtgctcgacatcaacaagtaccgtacgattccaattcagatccaatacctgaagggcagctacggcacggtcgatctgggcgccacgatggcaatcatcctcatggctatcatcccggtcattgtgttctacctctcttgccagaagtacatcatcaagggtgttgcagctggtgctgttaagggttaagccatcaactctgtacgactaacggtacgacttgtttttgcttcaactctctccgtttagatctacaacctttacggagagactttaccaaggatatgcagccgcgaatgaaacaagattccggctgcacttatggaaggattcaataaccatggcagaagtcaccctggagcatattacaaaaatttatccgaatacggagaaggagaagaagcatcgcggtaagaaaaaagacgaagcgccagagaagaagaataacctcaagattaccgatgagggcgtcgtcgcagtagatgacttcaacgtcgatatcaaagaccgcgagtttgtcgttctggtcggcccatctggctgtggcaaatccacgactctgcgtatggtcgctggcctcgagagcatctcaaaaggtactctcaagatcgacggcaaggttatgaatgaggttgccccgaaggaccgcgatatcgctatggtctttcagagctatgctctttatcctcatatgactgtctacgataatatggcgttcccgctgaagctccgcaaggtttctgagaacgagatcgacaagaaggtccgcgatgctgcaaagatcctgggcatcacccagtatctcgaccgtaagccgaaggcgctttccggtggtcaacgtcagcgtgtcgcaatcggccgcgccattgtccgggatcctaaggtcctgctgatggacgagccgctctccaacctggacgcaaagctcagaaatcagatgcgtgctgagatcatcaagcttcgtaagcgcatcaatgcaaccttcgtctatgtcacgcacgaccagactgaagctatgacgcttggcgaccgtatcgtcattatgaaggacggcgtagtacagcagatcggtaccccgcaggaggtctttaataagccgaagaatctctttgtcgcaggtttcattggcgtccctcagatgaacttcttcgacggtcatcttgtaaagaatggttcttcttatgagcttgatgctttgggaagcacgatccaggtctctcctgagacctgccaggcgcttgctgcaaatggcatcaacaccatggatgtcactgcaggtgtccgtcctgagcagatgcagcttgctgatgcaggcgatccaggcacccttaccgctaccatcgacgtgtccgagctgatgggctccaccgtccatgtccatgccagcgtcgagggctatgacttcattttagtcatcccgaccatcgacttcgaaagcggtagcggcagatcctttgcggacggtgcaaagatctccttcaagtttgagccgaatgccatccacttcttcgataagacgaccacgaacagccttatcaactaagtttaatcccttttttgtaataccaacaagatgtaagccccattcgcatttgcgaatggggcaggggattcttatatgtaacatcacggaatcgtgtaatta

SEQ ID NO: 335 - DNA, 36239 bp, Unknown
  Metagenome-assembled genome
ctttgccggctcagcgttcgtttgcctgtgtactggttcatacagagagtcgaccatcgttgctgcaagctcccagaagcgcgtcagcacatggcaggagtcatcggcgtgcgacggcagtacgaaggtgtcggacgtgatgccctgagcatccgcgctcgttgcgtccctcaatcccttccgccttttgccatagcgcatctgcatatgcccgagcgcttcaatgggccacagccggtagtcctggccccagagagcgtgcccggcagctctgctgatgcgtactttagtccgtaaccagatatcgatatcgtctgcaaggccaatcgacgaagctctggcgctcgtagccgacgtgttcgcgacgatcgggagcgcgtaggccggcttcctttgcaatcaggagcgctccatgcacatagggtgcatagttggaaagcgtccacgagattgatgttcagggctcccgtgtcctggagctcgagcatgatcttttgccctccaagcgcctgaccgtaatcttggtgccgaagccttcctggagatgttgtggttctggcaagaagattcaagcgcagagtggcagcggtgaagaagatgcacccgaccccgcctcccgtatcggcctcctcccaaaactggagtgcggcgcgtgcgatcctgagatctgccgtgcgccgcatagccctgccttgccggctgcgcgtgcagcgccgcagtgcctgggcagagcgtgcaggaagcggaatgcatcctcttataggaaatccataatctccttcatgcagaagaccggattcagaacgcatccgcgtccgatagacgaatggtggagatgaagggattctaaccctcggcctctgccttgctaagcacgctctcccagctgagcacctcccgtctgggcagtgcgttagatattctcgcaattcgtagcagttcgtgtcaatgcccatttctggctggcacaagtaaaggcagactgaccgatgcaaagaatgccgcctcctgccccctacgagacgttcatgaacccaccttcctaaggtgggtgtcctcgacgcctgttccagcttccttaacaccgaaggatacctgtactaggtacgagatatggactccctataaatgcttgtcggttcacccagtttgtgtcgcaggaggtcggcacctccaatataggaagtactgcccacaaaatacagtcttgacttgctgtaaagatgccgcacaattgaatgttagaggctgtttttggacaggtgggagtatgtatgtgcacactctacaccgcctttccaccctatttttcttttgccttacttttcgttattatttaatctaactgtgtgtgatgaattgtagataaaaacgctggaggatatacgtgcacattcaacattggctaccgtactttatcctctttgctgccgcatgtatcaccgcacttctggttaccccgctcgcaagcaaaatcgcctggaaagtcgatgcggttgatcgccctgaagcgcgccgaatcaacaccaagccgatcccccgcatgggtggtatcgcgatcttcgtggcgctcctcgtcacctacatcatgcttttctcgggcctgaagtcttttcagctccccttaacgctgatgccgccacggcaattctccgtcgactatcagatcttggggcttgcggtcgtggtgatcttcgtaacgggcctcctcgacgacaaatttaccttgaaaccccaccagaagctgatcggtcagattctggccggcatcatcgccgccgcctccggcctcgtcctcggttccatcatcaaccccttcacgggtaagatcatgagtttggggctctggacctatccgatcacggtgctctatttggtcgcctacactaacatcatcaacctcatcgacggtttagacggtctcgcctctggcatcggtatgatctcgtccctcacaatgttcatcctcgcctttggcgcgcggcgcttcgatgcggcggctttggcaatctcgctagcgggtgcctgcctgggtttcctgcgctacaatttccatccggcctcgattttcttaggtgattcgggctcgatgctcatcggctttatgctgggcaccatctcgcttctgaacgtcacgcgtatcgcgggcctcacgacgatcattatcccgcttgtggtggcggggatcccgatcatggacaccttctctgcgatcatccgccgcctcagaggccacgtgagtatctcacaagcggaccgtgggcatatccaccaccgcctcatcgcggaaggctacgatcagcggcaggcggtccttgtgatgtatgcctggacgatcgtcttgtgcatcggagcgtacgtgatgacacaagtggagatgagaccccgtatcgtgatctttatcgtcctgatcatcgtctctttcttcttcgggaaacacctgcgcctctttgagccggtgctcctccaccaccaggaccccaagaccggcaccgacaagctgatcacgccggacgaccccgctttcaaggaggaagaggaaaagattgagcacgagaccccgctgcaccactaaaataagcgatactaaaacggtaaataccgcccactacacacgaccgatatacgacaatgcccacttcggctccctgaccgaaacgggcattggtttcgtacgctttaaagaaagagagcgtttaggctgtcaaagctttcttcgcgacctgcgcgaggcccttaaagccctcaggatcctcataggcgatctgagagagggtcttacggtcgagctcaacgccggcgagcttgaggccgtggataaaggtggagtagctcatatcattctgacgagccgctgcgttgatacgctggatccacagtgcgcgcatatcacgtttcttgttgcggcgatcacgatactggtactcgaaggaatgggagacctgctccttcataccgcggaaggtgcgagaggaggtaccgtagtatcccttggaaagtttcttgagtgtctggcgctttttgcgaccggaaactgcgcgctttacacgtgccatatgctatcaactccttgaattctgcaatcgtaaatcagttacttgctgcccatccgtgaggaaacaacctttacgtctgcaggattgacctcagtctctttacggaagccacggatacgcttctgggacttcttggacaggatatggctcttgaacgccttggcacgcataattttgccggtaccggtgcgacggaagcgcttcgccgtacccttatgtgtcttcatctttggcatcttaattctccttctctggtttgcttgagctcttcttctcgttcttcgcgggcttcttctcatcgaacgcacccttgatcggagagagctgcatatgcatattgcggccttccatcttcggcggttggtcgacagtcgcatagggtttcagatcggcggcaagacgctcaagtacattgagcccctgctccggatgcgccatctcacggccacggaacatgattgtgactttgacacgggcaccctttttcaagaaacgcaggacgtggttcttcttggtctcgtagtcaccgacatcgattttgggacggaacttcatttccttgacctcaatctttgcctgcttcttacgggcctgtttcgctttacgtgcctgatcatacttgtacttgctgtagttcatcacacggcacacaggcggcttcgcattcggagcgatctcgaccagatcgagatgctgctcctgggcgatacgcagtgcgtcacgcacgccaaacaggccaagctgagaaccatcgacgccgataaggcggcaggtacgagcattgatctcttcattcacatggggtccttcggacttagctatgactggacaccttcctctctgatatgaaaccttgcctgcgtacataaaaataccggacgcactacttgttgcgtccggcagacacagatcctggacctcttcaggatcacccatccagattgtctaaccagacagcaacagataagcgccgcaaggtggggaacttgagagctcccgctttgaaacacaattgtttatagtaccaagacactctgtatattgcaagcgtccagggataacagatatgtcccggcacacaggctgtccactccatgttacaccccaggatgggtgacatgaggccgcatcccggctgaggaaacatacttacggtggagcatgccgtgggagttgagttccggcgaactccccacaggagttacccgcataaaggaagcttcctacaaagagatagaaaaataaatcggacatggagaccctagtaattgctacactaactcaatgaacagtaatgcacatgttaaaggagttatgcggcatgagagaatttacgcacgaggtgaacggcgttgaggagacggctacctatgattctcagacaatcaatgaagtcttaatcccactccttagacgttggtcagagctcgcccgtggcctccaccgcaagatggtgatcttcttggcaggacccccatgcgccggcaaatccaacctcgcactatccctgcaggagctgagccacgaagagagcgggctggtctccctcatcgcgatgagcctggatggcttcttctactccaacgactaccttaaacatcacgccctcatccggggcgtcgaagagctcagactttcccaaatcaaaggggcgcctgagacctacgacctcaaccgcctgcgttcaaagttgatcgagctcagaaacaagcgccaggtccagatcccagtctactctgagagagaccatgaggtgaacatgtccggcaaggtgctcaaagatcacatcgtcctcgtcgaaggcagctatctgctgctggatgagccgggttggcgtgggctctccgcctactgcaacgactcagtgttcctggatgccacgccctcagagctcaagagccgtgtcctcaagtatgaatcccagcacggtatcgccaaatcccaagcagagatcaactatacggacaagtatgagccgaatatcagaagggtgctttcaaaccgcctcaatccggcagttacgcttgagcaatccggtatcaatcacctgatggttagaaagccggcttaggctgaagaagcataacgggaacagctgaatcgcagcgtatggcaaaggggaaaccggcatcagccggcttcccctttttagtatctgaatggtgcccgaggtgagactcgaactcacacgctgtcgccagcaatggattttgagtccatcgcgtctaccaattccaccactcgggcaatggtgtcggaggcgggacttgaacccgcatgaccgtttagttaatcactagcacctcaagctagcgcgtctgccaattccgccactccgacgcagtttgtgcacacggtactgtaccatacttcgtgcctgactgaacgcagattatcgaaacaatgtcagattacagaaaacagttcggagcatccagcctcagatagcacaaaatgtaccaccgaatgattagttctggccagataccgcacgtttaatcagtcggctgatccttcagatagggattgtgctgcagctcgtattccatcgtcgtctcgggaccgtgaccgcagaagatcgtggtgtccggagggaccacctgtttgagcttccgaagcgatttctccagatcctgcgcattcccattgggcagatcagtcctaccgcaggagcccttgaagagagtatcccctacaaaggcaaagccgggccccacgtagaccacaccgccgggtgtgtgccccggcgtggcgattaccttaaaggcgatcccgtcgaactgtacggtatccccgtcttctacaagccggtccggctcaggaatcggatccccgtaggcttggccggagctgtccgccttgccggcatgctcctttgcccagggatagtccgctttgctcatcacaaattgtgccccggtagcggctttgagcgcggctacccctgacacatggtcgttgtgcccgtgcgtagcagcgatcagcgtcacgttggtattcagcagctgatcggcgatatccttaccccgatcacctgggtcgatcaccatgcactgaccaccggagatcagcgcatagcagtttgtctgaaacggactgactataaagcgtctcaattcagccatctatctaaaccctccgtttcatctgagaggaaccttcgcccggcagaattctgcgggcatcgtaaactgaaggcacgcgactgacattcgctaacagtggcatcagcaggctggcgtccgagatcgtaatcaggaagcgcagccgtgcggcgccctcagtggtagtttgcgtcgcggccgagaggatgttggcaccggaggatccgatcgcctcagtgacatccttcagaaggcccatgcggtccccgccttcgaccacgatctccacctgaaactctgtggcgcctgaggtgtcccacttcacgtcgatcatgcgctccggatgcttcatcaggttcttcacgttggggcagttggcacggtggactgagaccccgcgtccgcgcgtcacaaagccgacgatcttgtcaccggcaaccgggttgcagcagtgcgctaaatggaccatcaggttcgggccgccctctacgatgacgccagtgttattacgccgcttgcgctgttcccgggtaggctttgcacgcatgagcggcttgtcttcggcgatcgctcgctgcatctcctcctgacgctcctcgtgggccgccatctgcgcggcgtgctcggtggtcttgtctccgagctcgtccttgatgcggttcacgacgatctttgcggtgatcttacctgagccgatagaggccagcagatcatccgttgagtgcacgtcgaaggtcggtaggatcttttcggcggctttcgcgacccgctgactgttgatccccaagtcgcgctttctcagctcgcgggccaattctgtgcggccggactccatatcgtcagctttggtgaccgacgagaagtactttctgatcttggccctagccgacggggtcaccacaatgttgacccaatcacgggagggctttgcgttgttgttcgtgaggatctcaacacggtcccccatcttcaggtgatacgtcaaggggacgacgttgccgttcaccttggcgcccacacagtggttgcccacctcggtgtggatcgcataggcaaagtcgagtggggtggagtccctacgcaagctcataacctcactcttgggggtaaagacaaagatctcgtcctcgaagaggtccacgcgcaggttgttcaggaactcgtgtgcgtcgtcgatatccccctcagttgtccactccaggttcttccggatgtagttgatcgtggagttgatggacttgtcgtcggcggacatctgcccgttggagttacctgagcgcttgtagagccagtgggcggcgatgccgtactcagcctgttcgtgcatcttcttcgtacggatctgaatttcgatagggcgtgcattcgggccaatcactgtcgtatgcaaagatcggtacatgttgggcttcggagtagcgatgtagtccttaaagcgtcctggcagtgggtgccagagcgagtgtaccgcgcctaagaccgaatagcactccccaactgtattcacgatcacacgcagcgcgatcagatcgtagatatcggagaactcgaggtccttgcgctgcatcttctggtagatgctccagaggtgcttggggcgtccggtgatgatgaaatcctggattccggcgcgtttgagctcgtcgtttaggatcttgatcgcctcatcggtattctgctcacgctgggcacgggagtcctgcaccatgcgggcgactcgctggtactcttcgggctccaggtagtagaaggccaaatcctcaagctcccacttgatggagctgataccgagacggtccgccagaggcgcgtaaacatccatcgtctcgtgagccttcacaaggcggcggtccggcggcagcgccgcgagcgtcctcatattgtgcaggcggtcggcgagtttgatgatgatgacacggatgtccttagacatcgcaagaaacatcttacgcagattcagggcctgcttttcatcgcgggagtcagcattgatgttggtcaatttcgtgacgccgtcgacaagctcagccacgctggggccgaatctgtttgagatatcctccagcgtggcaggcgtatcctccacggtgtcgtgcaggagcgccgcgcagatagagtcctcatccatgtggagtttgtccgctaagatcaacgccacctcaaccgggtggttgatgtagggttcaccggagcgtctgcgctgatctttgtggtaggcacgggcgaagcggtaggcctggtggatcttgacaacagcctctttgctcaggtaccttgaacacgttacttccagaaggcgccagttgtcagcgtccggtatcgtctcttgagccatcgtcaactccttatccgtcgaccacgcatcccatatgcggaacaatggggcgacagagcttatagagcagctcctgtgcaggagccgtcagtattctgtccctgaatgagacaaagtcttcccgcgcacgcatcccctcctgcagacggaccgagcaggaaagatcggtgtatctgggggcctctgtcatgagtatatgacgattctcggcaaaacctctcacatctaagaatccgaactcttgaaatatacccaacccggcggcaattccctgactggtcaggcgtgttttttggttgatgaggcgtacctgatacaggagctcttcatcgcttgcctcaatcggctctccaccggtggcgcgccactggcccaacaggaccttataaaggtcgacgagatcagagcgttccggggtctctgcagcgatgatctgatcgttcaggcgcgcatcgcgggtcgagaacagcaggtcgatctccgcaggtttcccgtcgcggccggcacgcccgcacatctggttgaattccacctcagagaagggcaggtggtagagcaccacgtggcggatatccgggatattgacaccctcaccgaaggcagaggtcgccacgatgcaggtgagatcccccttacggaaggcctgctccacctgcgtgcgctccccacgcagcaggcctgcgttgtagtaggcgatctgaccagcgaggtcaggaatagcgtgacgcagatagcggaccagttggacagtctggtcgcgcgagttcacatagacaacgctcttctggccgcttgccacgatattgacgagagccgctttcttctcccgggtctccctgagatcttgaatggtgaggttggtgcgggcggtcttgtcgatcagaatctgtttgcgttcgagtgaaagcagcttcgcgatctccttggccaccgggtcaggcgctgtagcggtcgtcgccaggcaggtcggatgcccaaggctcatgaggatcttcgggaagtccccataggcgctgcgctggcctgatttggcctcctgcatatggtgcgcctcatccaccacgacaaagccgatgcggtgtaagcggcagaagcccatactgtgtagggctaagaactctggggtcgtgaggatgatatcaagggagccggcctgcagctgctcaaagatatgtctgcgctgctttgtgggggtcgcgccgctcaggactgcaatgccgatcccgagctttcccagttcctcgtcgaggtggtagaactgatcgttgacgagcgcccgcagcggatatacaaagactgaagctctgtgctgcttgagcgcgagccgtgcagcatgcacagtaaaaatcaggctcttacctctgccggtagctatcacgcacagcgcggactgccctcgcgagagcatctcaagcgcctgcttctgggccggcagcagttcgttatccccgattgcggtgtggacgagcgcttgggtcaacttctcctctgagagggcttcaagctgtttgcgtgtatccacagcctgtgtcgggacgcgcggtgcaatctgcacgcggacagtcttcttttcgtcgtggctgatccccttcacctgcgcctggaactgtgctcccttatgcatccgggatacgagcatcgaggtaatcgattcatggaggtgcccggcgacttgcccgtcgtcggtgacaacctccaacttcttgctgtggttgtcgacgacctgcaagagctcgcctgagtccaaggctaccgaggccgcctggatatttctggtatagagcttcgtcacaaaggtttcggcgcccgataccgcgactgtcggacgcacgagaatcgtaccagcatgtttctggatcccctgcagtttctgctgcgcttcagtgagccctacgggcgctttcgggacgcggacgataatgtctttcaccatcagttttggcttcgtccggccctgccaggtctcgttgattgcgtcgaagaccagatccaccgctccctcatagcatgccaactcttcgacgtggggcgcgtggaacatgatggcaggtatcgagttggtcccgtcggtcgctacaaacctcaggtggtccccattgttgccgacgcgggctctcgccttcattgtcacgccccgcgctgcgaagaggggccgcttgtttcccatgccgaacggctggagcatctccaaggcttcgatgccggcctggttcgcctcagagaggcgaatgacagcagtgatttcgcccttgtcttcaaattggtcttcaggcagggcatccatgatcttttgcatgcgactgcggaattcgtcgaaccgtgaggcatccagcgttacgccgaccgcgccggcatgcccgccgaagcgaatcagcatgtccgcgcactgttcaaccgcgtgaaacaggtccacgctgccgaccgaacggcctgagccctgggctaccccatcctggatcgtgaagaggatcgtaggcacatggtagcgggcggtcaaacgggaagccacgatgcctttgacaccttcgtgccagccttctcccccgacgacgataatgcgctccccgtggtaggtctccttgaccttttcgagcgcctcgtcggtcagctgtgcctcgatctgccgccggtcctggttgatctgctcaatctgctccgccagtttggtggcttccgccggactatcggtgagcaacagctggaaggcggtatccggtgcccccatacgtcccgccgcgttgaggcgtgggatcagggtgaagggcaggttgtctgcggtgagctccgtgagcggcactttgcactgctctgcgagtgcgacaatgcccggacggtcggtctcaggaagacgcttgattccatctgcgaccaatgcccggttttcaggcgagaggtccatcatatcggagatagtacctaaggtcgcaagcgtcgtgtagtgacgccacagctccggtttcccggcacgctctcccagcacctgcacgagtttcagggctacgccggctcccgccagatcccgtgaagggcagccctctgagagtttgggatccgcgacgggtacaccgttcggtacctcatcgcccggctcatggtgatcggtgattgcgacatcgatcccctcggctttcagggcttctaccttctgcgcggcggcgatcccgttatcgaccgtgatgatcagatccggcgttgtggctttcatcagccgctgcagcgcctcatgggaaagcccatacccctctccgaaccggtttgggatgaaggggtagacctcggcgccaagcgcacgcagccctagcgttagaaggcaggtggcactcatcccatcgacgtcgaagtcgccaaagatcgcgatgtgttcgttatttttaagtgcctgctccaccaggtctgcgacctcctcgagtcccgggatcagggcaggatcctcccagtcccgctccagtgagggggtcagaaaccgctttgcggcctcaggagtggtgtacccgcgcgccacaagcgtgcgggttacgagcgacggaagcttgagttcctgtgtaagcttctgttgacttttttgatcctgggagaggacctcccagtgtttgcttccgtttaatcctgccatgggtcgttaggctcccacaccggcaggcttttggtgcccgtaacgctcctcgagcttgtgccacttgggctccttggccttccacaccaccaggatctgtgaggcgattgcgaagctcgaataggtacctgtgagctcaccgatcagcattgcgaaggcgaagtcgcgcagcgttgcaccaccgaggatcagcatcgcaacgaccgggacaatcgaagtgatcgtcgtgttgatcgtacggacaatgacctcattgatcgaaaagttcgcaatttgagcataggtgtggtgcacgccgtcgttcagttgtttagcgttctcgtcgattcggttgaactcaaccaccgtatcgtagagcgagtaacccatgatcgtaaggagggctgccaccacgttcggggtgatcggaagctgtgtccaggcgtagacccccagcgtgatcaccaggtcgtgcaacagggcaatgacggctgcaatggacatcttgaactcatagcggatcgagacatagacgataatggcggcaatcgcgacgccgaaggctaaggtgctcgaacgggtcacatccgcgccccagtccgggccgatcgtcgtgacctggtaggaattgtcgctcagattgaggatctgcgctgcctttgaagcatggcctgcggcggtctcgggatcggtggtgccggaacgcacgaggaagccggcgctgccgtcggtgaccgtggtctgtacggtcgcctccccctcatcggactgtgacagagcgtcgcgcatctgctcgatcgtgatggaaccggtatctctgaagtcaatctcggtaccgcctatgaattcgataccgaagacaagaccccggacgatcatcccgacgattgccagcgcaatcagtacgccagagataatgaagaaggccttccggtgtgccataaatcggatctcatgcttgaaatggctacgcatgggcgacacctcccttcacaccccgtgcgtgtgctttcatttcagcctcttcgaggtcctccgcgataccccagaacttcggattcttctggatcgtaccgcgcgcgagcagcctcaaggccggtgccttgaagcagaacatcgtcacgatgtcgcaggcgacgcccaaagccagggtcaagccgaaacctttgaccgtgccgattgcaagggcaaacagggatatcgcagacacgagcgtcacgatgtccgcgtctagcgaggtgcggatgccgtgcttggcgccggagatggatgcattccgtacggtccttcccatgcggatctcttcgtggaaacgctctaagaccaagatcgaggagtcagccgcagagccggttgtgaggaccatgccggcaaggccaggcaacgtgagtgagaacatcccgttgcgtgaaaggattgcaagcaaccctaagtagagcactgcaaagcaggccagggagcccagcgtcaggaggcctaagccgcggtagaagataaagagatagaccaccacgagggccacgccgacgacgagcgccacaatgccctgcgtaagcgaatcctggcctagggtcgggccgaccacacggctctcggagaaggtgagattcaccggcagtgagccggagtccaatacggtctttaagttgcgtgcatcgtcgagggagaaattgccggagatggagacatttccgtcggtgatctcagactggaccaccggggcggactcaatcgtgccatcgagcacgattgcgatctggccatgggtcggagcgagctcacgggtaacgtccccgaagatctgagcaccgtcggagttgaaagagatattgaccacatattgaccattttgggtctgttgtaccgaggtgctgccaatgtaggagccgtccataaagggggtatagctccccggctgcagcgcaacctcccgctgtccggagcgcagctttaacagcgcatccgcatcgccgatatcgtcgaggcggacaaattccaggtgtccggcctgcccgatcgtgtgggccgcggactctgcgtccgtcgcgcctggaatctgcaccaggatggagttggaaccctgctgctgcaccgtcgcctcagaggccccgagtgaattcacacggttctgcacgatcgtggtcgccgcctgcatctcgtcggaggaaggctgcgagccgtcacttttggaggcgcttaagatgattgagacgccacctttgatatcgaggccctgggtgatcgtttcacttaaaggcgtaaagccgataatgcaggcgacacagaccgccgccaagacaactaaggtggagacccaccgacggacctgcgccggcattttttcatggtgctttttcggacggttagaagaccgcgcgtgctttgcgcttccggccgatcccgcttctctctggttccagcggtcaataccaaaatgagcgctgttggatcctttgttgctcatatagtaagtttctcttgtgtggctgggtgtatacagccttaagtcttttttccaacactctattataggaaaactgcgtttttagacgaaaacccaattgtgtctagcagtccttcgctgccgtgcacgacatccactcgtcttcaaattctttgtatctacctgcaaagatagccgtccgtgcctgtcgcatcagctgcagcaaaaagtacagattatgcatagatagaaggattgacccgagcatctcctgctgcttcaccaagtggtggatataggcacgggtgaaaccttggatgcagaccggacactcacataaggggtccagcgggctcttatcgtgcgtgaacttggcgttcttcatgttcatgcgcccctcatggctaaaagccgtacccatacgggcaatcctagtcggcagcacgcagtcaaacatatcgacaccgcagcctacctcgtgtacaagcgtcgtagggttgccgacccccatcagataacggggcttatccttcggcatgtactcagaaacaagcggatccaggctctcatacatcacttcgtggctctccccaaccgagtagcccccgatcccgtagccgccaaagtcgccgcactcctccagatgtttgagggaacgcaggcgcaggtccatgtccatgccgccctggacaattccgaagagagcctgatccggacgggtgtgcgccctgtaacaacgctccgcccagctgctcgagagctccaccgcgcgctcgacaaaggagcgctccgcgggatagggcgtgcactgatcgagctgcatcacgatgtccgcgccgagctgctcggcgatgtgcatgttctcctccggcgtccactcgatgtagcgtccatcgtagtcgaccgcgcggaacctcactccgttatcggagagcttcgtgaactggccgtgggagaagacctgaaagccaccggagtcggtgagtgtgggacgtctccagtgcatgaattcatggagtccgcccatctcctcgatcagatccgcccccggccggtttgccaggtggtaggtgttggccaggatgatcttggcacccaggtgctcgagggtggagggtaagacccccttgaccgtggctttggtccccaccggcataaagatcggtgtggggatatctccgtgctcggtatggataaggccagctcgggcataggtgttgggatcttcggcttggatcgtaaaggtaaaattcttgttgctcgccacgatggttcaaaggccccttagattaggatgtgtagaattcgctgtatcccatccattgtgccaccgcatcccaaccaattcctaaaacattcgtatctcccacagtttcgagacggtaaggcaaaaacacggcaaaaagaaacagctcgatgctcctacaagcaccgagttgtttgtactgactgccctaagagtgctgcagaagtctcgattacttctcgccgaagccatcgtcgatcaaagtgacgagggtatcgagtgcctcctgctcctgttcaccgtcacaagaaacctctacctttgtgccagactgaaggcctgcagccaagatcatcatgattgatttcgcgttgactggagcggagtccttcgtgagatccttaatcgtcacattgcaagggaactttttcgcagctgccacaaactgagaagccggacgagcatgcaaaccggttgcattgacgatggtcgtactcttggaaaccataatctctcctttggtaacgattcctctatattgcagacgcgtgactgcaatatgaattttctattactgtagcaaattgtgcagcaaatatggctggcatttcaagaaggtttaaagaagatgcgtaattattttgtctaattcttgcttttgcgtgtgagatggggatctgagcgcccctacaacagattttctgtgcaagaatagggaatgctagtgtatagatacacccgaggagcacacgcatgttcactgcttcaaacaagcataaaaatgctgaccatacaactaaccatacttcagacacaccacaaaacacccagaagcaccaggctcctgccaacaaccataccaaggacagaggcgagaagaacagcaagaaggccaagaaaccgaagaggaagtcttcgatcttcggtggctactctgccatgctcaaagtgcgggaggcttccaaggcccacgccaatgccagaagcgagctcaagaaggcccaggaggcgcttgagaaagaccagaaggtactcgatcaccgccagaatatcgacaagaacttcgacgctatcatcgacgagcagaccgatgagcgtgaggaagcggagaagatcaccaaagcgctcgacaagaagatggaagacatcaccaaagagcacgacaagctggcacagcagctcgatgagatgaagcaggaacatgcgaaggcccttgagccgtacaaaaatatgatggatacgaccaagagccgcgcggatgacgccgcccgtaccttcaacgaagcgaagaagaatctcaaggcggcccaggacgcctccaaagacgctcagaatcggcggtcgcagcgcatccagaccgccgatgaagcgctggacaacgcacaagcacgcgtgagaaagcttgaatccgacttagagatgctcaagggcagacctgacgccgagaaaggcgccatcgccaaaatgtcacaggagctcgaggccgagcgcacccatgtgaagaatgccaaggatgacatctctcgcgtgacagatgaggcgcagaagagcgtcgacgaggcggagaagcatgtctggagcctgcagcagatctatgacactgcacaaaagaacgctgacaacgcgaagcaagaagcccggctgcgcaaacaggaatacgataaacactaccagaagttccaaaccgaagaggctactctcgacaacgcagtcgtggagcaggaaatgcaggtgcgtaacgcgaagaaggacaaaggggaagccgagaagcgcatcaaaacagctcagggactgatcgacgaggccaccgacatccacaacactccggagcagacgcaggcgttggctgagtccatcgcgcagcaacgcgcagcgatcaaggcacagaaagccgaagtagggcagctgtcccgcactgagcgtcagctgcgtacgagcacaagaaagcagcgctttgtctttatcgccctcataatcattatcatcgcaatcattctcctagttgtctggttcttcacccactaacgtggagcattgagatcgaagtattgagggggactgagattatattctcagtccccctcatgctcagtgcttataagcaccgtatctgcggacagaacaaaacatattcgctacatagatttcagacgctgtcttcctcctttgctggttgctcgatcgactctcatggcctcctgtcgctcatgttttgtattacttgggctgccattacacgcttgtccatggactctgagggcttccaccacagctatggcgccgacaaacgcgatcccacgaggagcacttgcgtgggcgcagaggtgtcactggtcgtaggtacgcctgaggcggacctgacactctgagagccttgaaactacgaggccgcaggggcttgagcggaaccggtagcctgagcggccgtaccgttgttacccgtagcttaaccatgattgcccgttgtgtcggaggcatgagttgagtcattggtggtatctgtgtcattcatagtgccaccattgctgtgttcgtcagcagggtttccccgctgttagaaccaccgtggtcatctcttgaaggatttgcaagcaaagcctgagcggcgttcagcgccaccccaaactcagaccatctctcagcagtgtacttgtccgcatcaagcttctctgcaagttcaatgaccggggagagcaccgaggtgttgattgtttcatcggggctgtctgcccgaacaagcgttttctgcgctacctgtaccatcctgagctgcgtatccacaacccccctggggagtcagggctttcggcaacagagcgtgccagattgaggacggctgagaacaccttccagcttgcaggggtgtaatcagtctcaacgaggctctcagctatgctgataacctctccaagctgtgccgtatcaggtactgccggtacctcagattgtttgacaagcgcctgttgtgcactcgtcaacgctgcggctgcggtatcggccgctgtctacgtggtgggatatgcgcttgtacctctgtttcgcgcttgcaagcgcattggaggatactgcccagcttgcgtgggtgtaatcaggttcgttgagcgtttcagctgaggcaattgcactatcaagcgcaccagtatcaattgtaggccccggagctttgacctcgacggtcacactgctgcttgagaccgtcgtagcaacggaacctttggtatagggtacagccacatggtagctatgcgttccggcatcgcctgtcagagccgtgaagctagagcttgttgctccctcaatcaccgtatcgtcttggtaccactgatagggaacggttatgccttcagaagctgctgtgttgacggtaaaggtcaggccgtctgcgttttagtccacggtgatatgactctcacccaggttgaagttgatctcaggcagtgagttaaagcccaaggcacccaccgcggtgagcaaagtaatatccctcgccccagcgcacggagtcaaggcgtttgagctagggtccagctataagccacatccccttgctcgcctgcatcggtccaatcggtcagaggtgtcaccgtgccgtccggcaagggactggacaaagcggatctgtttggttccattcacgctacgggatacggtcgcggtcagcgtcacagggatgccttctactatccaggaatcgacagcatcagagactggagtctcagtgccgttgtctatccggttcatagcagtcgccaggtcttctgtattttttgctcagccgttgtgtcttgcttattattttcagctgtaggtgcactgctccagttgctggcgtccagctgttcaccaaaagattacagttcattggggcactcggccctcaacaccacgcagtgcacgatggtattgtattgccagatgttgggatgtttttaggtcctctcacgcgtgtcacaggtaccgcacttcctgtagcagacggagcattccaccgcctaccctgacgtgtgcaaacccttacagggagctcgtccgacgctcatctgcacttctttgtaccaacattgaagagctcccattcgtccttaccccatggtatcgatgtttggattaattctgacagtttgaagtgatggtgatagagcatagggggccggcgtgagttggtatgaagggtccccgccaacttagtttgccctgtcgtccgtccatctggtcctcagtttttttgcgacgtccccttactgtattggcgctgtgcggtgcgatggtgcaaaggataatatccgggcctgaacctgtcgaggaggtcgcaacacgccgaccggtccgcgccgttgtgccctcgtcgggcgaaaattctctgtgatgacgggaatattaccgccggcaccagcgttcagctgtcccaaccttgcactaagctctgacggacgaacgcccgccttgcttggatggccatatcgaccgactcgaagaggaagcctgctggcccacctttagtcgctccttcaatcgactgagtgtgctacaacttgcctttagggggcatcgcaaagatcgcgtggctgaacccactattggcctactagtgccgcctgagctcgtgtttgcgaccgtggagccaggtcccttcgcggtgcagcccgcaagcgcggccctgtcccaagcaaaaagctgtgcaatcgccgggccatcgacgccctgcaatccgcgcatccgtcgtcgcacggcaagccttcccgcttatcaagggatagccgtgctccttcacatcgccaaggggtcacctgttaggtcggggacatggtagaagtccacgaatcccttgtcatgtgggcggtcgaagtcggcactagtgcctacaggggcacacgtcccgtacccgcaatcctcgagttcatgggcgctctgtgcagcttctgcttttagctcaaacgtttacctttgggcctttcatcgtccatggactctgaagagactgcagagctacctgaacaggtaggtgtacctgttcggtggtcaaccagtttgcgccgacaaatggcccgagcttgaaaaggaaatggtggcgccatcttaatatggagattccgacttaccgcccgtcagcgcctggctaaggcacagtcagcccttctaaaacgctgttagaattatttaaaagacctggctgccgccatcagactgcctttagcatgccaacttgcgccttagagccgaagcctccccgttccaaactcctgctggtccgaacacgaacaccacgttgctcaaaggggatgcaggaagtgctaacccccaataagtatcgaagagccatcttttgtgcctgggggcaagctttatgcttgcttccatgcgctctctttctccctgtgtacctatttgcgcatgccccccgatctcgggggtgtcgcacatagtaactacaacgaacgtggtggttacttgatctagcgccgtgaatacacgtttgggcgggcatttgactgttgcccttatcactatccgactatcgttcctcgcagaacatagtgaatagtcacttatatctaactttcttcctactctatggatattccctccgaattgatataaagttagcaacttcatactccttacacgtatgcaacaaccatgctttcgtaatttcgcaagaggctctatataacgaaaccctccgaatgcatcagcatcccgagggccacttcgtcacttcatatgtacagagacgctactcgataaacatcgcgtcaccgaagctcagcattctgaacttacgttggatcgcgtcctggtatgcatccatgatctggtctctgctcgcaaaggcgcttaccaacatcatgagggtcgatctcggcacatggaagttagtgataagcccatccactacgtggtaggtggaacccggcatcaggtagagcgatgtggtggcattcttgcggaccacgatgtcacccttgccggtgaccttggcggagtccttggcatcctcaaagtagcgggcgaccaccggcggatcggagaccggaacctccggatcgaaggctgactcgagcgagcgcaccgaggtggtaccaaccgcaatcacgcggtggccggcttccttcgtcgcatgcacggcatccaccacatcctggttcacgtggtagcgctcagtgtgcatcatgtgcttggtcgggtcgtcctcctcaaccaggcgaaaggtatcgatgccgacctcgagctctactgtcttccactggacgcctttgtcctcaatacgcttgatcagctcaggggtgaagtgcaggcccgcggtcggagcagcagcggagtgctcctcgtgcatcgcgtagacggtctgatatttttccggatccccgtcgtactgggtgatatagggcggcagaggcacatggccggctttgtgcatcgcctcatcgagggtcagccccccagccggatcaaacctgactagacgtcctccgcggctatcctcgacgtaatcgatgatctctgcggtcaggacgaccggggcgctcattggtgcctgaatctcgccggcgcgatactcgattacagtaccgggcttgaggcgtttacccggattgaccaggcactcccacacatggcccatcggatccttgtcctcacggcgcttcaagagcaacgtctcagagacgccaccggtcttctgtttgtggccgaccagccgtgcgggcatgacgcgggtcttgttggctaccagcagatcgccggggttgaggtagtcgataatgtcagtgaagactttatagtcatgcttgcctgtatcgcggtgcagcacaaagaggcggcaggaatcgcgttggtccgtgggttcctgtgcgatcagcccctgtggcagatcgtaatcaaaatcgtcagttttcatatagtcgtgctccttcagcaataagtgcccatctatcctacaacggtgcggcgatcgtgccagattctgcttaagaactcacgtgcatcacacgtgtacgtgctttttggttttccgcgtatccctgagctcgtggcgggaaacgcaggcctccaccgcggaaaagcggcagccgcagtagttctgtcgatacatgccgagtgcccgtgaatccgtgaccgaatcagaatagtagggacggaagtccctccagacgctgatgagccccgccttctttgcggtcgcatcaagcacttcatggcaggtatcgaagagttggtagggtgagaccgctagcgtggtagagatgtagcgaaaaccccgctctttggcaacccggcaggcttcactcaagcgcagcgcgtagcaggcgcggcagcgctgaggccggttcatcaggttcggcgccacaaacttttcccaggcttcacgatcatcacccgcgacgatcacctcaacatgcgctacctcacgggcccacttctgaagcacagcaagtcgtttgtcgtgttctgccacaggctggatattcgggttggtccagcagatcgtcggctcaaagccctctttgcatagatatttcaccggctcgatcgagcagggcccgcagcaggcatggagaagaatagacgttctcatcgaaacctttcaacacttcgtttctataaccaccgtagcacaccctacgccgcatcgtttttcttaagcaggcagcacccataggaggtatcccgcacgtgcgtgcactcgttgtgtttcgcaatcgcttccaccatcatccaatcccctacgcatccggtgaggtgcagcgcatcgacgagcaggctctctcccagaaagccgaaggaagcgccaagtgtaggcaacgcaatggccaaaacgatcgtcggggccatcaggactgcagagaaagctcctttgggcaggattgcatcgtcggttttggtgtagaggaaggcccaggtgattccaaaggagatgtgcgcatgcccttgtgaggcgatcaggaagcccagcgcgtggattccctcgtgggcagtcaggctcacgcacatcaccaccgcgaaccagataaagccgatccatccctgtatcagggcggtgtgggtgatcgcacagatcagaatcgcggcaaggacagaggtgaccaacaggaactgcgaggcacgtgaaagccgctcgagaatatgccggtcatgcaagaggtcaaacttctcgaccacactgtagccctgtagttcactcacaaatatcgccggctcccgctttgtctatccgccgttataatcaaactttgttatgccttacaataggcatgttgtatcagttacagattatgcgttgaggatccatacatggcaaacaattcaaatgacacgcaggtttccttccccaagcgtgttgtgatcaccggcggcatgccctacggcaacaagcatctgcactttggccatgtcggcggaatgttcgtcgaagcggatttctttgcccggttctaccgtgaccgcatcggcgaagagaatgtgatctttgtctctggcaccgattgctacggctcccccattatggagggctatcgcgggcgcaaagaggcaggctataccggcagcatcgaggactatgtagaggaaaaccacaggtcacaggcgcagaccttaaaggactacgggatctccctcgacctcttctccggctcagggctggagcctgcaaagcccttccacgcaaagctctcccgtgaagtgatcgagcgcctttaccaacgcggctacctcatgaagtgctccaccaagcagttctacgatacgaaagcccaccagttcctgaatggccgtcaggtcgtagggcgctgcccggttaaaggctgcaagtctgagaaggcctatgcggatgagtgcgatttgggtcaccagtttgacccggaggagcttatcaccccggtgagtcaactcactggcaccactcctgaactgaggccggtcgagaactggtactttaatctgcctgcctttgccgacgatctgaagaaattggtcgataagtgggatagtgacccgcagatccgtccgctcgtcacgaagaccgtgcgcgagagcctcgagccaccccgcatctatatccaggagcactaccaggagacctttgacgcaatcaaggacaagctgccacccttcaagtactttgcccctgaagggaatcagaagtccttctcgatcgtgttcaactcctggcaggagcgtgacgacgcacgcaccatcctggaggatgccgatatccgcttccgtactggtaaaaccctgctccctttccgtctcacaggcaacatctcctggggtgtccccgcacccgatctggaagatctgagagggctgaccctgtggtgctggccggaaagcctgtgggccccaatctccttcacgcagacgctgttggcaaccgcagcgaccgggcgctacagctcaactgactggcacgactggtggtgctccaaggacaccaaggtcttccagtttatgggacaggacaacatcaacttctactgtgttacgcagccggctctgtgggaggcgctcgactggggtctcattcaagacactccgattgcggactaccacatcttatttatgaataagaaggcctcaagctctggcaagatcaagccgccgatggcagaagatctgctcaaccactacaccgcggagcagcttcgcacccactggttgagcctcgcgctcgaccaaaaggccgtgagtttcagcccgaagccctacgacacctccgtgagccacacggacaagaagaccggcgagcagatcctgaccaaagatgacccacgcgtcgcggatccggtgctcaaagagagcgctttcctcacaaacatcttcaaccggctggcccgcagctgcttctacggcgcaacgagagcgttggacaaccatctcccgtccgtggatcctgagcctgaagtcgtcaagcgctgcaataaagtcactgaagactttgagaaagcctgctatcacttcaattccacgaaggcgctgaccatagcggaagacttctgccgtgaggccaacaagcgctggacgaaggaatcaaagaccgccaaggaagacccgaaagggtatgaacaggccctctccaacgccttcagagcactcagaactgtgacccttcttatgcatccggtagtcccgaagggctgcgaagctatcgcagagcacctcaacatccccacagaggtcttcttcagctggaggcacgccgaggaaggtctaccggagctcgttcagtacaccggtgagaatgcggagcagcacgagatcaccccactgccgccacgttttgacttcttcgagcgccacgaaagccaacgctagctcacttatatcctgaaaatcctctggtctcagttgggctttgagctgaggccatatttatcagcaaaaggagtaccgatgcagattccggaacctccccaaatccatttcccctccccctatgagcgcccgcacacgccgctctccttcgcgcaacgtatcgagcgtccagacggagcttttattgcaacgttcggctacaacactgagagcactgcccaaaccccgatcctgttcctgcatggcaatggggaggaccatgagatcttcggtcccatcatcgacgcctgcgtggaagtgggctatccggtctacgcgctggattcacgtgctcagggtcagtcgacgcgcggtaccgcgaaattgacgtatgaggtgatggcgaacgatgctataggggtgatggaggcactcgacctcaaacgctgccacttggtcggcttctccgacggagcgatcgaggcgctcctcatcgtctcaaagcatccggagcttgtcgcctccctcacctcgatcggggcaaaccttacccctgaaggtgtcaacaacgagggatgggatcctcaagccaccatccaacgtctgctcgattgggctgagtgggtcgagaaccttccgaaagatggcgcaattgaccccaccttgatgtcccccactgcgcaggaggcacgccaacaggcagagcttttgaacctgatggagatcgagccgcacattgatccggagagcttgaagtcaatctcctgccctacaacggtgatggccgggcagtatgacgttatcaagcctgaagagacgaaatgcattgtcagggcaatcccccaagcgcagctcttcatctcggagggtcacggccacacactgcccaaagaggcaccggacgacgtgattgaagttgtcctcaaaacggtcaaacggatgctgtaatccggcacttcctctagtattgaacttcactttttctaggatatttgaataattcgttaggtacctagacatctgattattaggtacctatagttttctccgtacaataaacggcgagagtcatatgaggcggaatatgcaggattcacagtatgagaaaacggctcgggacttctttaatacaggtcccgttgaacgtcagttgcttgatacattcggtttgattaacgcgataatgcacgcatcgttcacaagtaggtctggacagccccatgcgctcctcaggctgcttgctaacggcggaacgatgactcagaaagatctgcagagcggagaggttcccatcagctccgcagcgctctctgaaaccctctcaaagctggaagcgagcgggcttgtcaagagggagcgctctgagaaagaccgacgccagatcaacgtgtcactgacagaaagcggacgggaagaggcaaaacggtgggtcaagcgtaaaacagcgttcgaaagagaagcattttcggttttgagcgaccaggaaaagaaagtattgcttgcgctcctcacacgggtgaggcttcattggatggatttagcacaggcacagaaacgagagaaggtgtaaacaggcgtgaaagtaaaagacaggattcacgaagcggtcagcgccggcactgactcgagtgtgcctgaatactcctatagagatattttctccacgctgggcaaatcactgcgggaattcaagaagacctcacttgcgacccccatcatcgtcacaggcgaggttgcgatggagtgtgctatcccttttgtcaccgctaccctgatcgaccggattgaggcgggggcgcctatgtcgaccatcgcccactatgggctgatcctggtgattatggcactggcgtcgctggccttcggcaccggagccggcatcacctgctccattgcctcaacgggtttcgccaggaacttgcgccacgacatctttcacaagattcagacgttctcattctcaaacatcgataagttctcgacgagttccttggtgacgcgtctcacaaccgatatcaccaacgtgcagtttgcgttcatgacgatcatcaggaccgccgtgcgctgcccgctcctcgcgatcttttcgatcgtgatggcatttctgaccggcggccccgtggcggtcatctatgtctttgtcgcaatctttctgggctacgtcctcttcaggctgatcctcatcaccacgcctatcttcaagcgcctgttcagaaaatacgatgcgctgaatgattccgtcgaagagaatgtctccggcatccgcgtcgtcaagtcctacgtccgtgaggactacgagcgcaagaaattcggtaccgcttcgcacaacctgtacaacgacttcgtccatgtcgagcggatcatggcgtggaccagcccaattatgacgatctctatcgatgtgatctactgcttcgtcgtctacttcggctcccaggcgatcgtctccagccaggcacaggcgatgggcgtggggcagctttcatcgctgatcacctacggcttctcgatgctcatatccctcatgatgctctcgatggtcttcgtgatgattgtgatggcagaagagagctcacggcgcctctgcgaggtcctgaaggagcagcctgatctggccaaccctaagaaggcgatctatgaggtgcctaacggctccgtcgacttcaaccatgtcagcttcgcctattccaagaaggcggaccgcatggccttaaaggatatcgatctgcacatcaacagcggtgagttcatcggcatcatcggtggtaccggctcctcaaagtccacgctgatccagctgatcagccgcctctacgatgcgaccgaaggctccgtcttcgtcggcggccacaacgtgaaggactacgatatcaagtcccttcgtaaccaagtggcagtcgtgctgcagaggaatgtcctcttctcaggtaccatcaaggacaacctcagatggggcaatccgaacgcgaccgacgagcagatgcttcaagcctgcaagacagcacaggcagacgagttcatccggcgcttcccggataagtatgacacctacatcgagcagggtggcaccaacgtctccggcggtcagaagcagcgcctctgcatcgcccgcacgctcctgaagaaccccaagatcctgatcatggatgactccacgagcgccgtcgacaccaagaccgaccgtttgatccgtgagggcttcaagcattatatcccctcaacgaccaagatcatcatcgcccagcgcacctcctccatcgaggatgcggaccgcatcgtggtgatggacgaagggcgcatcaacgacatcgggacccacgagcagctactgagacggaataagatctaccgcgaggtctatctgacgcagaacaagcagtcccacgatcagaaccgcgcggcgctcaaagaagcagtcgcccataccagacaaaccgaacagtacacaggagaggaggactaggacatggctgagacacaaaatgcaaaagataccgccaaacacacaaaacgtcaccacaccctgagaagagtgctcagcatgatcttccactactaccctgcctatacgaccatcatcgttatctgcatcattgcaacctcgctgatctcctcgctgccctcggtctttctgcagcaggccatcaacatcatcgaacagtttgtcaaaaccggtgattggagtacggcgcagccgcagatcgcccgcgttgtaatcacgctcatcttgtgctacctggtggctttggcctgcaacatcacctacacccagctcggcgctatcgttaaccagggcaccttggataaagtgaggcagcagatgttcagccacatggagtcgctgccgatccgctatttcgacacgaacaagcacggcgacatcatgtcccactacaccaacgacgtcgatacgctgcgccagttcatcggccaagcgctgccgagtatattgatgacggtcgtagcgatgatatcggtcctcttcatcatgctctggtactccgtgcccctgaccatcgtcgtgttggtccccgtgggactcatgatgtggctcaccgatgtgctcggcagccgttctgcccgctactatctggagcagcagcgctcaatcgcagacgtcgagggcttcgccgaagagtccatgaacggccagaaggtcgtcaaggtcttcacccatgaggacgctatcgaaaaggatttcgataaggttaacgagcagctcttccaggctgcaaagaccgcaaacatgtacggcaacaccttaggcccggttctcatgaacgtcggcaacctcgcctacgtggtcgtcgcgatcttcggctccatgttcctggaggctggcatcgcgaacccctccatttccggcatggcgctcaacatctcgatcgtcgtctccttcttgaacctcacgaggcgcttctccggctccctgggccagatctcccaccagatcaacttcgtggttatgggccttgcgggcgccgagcgtatctttgcccttgaggacgaagagcctgagcaggataacggttacgtcaccttggtcaacaccaagaagggcaaggacgacaagctcgtcgagagcaaagagcacaccgactcctgggcctggaagcatccccatgacaacggcacgatcgactaccgcgccctgaagggcaaagtggacctctacgatgtagactttggctatgagccgaatcgcttagtcctgcacaacatcacgatccacgcgaagccaggccaaaaggtcgccttcgtcggctccaccggcgcaggcaagacgacgatcaccaacctgatcaaccgattctacgatatcgatgacggcaagattcgctacgacgatatcaacatcaacaagatcaagaaggcggacctgcgccgctcactgggtatggtcttgcaggacaccaacctcttcaccggtaccgttatggacaacatccgctacggccgcctgaacgcaaccgatgaggaatgcatcgccgcggcaaagctcgcgggtgcggactccttcatcggacgtctgcctgatggctacaacacgatgctgcacgacaacgcagagacgatctcacagggccagcgtcagctgctctcgatcgcccgcgccgcggtcgcagacccaccggtcatgatcctcgatgaggcaacctcctccatcgatacccgtaccgagcagatcgtccagaaaggtatggacgcgttgatggaaggtcgtaccaccttcgttatcgcccaccgcctctctacagttagaaactccgacgtgattatcgttctcgatcatggccgtatcatcgagcaaggcacccacgatgagctgatcgctaagaaaggtacctactaccagctctacaccggagccttcgagctcgaatagttatccagagcctttacgactttgtgtacggtccgtctcaccaagaggcggacttttttgtcttcaggtcatcccgtatctttcaggttgcagctaccctctgcgttgggaactatggtgagaaaaaatcgaaagacaggtattccatagacaacgattcgatcagcagacgcagttttttcacggtatcgaaggcatcgggctcggggcagctgcgctcggtcttgctgagtgcagctcatctgcgaaagcagcaccgacagaacaacgggcgcagtcacagagcgctccaaatttctctcaagtcaccacccgcgcctttgtcgatatcgtttcaagtaggcttatgggatactgtgccgatggagtgtacactttcttggggattccccatgcgaccgcaaaccgctttcaagatccgcagccagtcacgagctacggtcagggcttctacgccgcgatgagcttcagtgcgatgtgcccaacagccccgcacgttcagttctatcgtagagccgaaccgcaacggcttcagcaccccttcccgcagcgatctggccggtaacggagcgctgcctgtggtcttcttccacggtggaggccttattgctggtgcttccagcgagatagggctctacgaggaggccgactttgccaagacccagggtcgcgtcttgtctccatcataccgcctcaacatcctcagcttctcgatgtgtctgaggcgggttgagaaatacaccaactccggttattgccggcatcctagacggtggcgtagctctggaagggaaccgtgacaatatcagccgcttcggtcggtgatcccgtcaagtcacaatcgtcgggcagtccgacggcagaacgaagatcatgaccctggcctgcatggagcgcacacagggactcttctccaaaggggtcatccagagcggctatatcttcgacacgacgccacagacgcaagcaatcgcaaaggcgacccaccagatcgtgactactatttactgcaacaccattcggtcgcagacaacccgatcgcgaggatctgttcgggcctcggccaccgtgaacttcttcgcgacgcttcctacggtgcagacctcttccccacaccgtttattgacccccgataccggtaccgtcaacaacctcgcggcccaacgcacctggataatggagacaaacgttttcagaacttgatgcactgcctctcccctggcgatgcactcgatgcccgacgctcccgctttcgtcgactttcagaacatcaccgatcttcaggtactggacggactacacagtggtacggcgatgatgctagcgtgtttgagcagcggcctgccccaacgcctatcacaccccatccgccccgtggagtcactctggctggcgaagactacgagctttgttctccatacgacgctcaccgagcctgacaccgggatgatccctacttcagccggcagggacttcccgtatacaactatgtggctactacagccgtcgggttttcgggagtgtaacgatggcgcactgcgaagatctaccctactggttcgcctcgcctgactgtgtgccatacctttttgctgatgacgacgatatgacccacactgtcgtgcagaccatgtccgactcgcttgccacttttgcacgcaccaatgacccctcatatgacgcaatccagtgagatccctatgccaccgaccaccatgcgacctttgtcttcgatcggggctcccagcagaaagaggggttcggcgaagaactttatgagattatgaagcggcacaattcatagattcggtctgattcagccttctgctggtcctcagtaatccaataatcgttgatggcaaacacaaacagccccagcttcttaaaaagccagggactgaatgttgacgcttatgatccaaacgctacttcaggttgtacatgacgtctttcggctcgatcacgatcttatccggatcgcccttgcggccaggcttcatttccggcttgtccatactgattgcgtggaccgggcagacgagacggcacagatggcaaccgacgcacttgtccttatcgatggagaccttacgctcctcaggatcccactggattgcctggtgggcaccgtcatagcaggagatgtagcagcgtccacagtggatgcacttatccgtatcgatcaccggatagaccttaaagtcacggtcgaggctatcagccggcagggtattcggcaccgcaaggccgacgagctcggagagcgacttgacaccctgggagcgcatatagtgggaaagcccatccttcatatcctcgacgatgcggtagccatactgcatgaccgccgtagtgacctgcagggtcgttgcgcccatcaggatgtactcagcggcatcacgccaggtctcaatgccaccgataccagagatcgggagatctttcagatctggatccgcgcgcatctgctggatgaaccgcagggagatcggctttacggctttgccggaaagtccggagactgcactcttgccattgacgatcggcattccgatatggcgatcaaggtcgacgtttgcgatggatttaaccgtattgatcgcagagataccgtcagcgccgccttccatacaggccttggcgacctcagtcatatcggtgatgttcggtgtcatctttgcgagcaccggcagctttgatccgcgttttacagcggcgcagcaggtgcagcagaggtctgggttctcaccgacgtcggagcccatcgtatggcttgtcatctgggggcaggagaggttcatctcgatcatatccgcaccggcctcttcaacctttctagcgagttcagtccagttgctctcattctgtcccatgatggaagcgatgatgatcttgttcggatgttccttcttgagccgcgtgatatcagcgaggtcctgcgcgagcggatgctcagcgatctgctccatgttcttgaaggctacaaaaggcgtggcctccttggtgagctcatcaaagcgcggagatacctcatcgacgacaaagtcatcggtgtgcagggtcttgtatacgataccaccccagccggtatcgaaggctttggcgcacatctcatagcagttgcctactggcgaggatgacaggcagaaggggttttcaaagtggacacccaaaaaatcaatgaagagatccatctgtttcatctcactcgcctcctttcagggaagcatcaattgctccagcagcttccttaccgcgccgcactgcccacacgacggtcttatcgccctgggcgatatcgccggtcacaaagatgtgcgggtcagaggttgctgggccttcctgtgccatctctacgcccttgagatcgagatcaacgccgaggtgatcgagatcagcacgctggccaactgccagaataatcagatctgcagagatcgtgagggtcgagtctatcacacgatgcttaaaggttacctgatggccggaagcctctttcggttcatacccgtcgatcagggttacacccatctcacgggcgccatcgagctcctctttagaagccaggaattcgcaggagcgctcccagatcacatcggtaaccgtaggaactccgagcttcttgagcgtcgttgagacgtccattgcaacgtcgccaccaccgattacgaggacattgtccggaactttcatcgtgccctttgaggagcgtacctcgtcgaggaagtccaccgcgagtttgacgttgtcgttgtccttaaagatcggcagcatcttgccctctgataggcccggatccagaagtaccgcatcgtgcttacctaagagctgtccgatcgtgatatcgtcgttgggacccgtgccgatggatacatcgcagtggatcgttgcgccgagctctttgacacgggagatcgcgcggttcacgatatcgtccggcagacggtaggccgggatgccgtgtaccagcatgccgcccggggtcggttggcgctcatagatatcgactgcgtggccgaaacagcgcagagatgccgcagcctgaagcgctgccggaccggagccgacgattgcgatagagtgcccggtatctgggccggcttccagcaccttcatcgagatgtcgtaggcatagtcggtcgcatagcgctgtaggcctttgatatcgatcgggtgatcgatatcggtacggctgcagcctttctgacagtaacgctctgtggggcatacgcgtgcgcagatatcgcccagcgcattgttctcaaagatcgtctctacagccccctcttcgtttaagaaacgaatgctgcggatgaacttagccggatcggtcgaggcggggcaatcctggctgcacggcgcgtcttggcacagcaggcaacggcttgcctcctccatagcggtagcaggggtatagccctcccgccactcctgctcgtatgtatcatccacgtcgactcctctcctagtgcatggaatatttcatacatgtttcttcacattatgagccaaccaaaaccgtttgtatccacttgccccatagatgaagaaacgtcttcggtaaagggcaaatcctcgaggttcagccacaccgcgtgcatacacgcgctcaacaatggactgaatggcacactatctgtactcgacaggacacaacctgccccgccctatggggcaaggaagatatagaagatgctgcaaaagcaaggagaggcacatgccacccgctacagggtgtcttaaggctgatggagcttgcaggcatctgcccatgctgtacgctg

SEQ ID NO: 336 - DNA, 22448 bp, Unknown
  Metagenome-assembled genome
cgaagacagggcatgaccaatgatctgtcgtgacgcacgagatgggctttgcccgccgcgtgcccgcgtcgtcttcatggcagcggccagattgtcgaggaaggcacacctgacgtttcttcgacatccagagccagcgtgcccgcgacttcctcgactccatcaggggccactagccaggatatcccgaccagcactgtcgccccgcatcagccgcaaacgatgcggggtcctcatatgaaaggcttcattcccatcagcgtcctcttcacgcttcgctcccccctgaggagagggccgagcacaggtccccaccagctgccccgacgaggggatggcaagctgctttcccgagcaatcatcgatgcaggaggcagcgcatcctgtccgctacagaacgcagagcaataactcgtagtgagctctgcgacggctttccctgcaggggccccgatgtgacgccgcttcgcgcacacgagccatacgacggcccctctgccccgagcgcatgcttcgagcttccgctcgtgcagaagatcctcgctgcaagacagccgctcttacaacctgtgccgcggccgcagctcctgaacgtggcactcgcggcacgctctgcctggattccagcagacctcgccgacggctgcagctctggcgccacagggcttagccccttgctgtcctcctccatgccctgacggccaagatgtcctgcccaagctctccctgcctcaggcacgtttggcggtccatgaccgcatccaggcggaaagcgggagaagagtggcatcctgtggcgactcctcgagaagtagcgccccccgtcgtcgaggcgaaccaccggatcgacgactatattctgcgcaaattggagctcatccaggctcttggcaccgcagcacagcatgctatccccgttgccgagcatgcgactctcacggcagagggcacaaggtcttcgaagcagcaatcgatctgctgctgcaacaagctcggcgacagcggcgtgacaatgtccactgcactgccagcacgactggcggccgcacggcagtggccgccaccttggtgatgaagcctaccattccgagatggtgccaaacaaacaaacagtcctggccaatgcctgcgcccccgactgttcagcctgcaatagccaggaccgccttcatgcggagtacgacctttgcgaggctctgccttgaagcttagtgcttgtccgcgtcggatgtctcgctgcaaagatggcagagacgactgccctcctccggcaacacgccgtgccgttcagctcatagtcgccttcggcaaatccgaccgccgccgataccgcgtgacattaggggaccgcgcgcgcagatgcggtgtcagctcctcgtattcactcgtactgcaagtctgtgttttctggcgcggattgagcgcaccgaccgaaatagtcggcgaccctgccttccaggcagcccacgcctcagccacgttgtgcgagacaccgaatgattcaatgcgcatcctcgcccgatctcagcgggcctgtgctgcaggcaaggtcttcctgccgacatgcacgcctccgcacgcgagcttctttgcactcgacagcgggagcgtcttcgagacacgacgggaaacggtgcactacgcagtcgccttgagctccaagggcaagcttctctgtctccgcctatccgtccttcttctcttctcgctaatctggatgaaacgtggccccgcctgaattgcctcctcctcacacaggaggcaacgtacagggccagcgagcaagcccttccgtcccggcgtagcagagcattctctgccagatagcgtcagcagaccagggacccggcgctggccagggtccgagctttgcatcatctgccgcatcagagatcggccacctttgcagattcgctagctatttgcctgaatcgagagcgccgatcaggtaggtggcggaaagatccggtccgtcctcccccttccctacgtgcacgtgcctgctcgcccgcagatgcacatctcgaatccggctacgcttgccccataccatcatcgttgctgccaataagtcttagcatcgccgaagcatgcagaggccccgtgccggttatgtgtcccctcatggagaacggggccgttccttctagctggaggtcctcgtccgtcggagcaacgattcgatggcaccggttacggcgaccgtgcatcttccatgccttggcaaggccaagccacgaatgctgctgtccgcccggagaggttttctcctcgattcgctgcatcggcagcaaccatcgacgccacgggtcgaagcataggcgccccggcccgcggcgtccctggccttcgccacgctacttgacggccactactcgttgggccgatcacgtggctccgacagcatcgtgaacgcagcttgagccgtgtggtttgacggcgcgggacgtagccgctgttgtagtctctttagtttgtcggtcgctttgttcggcatatctttgcgagcgctgcgggttggggtgccttttagcgaactttgctgatgccgtttcttgtttggcgctggcgtcgctgcccgcgagttaaccccataatctttgctagggtttactttgtgcatgtcactaggaggtatacgagtagatgtcaacctccgctggataggttcccccgggacttgctggtggactttctgcctgggaaaggatcctcctatcggcgctgaaacggttgtggtgaggcatgcgcagcagtgctttcgcgagtgatggtagtgattcatggtagcgccctttgtcgctgttcgccgagtggttgctctgagcgtgtcctgtgactctcatggggttcgtatggtgtgcctattgcaatacttttttcgctcgttgcggcgctttggtgggttttgccgtccagcttgtcggatcttgggccgctaaggaagaggctcagctccgtgcattcttggggtgctgccaccttccgtgcttgggagattgtacatgtatggcgggggctgtattgagagacgggcctgctggtcgccgttgtgcgttactttgcgtgcgtctctctgggtcggggtcggtgttacctaacttgtatacggtgagcggggggttgtgttgtcggggatttgacctcgttggtagtgttggggcgttcaagaagcgtggttcgcggttttgttgcagggagtcttaagattttggacggcgcgtgccgcggtgctcggtctgagtccgttacttacgttcggggcagcctcctgggttctgctgcgtcgtgtgtattacgcgaaccgacatgtgttggggaaaactctccagggccgtggtttggacggtattgtgcgcctcgtacttgcccgcctccgagagcacacgatctctctcatgtttgccgcaacgcatctggggatggtacgtggtcgaggagatgcttcgccgtcgctcggtgctgatcgtcgacgcaccggggcaccgacaagggtcgagcacgaattgcatatccagagatgctgcctttgcgggccgcatggggtccatgccatcgatcttccccatggttcatgggtgtccgatgttgaggtcgagcctctgctcagatcgatggtgatgtcttcccctcgtctcggcgtcgctctatcggggtgcgccgagttgcgagaacgcgccattcgcgcactctttttttcaatcaccgtgacgtattcggtgatgcgcagcaagggcgctgcctttgcgcacttgtccgaggacaggtaccggcccttccgtattcataatatgctcctccatgcagcagaggcagatgctgcccatctgctcagctgctttctatgcggttcttctcttcgcttctatccgagaatcgaccgtccccctttttcaaggcccggccatatcctgtttcacggtacggcacaagcgcacatcttgcgacatcgtggcaggtaccatcctcctcaggcggcggcctttgcgaggatctccttgaagcacggtcggggcgtcgattagcgcactcgaacatgccatccctccagtcccaactgcggcgggcatcgcttcatcttgttgtcgagtcgcgtggctccagggaggcccttcgcgatatctgccgcatgcgtgtcgattcgcgtgacgatgaggccttcgcttacttccttggcattcgggaagctttcagatgccagctgccgcgtcagcataggcaagccatcacaagcaccggtggaagccgccacggcggccgcagatgcaagccgtaatgtgtcgttatcctagcccggtgcgaatcgtcacgatggtctcgatcacatagaacgcgcaccagggcagaagacgctgatggagcttcaatgtttggcctggatgctcacttaaattcaggagccatatttttcctcgtccccattcgaaagacgactggacgcccttccccagtcacgcgtcggtgagtcttgcctatctctgcaagctccgccacctctcaggcatccgttgcatcgtagttggagtacgccacgcatcgcatcgcccaggctgatcgtcccacgtcgtggtcaggcggcactcggcacctcaggacagttgctcgtagaagggattctcctccccttggtcatcatacatgcaaagaggagcgatcctccgcgcgacacgacttcgtgaggcgcttcgtctcgacacggatgacaggacagaacggttgaagcctgcatggatgggtccatgaagtcgaacgccgtcttctgcctgcgcttccacgcctccagtaggcagggccgtaagttctacgagcgtcttcgttgtagccgatcacgtcgtcgatgggccaccgtggccccgaccatcacggcgtctttggctataagttcctctgcggacggaacgggtcccttgccgaagttcgagaggtccatgttcgcatcgccgccgcactctcggcaatccttaccattctccactcctccttggcattctgatgtctccgagatgccgagattcacttttttgaccttcgttcgcaggccctgctcctaccccgcagggacgaagcttctttgtgccgggttacgagagcgatgttccctttgccgacactgtctcttatgaatggcgtccgatctgtgttcccactgctaccgctgcatcctcgtcggtcactgtaccggcacgcgcgcagatccatctcgtcaatggcgctcccttgttggcattatccacatcaggtgtcaagggtcgggactactgtcccactctcagccggctatgcaccagctcccctctatgtctgcatgctccagaattcgtctgcagatgcaagccgaaagggtagcacctgaacgcctagatagcaaaacggcagaggcgcttgatatactcgatgagatatccgacggaaggacgcaggtagccctggaatccaagcggctatcagactcaacgccgacattaaacggctgggtcagcgagggcttggaatggggcagcccatcacatgaacctataaggccgccacagaaggcagatgtacaagcgtgctcacgccgcaaaccggtgccgagaagcggggtccccgctctcagggaccgaatcctcggccttgctgcaggaggaggccagcattccggttcttgctgtctgcggagccagattcaccgtgctcgaccattcggaggcacagcttgcacgcgagcgtcttcgtcgccgagcgtgaaggatacgaatatcgagatcgtgaagacagacatgacggaagggctgccgtttcaggacgcaagcttcgatagtggtcctgcacctgttagcctctgctacgtgtcgcgaatgagaacccatcttccaggaagtcgcacgcgtctgtaccgggtggcgcctttctcgcagtcttcgattttggtggctgcaactacgtcggcccgatgaagcggagggagcgcatcctccatacagcctgccgttcgaccccgtcgcagatcttcccttgcagactaactcacggcaccgtatgccggcatgcagttctcaattctcaagagagatcctgggcggcatgctccctgccggcctcgtgatcgcgatttttctgatgacacgaacggcgaggcaggccttcatgaggttcaattcccgaccatgctcgctgtgaaggcgcacaggctagagaatagcgggaaaagaacatctctccatccgctgtgtccccgaaatcctgcgtccaacaagatgatgcgcactggctgggttcaatgccgtacctgtccatcccgcgccctaccacaggcagctggcttggatcgcattccatataaccattcagaaccaaatggatgccactcgcagctgacgttggattcttattccgctatcgtgccttggatgataattgctctctacacagcttgttactccccggaggcattcgcgtgacatctcatgccaggaggttgcagcttatgccactgtgagttttttagcgaagcgtcccatccaggcgaaagatatcgaagaatggatacatggagaatgaaacgagtatgggcaagagaacgatgtcacggaggagcttcgtccggatcaggcagcagtttcggcagcaagcactggggattctgcttgctggcggcggaaccacacagcgcagagcggctagcgggctcatccatctactatgccgcgaaagctgatagcttggtcgcaaagacgggcatacggtcccccgtcaagagcaacgaacgaggacgggcgtgaacatctggtcggcttgccttactgcagtctccagagggagagctccgcgggcaggcgcccgaaggcagaatcctggacgaagagcgtgactgcacccagccagcaaccgccagcgtctgccgtatacgaacaactaggtactggcacagaggacttcctcacctcgagggtctatgctacagaaggccaagcagctcccggtcctcgtctatatccacgcggaaacaccatccgaaaatgcgcagagaattccggcaatgatcttgcgtgaatgactcattttggtcctacgtctcggctgagctaccgcctgcatctcggattcaactgcctccctgccctcgggaatgattaccggcaactttcacgctcctcgcatgcagcggagctcgactggtaacgcagcaccatcgaggcatcggcgagaccccgagaatgtcacggtatcgtcattctctgctggcggcccgatgtcatggccatgctcatgatgcccgcctgtccgagggcagggcgacaaggccatcggccttctcgtgcggatacaacagaagaagctcgagcttccaaaaaatattgcagctgctctgggtgcccttgcttaggaggatggcaaggctgcagacgaaagagagcgccctatcagtggctcctctctgcttacagacagtgtgtgactctctatcggtctccggcgagaggcttgaccccttatgggcaatgcctcccatcccatgagctccttcccgcacctctacgaggacgacatcgcgcttcccagggtggcctttcgcgaatgcctcctatcacgctgtgcccgctcccaaaatccccccaccaccccaatgttttgaccggctccacggagtcagcatgtttccagcgccttcgatgcgttctgggagtcccgatcccatggccgcgctctcagaagacaggctccagctgcccaggcatttgccatcattcgcggagatgtaccgcatttcatgctgaatgctctgccgagcagaggtccggctcgcaagctcgaccatgacatcgaggacctcgttgatcatctcagggtcgagggcgcttgtcggctcgtcgaagagcatggccttcgggtgcatagccagggagcgggcaatagcgacacgctgctgctggccgccggagagctgtgcggggaccttgttcgcctgctcggccacaccgacacgggaaagcaggtccatggcttccttcttcgcctgctccttcgactcatgcagcacatcgatcggacccaaggtcacgttgtcgaggatcgtcatgtgcgcgaagaggttgaactgctgaaagaccatgccgaggtcggcacgcatcgcagcaagctccttgccctcctggggaagcggctttccctcgatcaggatctcgcccgagtcgatggtctcgaggcggttgattgtgcggcacagcgtcgacttgcccgagccagaagggccgacgatcacaaggacctcgcccttgtggacggagaggttgatgtccttcagaacatggaggtctccgtagtgcttctcaacatgtctgagctcgatgacgggcgtggaggctgcctgtgtatccatatggctcctatccattgccagtatgccttcctctgcctgctagacaggattctcgttcgtgcgtgcgacgattccagaaccctgccttctggcgagatagacggcgagctggttgatgccgtaattgatgaggatatagatgattgcgaccacgaagtaggtggagacgagtgcgtcgtagttcgtgatgaggacgcgagcattctgcagaaggtctgggaacgatacgacgtaggcgacggtcgtatccttcacgacgacgacaagctgcgagatgagcgatgggatgaccatgcggatggcttgcgggaacacgatcttgagcttcacgtgcagcgggctcatgccgagagaaagtgccgcttcggtctggcccttcgggacggcatacatgccggcacggaagacttcggctaggacgccggaagctgccaaagcgaccggcagcgtgatcatccagaacgaggacatcttgatgccgtactgggggatgacaaggaagaagaaatagatcagaagcaggctcgggacgccacggaagaagttgatgatcacgtggcagatgccggcaaggatcttgttctcgctgatgcggcccatcatgaggaggaggcccagggcaagagcgatgatgcctgccgtgacagcgacctcgactgtgccggcaaaaccctcaagaaggaagcgccaggtcgtccagcgggcgaagaagtcccagtatttcggggcgagctggcctgtgacatagaagcgctggacaatcgcgaagatgcccagagcgacaagcacgagtgagattgcggtccagatatggatgcggcggcgggtcttggggccaggtgcctcgtagagggcgtcgcgcatggaagcagtcgtggcactcatctcaggatcctcgctttcttgtcgatcgcgttgccgacaaatccgatggcaagagccgttaaggcatagccaagagcggagatgaagaacgtcgcgataccgccggcaacctgggtgttgattgtcgagacgatgccggtgagctcatttggatcgagcggcacctgggagcccagggcggtcgtcagcatgacggcgatgagcaggttcgtcatcggcagcacggacgagcgcagagcctgggggataacgatgcggcgcaggatctgcgtgaacgtgaagccgatggaacgcgccgcctcgatctgaccgacgccgatcgtattgatgccgctcatgaagttctccgatccgaaggcagagcctagaaggatcgtcgtgatgatcacgcagtcgcggtaggacaggagaaccttgagatatggtagggcataaacgcagatgatcagaagcgagatgccgggtatattgcggaagatctgcacatagaggtcacccacgacgcgcaggggctttatcgggcagacgcgcatgatcgtgacaataacagagagcagcatcacgaagacgaacgagatggcagtcagctgccaggtcgtgagaagggctgtgatgtagtccgagccataggcgctccagagctcagcgaagctcatacatcctctccttcctttttatgaagtgccttcctggaagaagacgtgtgtatctctagagaagtatgaggtttccgcctgggtgcagcggaaacctcatagtgtgttaacagctaggaaatatgctggagatgggtgctatgcgccgatagcaggaggctcgggggcatttgagagacctgtgcggtcgccgatagcgatcttccagagctgctcccacgttccgtcgtcttcgatgcgcttgagccaggcgttcacgaactcgacgccgtcggagtcgagtggaaggccgatgccatagggatcctcggggccgaacgggtctcctgcgatgcggtacttgccagggttcttcacgacggagcccatctggagcgtctcgtcgatcacataggcatcgacacggccctgctcgagtgcctggcgcgcctcctcgtcagtgctgaactcttgctgcttggcatcaggagcaagctcgctcacgatgctcggacccgtggagccagactggacagccacattcttgccggagaggtcgtcgacgctgttgatgtccgtgttgtcggcgaggaccaggatggcctgttgcgagacaaagtaggggcctgcgaaggagatgactttcttgcggctgtccgtgatggagtaggtggcgaacacggcgtcaacctggtcattctggagtacggactcgcgggtgtcggacgtgacctgtgtgaggtcgagcttcgtctcgtcgcccaggatgtagcgggcaagaagctggtagaggccggcatcgaagccgcggactttgttgtcctgctcgttcaagaggctgaagagggtggaggtgcgggtgctgccgacgcggaaggtaccggcgtccttaactttcttggcccaggcatttgtggagatcgtgctgtcgtcggcgacagtgccgcctgcaatcagagagtcataggcgtcgatatcgaggtcggtcgaagcactcgacgtatcgggcgagcttgaggacgaggatgaagacgcagtgctcgaagaggtatcggaggagtcgcaggctgcaaggccgaagaggctggcagctgcaagggtaccggcacctgctgtgagcgcctggcgcctggtgagaaggagattctcgatcttgctcatgtcagtgccttcctttcattgttccggcttccgagacagggaagccgtggtaaaagagatgacgctctaaattataccgtcggggtggcaataaatattcatccgctggctgaacgagtgccgttttgcaatgaatctttcaggcttctagctatctctaacctagatatcctgcttctcttatagatgtataggtagtgtggataaagcgcagagtctttggctgaagtcttattttcattaaatctgaatagcgtctgccgaaaatgagctccatcatgctacaaaagctgtatgagcgggtaacaggaaaaagacctgatagcggtagaacgggtacgctgtctgtacagggaggcggcaatggaacccgggaacagcaaagaagatatctggaaggtcggcaggggacgtgcggtgacaaggagaggagcgcttggcctcgtagcaggcatagcgatgctcggcgttgccggatatacgggctgcggaaagtcggacgacacatctgatgctgcagtggatgcgcagaatacctccgcagctgcggcagacagcacagacaccgatacgcaggagcaggctgctcctgagccgacggcagaggagcttgcagcgcagcatgtggaggagcttctgtccggacttacgacggagcagaaggtgagccagctcttcttcatccgtcctgagagtatcgtttccgacacgatgacccaggcgggaacagaggtacagcaggcgctttctgcctaccctgtaggtggcatgtgctttttcggcaagaatctcgaggatacggatcagacggtccagatgctctctgccctgaagacgtattcgaaagaggcctgtggcatcccgctgctgtgctctacggacgaggaaggcggcacggtctcgcgtatcggcggcacgcccggtttcggtatcgccaatgtcggcgacatgcgcgatatcggtgacgccggcgatgtctcggctgcccgtgatgtggctgagaccattgcaggctacctcctgccgctcggcttcaatctcgacttcgcgccggatgctgacatctgcaacaacccggatagcaacacgatggcgcagaggtcgttcggaaccacggcatctgtcgtcgcacccatggtagcggcgcaggtcgaaggctttgtctcttccggaatcgggtgctgcacaaagcactttccaggcataggaggagcggtaggtgactccgagacagagccaatcgtctcagagaagacggcagacgagatggcagaagaggagcttaagcccttccaggcagccattgcagccggtgtccccatgatcatggtcggacatctctcctgccccaatatcacaggcacgtatgctccggcttccatctcgaaggaagtcgtcacagacatgctgcgcaattcccttggcttcgacggtgtcatcatcactgactcgctcgagatgggtgcaatcgttcaggactatacgatcgagaccatcgtgctctctgctctcgatgccggcgtcgatatgctgctcatgccgagcgattttgacagggcctatacggcagtgctcagtgccgtggaggcaggagacatcacggaggatcgtatcgacgattcctgccgccgcatcctcaagatgaaggtcggcttagggctcgtgtaggggctccatttcatcggctgctctgtcaggcgtatgatgcaggagaaggctgatatgcagagaggagcagccgatgaagaagggtcgggaagaggtctcgcttttcgattttgcctatctcggcgagggggggagacctatgcgcgtctggcggggatggctttgcccgagcggtgggacttcgtcgggacagaggctcgttgctacgagattctgagcgactacctgcgcttcatgttcttgcgcctcgagcgcaagaacaaggtccttgtgagcgatgcaggggatttctgtgccttcaatatgggctttgtcgacgaatcgtatgaggacatctttgcctgtttcacgccgaataaggtgccgggcaagcagccatggtacctcgaaggctttgccgttgccggggcgggctggctcggcgacaggctgtccaggagcttccacgatctgccccagcgtgcacgctatctcttcaagacagaggacgtgttctacgacgtggaccaggtgccggcgtttgactatgcccatatcctgattggcaacgttgaccggctgcctgaagccttccttgagcgtgagcttcacgacagcgatgaggagtttgctgtcgtgaagcgcgcctttggcatgcaggagaaggatgtacgcaacgatgctttcgatgcactcgcaaagctcctggatgccgaccagcgcgttttcagcgcttgaaggataggatcgatgccattatccggctctcggtcaagaaggtctcctggagctggcgctgggccgtgtccatctactatcccggcagggactgcgtgagcctgcttctgccgcttgaccttacggaaggcgagcagcccaatatcgcgcttgtgtttgagcggacgcagtcgggccgctatatcgggcagacgatgctgacggctgagatggcatacaaggatgcacgcctgatcgcgcgcccaggagccgagtggctcgatgcttgcttcgtgcagtaagatctaagattgagatgggaagacaggagagaggctgatgataaagacggatacgcccgcatgcgtccttttcgatttcgacggtgtctgtgccgataccgagaggtatggcatagagcttgacagggaagtgtatgagctttacggcatcaaccccacgagagaggagatgcagtcgctggtcggcacgaccgggctcgagtctatcccggcactcttcaggaaatatggcctcacagtcacggcgcaggagttctttgcaaagagacgcgacaatacctgcatctaccgcgatttcccgctcgaggcagagcctggcctcataggagtcctggcagatctccgtgcccgccgcataccgattggcctcgtctccacgacggctgcctcttctatcttctttgcgctcgatcggctccacttggcatcttcctttgatgtcattgtcacaggagatatgtgcgagcggcacaagccagagcccgacccctatcttctggcgctcagactcttgaacaaggatgcgaaagactccattgctgtcgaggattctcccgttggtattcatgctgccaaggcagcagggctctatgtgatggggtatcgaggtgcgagcatcaagcaggatacctccgaggcagacgagcagctcgaaggatttgttgcgtttcgcgtgtagtgctccatttctttcaggttcagctcgcagggcatctgcgtgcaagtggagaagcgtttagggtatgagtcctattgaacgatgttggttttctctttgaggaggtatccatggaagatgtgcttgaagcgattcataaccgccgcagtgtccgtgcctatgaggacaaggctgtgccgaaggaccttatagacaaggttatcgatgccggactctgggcaccgagcggcatgggcaggcagtctgccatcatagtcgccgtcacggacaaggagaagattgcctggctctccgagctcaacaggaagatcggcggctgggaaaaggggtttgaccccttctatggagcgccggtcgtgcttctggtcctcggcaagaaggacatgccgacctatgtctgcgatggttctctcatgatcgggaccatggggcttgctgctgagggcttgggccttggcagttgctggatccaccgcgccaaggaagagtcggaaatgcctgaagtccaggagtggctctcttcgctcggcgtgccggaaggttatgagggggtaggacatctgatcctcggctatcccgtgaaggacaaggtgtctgctccgcagccacgcaaggacagccgcgtgttctgggcagagtagccacaagctgcatcagtatgagttcgggctctgcattcttgcggggtccggatttttttctgtgctgcaaagctatctgttctcgaggcaccagcggacgatgctgcagacaagcttcccatggatgtcgctatacggcacttagagcgtacctttcgatgtcttgagaccggcagccgatatctcgtttgcaaaatgttcgagcgcctcaggtcttggatagatgccgatatgcttcttccaagcagcgagctggatgatgatcctgccgtccaccttgtatgtcggcatgctccaggagatgcaggtttcagagcctggcaggtatatttcgatgccagagcagaggcttttgaatgctgtctgctactttggagccaaagcctcgatatacgtgttgacgctttcggtcctgccgctgtctgccatgctgctcctatctccggtggggtggtaacgcaagtccgtaccagacatcaccgttggtacggatttgcttttacaccccattacatgagagatctccttgggggcttcttcgagcttttgggttttcgacaatgaggtgcctgcggatccctaaccttgtagatggccctgaaaggggctgctggctaagcctttcccggcagccgtgtgccctgcctcttgcgaaggccgggggttggctggccaagggatggtggtttgtccgggaacggtgatagggatgtgccaccacgataagcaggtcagggtaggatgtccccctcagacacgcgaggccatccggcctaagaggagattacccacatggaacgcaacagaaaactgttcgggccgcagcgcttctatctcgggatagatgtgggaggtccattcctccgtgcagtgggcctgaaaccgggtgcacaatcgagatcagcctcagcaggacagtgccggagaagatgtcgaggttctgctcgacgaggcgggagagggcgcccgtgtcaattgtgactcagaagaacaacatcggctcgcttatcgtacagttggggctgcgaaaaggatcgacttcggataccggcgggaaaggcgcatgaagtacgcctggcgagatgtttcccatggaaccgcgaagaagtgaccgaacgccggcgaggccatcgcgcagtatgggcatagcagcgaaaacggccatcaggcccatagccgagtacagacgactggacgctgcttctcgatcggttgacctgtatcagttttttttcgacattgcagcttgaggaattatgaggctcctcttaactgcaagacagccgaccgaaaagactacatggcaaacaatcttgctaccaaatacagcgatgagtagcgcctgaaaacagctgagtgtgctatctccaccggcaagcctaaaagccacctcaccaccgagttagggctaattagtcccaaaacacagatcgctgggtaaaagagcagtagagataggctatcagcgtgctaagcgcagcgaggctaaagaggcagattgtcagctgaatgccacatctccctagacttctttggctgtctgtatttcaggaccttcctcgctctgtcacagatcagctccctgtggttcacggtatcacggtcgtcgtctttgtcgcataatcgtcctgcaccttctgcgccgaagcagaacacatgagggtttatctcgagaactcccgccgcatgctcgtatcgtgtacttatcgtgctcctgacgcttcttgccatcctgggctccgtcttcatagccacaggcacggcaccgtcatctccgaatgcgtgggcgccatcatcccgcggggtaacatggtcgtcgtatcgttgtctacgcgtcggcatggccctcttcacggtgatcatggcaatgcctttgctgccatcacggtcatgacggtcggcattggggctccattcgagcttgcccctcggagatctgtcattgtcggctccacttcgccttacactgcggactactgtggcagatcatgacgcataatggcaagccaacttcaacatcgtccctgtcgcaatcctcgagatggacgacgagtacggtgccatcaaaagcagtcgtccctccctcatcattccttgcctgccatattctcctcagtctgccctcgtccgctgtagcttggttagagccatctagaacttatacaaacgagagctgctgccttcgggcaggtcttctgggagagagaaggattgctatgaagaagattctcgtgactgtgctccatccgtcgcagtgagaccatgaacccggcctgggaggctgttccgcaggcttcccgacacgattgccggcgcctcctccacgaagggcgaatcccggttgtctttggcaaggacgacccgaggctgtggacaagtcaattgacgaggtcagccgaacctcgtagatctcgtcggcgaggcaggtgccgcgcgaatatcacgcctgagtttgtcggtatcaactacggctgatgcccgcagccggacaacgacggcaacccagccggtggcatagaagatctcggctgaatgccccgatgcctacttcgcgacgctttccgccaatcaatggtccacagccatgaccggagcaggcatcccggcagaggtctcctataacggtacggccggcacctacgtctgcaacgcgtatgtattcgtgctgcacccgctggggccgacgcatccgggcgtccgttgggcttcctccgtcccgtatgcgacggagcaggcctgccatcttcttgccctccttgacgccgagcagtcgctcgattgatgatgcgcggcatcgagctcgggactcgcactgccgtcgagcacgaggaataatgtgaacggctacgtgtacaccgcactagcacctcaatctgtggagcatctgtgggaagcccgagattccctctctttcggaacctccttcgtccttcccggctctgcatcacccctgctccgagcttcaaaacagacgctgtctccgtcctgggacagggcttcccaatcatgggagatgggcaagggattgcacatgcatcatgtagaatgaatttgaaaaatccatctgacaagagactctcccggaggctgctgtttgctatactgaacgcgatcattggtgcccagcgcgatgacaagaagatctacgggaagccttcctaccggatggctgggtgacggaaaggccgcgcgctacggccatctttgcccatgggctctcgacgaaccatggggacatggagccgtatgcaaggtgtgccgctgagcggggcaaggtgacgtatgtcttcgacttctgcggtggtgcagctactcaaggagcgctggcagggacaatctgtccttcttcacggagcagcatgacctcgagggcggttgcctggagctctcagcgggagtcctatgtggactcgcacaacctcttctctgtgggcgcctccttgggtgccacgatcgcgcatcatggcgcgagggcggaacgtacagctcgtgaagggttgcttcctgctctagccctagcctcctgccttcaaaaaaaaaaaccttacgatgcggtgcacttccctgttgcgcggagggatgaatctgcctgagcgcgtccacgttatgagcatggatgtcaggagattcctgctctcctgctgggcttagactaacttcttcgagcacatcccgccctttcctcaggatgtgatcatcttccatgggacgcagatcagggtcgtgccgctctcgtactcccagcgcgcccagtcgctctctcccgcactgtgaggctccatgtgatccgggcggcggccatgtttgtcgacccctactactgtcagcaggtctgaacgaggcacgagtgggctccgcgccctatctgtcgcgagggggaaacgatgattaattcgcctcgatgaggtcgctggatccaccgctgtaagtccacctgctcaaattctcgaccacgcagtgcccataccccataatgcctctctgcctgcggatatgttatattacagcaactgtattccagcatatccaaaggaagatatggacagatagatgaagcttttagaccggtggatcaagcattctacagtgcaactatgtcctcctgaatgcaagcgtggcacactccggaaggctcgatgttggttgtctcatcaacgtcgaagctaaaggaatgtgccctacccacctcttagcctacatgagaggactgccctagccgagctgcatggcacaatggaaggccaattgcctataaatatcgctgcagagatcggcaggacagcttccagcgtctgccccagctcaaggaggaacggcttgccacggccgctttaaggcagtgctggccaaaaggagggcatggcataagggcgtctctcaggatatgccagggcaacaggcagcggcctttacagaaccctgccacttacgcagaaggtgcgcttacttctcatggacagacctggtccctaggggtgggggggaggagatagacgacatctcagctcggggtggggcaggtcggtcgtttggagcctgccgatattttaacctgaggtcctagccgtcgccctcgacctgtcgggatccggcccgcaagccaggttgtgggcgccacggttcgcaggaagggtagcaggtccgcaggcaatgaggcctaagacaggggtagattcgagatcttacacgcgaaggaaagtcccccaagaggccgattgggtctcagcctcgccgatggtcaacgaccctcgtggcagcgggggcccgtgtgcctgcgcgtgcctgccgacagtcagtgaaggctgcttgccgcaagaagaaattgccaccacgacgcagggaagcgtcccctctaagccgagggtcgggcttttgcagggacgttccctaagacgctcacccctaagtggggcagccgctcgcatggcatgcaggctcaacaaaggccttgggaggcgtacagttctcttttgcgaccctccacatcgagggcagaagctcaacagttaagaacaaccaccggcgcctgcgggagtttctccgcttaagggcacagctctcagcaaggtccacaaacgaggaggtgccattcgtggagctgatctgcgacagggcaatgaaggtcctgaactcggacatgccacgaggtcctttagggagatgttacactcagcttggacatctggccgtccgaaatattgacaccgggcgcactcgcgcagcgcctcgctgagatcgtggaggcctgccttccgcatggagttgcgccgctacgaatccacgagaggagtacttcgctttcaagaagatggacacgcttgaaggagctctttggcgcctgcgatttcgtgagctccacgtgccgctggtcgaccgaacgaaggcaatggtaggacacaaggccctttccaagtctggccttatactcataccatgtacgctggtggcaatcggacgaggggtactctggatcctctttaggacggattggtgggcagtggggctggcttccgatgtcttcgaagagaagattccctcagtagggatcccgctccaccttgacaacttcatcgtcactcttcacataggtgccgcacagaggagcgttcgggcgggtatcgaaactgcggtggaccacgtcctggcggcgcttgcaggctaagtcgtgtcctcgaatttactcatcgctatctgtggtatgatgccatcttgtcctcgttttcttgtgggtatgataatgctatgattccatcatgtcacatgattcaacacaatcaagatggagtttctttatggcaacagtcactcagacgcccacggtagtacgctttgaccgcgtgaaaggaagaaggcaacctctattctcgagtccatcggtctcatctttaacagttacgctcaacctgctgtgaacagctcatcaaccagcgttgcggtttccccttcgactggaagccatctccctcgaccctaacgaggagacgaggcgggctatggtggaaagccgggcaaggactggaatcatcccttatgatcgccggccttctctgatagtgcaagcctcatggcctacctagacaaaaagtagccatgttcgaaatcagggttgaacataggttcagctgactaccagagggtttacgggtccatcacagctcaaggagactttgccgaagccgtggaaactcattcaaccggcagtggcctgaagagtaccgtccacatgttcttatataatcgtggctgtaaattacaaacggcccattgacttccatctgtcggatggcaagacgtgtcatgtgctctaccttcccccataagacgaatcccatcatcccctcgtgcgtatgcatgccgaggagctctttaccagggacccacctatgaatttgctgctggcacaatcagatcgttacaaggaagaagaatctgagaagagtctttctcgtcgtcgccttttttttaaaagggaaacgatgatttattcgcctatgaggtagctgggccacctgctgtagaaccggccttgttaccgcctgctaaaatgtctcgaccacgcagtgcccatacccacatatatgcctactgtcttctggatatgtactagcgacatccacgcattccagccatatccaaaggcaatatggcagatagatgagcttttaagaccttaacaatcctaaggtctaaggagaaaaacccggcgagaggcacaccctggagcggatggatacaatcgtttgtgtgggatagctgattgcactggtagagaccagctaccaggacaggctcttgtcaggcctttgcgcactgcaaagacgaagcaataaggatggtgtctgctttaggtcatgttggctctcttaagacgaagaacgaaggctgccgatccttgattgccaccctggcatcgctctgtgcacgtagacctcatgtctgagccaggtgcccagatgcaacgacacttgcgacgatgtgccatatgccttaaagcgaaggagttcgggcaaagcttgtgctttgcacctggactcagaagcttgaaatgcagggatcacggggcgggtggctccatggttgattcgaccttcacctggggctcttacgctccacgaagaacaaggatccatggcgcgcgacccttaaagcgctcagtccaagaaaggggaagcctggcgtatcggatacaaggcgcattagcggcgtagacggcgaggtgccttgtgcaatgggtggagaacgttgcctagaagtatccgacatatcctgtggcacatgcaccgtaagggaaatgacaggttctgctgcgcagactttaggctatataggtagaagcgaagcgccttaaggtcacaacataaagacccaccccctgtgcatcttggcgctacagcgttgctagagacatccttcgactataga

SEQ ID NO: 337 - DNA, 17815 bp, Unknown
  Metagenome-assembled genome
tacaatccgttttgctgatcaaggccccggcatcaaggagaaagacagggcactggaatacgggacaagctccgcaacggaggatatgcgtcactacatccgtgggttggctctggcctgccatacgtccaacagtatatggacgataagggtggcacactcacgatcgacgataacatcggcccgggaaccgtcgtgaccctgtcgttggctgatgcagatcaccacgagagtcagaacgccgcacagccgatggtccccaacatcagcaaacccgacatacctagcaagcaggtgttcaacagggttatcctacctatcatggagcctctgtatgccccgcagcagggaccaagcgcagccgcagatgtggcagacccaacagcctcatccggagcagcagtcctatccggtacagcagcaaccccatcagtcacagccggctattctgcccaacatcagaggcccccacgccgcaaaatcctgtccaacagccgcagcaacagagccagccggttgcgcagagcatgccagcgctccagaggctgccagttaccgagcgggggcaccagatcatggaatatttatcaacccatgagtcagtggggccttccaacctcgtgagagcttacaaagggtcccagccaacctggtcaagaagcctcaaagagaatgaatctatggggctcatcaaaaaagaggggcaaaaatactatctcacccaggtaggttccctctttgcacatgcactagagggcagaaaagcttctttttttacagaaaagctgcctatctctcagttttctacagtcgcagcattgcactacaatgagttttcaacaaattaacgtctgatcgcgaggagctatgtatggaggtctcagcaaatgaagaagcacgtgccctctggggcgatgtcctgagcctctgaaagaagtggtctctcctcccgtcctcgctatgctcaacagctgtgagcctgaacggctcgcggacggtacctatcacatcgcaacaaaggcccgttttgtcaaactcaagattgaaggagacaagaacctgatcgatcttgctcaagcagggtcagctttgggatctgcacctcgtagtagatctgaccaccgatcagaatgtacgtatcaaaaccaactcgcgggtcaccaaaaggaactgactactgggacaaacgcaggacagcaggggaggtacagtacgctaccagcctcaacatgcgcaccaccgattgaaaccagaggaagcggttccgcataccgaggaaacaaccgactgctcaacaatgtcactttaaacgattcgaagctcacctttgacggtttgtcgaaggtgacgaaaaacgcgatggcgctttcagggcggctaagcaggtcgcagatggagagaacagaactacaacccctttcatctatggaaaaagtgatggggaagacaacggatggtattcccgccatccagaatcgagatggtcggctcaacaaaataggcgtggatgaagttttcgacgatctctctgatcaccataaatggaatcgagccaccctgctcgtgtgaaagtttagtcacctcatcggtgatctcttccaggtagtctctaacgggctttggatcaatcagcacgacacgcggcgtcgtggatttatcatcgtagaccgcgatacgggcggcgtagcgaacttcaaggggcgggcggtcatactctttgtcgctgtggttggggtcggtgtctggttcctcgacaaacggataaaagtcccgtgccattgcgcctgctcccttctcctacacagtatccactgcctctatagtttggatctcccagtgtactctgagcagaaatatttcaaaaggccctgaaaggcctgaaagttttcgacaaattctgtccatatgaagaaaaatttcgcaatgaaatttgtatgagaggaagctttcaaaacacgaaggatagttgtataaaagtagaaaaagtttttaacaatggctgaataaatgtagaaaactttataggagtaatggctccatgggacgaaactttcacgctgaaagaaagaacccaaaattttgctgcggcctgcctgggattgtggcgtaactacatgtcgatgggtatggcacgatgttctagtgcactctctatgacttggcctttcagcacaagaccgtggtatgaggcatctaaattctgcgtatcgctctatagggagtatctaatggtggttttactcgttaaacgcgcaggttttatagcgatttgttgactacagggagaaagaacaatacaattttaaagctattgcacctatgttctctatacactcttacaggaggaaacgatatgaagcgtacgtatcagccgaatcaacgtaagcgcgccaagactcatggattccgtgcacgtatgtcaactaaaggcggccgtgacgtgctgtctcgccgtcgcgcaaagggtcgtaaaaaattgactgtttagggcctgatatgaagaccatcaaatccaaacaggaatttgagagggtcttttcgcgtggtcgacgcttcaatacgcggcttgttcgcatcgtagtacttgcgacagacgaaggtgacttaccaaaagtcgccttcgttgcgcctaaaagattaggaaatgcagtattcagaaaccgttctaaacgactattgcgcgaagcggcacggttagccggacttccgaaacaagggtacgacgtgattctctttgcgacacatgctacgtcagacgtgcatccagatgagatgtcacgagcccttacaaaacttttacgcaaggcaggcgtttgttgatgctggaggcagaaaacgagcagtccacagcaacgcgtatcctcatcaaactgatcaaaggatatcgacgctatctctctcccctctttccaccctcttgtatctatgaacccacctgttctgaatatgcacttgaggccataaagaaatatggggcatgcagaggagggtggcttgcattcaagcgcatccttcgctgtaaccccttttgccatggtggctatgatccggttccctagggggactgatcgacggaggaataatgtgggattggtttattaacctcatgaccagtatccttgctggtattgaaggctggtgtggcgattggggcatggcggtcatcatcctgaccatcatcatccggttgcttattatgccactgatgacgcactctacgcgttcatctgcgcgaatgcaggcgctgcagccaaagcttcaagagattcaggatcgctacgcggatgatccgcagcgggcttccgaggagcttcaacgcatctattcagagaacaagtttaacccgctcggcggctgtctgccgattctgttgcagatgccgatcttctttgccctgtttacagtggcacaaaacgttccgggagatgcaaacttctacaacatcctcccttctatctccatttctgtttcaactgcgctctcccagatgggttgggtcggcggtggatgggtatatatcctcttcgatattgcctttggtgtcctcacctttgttccgatggtcatgaatatgcagaacttgcctgaggaacagcgcagcacgaatatggtgatgggtgtcgttatgtcaatcttgatgctgtggttcggctggaatgtgccggtagcagtcctgctctactacgatgcctctgcagtctggcaggtagcgcagcagaagttcgtgactcagcgcgtgatggacgaagtcaaggctgagcaggcgaaaaaggatgctgagatgccggttgcggtctcggtgactcgccgtcagaagaaagcacgtccccacaagaagagtaaataaattagtgaataatatgagtgagcagtagctttctcattttctgtatctcaaggaggtgtcttcatgggcgaagaaacaaataccgctcataaagaggactcatcagccaacgatgagcagagctatctggtgcaacttcaggagaagcatgctggaagcgaggaattcaccgacagcgatatcgactacattgctgatacagcgatcacttcccttaaagttatcctcaatatgtttggggagaccgatgtttccatcgatgagtacgacggagacgagggtgagctgatcctcaacatcaccggcggtgatctagcgatgctcatcggtcgtcatggcagggtactcgacgcgctgcagatgatcatctcatgcttgttgagctctcatctgaacttctactaccctatcatcgtcgatattgaaggatacaaggagcgccgtaaggagaagatccagtcgatcgctcgctctacggcagcacgagtcaagaagcagcatcggagccagagcctgccatctatggatgcttacgagcgtcgcttcgctcaccttgcgcttgcggatgatcctgaggttacgacgcactcagagggagaagatccccatcgccacgttgttgtgtccttagtgcaataaccatttcctcatcactgtatgagtatactggaaaggtcgcctctggcggcctctctttttatatcgacagggtgaggttcaatatgattgaaggacaattcgacgcactgcagactcaactcaacagcgagctcaagtggcttggccttgaagtccccgatcgtgatcaacaactgttgctcacacatctcgacttggtccttgaagccaaccagtgtgttaaccttacccgcatcactgatccctctgaggcagtgacccttcacattgttgactcgctgcttctctaccggtacttctccgcaagtcaggagaaaacacatctccctttcctcgatataggaaccggtgctggtttccctgggattcccctcagtatcgtttctcacaagaagggagtgctggtcgactcgacacagaagaagatcaaagaggtatcgagtttcatctcgacactccgactcggtaggcaactagagacccgtgcgatccgtgctgaggcgttgagttcgaattcgacaccaaactctacatctaaatatggtactgtcgtagcccgtgctgttggtcagattgccacgctcttggagtatgcctctcccctgctgtgcaagcacggttccctgattctcagtaaaggcaaactgacagacaaagaatacgatgatggggactatgcagctgagttgctaggaatgaaaaatgcttcacatgaaacattgtctctcccccatgatgctggcacccgtacgatactatgttatacaaaagagtgtccctcccggatcaagctacctcgccgcactggtatggcgcagcaccaccctctcataccaaaacaataatttttcctaacagtctagataacaagtgaactataagtggccatcaagccgcagtttgccatgcttttagccgctgaataaagtgtttgccatagggtttgccgtctgctttgtttggcgacaagtctcgggcggcaggcttatggcagatggggcagccgaatatggagagctgggagaattccttcacagaagcgggccggcgccctgtctgccgacaacttcaagcttcttgtccaagccgtaggagaacgcagctgctaagatgcgatttggcatgaggcacgctcagcgaagcgaaaggaaagcttcaggatgcatccgaagtgccctgcgtgcggttgcagctacagctcgcttacgggagctgtctttaagcacacctgctatgagctagcgagatgggtcttcttcatctacctcatgcgctacagcctgcccctgggctcacagccgaggaaagtcaggcatcacccaccagataacctgggagtaaaggcagagagttttctaggcagtcgatggctaccaagacagaatcatcctcagcaagcgcgcctacctcaatgagacctaacatcgctgacaccgatcttccccacaccttcagacaggcgagcaagcgcagctcttctgcatcgctttagcgatagatgcccacaaagacccagtcgctgtagcatgtagccacggcaagccatccacgaaaagaactaaagggttgcccttagaaccttcagaagggtgccacgatcctctacgacaggccacgcgctcacagtggcttcttaaggtctacagggctgatgcggtagagcgtatctgtcttgagaacatgggctttcctgaacaatcttttgcttgtggctcaaatgctacctctggtatctcacagacatacccaaggccaacatgcaaaagctaccttaactggcaggtctagctcttttgggtcaaccaagcccgtgataggtggcctggaactgcaagagtggttcgccatatgatggtggccgatgcaagccttcgcagctcaacgtaggtacactatcacccgttatctagactggtagaataccagatatatttgaacatcgtgtatataagaaagtgtcatgatacttagatttatatgatcgtatctcccctacttttagtataaaaatgcgatatggttggaataacaatgtttcacgtgaaacattgttatcgcctacgactttgctacccttataccgtactatcttatacatagtgtgcattataggggatgaagtgtcgtattgtagaggtgtgaggaataaaactctcctatctgaactgacgacctcgatagtttgattgtcaatgtttcacgtgaaacatatgtataagcaagtaatatagatatgaagaagatatcctggatcgaagtgaggacaaattgagctataaagatcagagacggtttaatgttgatagaaagacgcaagtcatagcgatcattaatcaaaaaggtggtgtcggtaagtccacgacagctattaacctttcggctgcacttagtgagaataaacgcaaagttctcttggttgatttcgatccgcaaggaaacgctacttcagggtatggtatcgacaaagagacgatcgacagcgatatctatgatgtgctaattaatgaaagccctattgaggatgcgatctgcgatacctgtgaaaagaatgtctttatagtaccggcaacagttgaactctcaggagcggaaatcgaactggtaaacgaagagaaccgcgagagtaaacttaaggaaatcatcgatcaggtcaaagacgagttcgactatgtcttcatcgactgtccgccttcactggggattttgtcgatcgatgcttttatggctgccgattccgtcatcattccgatccaatgcgaatattacgcgctggaaggtgtaacgaagcttatggaatctatcaagatggtcaaggagaacctcaacccagatctcgagatcttcggtgtgttgatgacgatgtacgacagcagaaccacactctctaaacaagttgtcgaagaggtcagaaagtgcttcggaaataaagtctttaagacgatgatcccacgcagcgtcaaagtagccgaagcgccttcatacggtcttccgattacgcagtatgcgcatatcaataaaggctcactggcttatatgcgactcgcaaaggaagtgacacgtcgtggctagaaaaggactgggacgcggccttgaaagcctgatgggggaggccaatgctgaagtacattcaaataagcccgatgttgaattgccgatcgaatccattagccctaacccgcatcaaccacggaaagactttgatcaggacaaactcgaggaattaaagagctccattgagcaacatggtattctgcagccgatcctcgtgagaaaacggggaaacaaatatcagattgtggcaggagagcgccgctatcaagcagcaaagcttgctggcctcaaaagggttcccgttgttgtgagagatatcagcgataaggaagtctttgagcttgccctcatcgagaatttacagcgtattgatttgaatccaatcgaagaggctcagggatatagagagcttctggatcagaacgactggacgcaggaagaacttgcccatatcctctctaaatctcgttcgactataaccaatgcagtacggttactcgatcttccgaaggaagttcaggattatatggcttcaggacagctgacagcaggacacgcccgggcaattcttgcagtgcctaataaagaggaccgtatcaagctcgctgataaagtagtacaggagaagttgtcggttagacagacagaaaaccttgcaacactgatttctgtcaataaatcacccaaaccgaaacggcaaccaacgcctgaaagctacaagcgtgcagcccatattttaggtaaggtattgaataccaaagtacgggtacgccggaaacggggaaagaataagatcgagatcgactttaaagacgaagacgatttaacaaggctcgtgtctgagttggaacagatccaagaaagaggggagtgagtgattttgaaacacccagcaagaacgttcttcattgaagttggtctcttcgttgctggcggttactatctctacaaccatgtactgtcagatgaagcaaaggaccaactgaatcatatgtttgatacgctaaagacatcatttactaagatctccgaagtcgcatacgaacaggattcagcgaaccaagaacaggaaaaaaaggctgcagaagctaatcgtgaaaacgttgaacgacagtgggagagccttgggtactgagaataacagtataggataatgcaaaaatcccctatcagaacacatgttctgataggggattaattcttatgagaaagctacgctaacgcttcgtataagcctgtgagagctgaccgcaggcagcgtcgatgtccgcgccacgcggatttctgatcgtagcggcaacaccgactgatccaagcctctgcacgaactgattggcgcgctcctcggtagaaggcgcgaagggtgagccgggaacctcattgagctggatgaggttgacgtgggctaatgtgccacggcagaagtcgcacagtgcgtcgagttcagcgtctgtatcgtttactccatggatcaacgcatattcatacgtggggcgacggcctgttttgtcgacgtattcgcccataacgtcgtagaggtacaagagtgagtacttacggactccgggcatcagcttgttacgcgtcgcctggtttgcggaatgcagtgagaccgctagaccaaactgttctttctcactggcgaacttcttgattcctgggataatgccacatgtcgatacggtgagatgtcgagcaccgatacctgcacctttatcggaattgaggcggcgaagcgccttgagggtttcgtcgtagttcataaagggttcaccctgtcccatcaatacaactgaggtaacacgggtgtgaaagtcatcgccgatatggcggacctgctcgtagatctcggaggcggtgagggaacgggtgagtccggctttaccggtcgcgcagaatgtgcagcccatgccacaacccgcttgggtggaggcgcataccgcgaggcggttcttggtcggcatgccgacgcattcggcactgaccccatcggtaaactgtaagagatacttgcggctgccgtctagcgatatctgtcgagcaagctctttcggcgtcccaatggtgagatgctggaaaagtaaatttcttaatgatttagggagatttgacatctcatcaaaggtatgtgcgttcttttcccaaacccactcttctatctgagatgcccggaattttggctggtgtagctcttccataagggctgcaagctgtccgtgtgagagcgtatggatatcgggaagggaagtccctttgtgctgcgtgagcgttttacgatttggagccatgttgtgaccttttctttccggagctaattaaggaagtgtatccttttaaatctaacaaggttaattacacaataccgtgtttttggatggcctgaggaatgaccaagaggagttcacatgacaagggatgtcctattcaaattgcacattgcaattcttgcaggcggttggtccgatgagcggaatatttcaatggagtcagggcagcactgccttgaagccttaacagaagcgggattcaaagatttgacgctgttcaacgtagccgatcccgactttgttgatcggttctcagcgggacattttgattttgccttcatcacgatgcatggccgctacggggaggacggctgcatccaaggcttccttgagaccatacatatcccgtataccttctccggcgtgcttgcctcagcgttgggtaacgataaggtagcagcaaaggtcatgtaccgcaatgcgggcataccggtgccgaggggtgagacggtcgacatcagtgccgcagatgactctgagaccatcgaccgcctgattgaagagctctcgttcccgatcttcgtcaaaccctccgcgaacggctcaagctatggggtgacccgcgtcaataagcacgaagagcttccgttagcgatcaaaaaggccgctgctgaaggtgatcgtgtgctggtcgagcagtgcattgaaggtactgagatcacggtaccggtcatcggcactgaggacccgcaggtgcttccgattgtcgaggtggtcttcgacaatgcggattactacgacgtgtccgtcaagagtgaaccggcttcgctgcaccatattattccggcacggctcactgacgaagagaccaggctcgcttccgattacgctaccaaggcacacaaggcgctgggttgtaggggaacctcacgcagcgacttcatcgttacgaaagaggggataccctacatcctggagaccaacatgattccgggcatgactaagagaagcctgctgcctgactcagctgagcgtgcgggtatcccattctctgaactctgcacccgctttgtagagtggggtctcaaagaaagtgtacatgagaagtaatgagtgagaaagaactactaaccctcaacgaggtactccttccgaatacccctaaacatatccgtgaacagtatcagacacttgcggaacgtgctgcgaagaccgatttcggaccgttggaagacaatatcgtggcggtcgacaccgagacaaccggattgtctttcaaaaactgtgagctggttgagatcgctgccgcccgcatctccagtaagaaggtggtcgacaccttcgacacctttgtgcacccaaccggtttgatccctcctgaaattgtgaagcttacccatattcgccaagtcgacgttgcagatgccccgagtgcacctgaggcggtcgcaaaactggcggagtttgtgagaggagatgtagtcttagcccataacgcagtctttgaccggacctttatcgaatccgttccgggtggtatagaggtcagcgacaactggatcgatacgctcgcactgtcccgcattgcgttgccttcgctgacaactcatcggctctctgatctggcagagatcttcgggagcgattcggtgactcatcgctcagaggatgatgtggtggcactctgtggggtatggccgatcatcctgcagggacttgcagatttacctgcgggattactggactatcttgcaaatatgcaccccgaagtagagtggagctaccgccccatcttctcgtatctggcgcatcagagagaaccggaggtgttctcactcaaagatacccgcaacgaactgctgaaacaggtgccggagcatgaaagggaagacgcgaacgataaaaaagaaccattccaagtgccttctcctgcagagatcgacgcaatctttgccgagggtggcgatgtaagttgcgcttatgatcactatgagcaacggcccgaacagctgaagatggcgcaagaagtgcgtgaggcgcttgaaacctcgacgcaccgcacgattgaagcggggaccggtacgggaaaatcccttgcctacctcgttcctgaaatcctgtttgcccagaagaacaacgtgagcgtcggtgtggcgactaagacgaatgcgctggctgaccagttaatctcacatgagctgcccctgttgaacactgtcttagaaaacggggtgtcctaccataccctcaaaggatggaaccattacccctgtctctatcgcatggaaaaggcctatcaagaggagttaccaatcaatatagtgatctctcgtgctcaaggccgtccaagctccaaacgtacgattacccaggatatgctcactgctttggcagtatcttatacctatgtcgcggaatctgcggatgaggacctcgacgcaatgggcatacgctggaagaatgtgccgcgtgagctcattacgatcacgtcccacgagtgtctccacacaaaatgccccttctattcgcatgagtgcgtagcctataccgcgcggcggcttgctgccggctgcgatgtggtggtgacaaaccattcgctgttgcttcgcaatgtgctagcagagggacatatcttgccgccaattcgtcactgggtgatcgatgaagcacatagctttgaatcggaggcccgtagccaatgggcaactgagatctcagcagtggatatccatgacatctttgaggtgttgggcgacgccaaaaagggtgcccttgcccgtgcatgtaactcggtcgtgggtaaagatggtgcaactttggcgctcggtctcatccagaaagcctctaaagcagtgcagcatgcgtcgctcgtgacgtctgagttcatggcggcaatccatgatctgatttcgcttgcgggcaagtcgagctatgaggggacaaccctgtggattaatgaggaggtgcgtgccagtgggcggtggcgcgctgttgtggaaacaggcacagaggccgtacggagtttggaagaggcgagcaaatgcctcaaagaagcgcagacaacactctcactgaccaccaatgaaggcgacaacatcctgggggatcccgcgatcgccttcgatgatctcgtcaacgctatcaacctgattgttctcaagccggatccagcatacgtgtattcggcgcagctctatcggcagaccaaccagcagagtaagaacaaacgtttgagatcagagaggctggttgcagaaaaactcgatatcgggcaggatctggggactcagtggctaccggggatgaagagcgtcatctttacctctgcgactatggcagttgagcacgatttctcccacttcaatcatgcagtcggtttggataagctgcccaaggagtcctacaaggatatccagttaccttcaagttttgacttcgatgacaacatgtcagtgattgtggcgaaggatctgccgcttccgggtaatccgtcctacctcactgccctagacgatctgctctttgacatccatattagcatgcagggttcagtgctgacactcttcaccaacaggcgggagatggaaaaagtctacaacgagctgcagccccgcttagcccgggaaggacttgagctgatctatcaaggaccccgttcctctcctcgacagcttcgggatcagttcatccgggacagggagctttcgctctttgcgctgaaatccttctgggaagggttagatgcccagggggatacactgcgctgcgtggtcgtaccgaagcttccgtttgccagtccccatgatccgctggtacaggagcgtgaagagcgtgaaccgcgggcttggtggcgctaccagttgccggatgcggtgctttctgtcaagcaggctgccggtagactgatcagaaccaagaccgataccggcgtcttggtcctctgtgactcccgtctcgtcaaaaagagatacggtcgggactttatcgaatcgatgccgtcacataccacggctgagttggagaccaagaatatcggttcttacctcaaaatgtggcgcgcctcacatgagcgtagatagcactctacgcttgggtgagtatatctagatcttgttgggtaagggttcaaacctgcttttgaacttctttgtcggggcaggttaccttgccccctacacgctatcgatcgctgtataagctactttgtgccgcagtagggaagcagttcctgctgtggattggtatgtcctttgctcacccatagacgcggccactcaaagaagctgatatacggtggatcccaaaaggtgagagggtgaccttctgcgctttctccgtcggtttgttcgatatcctgttctcctgctctgaggtcggaaggggacagggctcaaggttctgtatgtggctcagctggaactggcggtcctgctgtctcgtgtaatcgaacacttcgatatgccagacatggtcgtcctgcttgagccgttcaggatgcaccaaacagcgtttaccatcgtagcagtattgccttggtagaggaatgtcagtgttcgttctgtgatgagagcatcgatcaccgtattagcctgctgtgaggctcaaggccctgactgtctttcgataccctcctcgtcgatattgatctgcccatagttggagacgatcttcttcctcaagggggtcatcgtcagagaccccacagcggttgagtgccgcgaggatcgcatcggtttctgtcagtgacagtctgattgagtgccttttgattccgttatcaaagacaagcgatacctcattctcaccatctgagagcacaagcgagaggtatcgcccgtcgttgtcccctgatgcgatcaaaagttcgaacagatggcgggctgaaatacccatgcgatctgcgattgtgtctccacgtagggtatcacccccttggagagggcggagagcaaagcaatcagttcacgaagttcagtggtattgccggctccatcgctcggcatcgttcaagtcttctttgaagactgatacgtattcgtcttccagctcctgtggggatggggagcgaacccctgcttcagtccctaggttgcagcatcgcttcacgagctcacttcaaccgcacgctgataggtattcgcgtcgtgtttggtcaggattgcatacctctgcagtgtctccagcaactcttctacaggctgcttcaggataaagtgcgctgtgccaatagtcgctctgatctggcaggagagcactttgaagtcagccgcgccgaaagactttgggattccatagtacgattgacgagtgagactttggggagctgctccacccgatagattcttcaggtgatcgctgacctgctgtccgtcgctgtcttcagtggcgacgcagtacgtaatatcccgtagggtaaagaaaccgtatggatccacgacagtgggctttgccgtaccgtcagcttcggtatggccgagcttcacaaattggcggttgagaaatccctagtggagcagttagaggttctgtttgcctttgggttgatctgatgtaccaccggttccctgtcgaaggcgtgatcgatctttaagagcgccctgtgcagctccgcaccggtagggggaatctctcatcttcaacgatagacttcaagagtagttgcagctgtaaggcttcctcgccgatgagggaagtccttccggtgtaggaggtgctctcgtcggtggcctacctcacttttttgtctgcaggatccggctctttctcacgacatggatcccacagagtgccaaatgccgcatatctcgcttttgcaacgcgttgaatgagcggtgtgagagctcagggtagatctacttgtggatgaactcggaggtgagcagcgtcgcgctgttgataaagtcaatcgcgagcgtgaccagccgctgtgcgctgatatcatttgcggagaactgtacattttcttcacagtgaggtttcatataccgtaccccttggtgatctggtttctctcgagagcgaccaatttgtagactatgtgttgaggctgagagatgaagaagctggagaaaatgcatggctgtttctataagaaaagtatgagcatacaaaagctagattctaacaagtatacttaacacatgattatatcaaaacagatttatgacccacacaggtggtggagataacgatgtcaaagacgcatgaatacttagactatcttgaggaacagataggcattgcgcctgcaaacagccaagaagaactcgatgccgctcagacaatctctaaagttatgcaggaccataacgtggatccccaactcgaagagttcagcgcatcgacagggtcgcagacgctcgtgccaatcttcacgattctgatgctcgtcggtctcattatggctggcatcggctcctttgtccgtatcatcggtgctatcatcactatcatctttgcggtcactctaaccttgcatcaccaaggtcgtatctcgtttgatcgggttgggccacagtgcaagagtcaaaacgttgttggcctccaccagcacaccggtcccaaagtcattaaaggcaaccgaccgatcgtgattgtcgcgcactacgacaccccgcgcgtcaaccccctgattgaaaacaagaccactgccgcatggtatgtgttggcaaagcaggcaagcacgtactgtatctatataagtatgatcgcagcgctgcttcaactcttcggatttatcccctctatcgtgcggaccatcatctggattgtcggtattgtcgcgggcctcattcccaccgctcttgcaatcggcgacatcgcgacgcgcttcggtgactgcaccgatggggctaacgacaacaaatcatctgttgccgcactgttgagcatcgtaaacaatgtgcacccggggacggaccgtgccctcgagacagaagcagagaaagccaaagaggaagcgcagcgcgctgaaaaggggcggaaggctgcggaagccaaacgggaagccgaagcgaaagcggaacggctctcccactatcgccggcatggcgtagacacacttcgctctctcaatatgctccccgaagactgcactatagagtatgagagagaagaagcggcggttgcagcgccacagcaggaagaagggcagtctgatgagacaagtgtgctgcccgctcagactgatgaaaaaacacagcagactactcctgcggacaagaccctcagacgtccaaccgtcggtagtcggtttaatcgttcgaatgaggctcgaaaagcggacaagcgtgaacagacgcaagaggaagagcctgaagaacatgagtcccaggcttcagctggacagccgggagaagagcaaccgaccacatcgtttactgcgccgacccttgatgagcagaatgaggtagccgaagaggctcccatcgagacagaggagaaaactcccgaagagcctggtgagggtgagacctctacagagaagcccaaaggcaaatatagggacaagaagaatctttggccgaatgttctagacgctgagtgggagtcaatcactcctgaacctgacaccgataccactgaatccaacacggaaatggagacagctccacaagagagcgatacagccgaggcagtgcaggaagagaatcagcaagagtcctcagaagaatcaactggtactgggacagagaccaatgaggaacaggacaaggaggacaccactcagtctgaggagtcaagcaagtccaagtttcagaagttcgttcagaaattccatcacaacgatgcgtccaaagagtctgagccagaaccctcaacggaagaaggggagacagactcacctgataccacacagaatagttttgctgaggaaacgacggatgaggcaacggacaaagaggggcctggaaaggaagagcagacttctgtcccggaggagaaggccaagcatcttcaatctgacgacaacgaatctcacagcgatgaggatgacaatttctcgcagatg

SEQ ID NO: 338 - DNA, 33395 bp, Unknown
  Metagenome-assembled genome
gaacggtataacccgcatgtagtcgctataggtcgcgaccgcatagcgacggataccaaaccagaaggcgaagaggacgatctcaaacaccataaagaacatcatgaccgactcatagtagctcatcagattcataccgccgagcatgatgctaaccgcaatacccaggatgcccatagcgaccataatgacaacaagactgtgaaagagactggcaggagcctgataggtatcatggtgcgtatggtgacgctcagagacagcagcagatgcaaggcagtccaccaataccgcggccacaggaatccccgcaacaatcagaaattgataaccaaagcccacaaaaatcaacttcttaactctatatcgtgaatatatctttccccgttgagctctactcgacaaggtgctcgacactgtcgagcacgcaaaatgccccgtaaatagccttttttgcttgtagaagctcaattaagtaaccattatgcacaacaggctgtacacgcaacaaatatttccgtaaacggccaaaaagtgtgtgtatacataggtttaggcgtccatataagcgtaatcgtcacattcgggtgtataaagcgtctattttgattactctctactggcattttccctgattaggcaaaaggtaaccgcaatcagctgccttcccgatgcccttcgcaagattcgatcacaacaatgtctggaacagatatattactgctgcggcttagcaaactttgctaccaggtttgtcaatacgtcgacagtcttctccagcgacttcaatgggatgaactcccgcaccgagtgcgcattgtaaccgcccgtcgcgatattggggcacggaagtcctcgcgccgagagctgcgagccgtcagtgccgccgcgcaccgcaacgacctgaggatcgatgcctgcctcacggttagactcgagggcattgttgatcaggaaatcttgacctttgaggtaagccgccatgttcttgtattgctctttgatcgtgatcttgaccgtatccgcaccgtagcgtttattcaggaaggctgcgatatcccataaggtctgctcacgcgccgcaaacttccgctcgctgtggtcacgcacaatatatgtgagacggacgtgtgccgcggtgccattcaccgccagcggatggtagaagccttcatgcccttcggtgtgctccggacgctccgcctgcggcaccagcgtatcaaactcaccagccactgtgattgcgttgaccattacgtccttagcggaacccggatggaccatcacaccggtgatatcgacaagggcttcagaagcgttgaaggtctcgtaattgaactcgccgagcgcttcaccgtccacagtgtaggcccactttgcgccgaacttctttaaatccagcagagaagctccatgcccaatctcctcatccggcacaaaggcgatcttaagggtcggatgcggcagctcaggattctgagacagccggtgcagcagtgagcagatctctgcaactcccgccttatcgtctgcagacagcagtgtcgagccatccgagcagatgatgtcctgacccacaaactgcgcgaggtcggggacctgctttggtgtggtgacaaccgccttcccgttagcggtaccggcaacgagatccccaccttcatagtgcacaatgtgcggatggatatggtctgcaggggcatccggtgaggtgtcaatgtgggagatcaagccgagtgctgggagatcctctgccccctttgaagcggggaatgaagcagtgacatacgcgtgttcatcgacggtagcatcctcgcagctcagctttttcaggtcctcgtagagtgcctgagccattgcgtgctgagcctccgtcgaaggggttacctccgcattggattcatcggactgtgaaggtatctggacaatacgcaaaaagcgttctacgacgtcggaatattctgcttgagccaccagcggcctccttacatcgatacggtggagagcgaatcaatcaaaaatgatttcacccttcccaccataccaagccacgcgaccgcgagcaatgagcgtctaaagcagacgctgctttacacgaccaacctctttgtcggagacattgcacttctcctccaggaaggtacgggcgccgccgagggcctcgatcgtatcgtagatgtagccaccgagcgtgttctgcatcagatacacgagctcatggacctcctcaggcgcgcggtcaagttcggccttcccctcttttgactcatagatgttggaataggacaggatatagttgccgatgcagtcctcacgggagacgcccgcaagcatcagcaggagcattgcgatgataccggagcggtctttgcccgcgttgcagtggaacaggatcgcggtgtcctcaggctccattgcgatcgaacggaagatcgcgcgcaacgctttggtgttatcgaagatatcgtcgtagacagactcaatcttaaaaccctgagacagaaccttcttctgcagctcgtttaacacttcggtatcagagtagtcagtctggcccagcgccacgtgaatgaagctcaggtccggtcgcgtaaccagttggtcaggctcgcgtttgacctcttcatcagatcgtaagtctataacggtacgcaccccgtagtcatacaggaactgctcatcgtcctcagtcagatggctcagattgtcgccacgtaaaaaagcatgccacttggtctgccggataccaacgggataaccgcccaaatcgcgaacgttgcaggcgccctccagcggtagacgttgccagttgagttctgctgccttagccataatacaatcctctcaatttttcggttatacaaaaagggtgaacatggagcgactctgcgctcaaaaacaagaaactatcggctacctattcctccgtagccttaacaaggtacgtgagaacgttctgttggttctcactgtttacggcctgtactgtaaacacggcttatcatataccgttcagagataatttccaatcgttccaacaatttttcttgattttttacaaagactattaatcaatctttttggagcatcacccgctgatcctgagccccggcgacgtcacgctacacctgtaaagatgtcatttcacaaccataatcagtttcttttgatttacttttatattacatacgatatggttacaataggatcgataatgatccagcagaaaggaacgatggtatggcacgtgtgtttatcagccctggcaagtacgttcagggatccggtgagctcaaaaacctcggctcgtacgttgaggcctacggtacaaccccactggtgattatctcgaagggcggcgtcaaacgtttcgccgacattctgaaagcgagcttcgacgaggcccggatcaaaccggtggccgaccagttcggcggcgagtgctctcaggatgagatcgaccggctctccgggcttgcctacacgagcaactgcgatgtgatcgtcggtatcggcggcggcaagatctgcgattccgctaaagcggtcgcggcagcgcaggacaccccggtcgtcgtagttcccactatcgccgccaccgacgccccctgctctgcactctcggtcatctacaccccggaaggacagtttaaggagtaccagtacttcaagcagaacccgaacctcgtcctgatggacactgaggtcattgcgaagagcccgctcagactcaccgtctccggtatgggtgatgcccttgccacctactttgaggcccgcgcctgcaagcgctccgacgcaatcacctgcaacggtggccacactaccacggcagccctgggactcgcaaaactctgctttgacaacttgatgcgggatggtctcaaagcgaagaccgcactcgaggcaggagcccgctcggaggccgtcgagaccatcattgagaccaacaccctgctctccggtctgggctttgagtctgcaggtttagccggcgcccatgcgatccacaacgggatgaccgcacttcctgagacgcatgggatgtatcatggtgagaaagtcgcctttggcaccatctctcagttggtcctcgaagatgcgcctgagctcgaccaggtcctctccttcgatgttgcagtggggcttccggtcaccttcaagcagctcggcgtcactgatgcgagctacgaccgtatccttgaggtcgccaggcttgcctgtgcagacaacgacaccctacacaacatgccgtttgaggtcaccccggacgctgtcgccaatgcaatgctcgcagcagatgccctcggccacaaggcgctcaacaacgctcagtagttgatgataaactcgacaggcatgaacgactgccgagttgtttttcacacactatagcaaaggccggctcgcttacgtacaagcgagtcggccttatctatatacggatatgtgcgtgagcctaggtcactacttcaggacaccagcctcttcctgagcttccctgatcttctcaagttgctctttcgtgaggtggatggcaccctcaccgtagccataggtcttaccgccgtcggcgtcggttctctcaccgaactcggcataatccgcaccgcctgctggtccctcacggacgaaagaatcctgcagctcacccggacggcggatgtgcttgttgccagctgtcgcaaacctaaacttcccagtcgggtcatccggattcctcagcgtgaacctcttgtcgtggccgttcttgaagttctccttagccacggagatcatcagcttgatacggttgagctggttcacctcagaagcacccgggtcgtagtcgaccgcgacgatgttgctctcaggatgcatctgacgcaggcgcttgatcacagacttgccgaccacatggtttggcaggcacgcaaacggtgagcacacgacgatgttcggggtgccggactcgatcagatcgcacatctcggcggtcagaagccagccctcacccatcgtgttgcacagagagagcaccttcttcgccttgccagccaagccccagatggagccatagggctcaaagcgctcggactttgcgagcatctcgttgatcggctttctcatgccttcgatcacgtcgatgccagccttgtgcgtcatacgcgcggttgccttcgtaccgagctcctgattcatattgatctggttggacagaccaaacaggaagaagtcaacgagtcctgggacattggcttcgcagccctctgcctcgatctggcggaccacctggttgttcgcagtcggatggaacttgaccaggatctccccgacgacgccgacacgcggcttctgacggtcgttcaccagcgggagcgtatcgaagtcacggatcgtatcctcgcagagcttatagaagtgctttgaggacgcatcgtgggcaatctgcatctccgcacggtccatataggtgtcatagagcttgtctgtggaacccttctgagcttcgtacgggcgcacacggtaggtgcactgcatcagtaagtcaccgtagagcagcgcatagacggccttgatgagcagacgcggattcctaaagatcttgaatcccgggttgtcctcgtccaggttcgttgcagcggtcagtgagatgaccgggatgtccgcatggccagaatccttcaacgccttacggatcagggcgatgtagttggtagccctgcagccaccgccagtctggctgatgagtactgcggtacgcttcaggtcatagttgcctgaaaggatagcctccatgatctggccggtgaccagaattgaggggtagcagatgtcgttgttgacgtacttcaggccaatgtccactgccttgtggtcgacgcccgggagcagcacgacgttgtagccctccgcgcgcagcactgcctcgcagatctcgaagtgcatcggtgacatctgcggcgccaggatcgtgtagcgctgatcctgcatcgccctggtgtagtgtaccttgtggaaggcggcagacttggacggacggtagaccggcggacgtttggacagatcggtgttacgcgtcttctccagtgagccatccgcactgtgaacgtcgatcggggtgatctcgtgaagcctgccctcctcgttttcacgctcaagctgcgcacgctgctctttcagtgccgccatgagtgagcggacacggatgcgggcggcacccaggttggagacctcgtcgatcttcaagaccgtgtagatcttgccggaggcttccagaatctcctggacctcgtcggtcgtcagtgcatcgaggccacagccgaagctctggagctggatcaggtcgaggtcgttacgctcagcgacgaagcgggcggcacggtacagacgggagtggaacatccattggtcgatcacgcggatcgggcgctcaggcttcaccttgtgggccacggagtcctcagtcaagactgcaaagccaaagccgtgcagcatctccggaattgcgtggttgatctcgccgtcgttgtggtacggacggcctgcaaggacgatgccgtgcgcatcgtgatcctcgatccaccttaaggtcttgtcaccggcgcggtgcatactgttcttgaaatcgatatctgcctgccaggcgacgttgacagcatggtcgatctccttgcgcgtgatgtgcggacctttaaagcgaccatggccggcagcagcgtccttctcacgctggacggagatgatatcgtagagtctacgcttcagctcatccttcttatcgtacgggatgaacgggtcaaggtattcgacctttggatcagagagctcgtcgatgttgaggcccagcgactgcggatagctcatcacgatcgggcagttgtagtggttggtcgcaccgtcgtcctcctgacgctcccagcggatgcagggcatccagatgaagtcaggatccttctcaagaaggttcatgatgtggccgtgggagagctttgccgggtagcacaccgattcagacggcatcgactccgtaccagcctcgtaggtcttcctcgtggtcttgtcagacaggatcactgagaagccgagcgtcgtgaagaacgcatgccagaacggatagttctcgtacatgttgagtgcgcgggggattccaaccgtgccgcgcggtgcggtcgtcgggtcaaggcactcacggtcaaagagcagatggttcttgtagtcgaacaggttcggggcgtcgctctgctccttcagcggcttgccggagcccttctcgcagcggttgcccgtgataaagcggcgaccgttgttgaagatgttcaccgtgagcaggcagtggttagagcagcgtccgcagtggacgttcatgtgcttgacggtcagattgtcgacttccccacgggagaggatcgtggacaccccatccttacccgcacggtcacgcgcgagcagtgcggcgccgtaagcgcccatgtcgcccgcgatatccggacggatcacgttgcggccggtcagaagttcgaaggcgcgcagcgtcgcgtcactcataaaggtgccgccctggaccacgatgtacttgccgatctggtcgtagtcacgcagcttgatgactttgaagagtgcgttcttaatgacggagtaggagaggcctgcggcgacatcgccgatcgtagcgccttccttctgcgcctgcttgacgcgggagttcataaagaccgtgcagcggctgccgaggtccaccgggcgcttgcctttgagtgcggcctgcgcgaattcctggaccgtcatgcccatggaatctgcgaagttcgcgataaaggaaccgcagccggaggagcaggactcgttcagcgcgatgtgctcaatgacgccgttgtggacctgcaggcacttcatgtcctggccaccgatatcgaggataaagttgacatccgggacaaaagccttagcgccacgcaggtgcgccacggtctcgatctcaccatcgtcggcttgcagggcctcgatcaggatgccctcgccgtagccggtggtggtcacgtggccaattgtgcagtcttcaggcagatggtcgtagatatcgtccatgattgtgcgggcggtacccaagacatcgccgttgttgttgccgtaccaggtgtagagcagcttgccgtcttcaccgacgatagcggccttcatggttgtggagccggcatcgataccgataaagacacggccgtggtagttctcaagcttgcccttcggcacaacctgctggtcgtggcgggacttgaactcctggtaatccttcttggtcttgaagagcggatccagacgggcaacctcggagccctggacgtccctcaggctctcgagctggtcgatcagctcctggaaggtgacgcgcttgtcggtctcaccggcaagcgctgcgccgcaggcgacaaagaggtgggcgttcttcgggacaatcctgtgttccttatcgagcttaagcgtcacatagaagcgctttctgagctcagagagatactgtagaggtccacccaagaaggcgacatagccacggatcgggtggccgcaggccagaccggagatggtctggttcgcgacggcctggaagatggaggccgcaacgtcctcacgcgctgcaccttcattcaggagcggctgcacatccgacttagcaaagacgccgcagcggctcgcaatcgggtagatgttcttggcacccttggccaacgtattcaagccttgtgcatcagtctccatcagcgaggccatctggtcgatgaaggcaccggtgccgccggcgcaggtaccgttcatgcgttgctcgataccgttgtcgaagtatatgatctttgcgtcctcgccgccgagctcgattgcggcatcggtctccgggatcagtgtctcaaccgcgcgcttggaagcgatgacctcctgcacgaactcgacacccagccacttagccaggagcataccgccggaaccagtgatcgaaacgcgcatcacggcatccctcaagaccttctgtgccttgcggaagacctgtactgcggttgccttaatgtcagtgtggtggcgctcatagttggcgtagaccagatggtcgttctggtcgaggactgccagcttgacggtcgtggagccgacgtcgataccgagacgcagctgcgcatgacggaagtcaacgcggctctttggcttcagctcagcctcttcctggacgagcggcatagcgtagcgagcattgcgctcagctgctatattttctgtcatcactccatctcctttgtgcttggggatgcatcgtgtgttcccggaattgaaaagtcaatctttttaccgtacagatcgcctggacgaacgaacatcaaaatagtcatgacacaggccatatcgtgcggagactcccgcatgcccgaagagagccatctgagcaggacacccacctcagccgaaattgcaaaggtgaggtagtactcaaagatctgaggtggcagtggcacgtgaagcccttcggaggcgcggtccttgaccgtattgaggaccacacgtttgatcttctcgacgaagcccggatctcccccatcacccaacagtgccggaagataactcttgcgctgcaggaaataggtcaggatatcgacggcacccggacagggctcgaagtttctgatcgcttcctggagctgctgatcgggatccgtccctgcgccaatgcgtgccaagatggggagtgatatccgccaggtatcctcctcactcgaattcccgagatccggaaatagtcccggataatgggagtagaacgtacggcgtgtcacgccggccgctacagtcccctggaaccgttactctgcgaacagtatccctgtctcctcgatctggcgcgccaacgcgtcgcgcagcgcttgcctttctacgcgttctgcgatcggccgagcctgatgtctctttcgtctcccgctgttgaaggtgcgccaatctcatctgtttagagcgtgaaagctctctcagcatgggcctccctctcttggtcgaatagttctttcacacgtgagtaattatttccgcacagccggtggggggtgaaatatttcaagaaatctagtattgtcattccttcaaaaccccgtgcataaaacctcatatgatggccggaccccatcacgtgctcagcctgtcggcccctgataggccaccaaatacctcatttttgcacatcctatttaaagggctaagcactttccggtcatagtcccaaccgcttctggtcacccctgcactgtacaaatagatgcaaagtgataactccgtcaagccagagatctgacatagccaaaggtgctaacatgcgggccttgagcctgaggaatgcagctgctagggaaaaagctcatgaccgcaagagaggtagtcaagaaggagtcgtgcgaagaaggcttttagggaaagaatccccatgaaactttgcctcccggcctgcaaaggggccagctactcagaaggtttacggcatgcacacaacctatagtagtggcacgagatacttaacacctggcttcaaacctcctggcagacactatgattggaaaacacccacttgccttcagacgtggttgtagctcttccttctgcctcatggcacacacaccaaaacggctgaacacagcgcatgtgccaagcgccgaataggccatagctacaggaccaggtccttgctgctgtgctataagcgagatcaaagtgtacttcgttgtccttcttacttgacacacatcgaggtggacggctcctatatatgaagccagggcaaaggcacaagcagcaacagcaagcccctgttcgctgcgagggaaggcagggtgctatgccttgcgtcatccgctggctcaggactgctcaggggacttttggcaggtcgaagaaggggcggaatgtatgcagcaggatatcggtcgggcttctccttccttctggcaggctcgcccagaaggagtgtgacagcttcgacggtggtgtatcgcttcccctgaggtctgcaggctcatctcgaatatcaaggcatatgtctgtagcacgttccatagccttccgaaggcgcacacacagtcgtatgcagacttcttcagctagaggtacagccacaggggctacaacgatgcatgtatgaagctcctgcatgggatgtgccttgtgcatgtgctgctctctccggcatcgccgagacagtcacactgcagctgaaattgcctaagccgcttgcagttcggcagacctaactgtgctgcaaacactcagccattttcgagaactgcctgcgagcgcttgcctcatagtcctgtaacggagtggcacgtggcgccaatcgaatgtattgttgcgcatctactgtagtatccgacatatcgcacttccaatctcatcatcagttgtgcgggtttagcctctatcgagaagagtacgggccaagtccttgccctatcactcaaggtatcgagatattcgaagtgaaacctacattgcgtccttaacactcttcaggaacttgccaatgaactctgagtcagagtgatcaaagatcaggggcttgccaccggcgaaagctgcaatctgctttttcttatcgtcaatcagatcgaaatcaaaaacgttgatgtcctcctggatacaggccttgtgcgtagacttcggaataactgccacattggaatcaatcaggcaacgcagtacaacctggccaacactcttgctgtaagccttgccactctcgatcagcgtcggattcttgaaaaagttgttggttccctcagcaaacggactccaggatatgtgccgtacacccagacgctccatgtttcccatgcgccggcttctgccgccagaacacgtgggtttcaacctggttgaccatcagagctatgtcaaagaagacacaggtgcctgcgaggcggaccggcgggaagctgaagacaccgatcgagcgaacgagacccgctttgtaagcgcactccatatctctccaagcggcatggtagtcgctgtacgcctggtgcagaagcaccagatcgatgtagtcggtgccgagcttcttgagggactccttgatggaatcgtagacattgccctcaccgtagttggtgatccataccctatcgatgaggaagatatcgtcgcggttgacgccgaactctttgatgccctcgccgacgctttcctcattgccgtaggcctgagcggtgtcgatcagacggcagccgctatccagagcatcctggacgcagtgctttgtctcatcgtttccgatctggaaggctccgtagccgagcaccgaccctcaagaccgttggctagttttgtgtaccccatgatgtatacctacttgggctaggcttttcttctcaacacctgtactctcaggcaatttgtacaatacaaaaaccaaagcctactgtgcacggcatgtatagtagatctgccttatttcttcccgcctgagagctccaataggatctcagtgtgggagtgacgtttcttggtccctgcacctaagagcgcaatgcttgaatactttgagcaagcatccttgaagtgctgcagggcatcacgctcctgcagcactgtgagatagccctccttaaagccgtcccaatccagctcatgcttccgatacccgtccagaagctcagaggccgaggcaaagatcggatcgtagacataatgggcccggctgatggtctctacgaaatactccaaatcctcctacttggtgaacccacaaagctgattgctgttgcgtagacgtacgtccaacaccagacccgccttcaccccctgcagcttgccgaagaactcccactcatctcataggcgcccatgatgaatatgttctgcatcatgtccccctttgcattgtccgcttcaaactttaggatagacatacactcaattatgttgccaacacaacaaactcagagagaagggcatcgcaatgggagaactacatccggagcagcgcgaagacgatgtgcacgtactgctgtcctcccctctcttccatgggatcaatcgcagcgagctcaaggcattgctctcctgcctgaaggcagagaggcgtacctacggcaaaggtgaatacatctttcgtatgggtgacacaatcaccaaattcggggttatcctctcagggagcgcccacatcgagcgctacgactactggggcgaccgccatattatctccgccctcttgccaggcaatgcctttggggagagctttgcggctgtaccgcagaccactgcctttgtgagcgtcgtgaccggcgaggaaacaagcgtgatatttttggacctgaacaaggcgctccacatgtgcacttcatcctgccccttccatgcacgcttgatttccaatatcgtgtcgctactcgcccgcaaaaatctgctactcaacaagaagctgacctacgtgacacagcacactttaaaggacaagatcctgacctatctctcggcagaatcacagcggcagcattccgcctatttcgatatcccctacgaccgccaacagctcgcggactacctcaatgcagagcgatccgccctgtccaatgagctttcgaaactcaagaaacagggcgtgatcgactaccagaagaaccattttcacttgctgacgccgccctaccggcaggcgtagggactaccctcagtcatcgaggatcaagagagccatcgtatagtccgtgtctgcatggaccgcatgcttgccacctttgtcgaagataaagtgctcgccggcggtcagcttgtgaggtgtcccgttgtaggtgatcgtcgtcgaaccagcaacgtcaaacaccaacgccctccccggcgcggcatgttctgagagggcggtatcctcaaagaagctcatcagcgcaaagtgggcacccttcgcctgcataagatccatgttgatgatcttgtcttgctgatacggaaggtgggaggccagcttcaccgcactcccccgctcgagcttcaactctgagatggagcccttcggaaaactcaactcaaggtagatgcagccttcctcggtcgtgatgccgatcggctcatccaacggaaccgcatagagctccccggtgtgaacttgaaatgtctgcttatctgtgcgttccacatcaaacgtgcctgattccacataccagagcctcgtgtttgcatagctctcagggctgatacgggtatgcggggcaagtgaaaagacttgcacctcaccggccgcagttttcattacctcagaggagagcgtgcagccctccacccaaggattgtccttaacaacactgaataccttgcctgcttcgacactcatcgtgtatctccttacctatgtagtcctatcctgagattcctctgttactccccggttgggtagtccgtgatgtcctcgaccacctcaagcgtacccaggtaggtgcccccctttgaacgcaccgccatgtatcgcaccagtgcctttctgccctgtttaggcatcacaagggtgatacagtccttttctccgctcttcagcatggtgagcacggtcttcactttagagaggatgttggcaggatggcaatcaagcatgttctgccccagtgcattgagcggacgcgggaagagcttggtatcttctgagaagtagcggttggtatcctgcgcatcgataaaggtaagctcaaacgggagcgtccgcaggatcccttcaatctctggcacactcagtctcccggtcggcagcgtaatgtatacggatgtcgtatcactgcctacctggacctcaggcagcggtgactgctgtgacggttcaagcgtctcccctggccatgcaggaatctctctgagccaggcatacccaaacttcggcatatccgccttgattgaacgccagtcctgatccgtaaagtgctctttcgccatcggatacagcacgttgttctctttgaagaccatctcctgtgcgcgctcgatatacttctcaatccgtctattgatataggcagacatcgtttcgtcaggattttcagcgagcttctgaagctcatgcagtaggaaatgatgctcgtcgcgcagctcaatatcgacgttccacatcacgtccgacggccccgggaacccgtagtgcttgagcgggacaataacaagctcatctttcttagcgagatgggtagataccggtgagaggtcctgcatagtatccgccagctccactgcgggggcatgctgttcaagctggttgtgaagcttctgcagccgggacatcagctcggtgttttccttcatcaggatatcgagcggatgtcctgcaggcacattgatatcttcggatttggaagaaggtttgacgaagctctgctgcttcggcgccggtgcctgtggtgcaggctgctctggttctccctctccatgaaataacgctgagtgtagatcacagagccgctgtacacgttcaagcggtacccctgctgcgagcatctcctgctccgcctccatgatcgcctcgggtgggaccgtctcaaattgggcacggaaatccttctgtactgactcgagcggctctccgttattgagtcgctgcaagtacccaattaatgtgcctgtcgctgtggtagccatactgctccccttctattgttcttataccgaggaaagcatacgaaaagagcatcactgagatacgttgttctgacaacaaaacacggcgcctcaacgatccacacaggatcatcgggacgccgcaagggaatgagcttcattcagtcagggattagagctcgtcgtactcctcgtcggtgaccggctcaagccgctcgttgcttacacctggagcagggactgccagcgcgatgtgccagaactaagaatccttggccgcgccgcgccaatgcttgacttccggatggatgctcacaacagcttccgacttcaaggtctgggcagactcgccctcctcctggtaccaaccgtgaccggcaatgcagaccagcaccttgccacccttgtagtggatgtaccagttgttgcggcaacccggctcgagggtgacgtttgcggcactgagctgatcgtctcccaacgggcgaggtagccctggccgataaagtactgtgcgaagacgtcattcggcttgtcaagcggaaggatcggaggattgtgtcggattttgtggtgtaagagtagggccgcggcagtctcgatatcggcagcctcctgcgttggcgtaactttatgccgctctctcgtacttatcaatcaccagcttcatgatcaccctcgcttcggagtgcgcctcctcgcccgcctccagctccttgatgcgcatctttgccctcttaagggagaaaacgggctctagtgactccttcgacatgaacagccttccgcactcccactcggcgttgagtttaccgataatgccggcgagcagccgcatgactgaccccgttgacgagaacacctgcacggcccggcccctgcgcttgagcttgccgttcatgcgctgcatcacgttgttggcgcggatcttcaggcactgctgcctggggaaggacagatacgcgagggcggcaagctcggcgtccttgaccaccccggccgccgacggggcgtcctcccccagctcgtcgatggcgcgctgtcaggtgctccccggagtcgatcctggcgagtacgtcgcacttgatgtgcgcgaggccgcgctaccaggccgcctgtgggcgtcggaggtgaccaggcgcacgttgtgcaccccgcactcctgcaaaaacccgcgccaggaggcgtagctttctgaattcacacacgtgaaccccacgaagtggcgcggatcgtcgtcgccgacgccgatcgccacgatgaaggcctccctgcgccacgcgccagctcacgtaggtggcgttaaggaacagctaggcgaagcggagcggcgagcagcccctcgccagcaacgcgtccaccttaccctctaccaccacacacaggcacaagacctggtccttggacagggagtccaccctctcgaccttgcgcgtggaggtggcggtgatatacatttcggtcagcgcgcactcggtgcgcgatgcagcgcttaaagagctcggttgggaagtacgagccgcagcgcaacttgggcaccaacagcgggagcgtcccgaccgcggtcgcgatagccgcagcgagtgccgccctcggccccgcacgcctcgtttgcctggatggacatgatctcgttgagcgcggcggccatggtggtgttcatcatgtcacacaggctcgaggcgctgtctaagaaaccgagcaggacctccttcagctgcgggtccccacgctgtattctgtttgagctggccatcgtcgtttcctagtgtcgtcattgatgcaaccgacattctaggaccggcgatggtcttctcgtagcttccctatacaccacttttttcgacacaacctgtcacaggaaagctccgtccgaagaatgtgaaatgtcaggaccgtgtcttcgaccatgcagagatcatagctatggcctggctcacgctgcccgaaagcgtgagatcctaacatgcagaccttctcctacgatgcagtgatccaggcagtgccagagaagggcagcgcctatgtcgcctttccctacgatatccgccaactcttcggtaaaggccgtctcaaggtccatgcggccttcgacggcgtgccctacgacggcagcatcgtgaacatggacgcaaagaacgatgatggctcaatctgctacatcatcagcatccgcaagggcatacggaaggccattggcaaagagccagaagacaccgtccacgtggagatcgtgtctgcttagcgatacaaaagaacatctcgaagatgcctctcatttcttggacacaggaaataggaggcatttcatcattatcaaagcttcgatcctgcacagtgcacactacgttctgtcacacggaatctgcttcgaagcgttttggggtatcttcggcaaccatgccaatggccttctcaagtccgagcaggcctcattcacacgcctttttctgggatcctgcgagatagtcttcgagcaatcagtagtgcgtcctgctatcactccatcgccgactcgatgaggctataggcgtccgagaaacggcctggcttcccagaagccagaaatgcattgccttccgcgatggcatcagcactttccgcattgggttcttcgcaataaataaacctgcggtgcgcccggaagaggatctcgctcgattagcggggctgagttctcctgctctcgtccgcaatcgtcgagcttcagcctcctgccgctcgatgccaacagcacttgcctcatcatgtagacctcctctgacacctgcatgaagcgagacgccgccatcaccgcaagccttgaattctcgcgcagaaggggaatccgaccgtagccagagaggataatcagacggcccgccctgtcatgggagccttcaaacagaagtcccctcacgtaaggtatgccctcccgcaagagggacgagtgcccaaaaagaccgctcgcaatcggagcgcgggggtcgtgtccgtaaagtggtgtaaaaggcaggcgagccagaggcccgccaccaaggtgggatcgcagtcggcaaacaacgaggacacccaagaggacggacatggctcgaatcaatcttacactggaccaagacgaggtactggggctgcttaccgacggggggcggggacaccttcaggctgctgctccaggagatgctcaacggggcgctgagggcgaagtcggccgagcagctgtgcgcctagtcctacgagcaaacgcagcagcgcaccgacagccacaacgagacgaaggcaaggtccctcacgaccagggtcgccaccatcgagctgaaggtgtcaaggcagcgcagcgccccgtttgagaccctcgtgttcgacaactacaagcgcaagcgaggctgcccttatgaccgagatggtcgtcacggacgtctttacagtgaaggtgggcagggtcgtagaggaggtctgtggaaggtcgttcttcaagcgctccgtcttttgaggcctgcgccgagctgaactgcgccgtcagggcattttgcgattggcccccttaagggcgagtagccgttcgtgatggcaaatgccacctacctcaaggtcagggtcgaccaccgcgtgaggttcaaggcgctgctaagtcatcggggtctcgcttgccgagtcgcacacgggacgctcctgggcggacttcctgcgctccctcgtggacgccagagaggggctcgtggcggccgtaagggaggtgctgcctagcagcgctgccaggcccacttctcgtgcaacgtgtgtaaggccgcccccaagggagtgtgcgccggccttaaggggggagctggtcgagaggctcaactgccaagcgcaccggaggcgaggctaaacagggagatagagaggcacgcctgctccgtcggggtcttcccgagtaaggtgtcggtgatcaggctgatcgggtcggtccttaccgaggagaacgagtgcagctcgacacagaggaaaagctactacggattggacttacgcgcagctcctgcaggtggaagacgagctcgcaaagatagcgcgcaaccagagtgacatagcgaaggcgtaaggcagggaacgcggcagcgatcttacacacgaagtcggacttgaccagtgcgggctgctcatcttttgatgcgtatcctgttcatcaccataatctcaacctcgcctgctagcagcgcaatacgcacaagcggtgcctttcgtcacggccaccgtcagaaggccgactcagaccagtttcccttcttgcatgctaagcgtgcggtcacacttatctgccatcaacatgtcgtgcgtcacgaccacaagtgtctttcccgtctctcgggcggcggacacgagcgagtccatgactatctccgccatgcgagcatccagcgaacccgtcggctcgtcagcaagaatgagattgcccggcttgagcatggcgcgactgatcgcaacacgctgcttctcgccacctgagagctcgtttacgttggaatcgagcttgctggagaccgagaacttcttcaatgtcttttcaatagccccctctttctccctcttggagagcttcgtgtaatagagggcgagcatgagattgtcgcgtaccgtcctcgagtcaatgagggcgaacgactgaaagagatagttaatctcgttgcgacgcagaagcatcgcctgtctggtttctggtcccggatatttctttcccgataggagaatgctcccagattcatacgtttcgagcagtcccagaatgttcagcagcgttgtcttgccgcatcccgacggcccggtgattgcgacagattcaccctttccgacaacgagatctataccagaaaggatgcgatgcttcccataggatttcgagagggattcaatctgaatgtacgactgcatcactactccttggagacggtttccagcacaacggccgcagatttcctgcgcgatgcggcaccgataacgaaattggacaagaccagcaaggcaaagccaacaagcacgccagcgctgcttccgaagagggcactcaccccagcgccaagcagagcagtaacggtcacgaatagaacctctcgacggtacagctcccacactccgaagcccaggacgtactttacggaaatctcctgggcacttacccggttgaccacattgacaagacatgcaaccatgacggagacggtggccaccaaaacaaccagaaccgccgagaagagcgcgaaaagctcctcgagggtcttctgcagaccgtcgatgtagttccccaccgtggcaaatcgagcacccaccgagccaccaatctcagctctgttgtcggcatcgagcagacttgacgccgcatgctcgtcgagcttcacgtacgcgttctccaagccagtggcgacgaggctttccgactcaaagggcaccatgttcgcagcagtaacaaccgcaatagcaaacccgcttgatgtgaccggctcttcagggttcgtactccacgtgaagagctccttatcagcgtcataagagatgaactcgtactcagggttctccatgaagggagtgacgatgttcgagtcagagggcttccgtgcggcaataaggaagtccttcacttcgttcacttcgctagcgcttagcgaatctggcaggaggtagacacgtactccttgctctgccctctcgacaacgtccgcaggtatatccacccccatcaactcaaggtaagagggggatgccgcgagataccagagctgcttgagcgtcgtatctgaaccggaatatgctctaatggtcgattcgttgtagttgatggcgttcgcaaggtaaacaccatcatcatactcgtgctcggcgtaccatgtgtacatatcctctgagagctccattggattgtcagtgagccgagtgttcccgatgctgaagtcctttaccacgtaccacccttcatactcctgccatgctgagcgcgtgcgagcaaggtccgcgtacatggtgaggggttgatctatatagaggcagccggcaaaaatggcgaccaagcacactagatagaccgcaacggtcagaccatagaaaccccgccgtgaatatcgcccgtggatggcctcaaccggcctcgttgcgataagtggagcaacggaaatcatcgcagcgacaagcaccatgacgaccgctggaagtacagagacgagggcaagccctacaaaggcagcgttaatcgtgaacccgtccaagtaagcatatactcccaccattccgattggaatgagaacaagaatctggagagcttgcgaggagagcagctcgcttgcgaagtcgaccttactccacccaagcatcaggtgtatccctagcgtcttcagctcaagcagcgagtgcgttaccatgaccaggcaaaggataagcgaaaggagcgcaaacgcccctatgcagaacaggtagatcaggccgggttctgaggttgagcctgacattttcgtggtcagagtctcaggtgttaccccgacagcagacgacaggctgtctaccgttgatttaaagtcagcgcttccaaggttaaggagcgtgcaggagcttcctagattgctcccagcatccatcctgtcaacgcggaaatatatgcctgaacgaatactgggcagatcggacactcgcgagtagacgtcgtttccatacccggcatagctattcggacttccggagcccactctctttatgagggtaccatctataagcgtggtgccgagaacaacgagtgggtcgatggaggtctctccgtcaatcgatgccggcaatatgctaaacgtgtagaggttcgctccggattgcagtgattccttatcaagactaattgccgtaaacgtgcctttgttcgccaaattctgaagttcagcgacgagactgtccttctgcctatccgtgagctgcgaagtgaaaatcgttggctgatctgaaagccagtcatcaacctgcctggagacaagggcttcaaagactcccttgacgcagatgactgaggtgacacccaatagggctattaacaagaggctgacaattgaccaggctttcttcatattgcaccgccattgcaatcccattgcttattcgatcgggtaaatcaaagagcaaatgccatttcaaattccaggagaagctatcctctgcagctccagtatgcctccaaggtatccgtcccaataaagccccatgcctgggaaagaacatcagggtccttccagccagacgtgtatccgttgcaagacgaatggtgctcatagtgggcagaattgcaatcggagaacccaactaccccggcattacgtccataattccaatacaccgctgaacccttgtagtaaacggtgtcagccaacgcaatcgccggcgctcccgcgcacatcagacagcacaatatggcaataatgattgttctcttacctcttatgattccctccgttctcaagcaatggcggtgctttaaagacattctgccatctgcccgcttggcggaacgattcagtagatcacttgccggacaaacgcatagatggggacggtgtgtggtagacatgtggtccgcgaagcagcagcatataggtagggacttatagcattttccgcgcaccaagtccgggggtaggaactcatgacgacaacgctgttttgcatcaagctgctgccgtcctaatgaccgaccacatatctgttgccccccatccgcaacaacagtggcattgaggcactccggatccgcgacagcaaccgtacatcgagcgctgcttagcttgcattgatgctgtgactgcaaccagcagccatagctctgcaatgtcggtacgatgcaggtaggagtcgatctcggcaccgcaacgttcgtatccgggagtatcgatgcaggcacaggcaggtcctcaaatgcggtcacccagcctgataccccactatcacagcgaatacccccaatatggacagggctgaaatcatcgatcaggtataaaactttcgtccagcggagcatgcagacgatgctgaatgccgcccggcgttaacatcgccttgtgctccgatgtcgatgcaacgatagattggaggcctaggtgcgggaaaggcaatggctatcatcgttatcgcctttactgcaatctaacagtttagaagtgtggtgtgcctagcaaggttctgacgtgcggtaagtcgcgtcctccatcatcagatggcgcaccatcctttccaatctcggccatttgtcgcgcgactggttgacaccgaacaggtacacctaccagttcaggtagctctgcagtctcttcgggtccatgccgctgaagtgccacaggcaacgtttgagctaaaagcagaggttgttcacgagcgccatgcactcgaggtattgcgggtcactgacgtgtgccctgtaggcctcgtgcacaccttcgaccgccctgaccggggacctgtgcgacttcttcatgtccccgaccacggttgaccccttggcgatgtgagagcgcaggctatccctgatacgcgggaaggcttgccgtgcccgatgacgacggcgaccgcgttcttgtgggcatcgatcgccacggcgatgcacagctttcgcttgaacaggccgcgcttgcgggcctgcccgaaggcgtgcgtcaggtccgtgtcgttgatgtaggtttcgtctatccagacccggccacacaggattgtgcaatcctggtagccgtccacggtcgcgaacacgcgctggcgccactcgtaggcgctcttgtggttcagcccgcagatcttcgcgatgccccctaaaggcacgttccagcacataagctcgatgaagaagactaaaggtgggcaggtccttcttcgagtcgtcgaatatggccctcaagaaggcggcgtagtgcttcccgccgcatgaggggcacggcggcgcgggcctgtgccgtgttgcggcctcgtcgaaggtctcaagcccgatcttctcctttgcatcctcgcaccgacacggcgcgctccaggagggagaactcctcgtccgacagtgcctcgacgcttccgggaagggccgaggaaagcacgaagaagaaggctgcttagatgaacttctcacccacagaaactaccgaaggctcaacaaatgctcatgctccggcatgcatgtgcgaccgttgcaacagagccccgtccctcctgaattgcttcaggacagacggggcttcatcatgctccatatagaaggagctgccgtctatagcgccaggccttccaacagcagctcctgcttcgccagagtttctggtgaaatcttacctgtttgcctgctacttcgcagcacggtagatctcgacgatgtcttccttcgtgagcggtacgaacgagcccttcgagccatctgcagccttctgggccatcacatcgaagtactcctcgtcagtgatccccacctcatgaagcgttgccggcatatgcacggtctccgtaaagaactggcgggtgcgggcaatggcctcgcgggtgaccggtgcatcgtctgtgccagtaaggccccagacattgcggccgtaggtcgcgaactgcttctccgtcttttcagagaggacatgctccatccatgcaagcgtaaggatagcaaggccctcgccgtgggtgatatcgtagaaggcagagagctcatgctccatcgggtgcacgaccacgcaggagcgcagccctcgccgacgaggctattgattgtatggcttgcagaccacatgaggtttacacgggcatcgtagtcatccggcttctcaggtgcgatcggaccagagtggatcatggtcttaagcagggcctctgccatgcgcttctgcacgtatgcaccatcatccatcgagaagtagttctcgaacgcgtggctcatcatgtctgtcatgccagctgcggtctggcgtgccggaaccgagaatgtataggtcggatcgagcacagacattgtcggcttcaggcactctcctgccgtgtcccacttctcgttctttgtcatgtccgagatgacggcaaaggcatccatctcggagcccgtagcagcaagcgtaagcgccgagaagatcggcaaggcatccttgatgagctcaggatggatcacgagatcccaggcatcgccgtcgtactttgcgccggctgcaacgacctttacgcagtcgattgtggagccgtcgccgatagcgaggaccatatcgatggactccttgcggcagagctcgacaccgtggcgcacggtctggatgcgtgggttcggctcgacgccagagagctcgaagatctcaaggcctgcatcggagaggattttcgttgcctgatcataggtgccgttgcgcttgatggagcctccgccgtagcacaggagaaccttcttgccatatcccgcaagatctgcaagatgcgagatctggcccttgccgaagtggatgatcgtaggtacatggaacgtgaaattatacatagtcacttcttagccggcatggttctgccgcttgtccctgtccccctcatacctgcatcgaaacgcggcaaggccgaatggatgccagtctgaaagaaacggctgcattgcataatcaggacagaaggagcctcgttcccccatccggcaaagcttccgtgcaccagatggcagaagagaccgcctccacgagatgccggtcatgggagacaaggacaagcgcgcctgcaaagctcgccaggaagcgctcgagcgcttccacagcatgcacatcgagatggtttgccggctcatcgagcacaaggagctctgccccgtcgagcgctgtaaatgctagcgcaagtttcctgagctcgcccggactcaccgctatgcccgtgcgatagctctcaggctccacgttgagctgcgctgccagcgagagcacgcttccccgctctgcacggtcaaggttctgaaagcgcagaagcagagcctttgcctcctcgggtgagagctcctgtggaaggtagaccgctttcacgccttcagggatgccatgcgccacgagtgcctttatgagcgtcgacttgcccgtgccgttggcaccgacaagcgctctgtgctcatctagccccacgaagaactccggaatctctataccataccctgcatcgccgaaaggaatcgtctgggccggaagatgcgcgacggcatttctcttcgagcgcacacccaaggcaagaagctctccatcatagctctagggaaacgatgattaattcggctcgatgaggccagtggagccgtacgctgtatgccgccggcttaaaatgtctcgaaccacgcagtgcccatacccacataaatgcctatctgcctgcggatatgttataattacagcaacgtattccagcatatccaaaaggaagatatgagcagccagatgagcttttaagaccttaaatcctaaggtctgaggagaaagacccggcgagaggcattcctggagcggatggatgcaatcgtgccatgggatagctggattgcactggtagaacccagctaccattctcaggcgcgtggcaggcatgtgcgcggtgcagagacgatgcttaaggatgtatctgctgcaggtcatgtttgggctcttaagacgagggaacttaaagatgctatcctggattgtcggtcctggcagcgcttcatgcacttagacctcatgtctgagcaggtgccagatgcaacgacacttgcgaaattccgccatagccttaagcggcagggactcggcaaagctatgcttcacgacctgaatttagaactcgaaaaggcagggatcacggcgcaaggcggctccatagcggatgcgaccttcacctgggccctaaagctccacgaagaacaaggaccatgcgcgcgacccttaaggcgcaccagtccaagaaagggaagaactggcatttcggatacaaggcgcatatcggcgtagacgccggcagcggccttgtgcatgctgtagagacgaccgccgcgaatgtatctgacatatcccaggcacatgcactcgtaagggaagatgataggttctgctgcgcagactccggttataccggtatagcgaagcgcccttaaggtcacagcagacccacacctctcatctatgcgctaaagcgttgctaaggaagccttcgaccataaagagccttgcctgtgcgctcttgtccaagaagggtatcgagtccaggaaggcatgcgtttgctcaaaggcagaagcacccttccttatcgtgaagcggcgcttcggccccttaaggaagcgctacagaaggatagagaagacctcctgcacactcgagtctttctcgcccttgcaaaccttgccatgtgtatctctgccggcaggctgtacctcccggctcccagagtcgcttgatctgtcttggagccttattgcggtgcatgcggcaggataaatgtcaggatggcggctcctgcacgtgctggatgagcatctttccctgcctttcccgcataccggccgcgaaaggccacgtggctggtcctttctggcacatcattgggaattaatcattgtttccctaggcgactgcagcctccgccttcttgccaagcccctgcatgcgctggtcaagctggcataccttgtccgcagccttccggtccttgcccgagacgatggcacatccgatcttctcccggctgtcatggtcatggggatcgaggctgcgctttgaagcagaacggtctgcctcctcgcggcgcctctgctgctcctgcgcaagacgccggtattctgttctcgcagcctcccgtgcatggagcgatgtgtcatgctcctgcatctcctgctcccgcacggcactgtagttgccaggccatatctccatgccatccccctcgaagcagaggcaggaaaccgccagctcatcaaggagcgctctgtcatgggagatcaaaagtcctatgccagagaaatcccggagcgtctctgtgagcagcaccctcgtcagtgcatcgagatggtttgctggctcgcccagaatcaacacatcgggtgctgcagccagggcgcaggctatctgcacgcgtttctgctggcctgaggagggcgtatcgtagcgccagagccacccgtcctctatcgcaagcgcacgacgcaccttctgagcaagaggactccaatcgcacgcgaagtcggaaaggcctgctagctcctctgtggcatcctgcgcgtaaagcgccgtgacaagtcctttcgtgacagagccgctatcaggtgcgagcctgcctacaatgagctgtgcaagcgtcgtctttccgcagccattggcgccgatgatgccatgctatcctttggcaaacgtgcaggatatatcagtaaagaccggattggcgcttccgggatagcaatagcttacgtgagaaagagaaaactgcatgatggacctcgcagacacagggatgaaggacacaatggtgtccatgaaccgtccccgcgtgctcttaaagagcagtgtctagatgcgcaaggctccattcctttcctcggaggacagcgtctctgccctatgcagcgtgtgagaatctaccacaggtaacggaaggacacaagaaataagccgagttcagtactgtgcacgggccaagaacaatccaaacacctgaccctgaaaaccagtacgacagagtaacgacttcgcggccgagaaatgcgctccagtgaccagaacatcatctaccagaaagacgaactcgcaggtgttcgcatcagttgcgactctctgcagcgtatcttcgatattctctatcttgcgtgtaccacccacgtgagatgcaatcccaggcactgcagtctcgatatcatggcaaagacgaagtcccagcttgctgcataccgctctgcagacctgttgttcattgcggtcatcataatcttggctatcaggccgcattgatggtgggataggtacgagtccgaccctatatcccagcgatgcgagactctcgtcagtggctttcggatgtctgccttcgagaaattcgacaagagcatccgagtattggcgaattgccttcagcttgtaacgagtccgatccggacgggcacgcaagcccctctctgtaccaaccggtattttgtaattgagaactgtctggttggcttccgaatgccggtagccaccccgaggggtgcagatcaggtagtagaagcagaaatccccctcatggagattcatcggacgatcaagttcatcgaccatctgccacctattactattcatgagcagccaatcgcagaaagcacatcggtgaccgaattcgctacgattgcaccatgctctaccatcttcgcagcccaagttgtctgctcgacaacagagggcagcaagataagctttttatgctgttcgatgcacgcactggcctgcgtccttgttccgctggtttcgcctgcctctacgatgacagtagcttcggacagggcagccatggttatgttgcgctccggaaagtagaagcgctgtgtcttgattggctgatgatcatagcggtagatgggcacctggctaataaggagatgctccgtagctacctgctcctgcaggtcttcattttcctttggataatacctataatcggcgtgccaataacgccaattattttgcctttagagctgttttggccactaccgtatctatacctgctgcaagtccatcgacgacagtgaagtcataccgaacgagcgcagcagctatacgatacgccgctcgctcgccacgctcgctaggatggcgagtgccaacgacagagatgcatctcgactgcgtcagattgatatcgccgcgatagtagaggaccgggagcggattcttctgcgccctcagaccatgcgggaactgtggcgttccatccaccagaacagaaaatgttccaagccttccctttacgtactgaatcacttcggaacgtttttcttcgtcgggaacgatgccgtcaattgcatcagcagccatactcggaagtccgccatttcgctggatgaggttcgatactttgcttcgggaagttccctcgaccgcatagagatactcatacaccatgagctccttatagggagaaatgacctcctcttcgctgattgccggcaccatgtcgcaccccctatgctctcgtgtctccattctaacgactcaagcatctgctgtatagtacaattgttctatgttttcgtggcatattggccacgtaatatgatgtggctgccagttttgagacacggatttgaccatccttccgaatcccgtagagatgtttccagggggtacggattgcgaggaagagatgtccaagatcacgaggaagacatacagcgccagcttcaagatggccgccgcgctggaggtggcgaaggagcaggagacgctctcgcaggtggcagccaagcacggcgtgagcccgtcgcttgccgctgcatggagggacgagtgacctgcgtcaatatttcggacttaatggctgagtacctccagcatagttaggctccctgaactgtaagcggcttaaggcaagattgaaggcatcttcggctggaccgtcgtggtggctgcgatgccgaagagcaagacatggatgaggcacatctcgtgcagcagctccatgcagccatcccttacatccctgtggctgtatctttgtccgcataggagtgcatgtgggccttgggaaggccatggaaggcgccttcaacgtaggccttgaagttggatatcaccctgtggaccataggaagggatgcatccccgtctgctctgtcgtactccctttagacgagcccgcaaaacgaagagaggccggcaagctttgccgctccagccatccgcccttatcttcgatgtatggcagagctggtcatgccccacctggcgccagcaatctttcgagcacccctttgcgcagcgcagggggcaggagccctgcctgccgctgtaagcatcggctgctgctttgtgccgcgcccgcccttgcctggtgccttggcgccgatatagaagtcgtccacctcgtgtgtgtcagctgcaaggacactgaacgcactgcgatctgacccaggcgagcgtatccttaaaaggacccgccctgccgtctttaagctgcagcctatctgccttctgcagggcgcaggcgctgatccttgccttttgggcggacatgagccatatcgcctacgaaccacttcctgagctcgagatgcgtgccctccatcaatagtccctgcgctcacgctcacctggtgcgagcacttcgtgcactgccacttgtgcgcgcggcctcagaccttcgagcaggacgtattggcgcacaccgggcagacaaagccgccggagaccttctcctcgataagcctcccctcgcacgactcctcgtctgagaacctctccaaaaggcccatcaatgtctctttgctctcgcattcgcgcctactcagagcgcctgcatgcccctttaccatctctttctttgccctctcggatgcatcaaccttgcatcctcattgtacggtttggaggcgacaggaactcctgcggttatgctggaggtcctcagtcatttcttgggtttaccccttgactttaaatagcaggtcttcctttatgagttgatggtctatcttcgatgagccctagaccatcacaggtattgagaaaaagatcaatgaccttgtcatcatcatatggaacatcttcatgctgtgttgctaacaggtactctacctggtcaagtagcatcaccgccgggctcgtgcggtacgtacggcctgggtggcgatcgaggatctgaacgtgtccggagatgcacaaaccacacctcgcccaggcggtcgccgacgcctccttcggcgagtttccgccggcagctcgaatacaaggcgaggcgcaacggcgtcccagttggcggtgggtgatccgcttcttcccacagcacaatgacgtgctcgcgatgcggggcattgaaagccaaggctgccctgttcagaagcgcacgtaccgatgcgaggaatgcggactgaccatcgacagggatttgaacgcggcaatcaacatactcgtcgccgggagtgccccggagactacgcctcccatctgcgcgcgcgcggccgggttcctccgccgcgcctgccgcagccgcatcctatgaaacgcgaaccaggcgttcgggagaccgatgcgagacctggagctccctggcaacgggacatgcaagctagaaacaaactagcttgctacggaggaaactcttctgtcgttcaatgttactggccttaatagactttcaggagatatcgacctagatgcaagctcatgaggaatctaaccgtaggctgaattttctctgtagtgcgttataagagctcaattgcagtacagaccggaactgtggaataccgcatttgcttaaaaggatattcctgaataaaacgattaggcagatgtccctgatttcattattctcgaatgaactcctctaaaagctcgaagctgtgtttccatacataaagacgcggaattatatacgccataagaataacaataggcaaggtttacacaggatcttagatctttcccgtagtctacaatattgtacccgtcttgcgactaaatgaattgccgctgccttatcaaaccagacgatagagctgagagcagatactcgtatgtagacaatcttatgtttttatctatcaacgataaaatacagaccagtctgtctgatgtaacgatagcagacaaatgaaaagccacctactcgcattaaatagatacttgccagaacctct

SEQ ID NO: 339 - DNA, 4156 bp, Unknown
  Metagenome-assembled genome
ccaaggaaggtcctgaagtacaggacagtcagcgaggtctttagggagatgttgcactcagcttgacaatctgcccctgaaaatcgtccatgttctaccgctccttttgcaagcttgccctgccgggcgtcccggtcgaggtgcgcctcgccttcggtggctcttcgtaccgccacgattgccagcatcgcaaccgtcccagcaggtgctggcgtttccgttgtctgcgaccatcatagacacgactgcttcgaaagataggcatgcaccaataagtgaagtactacccgtttggaaacattgcttaccatcaggctttttcatggcattccggataatagcgcaagaaacctgacaaatgacctgtccctttgtcaggttcttgtcgggttttactcctgcaccttgagggccagggcaagcggaatgcgtttgatgcggcgcaggtggaagagcgccaccaccaggtaggtcgcaaagccgatggccagatcttctacgataacctgcgacgtgtacgtgaccacgaaattgccgggataggagagcatcatcatttccatggtcgtgctgacgccccacatcgccagcggcaaccccaccaccagcgagatggcgaccgccaaggtaatcgtcgaaaggtagagccgacggatctctcgattgcgatacccgaataccttcatgagcgaaatggaccgggcgctatgatccaggacggtctttgtcagcagatacatgaccacgaagaacacgaccgcggcggctaccaggataagctgcaccatatcggagaatgtatcgatcatctgacctgccagattctgcatatcctgcggcgtgatatccgacgaaaggtagtcggaatctatgttgagttccttgttgctcacataggcgttgaaccagtcgtccgcgtagccgaaggcatctcggaaggcgccgcacgacatgtacacgttcatgttggcactatcgcccgttgccgcatcgatgacgaacgcgtagctcttgtcggtaaaccgatcgtagagcaccacggtgtcgcctactcgcatgccacatttgtccaggagcccctgccccactagtacacgtccatccgatacgtctaggccagtccagtagcgcgaattcttctggataccgtaggctgaaacgtcctcttcacccttacccatcttgcgcgagacctgaagcgaagcaacgcaggccttctccgcctggtcgatagcctccgaggagaacgtacctttctttgctaccgggtgaatatcggcagcgatgctttcagccatgtccgaaagccccagctcgtcggcgcccggaagaaacttgtcgattccagcgagcacgccgagctggtcgcgcagcttctgctggtggtcggtcatctgcaactcatagggggccttgagcacgtagatgtgcttggcgggcatcgaatcggccacgtgatcggcatagtcattgaacatgggcaacaagaccagcgaatacaacaccagaaaactgcttgcgagcaccccgatgaacagtgtgacgaacgtcgaggtgttccgcatcaggaagcgcaggcgaaaacgcgtcgcataacccaactgcgcaggcaaatgcaggttgtggcgcctgcggccatgcgagacctcatgccgtaggaaggcgagcggggtttcgccgagcttgcgcgccagccccacgaacgtgattgccacgagcagcgtgtatgggagcactgaggtaagcaggaacgtctgcgcatcgaacgtcgcatggtacggcggaatgctgtacgaaccgtagtagagttcccgcgccactccggagaccaccgtgtaccccaagacgttgccgactacgacggtaacgagcccgacgaagcatggtaggaacagatagtggcggatgatctcgtccttgcgccacccggacgcgcggagcgtgccgatgaccgatgactcctgcaccaccgtcgcattaaccaaaacgacgaagatgaacgccatgatggccacaagcacatagaggagaaccaggtacacggcactgtcaccgttcatgtccgtagcaagatagctgatgccctggttctgctcccggtcgagcagggacgtaaccgtggtgccgtgctcctcgagcttcttggtaactttcgtctcctgctcgatacgatccgataccgaaagggtcttgtcgtcgaagatgagcgaataggtgtatgtcgtcgagactcccgaaagccgcgtgaaccccttttcggtcaccagcgccacgctgaaggtctgcatatccatcacgaaatcggtgttcgagcgcataagcgtgttgtaatctggcagcaccatgatgccgcagatggtgaaatgctttccttccaaatcgagggaatcccccacggagaggccgtgcttcgagcagaacgtatcgtcgagcgcaatctcgtcgcttgcttcgggcgcacgcccggcgaagtagctcggcgtatccacgctcgtgcgattacaataggtacggatggttgcctcgacgccgtcaatcgtggaggaggcatcgcggctccagttgttataggccgttacgcccagatcttcgaccgcctggcgcacgtccttgccgattgccgcagaggtctcgacgcgcgcgtcttcaagagagctcgacgcctgctgctctgcaataacgtgctggatggatgaaatggtagcaagaaagcccgaggtcaccgatatcgtgaccaccagcagaacgaagatgccgatgtagcgtcccgcatcgtggacgagttggcgtggataacgtttgtgcagggggttacgcatggcggcctcctaccattcgagctgggcggcgggaacgggatcggcattgatctcgttcccgacaagcaccccttcgcgcaacttaagccgtcgcgtcgccatctggccgatagcgttgttatgggtgacgatgatggtcgtgcacccatggtcatgacagacctgctcaatgaaggcgagtatttccttcgaggtttcgtagtccaaagcgcccgtcggctcgtcgcagagcagcagacggggcttcttcaccagtgcacgcccgatggaacagcgttgctgttgaccaccggagacctgtgtggggaacttgtcgcgatgaccccacaggcccagcgaatgaagcagctcgtcaacatcgagtgggtcacgagacagataagcgcacacctcgatgttctcgcggatggtgaggtcttcgacaaggttgtagaattggaagacgaagccgagcgattcgcgccggtaatcgtcaagccctcgacctgaaagctcagtaaggttgacgccgccaacttcgatcgtgccgccgtcgggctgctcaagcccgcctaccaggttgagaaatgttgacttgcccgagccggagggccccaacagagcgcacagctcgccggtaccaacatcgacgtcgatcccctcaagaacctcgacgcgcgatccgctttccccatagccttttcggagatcccgcaccctcagaaagtcgtccatgatagttcctatcttttagctattgcatttgagagctgagtatcgaatgctttcagatacaatgcagaatctggcgggtagggatgccaacatgtcagcccctctcccaacctctgtcagttagataagattaacatatcgggaagttagcgtaaactgacaatctgccgaccttaaacattcaacagaataagatccgtaaggccaaagttctttttaaggtctaataaattggagaaagttttataatcagggggtacctggagttggcgacgaccctgtcctctgcccccaccacaggcgccattgcacacaaagatgtaattcgaactatggacattccatgcgattttgagtactctattcattagtgattcctttttgtatgtggtaaaccagcttactttgttaaaccactatcgtaagcggaaaaatccacgttgctactaggtgaggtcacgtaatatgttactaaagtattcgtctttgcagcggtaatgcctgccacgcgcataagaatggtagcgggttctaccaggcaatccgctatcccacacaacgatcagcatcatacgctcaggtgtgcctcacgccagtcttctcctcgaccttaggattgataa

SEQ ID NO: 340 - DNA, 68842 bp, Unknown
  Metagenome-assembled genome
ccatgcgtggcgactcggctcctctgcccaatgcgtggccatggtattcggagagatattctgctggactcagacagtccccgcccgaagaggacaagctctctgcctgccgatggcccagctgcgcgcgctgaggcagcagaagcgccactcgcacggatcgcgcagggtgaggcgtgcctctctgacagtgcatccctgcgcagctgtgggtgcgtagtccggaaattgccgtcctgtggcggcgatggcgcgtccccttcagctcggttctgatcaggaatcgcagctcggcatagcctgacagatggagcttcttgctgcgcgctcgaatgacaggggcagaggcgaagcttgacggcggctgcctggtccagctccatcctgccatctccgcgaatgcaatctcttaagcgaagtagaggaaaaatcgagctttcgccttgtgtgacgtcgagaggatatcgtccccctggatgcctcgatcatgcggcgtgccttcccttttcgatgacctggccggtgtggtgccgatggaataggtgcggggctatctcgtctgcaacgggcgacgatgcccagaacggcgaggcagcggctgtcctgttctcggcgcgctggtggccagaaggcgatatcgcagaacgtgacaaggtcgctcgtgagggagctggtggatgcctatgacaaacagccacggttatgccctctcttgcaagggagagcgtggatcctgcgcccgagacgcttgcgcagagcacgaccgcatcgggtccggcgcttgctatggcatcaagcgagagctcgcattcggcatgcagatcgtggggcaggaagccgagaagaggtaatggtgcagatactcgagggccgtatgcgtgaggccgccgccgacaaggatgacggtatcgcgctcggcaagcagatcggctgtgcgctcgatatcctttgcctggttgagatgggaggtcgcggctgtctctgcaaggatgtcacgccggggcagggctcctgcagatacggtaggatgcttctgccttctgagcgcgaagcggtactccgtgtagcccgaatagccagcttgcgcgaaagcctgactacggttgcggccgagcatccagccttggctgccagctctcttgcactcaggtcaggtaccgtctgggcatgggactggatatagcgcagctatagcgaaggacagaaagctctgctgaagtgaacctggatgctgtttccggcatgctttgtgctctcctctgggatacaagacagtttggaaatgtttctgattttgaaacatgtaacagattatggcatgagtttctgtaacgttctttggctctcaggcacggttccgcgggcggtatctttatgctgtgcgcagggaagagaaagaaaaagcccctcgtacctgtgctgatatgaggattggcaggacaattctgtacctgctcaacaagatccgagaggtggattgcaatggcagagaagcgttacaacgtgtgtatcgtcggtggtggcagcacttatacgccgggctttctcaagagcttcgtgaggcttcaaaaggatttcccgcttgcaaggcttgtcctcttcgatatcaacggtccacgataggagccggtcggaaagttcggggagatcctcttccgtgagatgtatcccaatgcagaaatcagctacaccactgatgagaagactgcctataccggcatggacttcatcttcatgcagatgcgttcgggcgggcttgagggccgccggtcggatgagcacacctgcttcgatcatggcattatcggccaggagacggtcggtgctggtggcatggcctatggcatgcgctccatcggtgacatgatccatgctatccatgccatccgccagtactcgccgaatgcctggtgtctcaactactccaaccctgctgccatagtggcagaggcgctgcgccgtgagttcccggatgacaagcggattctcaacatttgcgaccagcctgagaatgtcgtgcgctccacgagccggcttctcggcgtggactggaatgatctcgagccggtctatttcggcctcaaccactatggttggttcactcacatgtactacaagccgacgggcgaggacctcatgcctaagatccgcaagcttgtccatgagaagggatttctgccgcaggatgcggaacagcgcgatccttcctggctcgagacatatggcaacgtccagattatgatggaggactaccccgagttcctgcccaacacgtacgaccagtactacctctatccgctctacaagttccagcatctgaatgaagagcgcatggctgctggcaacaagacccgtgctgatgaggtcatcgaaggccgcgagcagcgcgcattcggcgagtgccatcgttgcatcgatgctgacacgaccaagggcattgtcgacatccactcagatgcgcacgcagagatgatgatcaaagtcgcatctgccattgtccacaactcgggccgccgctatatcatcattatcgagaacaatggcctcatcaacaatatgcaggacgatgcgatggtcgagattgtcgccgagcttactgcaaacggtccgcgtccgatgggcgttggcaatattccgcagttttacctcggactccttgtccagcaggtgtcctgcgagaagctgctcgttgatgcgtacttcgagcatagttaccagaaggcgctcgaagcgatgacgctgaaccgcctcgtgaacgatacgaagaaggcacacgagatcctcgatgttctgatcgaagagaacaaggactactggccagagctcaagtagtatcgaacgctacaaaaagtgcttgaaacggtttgtgccaggttggggggataagtgcctagcgcaggctgcactgcccgcatgctgcaaaatggcgggcttcattcctatgacaggagatatctgcgacaagggggaagcatgggagagaagaaacagaggggcagtgtcatgaactacctctcgaagctgggccagagcctgatgttgccgattgcagcgctctcggcggtcggcctgcttctgggtgtcatgagtgctctaacgaaggatgcagtcatcgctgctgtgccggcgtttgtgccgacagcgccggtcggattcgtctttgccacaatcaagtcggttgcaaacgcagtctatgcacagattcctgtgctgtttgccatctgccttgctctcggtcttgccaggaaggataaggagattgcagcctttgctggctttgtcggctactacacgttcatcgctgctggtgcagccatggtcaagagcggtctcttcgatttcagctcccttgatacagctgcggtcctcggagtcgaaggtgcaccgaacatgtcggcattcggaggcattctggttggctgccttacggctgcactgcatgaccgtttcatcgacacgaagcttcctattgctatctccttttacggcggcaagcgttctgtggcaattgtcgtcttcgtcgcaatgcttatcctcggtatcctctcgccgttcatctggctgccgctctcgattgccatcatggctcttggcacggctatcgcgaaccttggcaacttcggtgtcttcctctttggtctggctgagcgcggtctcattccaaccggcctccatcacatcatcaaccagctcttccgtacgacttctatcggtggtatgctcaatggtaccgagggatgcctcaacatcttctaccagtatgtcgacaccatgggtaccgcggcactgtccgattacacccgctaccttgcagagggcaagttcgcattcatgctcttcggtcttcctgctgcagctcttgccatctatcgttctacgcccgagaacaagcgtgacggcgtcaaggcactcgttgttgccggcgcagtgacggcattcgtctccggcattaccgagccgctcgagttctcgttcctctttgtagcacctgttctctatgccttccactccgtgatggctggcctttccttcatgctaacgcatatgctgggcgtctccatcggtagcacaggtggtggcatcatcgacttcttcatctggggcgtgctgcagccgggttcccgctggtacatgatcattcccctgggcattgcctacttcttcatctactacttcgtgttctacacgtacctcacgtcccaccacatcgtgatcgatgcgccggatgattctgctgaggtcgccgagaaggcggagattgctgagggaaccatgacgccgcagctgacgtacatcatcgaaggactcggtggcgtggacaatatcgtcaacatcaacaactgtatcacgcgcctccgcgtcgacgtgaaggatatgtcgctgattgacgaagacatgctcaagaagtccggctccatgggcgttaagaggatgtccaatacccacatccatgtcatctatggcccggcagttgagaacatcgcaacgcagcttcatagcgtgctcaagatgtaatgaacgtgtgatgcccttctaattgtcaagtcgttttgagcatgcggttctgggcaatgatggcgtagtactgctcgcgcgctatgcatcgcttgaagcatcgtatcgcctcgagcttggagtgcccttagatatcttgcgggccacctaagcgcgagtcctgtcgtctatctgcagtcttcccggcgcaacgatgtgtatcgcgctgttcgctgccctgccagcgcccctgttgagcctgtagagtgtcgtgagcctcgacgacacaggacacgctgccaccccgcacaagcatcgcgaacgacgactcgctgcttgagcctctccggattgtccctccacggtgatcatcagctgggcgctgccctgcgagctgacgcacttctcctcgaggatggctccgatggtcgtaccgagctcgcccaccttatcgtcgaggtcctggtagcgagcggcgagtgacttgagggcgatgtgcgtgggcaagcgcagggtcgcactagccggacgcgcccgatcttgatgcagcgtgacctggggacgaggcgggcggctgtcatcgcgcactactggtctcacacggtgtcgggagccgagacgatcagggagcggatctgctcgatcgcggccttgcgcgccttcagcgcagacgctctcgccctggtcaggacccgcaggctctcgaccatgtcgtccctaccctttactgtcacgtaccgtgccctgctcctggcgcccttgtgcgccatcgcggcgtcgtccttgtccctgctgcgcctgacgaagcggtcgggggtgctcacctcgacgacctgcacgtgctcgcgcgagaggtgcttaaagcagctccggcaccgtaggtccccgtgtactccacgctgaagtgggccacctcgccgcctcgagcgggcccacgcgagcatctcggcgcacccccgcctgctcgtcgggaagaaggcacgctcgacctccgtcacaccggtgtcgacgccaacgtagatgaccctttccacctgtccttgttgcatgggcgaccttcgactgcctacggctgaacgatcgcctctgccatttgcctctcgatcagaacagtaggggagacgcttgtcggcatcaggcctctcttcggtcacgggagccgtcatggcgaaggccctagcgggtttgcgccccgggcatccgacagatcacagaagcgacaccgatcaagtcggttttgtcatgggtcaaggcgccgggggcacgtcccccaccagactcgcacatcccgtcggatagcaaaacctctggcgtctccgagtcttactgtttagtcaagtcagaatttcgtctttgagcatgacttcttttcgggtttctgctctaaaatttttcggctttacgcatgagcgcgccgatgccctactttcctgatttgctcagcatgagactctgcttaagcctgtggctaggacccttgaactcgacgagccttccatggtgcacgaccctgttgcctgacctgtatcattttttcggacagtgcggcttgaggaattatgaggctcctctatactgcaagataagccgaccaaaaggaagttcaatcctaaaagctgtgggcgaatgccagcggcgtagcgccctcagagacagaagagcggccatcctctagaatcttgcatcgcaacatgtagactccgaacaaggatggagcgcgctgacaagtgtagcatctgcggcagcccagctgcccgccgtttcccatgccgatgagatgtgtgctcccggcttcctccgcattccctcccatctggacggattcatgcagacaggcgtgcctaaggagagcgtccgcaccgaggagttcggcacctcggccagacgatgcagcaggccggtgcagatcctcacggtcccaggcaggctggctgcgagggaagccccctcatgcccctgctgcggaaaggccatggagggcaacgggcaggtccccattgcgcttcggcacctccctctgggcatggagagggcaagggtcgaggtcttgcggccaagatgggcatgcaggggatgcgggacttccagcatcgaggatgttcccttcagagcgccaggccagcgcatcacgctgcctctcctcgtgttcgtgtgtgacctgcttgccctgggccagacgctcaaggcggtatcgctcacggcaggccttaacaggaacgtcgtgaaaaagatcgacagggcaaggctctctgcgctctacacggaaggcgaaggcaaggagctgaagctcaggaagccggagcggcaggcgcgctatctgggcgcagataagttcaagctgcacaatgcccgccgctgcgccaccgtgatcatcgaccttaagaccggtcacgtgctctggctcgcctatacgaagaggaagcaggtcgtgtatgacttctgcgacttcgtgggcagcgagtggatgtcgcatgtggaggcaatcgtctgcgacatgaacgccgacttcaagcgcgccttccttaagcgccatccgcatctggacatcgtctacgagtacttccacctcatcaagaacttcaacgagaaggtcatctgtaaggtcaggaaggacgagcaggcaaggcttaaggacgatggagacagcgaggctgcaaggtccctcaagcgctccacatacatcctcatgtcctgtgcggacaccaggaagaggaaggagcgggatgcacgggccggcaaggtggtatcaagtggaagcgccctcttcggcaagcaggaggtcctgcagaagggaggggccagggagcgctacaaggagctgatctcgcagaacgagctccttgccgcctgcgacatcgcgggtgagatgctctgccgggcgtatgcctaccggcaggagaagcgcatgcgcgatgccatggagaggatagtcgaggtctgccgcggcaccggcgacaggcacttcgagtggttcgccaggctcgttgagagccacatggacggcatcgtcgcgcatgccaggcaccatatcagcagcggcaaggtcgaaggcacgaaccagatgatcaagacgctcaggagggcaggctagggataccccgacgacgagtactttttcctcaagatattcgatgcgagcaggcgctactcgaagccttccggggctgcttcgtgataggcccgcacacaggtttcaggactgaacccaaaaggacgacaaatggcaaacaatcttgctaccaaatacagcgatgagtagcgcctgaaaacagctgagtgtgctatctccaccggcaagccgatagcccacctcgccaccgaattagggcttaaatcccaaaatactaaagccgctgggtaaaagatcgtagagataggctatcagctgcttaagtgcagcgaggctaaaagaggaaaagctcaaaagccttatgccaagcgcaacaaagagcttgagatggaacatgccttcttaaaggcagccgtaagccttctttacaaaggatcttaagcgcaatagattgttacaagcagaagcttaaggagaaggaaaacttcccgatcaagatacaggctttaatccttaaggtatcgcgctcaagcttttattcatgggtgttccaagggagcaccacagaaataggtgaggtgagcttacagaggctatctggcgggcgtgggtggactctgacaaaggttttggggctagggaaacgatgattaattcgcctcgatgaggtcgctggggctgtacgctgtatgacatcggctcaaaatgtctcgaaccacgcagtgcccatacccacatagatgcctatctgtcttctggatatggtatagctacagcaacgtattccagcatatccaaaaggaagatatgggcagtcagatgagcttttaggaccttaaatcctaaggtctgagtagaaaagacccggcgagaggcactcctggagcgaatggatgcaatcgttgtgtgggatagctggattgttctggtagataccagctaccactgacaggctcttgtcaggcatgtgcgcgctgcaaagacaaagctttaggatgtatcctgctttaggtcatgtttgctctcttaagacgagggaacctaaggatgctatcctggattgccacttcctggcagcgcttctgtgcacgtagacctcatgcaagcgcaggtgccagatacaacgacacttgcgaagatgcgtcatagccttaaagcggcagggatcacggcgcggggcggctccattgtggatgtgaccttcacctgggccccgagctccacgaagaaccaagaccatgcgcgcgacccttaaggcgcaccagtccaagaaagggggagcctggcgtatcggatacaaggcgcatatcggcgtggacgccgcaggtgaccttgtgcatggtgtggagaccaagcgcctagaatgtatctgacatatcctatggcacacgtactcgtaagggaagatgacaggttctgctatgcagactccggctataccggtatagcgaagcgcccttaaggacgcataaagacccacacctctcatctatgcgctaaagcgttgcaaggaagccttcgaccatagaaggccttgcctgtgtgctcttgaccgagaagggcatcgagtccaggaaggcatccggccgctcaaaggtagaagcatcccttccttatcgtgaagcggcgcttcgatccccttaaggaagcgctacagaaggatagagaagatgcctgtacactcgagtctctctcgcccttgcaaaccttacccatgtgcatcttttgccggcaggctgcacctcccggctcccagagtcgcttgatctgtcttggagccttcttgcggtgcatggggcaggacagatgtaaggatggcggctcctgcacgtgctggatgagcatccttccctgcctttctcgcattccggctgcgaaaaagtcgtgtggtcggtcccctctaacacgttatggggcattaatcatcgtttccctagatatcaccatccaatgcagcggcgaatcctcagagcaagtgtgatgactggcgatgatagacctcccagagacacttccgctccagacgcttgcgaggtctttggttgagtcctttcctctattgctgtgagtcatacccagctgccgccatgcgggagagtacgttgtctgcactcagggcggggtttacggtggaataggactccgtgcaaatggcagctgctgccactcctgctgcgcaggtgttggcaagggattcaccgcgggtttgcgcccaggtaatggctgccatcatagtgtcaccggctccagtcgtgcttacaatgtttgaggcaaagctggggatgcggaccacattgttgcgatcagctgcataggctcctcgtgctccaagggagatgacaacccgtttcaccccttgatcgaggagcttttttgccgcgagcttcatgcttctgtcatcggtaatatggacaccggtgagggtttctacctcgagctgattcggtttaatagtgtcaagtttgccaattaagcccttcaccttcagtgccttggaggtagagaccgtatcacaatacaggggtactctgacgtggtctgcgagataggctaagcactcaatagagatattggtatcgactacacatacctgtgcgtggttgatcacacctagacgtgactcgagggcttctggagtgagctgatcgaggatcttcatatctgagattgcgagggtcatatcaccttgttcgtccatgataaacaaatgcgtagaggtgattccaccggggatggtgatcgagttgtcgatatcgatattcaacttacgacagtcattgacaagctcggttgctctaatgtcatccccaaagacagtgataagcttcacatcacagccaagcagcgctaggttgtgagcgatgtttctggcagtcccaccagcggagacggtaacagtacctggcattgtgtcgtgggctcttggagtgtaggcagggtgtcctgcgaggtccatattggttcctcccaccacggcaatataaggcttatcagccaatacgtagcgacgccccaagattgcacctttcttcgtgagattggagatgtggacagctaccgaggagcgtgagatatgagcacgctcagcaatctctttttgtgtaatggaaggattgatacggatccaatttaagatctgttgttctctgtcggtgagcatcgtggagcgctccttcggtgtcgagcatgctctatgcgtctttgatagagctatttgcatgccctttcaatacctgtgaccattgaaaaatgcggtgattagctccagtataagcatatgtttatttacgataagcaaaagccgctcggcgataaaacagcaccgatgggcatagtcattctactgttacagttatatttccatgatactaagtttaagccgttttccgtttcaatacagcacccgtagagatgggtacccctcatgagtagacgtatatttctcattgttctcgacagttttggtattggcgctgaaccagatgccgctgagtggggcgacgaaggaagtaacaccctgtgtgcctgcgcatcaactggtgaactcgacgtgccgaatatgactaagttgggattgttgaatattgagggcgcactgaagtctccctacactacaacgcttgccccgatcaacaaacctgaaggtgtttttgcgcggttacgggaagcttctgccggcaaagatacgaccgtgggtcactgggagatggcaggtgtcatctcaccgcatcgtttcccaacgtatcccaatggatttcccaaagagatcattgaggagtttgagaagcagaccggacgtggagtcctgtgcaataagccctattctggtacgcaagtgattcacgactatggtcaagagcaactcaagaccggtgagctgattgtctacacttcagcagacagtgtcttccagatcgctgcacatgaagatctgattccgcctaagcagctgtacgaatactgtcggatcgctcgtaagatcctaactggcaaaaacggtgtagcccgcgtcattgcccgtccgtacatcggtcagtatccgaacttcgagcgtacgagcaatcgtcacgatttctcactggaacctacgggcacaacgatgctcgatgtgctcaagaagcagggtaaagatgttctctcaatcggaaagatttacgatatctttgcgcatcgtggaatcactgactttgtatacaccaagaacaatgcagacggtattgatcgcacgatagaggcaacggagaaggacttcgacggcctgtgctacacaaacctcgttgatttcgatatggtctatggtcaccgtaacaacgccgttggatatgcacatgcactgaactatttcgatcagaaactccctgagattatggcaggattgcatcctgacgatctcttgatgatcaccgcagaccatggctgtgaccccgtcacaccgtctactgaccattcccgtgagtatgtgccgtggttagtctgtggtccgcaggctcgtaagggtatcgatctcggtactcgtccgacctttgctgatgtttcagcaacggttcttgattacttgggagctccctcacttgaagcaggggtttcccacgtcaaagagattttggaaggatagcgactatgccaaatgttccaacaccccacaacgaagcacgtgaaggtgaaatcgcgccgttcgtcttgatgccaggggatccgctgcgtgcagagaagcttgccgataactatctctctgatgtgaagcgcttcaacacggtacgcaacatgtttggctataccggcacctataagggagagcgtatctccgttatgggatccggcatgggcatcccatccatcggtatctactcctatgagctgtatcacttttacaacgttgagacgatcgtacgtatcggcactgccggcgctctgtctcctgatgtagatgtccgcgatattgtgcttggggaaggtgcgtgcacggactctaactatgcgcagcagttccgcgctccagggaccttagcgccgattgcagattttggtctgctccgcaaggcagcagatgcagcagattgtttaggctacccggttcgtgttggcaacgtggtctcctctgatgtcttctacaacgacgatgagacggttaacgatcgctgggctcgcatgggagttcttgcagtggagatggagtcagctgcactctacctcaatgcgatgcgtgctcgtaagaaggcactgacgattcttacgatctcagacaagcctgcaaccggagagtctctctctgcacaggagcgtcaggagagtctgacgcgcatgatggaagtagcactgacgctcgctactgatggataggttgtgaaccggtgagtgtgatcttactggttaaataatggatcgtttgtatcgtttcacgtacaaggtgtgcaaacagacgaaaggggatctcaaatgggtgcgtctggtaatgtttcacggcgtgggttcttacggggagccgcaggtataggcgcttttggcgccgctgctttcctggcaggttgtggcgaatcttccagctccaacaattcttcaaattctaatagttcctcagatgctggcaagaaatataaggttgagatggtcaccgataccggaggtgtcaacgaccagtcattcaactccagctcctggcagggactgcagaagctccaggacgaggaaggctgggatgtcagctatctcgagtccaagcaggaatctgattacgcaaccaacctcgataaggcagtcgacgatgaggcgaacctgatctggggtattggttttgcgatggcagatgcagttggcaatgctgctaaagcaaatcctgatgttcagtttgcaataatcgataatgtaaacccaactggtggtagcaacatcaccggtgtgaccttccgcgcacaagagtcctgttttatgtgcggctatattgcggcccgcttcagcaagagcgcaatggtcggctttatcggcggtatcacctccgatgttattgatcagtttgagtacggctacagagccggcatcgactatgcaaacaaagagcagggactcaacgtacagtgcgaagttcagtatgctgattccttctctgactctgcaaaaggtaagtcaatcgcaaacaagatgttctccgatggttgcgacgttgtaatccatgcagctggtggtgtcggtgtcggcgttatcgatgctgcaaaggatgctggtaaatatgctatcggcgctgacctcgaccaggggcacttggctcctgaaaacgttttgacttctgctctgaagaagtgcaacgtcgcagtcgacgacgtctcaaaacgtctgctcaccggcgatctcgagggtggcagcagcatcgaccttggtctctctgatgatgcagtcggcattcctgagaaccacgacattatgggcgacgagatttacaacgccgctattgaggtcggcgacaagatcaagagtggcgacattgtacctcctgcaaataaggagcagtacgaccagtacaccgccagtctgtagtggcatatatgagagcgtcacagctgagcacatgaggcgccctcaggttttccaaggggagggtgagagaaaaccctccctttttattcatggaggaggtgggcagtggaggtcagttctgactatgccgtacagatgcacggcatagtgaaaacatttggtacgtttagagcactagatggtgttgatctcgatgttcataaacagtctatccatgcaatcctcggtgaaaatggtgccggcaaatcgacgcttatgaatgtgttgtatggccttttaaatgccgatgaaggtgaagtgtatttaaacggtgagcgcgtcgatattcaaaatccgcaggatgctatcaagcacggtatcggtatggtgcaccagcactttatgctcgtagagaactttacagtcaccgaaaacattgtattgggagaagagatctgcagcactgccggtgtgttggatatggccggcgctcgcaaagaagtcgaacggattatcgacgagtacgggcttgaagttgatcctgacgcaaagattgaagacatcagcgtcggtatgcaacagcgtgttgaaatcttgaaggcgctctatcgtggctgcgatacgctgattctggatgagccaacctcagtgttgacgcctcaggaaatcattcagctcatcaagattatgagagagcttgttgaaaagggcaagacgatcattatcatcacgcacaagctgaaagagatcatggaatctgcagataagtgcaccattattcgccgtggtaagtacatgggcactgtcgatgtttccaagagctcagaagaagagctcgcttcaaagatggtcggtcgtcacgtcgacttgtcagtcgataagactcctgcaaagccgggaaaagttgtcctctctgttaaagacttacacgtaaaggacgcccgtggtatcgagcaagtctgtgggctcaacctcgatgtgcatgcaggtgagattgtgggtcttgccggtatcgacggcaatggtcagaatgagtttatagaggcactctgtggtcttacaaagagtgagtcaggaactgtcaccgtcaacgatgaggagatccagaataagactccgcgtgagatcatcgatcacaaggtctctacgatccctgctgaccgccagcgttttggcttagtcttgccctttacggtggcagaaaatacggtcctcgagcgccacaacgagaataagtttggtgcaggtattacccttgattacacgagagtgcgtgagtttgcaaactccttgatcaaagagtttgatatacgtcctgaggactgtacggatcacccagtggggggcctttctggtggcaaccagcagaaggttatcattgctcgtcaggtgtccagcgaccccgatctgctgatcgctgtacagccgacgcgtggtctggatgtcggtgctatcgagtttgtacacaataccttgatccgtgagcgcgataaggggatggccattcttttgatctctctggaactggatgaggtcatggatgtcgcagataccatcgacgttattcaccgcggtcaaatcgtcggttccttcaagcaacatacggtgagcggagagaaagttggtcttttgatggcaggaggtggcaagcatgaatagtacagtcgctaagattctcaagaagccgattacctccgcaatcctcgctattgttatcggttttgctgtcgcggctatcatcctgttgttagcaggctacgatcctggtggatcctttgcagccctgtttgcaggtgcgctatccaagccaaagtatatttcgaacgttatcatcaaagcgaccccgctgcttttgtgtggtatctctgtcgcctttgcatttagagttggtctgttcaatatcggtgctgagggccaatacattgtcggtacaatcgcagcaactatcgtcggtattctggttgatctgccagctcctttagagatcccgctcgtgatctgtgtaggcacccttgctggtgcaggcctcggcgccctgatcgggtggctgaaggcaaagttcgggatccacgaggttatcacctcaatcatgttcaactggattgcactgtacctgtgcaactatgtggtatctctcgatatctttcaccagccgaattccacgggatcctatccaatccacgaaagtggctttacgatgatcctgccgaattggaagacctccgatgagggtatggcggcactgtccaacatcccttggttgcgcgaggtgatggtgaaaaccgacgttaatatcggtatcattgttgcaatcgctgctgctatctttatcaattggcttctcaagcgtaccaagaggggctatgagatgcgggcggtcggtctgaatgctgacgcttcccgcttctccggcatcaatgttcagaagaacttagttctgtgcatgctgatctccggtgccctgagtggtcttgccggtgtactcaatatcaccggtatttctcctcacggaatcgcgacgatcgcagcctttgaaaactatggcttcaacggtttgtcggttgccttcatcgccggatgctctccgcttggctgtatccctgcatcccttctgttcgctggtctcatctacggtggtcagaccttacagcaggtcatgggtaccccctctgagatcatcaacattatgatcggcaccatcgtgttctgcatggcattgggtaacgttatccctatgctgatcaatcgttctgaacataagcgtgccacaaaaatgcttgctcaagaaagtgtgagagggggagacacccatgttagctaatctgcttttgtgcctctcaattaccctcatgtactcgacaccgcttctctttggtgctctgggtggtgtgttatctgaacgctccggtgttaccaacatcggtatcgagggcatgatgaacattggcgctatggccggtgtagcaggcagctttatcacgggaaacccctggatgggttttctgtgggctggtatcgccggtggacttgtagccgtgttgcacgcaatcgcttcagtgcgctttgcaggcgatcagacgatctccggtgtagcgatcaacctgattgctccgggcctggcactcttctggtgccgtcgactctttgacggagctgcaatgtccaaaccgattacgaccttaccgaaagtcttcgataccacgcagtttggtgattcagcgctcgcgagtctcgatatcgatatcaccgttatcttagggttgatcgccaccctcgtcctgtggttcgtgctgtatcgcaccaagctcggtctgcacatccgtgcagtcggtgagcacccagaggcggctgagacgctcggtatcaacgtatttcacatccgctacagttgcgttattgcctccggtgttttagctggattgggaggtgcttctgtcaccctcgcaatcatctctcagtacacacagaccgcaatcagtggccagggcttcatagctcttgctgctgtgatctttggcaaatggaccccgcagggtgcctacggcgcgtgcttgctctttggcttcacccaggcgctcgcaattatgcttgggggtggcaattccatcgtaccgagccagatcctggcaatgcttccgtacattatgaccatcattgtcctggtgctctttgtgggacgctctgttgcccctaaggcagacggcgtgccgtatgtagaaagcaaataagtagagttaggaggcatggggtatgagcgtttcagatgaagagcttgtgcatctggcaattgaagctcgtgaccatgcatatgttccgtattctcacttctcggtcggggctgcacttcttacgagtggtggcactgtgtatcaggggtgcaacatagagaatgcagcctacactccttcgaactgtgcagagcgcactgcctttttcaaagcggtgtatgagggagagcggagcttttccgcgatcgccgttgtcggaggggctgaaggacaggctatctctgattggtgtgctccctgcggtgtgtgccggcaggtgatgcgtgagttttgtgatccggatcacttctgtattattcttgctcgctcagagcatgagtatcgctccacgttattgcgtgagattttaccggagagttttgggccagatactttggagcgtgcggagactactaccacgcactcaggtgaagaaggttaatgcgaatgaggatgtatgacattatcgagtccaaacgtgatgggcatgagctgagtgatgctcagatagatttttttgtccagggctacactgagggctctattccggactaccaagtctcggcactgtgcatggcaattttctatgaggggatgagcgagcatgagactgctcgccttacccttgatatggcgcgctcaggggatatagttgatctttccgtgattccgggggtcaaggtcgataaacattccaccggaggcgtaggagacaagaccaccttgatcgtcgctccgactgtcgcctcacttggagtacacgtcgcaaagataagcggaagaggactgggccacacaggtggcaccctcgataagctggaatctattccaggactcaccacttcgatgtcgcgtgagcagttcttcgatatcgtacgcacggtgggatgtgccgtcgtcggacagaccgataacttagtgcctgctgacaaaaagctgtatgccttgcgtgatgtgactgccactgtcgattcactgcccctgatcgcttcgagcatcatgagcaagaaaatcgcagcgggctccgataagattttgctggatgttaagtgtggcagcggtgcgttcatgaagacgactgacgacgcaattgctctggcacgtgagatggtcgcaatcggtgagcacgtgggtcgtaccactacagctctgattaccgatatggatcaacccttgggccagtgtgtgggtaatgcccttgaggtacaagaagctgcatgcacgctccaggggaacggtcccgatgatctcgttgctgtatgtattgaacttgcggctaatatgctcgagcttgctggaaaaggtagtgtcgaggagtgtcgagcgatggtgaaagaacagctgagcaatggagaagcacttcagaagtttgcacagatggttaaagcccaaggaggtgatgagcactacgtgctcgagccagagcgctttggacatgacacctgtagcgttgagctcaaagcttcatgtgatggctggattcaccatatgaataccgaacaggtggggctagcctctaccgcacttggagccggacgtgctaccaaagacgaccttatcgatcctctagcaggtatcgtacttgcaaagaagacgggcgagaaagtacagaaaggcgaggtcttggcaaccctgtacgctcagaatggggccaaacttactgaaggtaaaaacgagctcagtggcgcctatacgattggcagtgaaaaaccggtccatgagcctttgatctacgctcgcgtcacacgcagtggtgttgaaaaactcgtttaaactgtaaccaatacgcgttgagtcatcgcattggtgtgagccttccatcctttgtatgcaagaggaggatgtattttttgactcttcgctacttatgatgggtagcacttttgcattcccttaagtacgtggtgcccggacagcagggttttggtgacggaaggctttggtcctaaggcgcgatatggatgcttacggcaggtatgctggcaagacgcttcaagaggccccatagggcttagggacgaatgggaggtctaagccccatcaatataagggacagaggggtcccagatctctatgcagcctgcgtggccgccggatcggatggaggggccctctcgaagtgctcgaagagctcctgtatggccttcttgtagacacgcacctacctatggagtcgtgcggacaaaagcggttgtagttacgactcgattgagcccgatggcccttgtgctttgtggtgggatgcaggcgcttgtggtggtaccactcgcccttgagtgtttcgagaagcgattctgcttgcgcactatcgtggaagtccccggtgtgcctcacgtcgtgcaaggccgcctgggaggcaagcttaaacgcttatgtattggctatcctgctcgctgtgggatatggcccttttggcgatatatcccacacacgcgaataggccatcttttaagggcggcagattgccaagctgagtgcaacatctccctaaagacctcgttggctatcctgtatttcaggaccttcctcgccctgtcgcagatcagctccaccgcatgctgcacctcctcgtttgtgacctttctgaagtcgctgcccttaggggaagaacttgcgcaggagcccgttggtgttcttaactgttggcttttgccatagatggtgggggtcgcagaagtagaactgcacgcctcaaagggcatctgtgacatctgtatgccctgcgaactgcttgcccctatccggaagtgagcgtcttaaggggacgtccctgcagcagcccgacctcggccttagagacactcccgctgtcgtggtggcatctctttgcgagaagcagcctcactgccctgtcggcaagcacgagcaggcacacgggtcccgctgccacgagcgtgtcgtctacccactctccgagacgagacctcgcatcggccttttgggcctctcctttacggtatgtaagatctcgatcttgcctttggtcttaggcctcttgttgcgcaggtggcgccgcacctggccttgcgggcaggcttccggcagctcgagggcggcggctaaggacctcacggtagaatagtcggcaggctcaacggtgcacctgacaccaccctcgagcctgagatgtcgtctatctcctccagggaccagtgtctgtccatgatgagtaagcgcaccttctgtgcaagcgcagggtctgaaagccgccttttcgccctgcatctcctgcggcgctcatccaccctccttttgggcagcacatgccctaaagcgcccgtggcggccgttcctcttgagcttgtggcagatgctggagctgtccctgccgatctctgccgcgatatagccgattggccttcccttgtgccacacagtacggctatacagtcccctctcctgtaggctaagatgtttgtagtggcacattccttctagggaaacgatgattaattcccaataatgtgccaaagaggatcagccacgtggccttacgcagccggcatgggcattaatcatcgtttccctagctttcgacgttgattgagacaaccaacatcgtagccttccggagtgtgccacacctgcattcagcgggccatcctgttgcactcagaatgctaatctgtcgtctgaaagcattcgatactcagctctcaaatgcaacaactaaaagataggagtttacatgacaaacgaagagcttgcttcctatattgaccataccgacctcaagcagaatgctactcaggcagatctcgcaaagctttgtgacgaagcggcacagtatcactttgctaccgtatcgatcaattcctgctggactaaatttgcggcagagcaccttgctggtactgatgtaggagtaaccacttgtattggttttcctctcggtgcctgcagtacacaggcaaaggttgctgaggcaacacaagcaatcgccgatggtacccgtgaagttgacatggttatcaacgtgggtaagctcctcgacgacgatgatgaatacgtgaagcacgatatcgcttccgtcgttaatgcagtacaaggacacacgcttaaggtgatactagagtgctgcttacttactgacgagcagaaagtacatgcctgcaaactttgcgtagaagctggcgcatcctttgtaaagacaagcactggttttagcaccggtggcgctacagttcacgatgttgagcttatgcgtaagacagtaggggatgcttgcaagattaaggcagcaggtggaatccatacccgtgaagaagctttagccatgattaaagctggtgctgatcgactgggttgctctgctagtgtagcggttgtaaatggctagaacgagcctcaaagataacctgagtgtaagaaagagggttgacattcccgtaaactgaagtttatgggattgcagtgtgacccatgtcttaatcggcatggatccgctgtggtgttgccaaaacacctctacacagttgccggtctgccggtttctgcttatgtgtgatgttcgcgttcaccaagacaccatccttggttcggtacagtccgcgtttgatgctcttaccggagaaaccatgcgtcgtcttgtcgtcaggcttgtatcggtggctgtgtccccatccaagtaggatgctttggaagtgtaggcctcctcctgcttccatgtatcggatggtatgcttccagcacaggtagctgagttggcgtttgagtatcccgtaggggatttgcacgaacatctgattgttccttctgtcgtgattgactccttggtttcatcccatgttggagccgacgatcagcgtggctgtgttttcccgtatacacaggctgatgatggtgcgcgcagctttgagcatacagtcatgtatgcgccagctccgtttgtcgctcaacgtttggattcggcggctggttttcaaagcgttcccatccttgtccagtcggcttttcaggtatgccaaccgcttgttgtagtactggttgattgacttgagtcgggggtggcgcatgcggcgagattatcgacttccaagtccactcccgcgacacggtttacatccaaatcgagggggctgttgccgtgtttcgaaggcgtattggattttgaagcagctgctatcccgttcgggaaggatgcggatgtccttgatatgatgcccgttcaaacgattgggcacaaggatacgtatgtttgacatgtccggatgggcttgcataaatcgtctgctcacggacagtttgaacagtccgttcgtgatgttgattgcgttcgtggagagtatcagtgggaacatgccccctttttgtccggtaatgtgggattaccacttgagaatacctgtagtctgcgttcttgcattttcccaataatgcaagggaaggctctcaggctaggggcgacaactttcatcgtgtgcttggccacttcggcttgcagcatcttgtagatgtcgttggttttgcacagatgatagttggtttcgtatgtgaggatcctgccttcgttgaaggcaggctgtcttgtctgatacagggccttgctgtagaggttgtttgagtactggcagaggagcttcagagcgcggtagtggttggcgctgagatggcggatgtaattggtttgcgtcgcgtactgcattttttgtttcgcctccctcctattcatgtcttgttatatgtaatacataagcaatatccgataggtggtgagatcaacatgaacaatcgctatgaacatgggaaccattcgaaatacctgttacgctaccacttcatccttgccactaaataccgaaggaaaacactcaccgactcaacgatgatcacggacgtcaaacagctttcaaccgagatcgtcacacggggccacgtctcaatcccatacgtggagaccgacaaaaaccacattcattacatgatctaaactccaccaaccatccgtctaagcgacttcgtgcgcactttgaaagcgttcaccacattccacatatgggaaacccacgcatcatatctacgtcacatctactggcatgagcacacattctggtcggatggatattccatcgccaccacaggcgaagtcagcgccgaaaccctcaaacactaatattgaaaaacaaggcaaacgcgattggacggcgtttcatcccgcgaactaaagttcacgggttttcacaccaccgattcctataaagcacttctatgaaaactccagtgcctcttccaatgaatgataagaatgccaccatgatctgttcacaggtcatggtggcagaattgagggaatacatattttggattgattcttgaagttagcgcaatatctagcagctagaaagtgtattcgcactcagcgcaagacttctcgacaacagatctttgatggaaacagtcggttctcagtatttgcgcaggaacctatcgtccttttcggtgttgcgataagtcttgaaaccaactcatctaacccgttgtagcgaggatccacattcagcgcaatggggcgaatctgtacaactctgtggtcttgacttaggctctagcctaaggcatcaccccttttctgacgacagagtgtgatggcctctggtttgtggagaaggtcactgcaggcgatcttctgtgtgtgcgtcgcctgaagcattttgtctgccacatcccccaagccagaatctctcagctggtctcttatagcaacgcgatgggtggagccctgagctgacctcaaagcacattggctgtatgtcttcaggtgctaatgtgtcgaagctaacagagcctttgggcaagatctttcctatcttctcgtggttcttctcacagacccctttctcttgactttgtctagggttgcagcagtagagcctgatcgcttgagcctctccttcgaaaaggtgtcctggcacctcttcatctgagaactcggctctccgacagactcaaagagcgcctcaagtgttcgcttggtgttgtcgcagtctttgtgtcccatcaaagacatgagctgaaacttcgatagtctgtacaaaggtgtaaggatacattcactgtcagatattcactgtcagattgaaggccttctgctgtatttatctcccaggcaccaacacaggctctcctaaggacagaaacgactataagcgctcggacgggtggttatacggggcacacaaggcgtgttgttaggacctatagcccacagactgccttaaagtccatggcagacataatagctataccgtctgtggacccagcgatagatagtgaagacagctactggaacaggagaggtagttgctatctgcttaggggaaagcccgcaggcgagcttatcttgtatgtgggcaactgtgtgcgctgtatcctcttcgctcatatcgatgccacatttcatctgcaagcatttgtgcgtatttcaccatataggctacacggatgtggtagtggcatgcctctgttgtgtatctcatgcgcccgaagcagcactgcggtggctgccacaagcgtctctttgacagtctctgtcttttgttggctctctgggctctcccttaggcgctatgtagaccacgtggtgtctaacctctctctccgctgtagagggtactctatcaaagtcttttgcgatggaacagatagagtgtttttgaatctagcccatgctcaatggatcttcttcttttcgcaaggctcaatctgtcgtatcgcttgtgcttttcgtgcttgtaagccataaggtctcaaccgtgtctttatagctacagctgtgaaggtaccttagttggcgcaagactcagcgcaatatagtgcgatgagtcagaatagccgggctctatggtagtgcacgggggacagaaatctaccgctttttcttccctacacgggcaggaagaactaccgcacacagaataatgcctaccgttcagttgatacatttcttatagtctggttagcaaacagaaagttagtaagaaacacttatagtttgtttgttatacggtcagaggttgtacgcagacggcctcatacataaggagagaggatccgcatgagcaataagaatgcgcagatggaagcgatggacgaagatactcgccaattgttcttgtacgaaggaaagccatctgccaggctctatgttcctatggcaatacagcacgttattgccgcaattgtcggtattattactccggctatgatcgtcggctctgcatgcaatctgccgcccgatgagcgtgcgttgatgattcaatccgcaatgctgttctctggcatcgtaacccttctgcaggcacgcccgctgttcagcgtgatcggctcaggtctccctgttatcacgggcgcctcattcgcgttcgtccctgttctgaacagcatcggtggcacctctggcatcgccgcgatcatcggagcccaattcatcggtggcttcatcgcgatgctctttgcgatgttcttgaagcagatcaagaaactcttcccacccgtcgtaactggcacggtcgtcttctgcatcggcctttctctatattctgttgcagttggatatatggccggtggcactggcgctcctgacttcggcagcgcccagaactggattatcgctctgatcactatggctgcctgcatcttctttgccaacttcaccaagggtgtcaccaagcttggttccatcctgttcggcatgatcgttggctacatcattgctctcttcgcgggcaaggttgatttctccggcgttggccccgctaattggttctcactcccgcagttcctgccctttggtatcgagttccaaccggatgcaatcgtctctttgggcgcgatgttcatcatcgctgctgtcgagatgatcggtgacttctccgctgtgacgaacggcgctatggaccgtgagccgaagctgaaagagatccgtggcggcattctctgcgagggcatcgcttctacggttggcgctcttttcggtggccttccgaccgcaaccttcgcacagaatgtcggcattgcaaccaccaccaaggttgttaaccgtcgtgtctttaccaccgctgcacttatccttgtcatcgcaggcctcgttcctaagttcgccgctgtcctcgatacgatcccgatgtgcgttatcggcggcgcaacgatctccgtcttcggctccatcacgatgaccggtattcgcatcttgaccaagggtggccttaccaaccgtcgtgctaccatcgccggccttgcagttgctttgggtatgggcatctccactgtctctggttcccttgcaggccctggcatcccgaactggatcaccagcatcttcggtggctccgcagttgttgtgaccgcgctcgtcgctatcatcctgaacctggttctccctgatccgaatggtgagaagaagcaggatgaggaggaagaggaagaagagctaggcgaggctcctgcgagcaagtaattcttctgaaatcgggaagtatagatatgagatgcagttcacctgtgagctgcatcttttttagttgttgtttaaacatggggacactagtttgtcgagatgatgaccatttctgcgctatactaaggccttgaaaaaaggataaaggctttatctagtgttggatggagtcgtactatgtatcagcgtgcatctctgtttgggcggagacgttaaagtatttttattcccaaaactttaattataaatcaaaatttaccaaataaatgaggaaacttaccgttcaacgaaaaaaatcacctgttttgattctgtaacctatgatggaaattagccggcttgttttattcaaactcttcttacaggggatggtggcttagtttaagcgcctgggtctctgtacggttttgagaaggatgattatagatggggtacaagctaaaggatagctacggtctgtatatcgacggtaagttcgttcccgcttcagacggttctatgttcgtaacgaccaacccagcaaatggtgagaagctcgctacttgcgctgaggctacgaaagacgatgttcagaaggccgttgacgctgcttggagagcctatccaaaatggaaggcaatggatccaactgcgcgtgtcaacatcttgaaccagatcgctgacattatcgaggaaaacaaagaagacttggccaagatcgagaccatggacaacggcaagcctatccgtgagaccatgaacatcgatatccctgttggcgaatcgcacttccgttactatgcaagcctgatcgagacggagacaggccaggcgaaaatcttggataacggcatcattagccttgtcctccgtgagccgatcggtgtcgtgggccagatcgttccttggaatttcccgttcctgatggcaatgtggaagatcgccccggcactggcagcaggcgactgcatcgttatgaagccttcttcgagcaccccgctctccgtccttgtcctggcggatctgctcaccgacgtgctcccgaagggcgtcttcaacgttattaccggcagaggctccaagtccggtcagtacatgctggacaacccgggctttacgaaactcgcgttcaccggctccaccgcaatcggccacaacgtggcagacgctgccgcatcccacctcattccggcaaccctggagctcggcggcaagtccgcaaacatcttcttcgatgattgcgactttgacatggcaatcgatggtgtccaggtgggcatcctcttcaaccagggccaggtttgctgcgcaggctcccgtgtcttcatccaggaaggcatctacgacaagatggttggtgcccttgttgaccagttcaacaaggtaaccatcggcgatcctatggatccgaacacccagctcggcgcacagatcaaccagaagcagcaggataaggtcatgggctggattgagaacgctaagaagcagggcgcaacgattgcctgcggcggtgagccttacagtgagggcgactgcgcaaagggtatcttcttcaaaccgacgctgatcaccgacgcaaccaacgatatggactgcgctcagaacgagatctttgggcctgtcgctgtcgtgatcaagtttaaggacggggacgacgttatccgtatggctaatgactccaagtacggcttgggtggcgctgtctggacgaaggatatcaaccgtgcgctgagagttgcacgtgctgttgagaccggccgtatgtgggtcaacacctacaacgcgattcctgtcggtgcaccgttcggtggctacaaggagtccggctatggccgtgagaacgatatgcgtatcctggatgcttactctgagaccaagaacatcatgattaacacgaatgagaatgtgagcgggttctatcctcacaaatagtcgataggtgacataagggcttacggtaagcaggagcagggggagtttccccctgctcctgtttcgccataaatcatcctttgcagaatgtgcagcttggcgccctataatcggaccaaccacatatcgacctgcgagaatggcggggcgggcggcgctcttgcgatgtggtagtcctaggcgccgcctcccacccggccagctaggactaccaccacaagcggagagaagcggcgctatgccgagacggcagtcatgctgagccacaggagcatgtacaagtaccagcattcgtcgctctttgccaagcaagaggtcgccttcttcagcgtctatacgcagggaccgctgccccttctgcggctccatgcacagcgatgcggcaggacggtaacggagtccgcagatggtgctgccacggctgcggcaggacgttcacgcccatggacggtaccatattccagggacataggctgccctgtgtccgaatggtgcgaattcctgctccagaccttctcgttcgagagcatgaacggcctgatgagagaggagtgcagaccaaagaccacgctgccctactggatcgccaagctgttctgagtcctggacgggatccagaatggcgtcgtgctgtccgtcgacgtgcagatcgacgagaagtactacccgtgggcccgctccgacgaggagcaggaagcgcggcctctcaaggaataagctctgcgtggctgcgacagggagggcaggtcggccttcgtgtcgtgcggcaggggaaagacgcgcagggccaggacctgggaggcatacggaagccagctctcccatgacaaggagaggtcgtactcggtgttggtcgagaggctgtcttgggagagcgtcgagtacgacgcaagggagatatcgcacatgcccgacaggggcaatttgctgaggagcgtcaaccgcctgtgcttcctgctggagaccttcctcaactcccattccggattcgacaggcacgacctccctggctggttcgagctgttccatgtcatgatggatggccctgcggacaagatagagaaggccgcgatggtgctgggatgcgcattgcgcgtcccaaagacgctgtcagacagggagttctacggcataaagcccagctcggagggctagtgattcagaagcatctgcacattgcgcaaaggatgatttttgccgaatatcccttatccatcagttcaggaagccttgtgggtgccagcttcgcgatagcattgccacttgataggggttcgagtcatatgaggaatcgggtctaaattatccaccgcagtcccctgttaaacatctcgtttttctgctcatattgctaggtatcatgagagtgcgactcgtatcttactgcgtgcagtatgctgaatatgctccagtttcgtctgccatcaggcagcttaggagcatagtctatgctcaacaggaagaataggccacactagaagctctctataatccggaggacaatatatatgggcgacagggtgaagaaactatccattatcattcccgtctacaacgcggagaagtggctgccatcgtgcgtcgacagtatcattgctgcaacggatgacaccgcagagatcctcctggtcaatgatggaagcaaggatggctcgaagaagctcattgagagctatcaggatcgctatcccaatcgtgtcattgccatctccaagccgaacagcggatctggagagacgcgtaatctgggccttgcgaaagctacaggcaagtatgtcacgttcatcgatagcgacgactatgtagaccgtgactacttcgagaagtttgtcgatgctatcgagcgtacaggtgccgacgtggttgttggcggctacaagcgtatcgtggacggcaaggagcagttcgaagtcgttccgaaggacgtgccgtgggcacgataccaaatccttgctccctgggccaagatcttcaatcttgatttcatccgcaggaacaacctcaagtttgttccactcgtgctcggtgacgacgaccactttgtgacagttgcctattcctatgcaaacaaggttgcggttctttcgtatgctggctacaacttcatttgcaatagggagagcatcacgaatacgaagcacaagggactgcgcagggacatcgagcttaccgagctgcttgacaggatcgacgctgatgttaataagcgcgatgagctgctgaacctgcactatctgaagttgggcgtctactacatgctccgctcgggtcgtctggcaacgaaagagcgttttatggaagagcatgtgaagcttatggattggtatcgagagcacaatgtgcccctgaacttccctgtaaccagtatcaccacatccgaccctttgcaggttcgtcttgctgtcaagatctatctcatgctggcaaaggcccatctcatcggtgtctttgcaagcgtctactgcaagggtgttgtgaaagagtaggtcctatcggctcggatctgtatgtgatgccgctctccagacctaagcaatctggagggcggcatactttgtgcagtttttaagctgcaagcttcttattgtgggaaaggcggaagagcgacaagacagcgcctgcgagtgacgcgatgatcacgacatagttgatgccctgcatgtcaaaggtagcttccagtggaatcatggtcgcaagtgtgatggcgagagccgctgcggcgctgatgagcgcacccttgatgtcgcggcagatgacaaggacatcagtgaggtagtaaaggacagcaagcgcgctcgtgctgatgaggacattcgtgaagaggtaggtatagccttcgactttctgtccgtacacgagattcagaagtattggtccagcccatgcaaggactgcgacgcccacgacgatgaaagtgagcatgatgaggagcgtcttcttgaagaaggggaggaaggactccttgggagagtcattccatttctccgaaagaggcacgagtgccggtgcatagaggtagcgggcagcggcctgtatgaggacggcaggagtggccacggcggcatagatgccaagacgctcgctgccataggcattggcgtagtactgtcgggcaacagagacgatcatgccaaggaagagaatctccaagacgatggggaggcattcgacaagcagatttttcgcctgctcagccttgatgctgggacggatgtcgtcgatgcggtgtgcgtgcggaatgtcgtaggagattgtcacgatgagtcctgcggggaacatggcaaggatcgcaaggacgatgttctgcgagaggtagagaccgagcgagaaagcaaggacggcaaggacgccacggatgaactgggagatgccgatatagtccatgcgctcgccacgctggtcaacgccgtagagcacatcgcagaacgattcgtcgatcttgaagagcagataggcaaagacagcgatgagggtgaggctgtctggagagacggccacagaatagatgccgataacgatgagaccgatgagcagagtgatgagcctgaaggcaacgtagttcctctgggagtacttgcccttgatatccgacacctggtacgtcctcatgctgtaggtgcctactgccgtgaacatgttgcctatggtcatcgcaaatgataggatgccggaatcgctgtagccatccgacaggatgaccacgaggacggtagtgatccatagacagccttgataggtcaggctgcctatggtgttgtagagcatattctttttgatatcgagaggctctggctggttttccactaagggctcctaacggtagcgtgctaccacttgatatcgatgccgaaatggttgatgacggcgctgtaaaccgagaggaaggctggtaggagtcccagcttgtagaacctggagaccgtcagtagcctcttgaaggtcttgccgtgtgtccttgcatactgtccattgatgtagggagaatcatgccaggtggggaagttcttgttcaggaactctgtgcacatctggatagttgccttgaggtcgcagtcgggagaggcggcgaggcggtagttgaatgagatgccgaggtgcaggaaggcggcagcgtcgagtgcctcctgcttgcccttcgaagcatcgtgcgcggcgtagcgctccttgacctccttgaaagcctcgtaggtcggctcgatctgctggggtttcacggtctggatgatggagtcggagcggaccatgtagttgacgagagattccggtacaaagacgacttcgccattcatctcgaggtaggcaagccagtggaagaggaggtcatcgagtacaggtggctccgttggcagatctacgagggacttaatcacgcttgcacggaagatcttgttccagggagcgccattgagctcgaggagacgtcccggatccttgctgattgtgaaggggctgcgctggtcgcacatctcgcgggagaggaccttgccagttgcaagatcggtcctcgagaagccgcagacagcgatatctgcatctgcagcctttgccgtatcatagaggtcctgcaggaagttcggctctgcatagtcatcgctatcgaggaagccgatgtactcgcccctggcctttgcgatgccgtcccagcggccgcgccagacaccttcattcttcttgtcgataatgacgatacggtcaggatagcgggactgccactcttgcagaatatcgatgcagtggtcgggagagccatcgttgatgaagatgagttcatagctgtcgagcgtctgtcccacgagcgaagcgatacatttcggcagatacttctccaccttgtagcaggggatgatgacgctgacttttgggcttcgattaggcatgacaattactccttaacagcgaagatagggatcgaaagatagcaacaatatagtatcgggacgctctgggaaaagaaacgcaggagtgaaacaactatagaagacatgctgttggcagggatgcagactgcttggcgcagagctctccgatggccctacggatgcttggctgcttgaatgtcacattcagagcatatgcttcgccgttcgatataatatccgtaattatcagtcctgcatttcagacaataagaagccagctgcttcgattggaacaagaagatgtatataggttttctgcttgcgatagtatttctgttcttgcctggctttgctctcgtaagggcatttagtatccgagtgcctctgcctctctccgtttctatggctcctgtggtaagtgcagcatattacggtgtgcttggcattctatattcatacatcggtataacatcttctccgcttaccatgctggttcctgctgctgcattgctgattatcgaactcattctgcatatcagaaagggcaggtgccatatcctgtcggattggggtactgttggagcgatagcgctgtatgcagcggtcggcacatgcataggctggtatgtattcgttcgctccttgccgagctatagtgggatggtcgaacagtatgatgctatcttccatgccaatcttgtccaaagatttattgcaactggtgatttctcctgtatgggaatagatacaggaacattagattcctctttctatggaagcagtactactggtttctatcctgtcgcgtggcatgaagtcgtggctctggtaacaatgtctggcaacatatcgtctactatggccatgaatgcagtcaactgggcttactgcagtgttgtgtttcctgttggcatacttggcctgttcatggtgcttttcaaagacgacagacagacaatcctcatcggctcgatagtgccggtggcattcactgcctttccttggagagacttactttggggaccgatattcccaaacctggcatctttctgcagcgccccagctgtggcccttgctttcttggtactcttctcacccatggccgaggtaaaagacagagggaaacttcttgctgcggggattatgggaattatagggcttggaatgctgcagccgaacgctgtatttgcagtggcagtcttcgtagtcttctacattatgcatgtcatgaacagcccagagggctatcgctgtctgccacagcattctaaggatagacaatattctgcttccggccgccgtctgcagtctctgctgcttcttgtcgcatgcattgctgtatggacgttgctgtatagaagctcctttatgcagggggttgtatcctactccgcttgggtttcctatacaacagcagctcagtccttcatcaatatccttgcccaagcatacatgaaaggaatgaactattacacgtttcctcagctatgtctggcggcaattgtgctgctcggcattgctgctgcgctccttcgcagagagacccgatggcttatcgtgccatatggtttcttctgtatcgcgttcataatcaatgtatcaacggatggtttcctcaaacggtacctcacgggcttctggtattccgatccgaatcggattgcagccatctgtgcaatcatggcaatgccgcttgcggcaattgggctttctgttatttgcacgtgggtgcatgcggttatcgccaggcattccgacctgccagagaagcttcatggtcccttgcccgctcttctgacagctgcggtctttctgcttatgaatttctatccaaactatattgatccggagaacagcgctgcggtgaccacagctttcgacgaaattcgcagtcagtatgcaaccgcatatgcaaagacagctccatattccgaagctgaggaagctttcgtccaggaatgtctgagcatccttcctccggatgccctcgtcataaatgatccgagcgatggaagcgttgctgcctatggatttgatgggctgaacgttgtttacaatcagattgagacaggactgagagcatccgactcagaagattcccctgagagccaacttattcgtacgtctctggtcaatataggtagtgatgctgcagtgcagaaggcagttgctgataccggcgccagatatgtcattctgctttctaaagatgatggtaacacatcggtgacagagcattttgtctctgagcagtggagcggcatctctggaataggcgatgaaaccccagggttcaagctgctgctggcggatggggatatgcgcctgtatgagatagaggaataaggccatatctggaaaagactcatctggcagtccgttcagcattgattttcggcaactagttgtatgcatcaatcctggagatattgaactagtggccgcttgtgacatagaatacgctgagattgggttttcgcggtctctagcgggtagcgcatgcaagctgactctgggccgtgaagttgagtttcccagtctgaggaagatcatcgtcctgaagtagaccgtgttcctgaagcccctggcagcgctttccgctgactggatgagggagttgagcccttcgagaaacgaattggtggagtccttcctctgccagttgaggattccctcctgttccttcctgagggtcttggctaccctcttcatctcgactgagctgtaatcttctggtagacaactggacgcaagtatcctttgcccagatgcccacccaacaccacctgtagatttaagccatgagatgtcagtgagtgcaaataaggcagaagaaggcaaagtccaagtcgaagcttcccgggcagtatatagatgagtagcgcttaaaggctaccagtgctgcggcaaagccaggcagacctaaagaaaagcatcagggcgtacaccaagaagcttgaggtcagcgataagaccttagacgagtgggtcatcaaatacgaaaagatcagggaagtccacctaggccagggccgaagagcaaaagaagccagatgaggcgttaagacgcatcagggagtttgcaggcggcaaggatctgtgtggggcctctcataaaggccatcttaggcgatatagggcgagggtgaagaggcgctttagcttttgtaaggtatgcttccaagctcgtaggggatctaaggcagagcgactctagtgctacaaccctctatagtatgtacagatacatatttgagctttaaaggataggtggtatctgccacagagcttccaagaggtgccggctttggacagggatgtccctgcacgccctaaccttgtcaggtcacaagcctttgttgcgaccataaagcctacaggcgacatagctatctttaaggaccacaaaaaggctttatctagcttagcgtcgcaatcgtgctgtgagcaccttatagccctcggctaaagcatacagggacacctttaagcaagccttatcatcttttcccttaaaagatggcctattcgcgtgtgtgggatatatcgcctgtggggtcatatcccacagcgagcaggacagccaatacataagcgtttaagcttgcctcccaggcggccttgcacgacgtgaggcgcaccgggaactgccacgacagtgcgcaagcagaatcgcttctcaaaacactcaagggcaagtagtaccaccacaagcgcctgcatcccaccacaaagcacaagggccatcgggctcaatcgagtcgtaactacaaccgtatttgtctgcacgactccataggtaggtgcgtgtctacaagaaggccatacaggagctcttcgagcacttcgagagggcccctccatccgatccggcggccacgcaggctgcatagagatctgagatcttcttgtcctttatattgatggggcccacctttcggggaggcgggcacaggatcttctggatcgacggtgcggctggatgttatctgaggaacccggctgctgtgtcaaagccaagccgagtccgtgcatgagaatccatgccggagcagcgcagagcgacccgctccgacaacaaagcggactctctgaaggtacctcaggatctccggtggagctttctggctatcccgcgcagggcgatgagcagaagcagaagcgctatacccagaaggacgatggtgccgcctggcttgagaccgaaggcataggagacagtgaggcccaaagctgtgatgaggagtccaacggcgcatgaagcaatgaccgtctggcgccagcctcgggcgaactggagggcgcaggctacagggacgaccatcatggacgagacgatgagggcgccgaccgtccgcgcaccgacagagaccgcaaacgccgtcatgaggacgaatatcgcattgacaagcctcacattgacgcccgagacgcgtgctgcccgctcgtcgagggtgacaaggaagagctctttcctcagcaggatgcagagtactaagacgccagtacctacggcagcgacagcggcaagttcatcgtcgctgacagcgacgatcgatccgaacaggaagctcgagaagcttgcagcgttgggcacgaagcccgagaggacgcctgcaagtccgatgccgcaggacatgacaacggcaatcgcaagctctgcgtggccttcaaaacggcggcgcgccgcttccactgctccagcagcgcccaggcaggcaattgtcgctccaaggaccgggtcgattccgccgatgagtccagctgcgacgccagccaacgaagcatgcgagagggcatctcccatcatggagagacgcttgaagaccaccacgacgccgacgcagggaattgcaacgcctatgatgatgccggcaaggaaggcacgctgcatgaaagcatattcgaacatctgaagctagcctttcctgaggtcgaaaagcttgccgtcgcgcagctcgacgatacggctatagagatggggcagacgcgcaaggtcatgtgtcaccatcagcgctgcggtgcccgtctcctgggaggcctgggcaacggaaccaacaagcgtgcgggtgctctgctcgtcgaggctgctggtaggctcatcgagtatgagcagctccggtctgcagacaagtgcgcgtgcaagcagtgcgcgctggaactgtccgcccgaaagctcgcctgccagatgcttctcgaagcccctcagccctgcagactctattgcttgagctgcacgcttcctgtgcccggacctgtaggggagcagaggatgcgaagaggcatagagccctgacaggacaagttcccagactgtcacaggaaaccggcgtaggtcttcaggagcctgctgcggaacgtagccgatgcttccatcgaagtgcccgtgcgagggagtgcggcctagtactttcacagatccctcctgaggctcgagctcacccagcatgagtctcagcaaagttgacttcccggccccatttgccccttcgagcacgcagaagcagccaggctccaggaggaagtctgcacagtcgagaactttggttgtcccataggagaagctcaggccctcaagctccaccgcagccggagcagacgtcacgaaagggctttcacgagcttgccgaggttttccctcatgacagagaaataatccttgcctgctgcgagatcgtcatcgctcaggccttcgagaggattgagctcttcgcatgcagctccggtctcgtctgcgatggtctgcgcaaccttcgggcttactagctcttccgagaagatcgtcttcacattgttctgcttgacaaaatcggcaatcgtagccatggtcttcgcatcgggttcagagtcggcatcgattccctcgattgccagttggttcaggccataggcatcgcagaggtagccgaatgcctgatgggagacgacgatgttctttgaagtggtcttggcaagctggtctttgtactcctggtcgagcgcatcgagctctgaggcatacttctcgtagttttctcggtagacggattctccatcgggatctgccttgatgaggccgtcgcggatattggccatctctgtcttggcattcatgggagacagccatacatgggggtcgtactggctgctttcgtgctcctcctcgccctcttccccctcatgttcgtctttggctgcagcacgcagcgtgattcctttggatgcttcgacctggacgaggctgtcgttgccaatgctggacagggtgttatcgacccatttctccatgccagccccattgtatatgaagagcttggcggagctcagggtcttcatatcattggtcgagggctcccagtcatggggctcggtgccggctggcacgagattcatcacctggacacggtcgccgccaatcttttttgcgaagtctgccatggggtagaaagaggcgactacctgtaccttgctgtccgcattctcggcattcgccgtactttgcgtgctctggccggagcatccggcaaggcaggcgagtcctactgcagctgccaatacggctgtgagtatcttcttcacgatttcatcctccggaatcgtactgtttggatatgacatgctgatagtgcatacgggcatggctgcttgtcagccggcagcgaaagggcctggcattcttgcttcgaatctttccattgtccacagatgcactttgggacgctatacgctgtttgccttccggtagcagtcgggacacaggccatagaacacggtgcgccctgcatccaccgcaaagccatgctcgctgagcatatgctcctcgagtctggtcacctcatggcagttgatgtggatgagttttccgcattgctcgcatttgaggtgatagcagtggcccttgcagcattcgctggtatcgagcagctgaaagcaggcactcttctcgccttcgggggtgaaccgtacgaccagaccctcactgacaagcttgtcaagctgccgatatacggttgcgagcgagacagcagcccccagatctttaagccggctatgcagctcagaagcagtaaaatgtgcctgcgggcttgcgcctaggcattccagtatctccgttcttccgcgcgtgtcatatgtgctgcgcattggctgtcatcctccaatctgcgaatgcttcgcaatatactagtggacagagaagctgtgtcaagcaaaattgcaaattattctcagattggctggatcgctgtagctgacggtaaagcttctacagggtgcggtaaaggacgtccggagtggttccgagtctcttgagcaatcgtcaggtgtaaatcggcagcgggatcaggtatcccggcagtatcgccaggagccatctgcaggaatctgcaggattgggaatgcgcaggatgggcatcgctgcggtttcgaagccggagggtgctcacgtatcatttgaggctcttcgctacttatggtgggtagcatatctgcatccccttgagggtgtggcctttaaacggcagtattttccccgacagaaggctgcgttcttaaggtgcgatatggatgttcaggcagggatgctagcaaggctctttaagaggtcccaggggactcagcgacgaatgggaggtcgccgatgtctggtttaagaagcgcgaggaagcgcaggacgagctccatgtgagggtcgcgcacaggaagggccaggcagtggaatgcccagtatgccataggaagtgcggcacctacgacacgcgcgagaggacctggaggcatcttagcatctggcaatacgatacgatcgtgcactgcgcgctgcccagggccgactgccccaaggacggcgtacatgccgcaaggatgccctgaaaggtgcggccgaactcgcacttcacagcgctcttcgaggcgcaggcggtaagtgatggcgctctttggcatgagcgtgacgccggtcgcacagcagctgcacgagacagcccacgcgcatatggcgcctgctgggcaaggccatcgccgaggcaagagatgccgccgactactcggatgtcgtgcgcgcagggatagacgacaccgccaaaaggcgcaaccaaagctacaccagcatcatggtcaacctcgacgcccagcgtgccgtggccatcacgcaggacagggacaagggcgccttaggcaggctctgcggcgagcttaaggagcacaggaggggaccgcacgaagatccaggaggtcacgcgcgacatagccggggcatactcgcttggcgtagctgcagagatgccccaggccgctcagattgtggacagcttccatgtggtacagctcctgaacagagcgatcgaccatgtgaggtgcacagagcggcgcgagtccgcctcgaagcgctggtagctcgcagggacgaagtacgtatggctcaagaggagggagaccctcacaaagagccagctcgcgaagagggaggagctcgatcccgtcaggacccatctcagggaggcacgcgcatgccagatggccgaggcgctgcaggacgtctattcatgcgctgacagaaaatcggcaggcagggccccagagtgtctctgctcgtggatggcgcactccaatgtccgaaagatgaaggccgtggcaagaacgctccgcaaggagcgggaggggatcttgaactggtggaagaggggttcgactaactcgttcctgtgagctgtaatcttttggtggacagtgggacagcagggactggcagcagatatgctctgtccagatacccacctaccaacaccagcagattggagagatgagatgtcggtgagcgcaagcgagatagagaaggcaaagtcccgcacgaagccggggacacccaaacactacactgaaggagtattgcctcgaggctgtcgagtactacaggaaggcccatgaggccgatccgaagaagagcatcagggagtgcgccgcagagcttggaatcaacgacaagaccttaaacgactggatcatcaagcacaacaagaccggaagggtgacccaggcaaggaccgaggagcagaaggagctcgacagggccaacaggcgcatacacgagctcgagaacgagaacgagttcctaaaaaaagccgcagccttcttcgccaagagcctctgacggaggacaggtttcggctcatgctagcggagagggcaacctacagcgtctcgatgatggcgcgcgtactggaggtgagcagggctcacttctaccgatggctcaaggccggaggcggtggcgaggatccgtggggtcccctcaaggaagccatctgtgcgatatgggagaagagcgacaggcgcttcggctttcgcaaggtctgggccaagctcacaggcgacccgcagtacgcaaaatttaggctcttcgctgtttctagtgggtagcgcatgccagcttcttctgggccgtgaagtccagacggcccaggcggaggaagatcatcgtcctgaagtaggcgatgctcctgaagcccctggcggcgctgcgggcggactggacgaccgagttgagaccttcgaggaacgagttggtggagcccctcttccaccagttcaggatcccctctcgctccttcctgagcgtcctcgccacgctcttcatctcggccacggcagagtgcgccatccacgagcagagacactctggggccctggccgccgattgtctgtcggggcatgagtacacgtcctgcagcgcctctcccatctggcaggcccttgcagttctgagatgggtcctggcggggtcgagctcctccctcttcgcgagctggcgctttgtgagggtctccctcctcttgagccatacgtacttcgtccctgcgagctgccagcgcttcgaggcggactcgcgccgctctgcgcacctcacatggtcgatcgctctgttcaggagctgcaccacatggaacctgtccacggtctgtgtggcctggggcatctgcgcggcgacccccagcgagtatgcctcggccatgtcgcgcgtgacctcctggacctttgacctgtcccctccgtgctcctcgagctcggcgcagagcctgcctaaggcgcccttgtccctgccctgcgtgacggccacggcgcactggccgtcgaggtctgccatgatgctgatgtagctctggttgcgccttttggcggtgtcgtctatccctacgcacacgacatccgagtagtcggcggtatcccttgcctcggcgacggccttgcccagcagcctccatatgtgcgtgggctgtctcgtgcagctgctgcgcgaccggcgtcacgctcatgccaaagagcgccatcacttatcacctgcgcctcgaagagcgccgtgaagtgcgagttcggccgcacctcccagggcatccttgcggcatgtacgccgtctttggggcagtcggccctgggcagcgcgcagtgcacgatcgtatcgtattgccagatgctaagatgccacaaggtcctctcgcgcgtgtcacaggtgccgcacatcctgtggcatacggggcactcgactgcctggcccctcctgtgtgcgaccctcacatggagcttatcttgcgcttcctcgcgcttcttaaaccagacatcggcgacctcccattcgtcgctgagtcccatcgacctctcgaagagccttgccagcatgcctgcctgaacatccatatcgcaccttaagaacgcagccttctgtcggggaaaatactgccgtttaaaggccacaccctcaaggggatgcagatatgctacccaccataagtagcgaagagccaaaatttacaggcacgacccgctaccgcgtacggaggtgcatggtcgagctgggcatctgcggcatctgcccgaatgcctccaagaagacgacggtgcccgatccggacgcccccgagcgtcccgacctcatcggacgggacttctcgtgccccgtgccgaccacgaagctcgtgggcgatataacctatcttaagactacggcaggcttcatatatctcgccgtcgcacacgatctgtgcacacacatggtggtgggctgaagcatacaggacaacatgagggcaggccttgtcgtctttgccctgaagatggcatattcgcgcggatatgtggccaaaggggccatattctaagcagcccaggcagccagtacataagctcagagctggccgcctgctcagccgtacacgacgtgaggctcttccgtggggagaaccggaagctgccacgacaacgcgctcgccgaatcgcttttcgccacgctcaagaacgtgtggtactaccttgagcgcctctcggatgcatccacgaccaagcacaaggcacacgagtttatcgagtcgtactacaaccgcttccgcccgcacgagtccataggagatcgcgtacccgcagaggtgatgcaggagttcttcgagcgcctcgagagaggccttgcatatgatccaaaggcgatgcagaccgcataaaaaatctgggattcctctgtccattatattgacagggctcactggaaggtctcaattccgccgtccagtccgcccgcagcatcgccaggggcttcaggggcatcgcctacttcaggacgatgatcttcctccggctaggccgtctggacttcacagcccagaggcagctggcatgcgctacccactagaaacagcgaagagccggaatctcgacgaccatatgctcacgtgtacgcttgatagcgaaagcgatgtggttggcaagcgtgacaggaaggttcggcgagatcgtgcgggcaaggtctgcgagctgtgccgcaaactcgagcacgtcttctgtaagctcgctcaccagtcccaaagacttaggatcgataccgtagaacatgcgcttgatgtcggagaacggaatctcgcgcggtattgtgccgaagccgatgccgagtgcgatgagctcgtgccctttgccgtcggcgcagatggcggcattgttgtggatgctcttgatgatgcgcatggagcttctcggtccgacaacgatggctcctgcattgtagcgaaggcccttgcatgcggagggagagcattctgctgatggtaggcacaggacagacgccctccctcagagttgtctgcagagagggcgctgacgtggacgtatatacaggctgtcaggagagctcggcgcggaccttgtgcgcagcagccacgaggttcctgaggcttgccaccgtctcctttgtgcctctcgtcttgaggccgcagtcggggttcacccagagcttctctttcgggatgtgcttgagcatgcggtggagagcatcgacgatctcttccttggagggcacacgcggcgagtggatgtcgtagacgccggggccgacttcggtcctgaagcctgcttctgtgaggctcttgaggatcgagaggttcgaccgcgatgcctcgaacgtgatcacgtcggcatccatctcgtcgatctcatggatgatgtcagagaactcgctgtagcacatgtgggtgtggatctgtgtctcaggcttcacgccgctatggacgaggcggaaggcgggaatagcccagtcaaggtattccctgtgccaatcgctcctacgtagcggcagcttctcgcgcagggctgcctcgtcgatttggatgatgcggatgcctgcacgctcgaggtcgaggacctcgtcgcggatagcaagggcgatctggagcgcactctcgcggcgcgggatgtcctcgcgtgagaaggaccagttcaggatcgtgacgggtccggtcagcatgcctttcacgggcttgtccgtgaggctctgcgcataggtgctccagccgaccgtaatgggatggctgcgccagatgtctccccagatgatgggaggcttcacgcagcgcgtgccgtaggactggacccagccgttgtttgtgaagagaaagccttcgagattgtcgccgaagtactcgaccatatcgttgcgctcgtactcgccgtgcacgaggacatcgagactgagctcttcctggagcttgatgcagtcggcaatcttgcccttgatgaactcgtcgtactgctcctcggagatctcgccttttcttttggccctgcggcttgcgcgcacatcgctcgtctgggggaaggaaccgatcgtcgtggtcgggagaagcggcagtcccagctctcggtgctggattttctcgcgttcggcgaaagcgggtgcgcggtggaagctctcctcggtgagggtggcaaggcgctcgcgcacagccttgttcggtgctgcgtgcccttcatggaagagtgcatcgttggtagcgagggcggggtcagatgccggactgctgagcagcccttttacgctcgtgccgttgcctgccgcacggtccaggatgacgtggagctcattcagctctgcaagcttttcttcggcgaaagcgagatgcttcaagcggtcaggctcgagctgggtttcggcggatgtggtgtagggcacatgcagaagcgagcagcttgtggaaagcacgaccttgctgtcaggtgcaaggctcttcagatgcgagagggcttgacggtagttcgtgcgccagatgttcttgccgttcacgatgccggcaaagaggacggtatcttttgggaagccggacgagacgagctcgtcggtcttcgtgccttcgacgaagtcgaggccgatgccgtcgaagctgagcttcgtgacagtcccatagacatcgcggatgtcgccgaaataggtctgaagcaggatcttgcagctgtgcttttggttcaagagggtacgggcgatcctcacgaagagcatctcgtcctctttgctgatgtcacgtacgagccagggctcgtcgagctcgagccaggcaccttctggtacgagcgccagaagcttcgcatagacagaagcaatcttttttgcccatacgttctcgtcggcaccctcgggtagctgggcgagtttcaggaacgtgaaagggcccgtgacggagatcttgagctgttctgctgcaagccccgcagcacgtgcttccccgatctggccacgcaggatatccggcacgaggtgaagctccatgctttcttcgagttcgggtacgagatagtgatagttcgtgttgaaccacttcttcattgcgagggcatgcacatcgccgcgcgtgccctggtagccatgagccatagcgaaataggtatcgagggcatcgaggccgagcttttggtagcgctccggtacggcgccgagcatcatggcagcatcgaggacgttgtcgtagagcgagaagtcgcctaccggtacaaggtcgagcccgcactcgagctgcacggtgcggttctcggctctgagcttggctgcctctgcggcaagtttgtccttgctgagctgccccttgaagtaggcttcttccgcacgcttgagttcgcggttttgtccgatacggggatatccgactatggtcgtcttcatgagctgcctttcacccgatagcttttcttcgcatcagagtataagcatgcaggtatcgtctgaataatatctattatctattcgctgcctcaagatatagcgtgagactatggatggaggctgtattgtcaggatgacaagaggcacgttccgctgtctgcaacgcctgtatcctcatcgttgccgaacgagaacatgacgtcgccgattgcattgccgaggacagggccaatcggaacaagagcgcagaggcccacggggaccatcacgaacatcgtgaggaagggcacaaaggccgtggaaagcatgtcggggatgacacgcttgaagaacttttcgacctgccggagcaccggcatgcagagaagaatcggaagcacggtagaggagtaggtgttgagcatcgcggggatgccatagaccgacgtgaaggtctggccggtctcggctgctgccgtgacgatgttcacgaagtcaggagcgatcaggacgccgcccatcatcatgccgagcatcttcgggcagccgagctgctgtgctgccgagtatttcagatatattggcatgaagtagtagcctgcgtcgtagatccagttgtagaagaggttgtagatatcagaatctgctgctcagagattgagcatgccgggaccagcgatgacagcaattgtgcggaacatggcagcgcccatcatgacagggatagcagcgaccatggtcttggaaagatagttaaggattgcctggccgacgcgcttggcgctccaaggcttcttcggcagattggtgtcgaggttctcgtctattgcgccgccggcagagacgccgagcttcacgatcgcatcgtagaccttcgggacgttctggccgatgatgacctggtactggccgccggatcactggcagccgagggcgcccttgattgccttgatcttgtcgccgtcgggggccggttcgtccttgaggttgatcctcagccttgtcatgcagtgcgcgatacttgtggcgttgtccttgcctccgattgcggcgaggacctctttcgcgattctctcgttgtctgccatctttgcctcccgtatcagagcggtgcttcccctgctgctctgatcgttccgaggaggcgccatccttggaagctgtggcaagaggtcgatgcctaacaaaaatgcctcccgagccataccagagtagcagggcacacagaatctgtgtgccccagccttggtaatgcctcgtggagcgaggtccagtgcgtagcacccaatgtagggaagagattagggtgggaagacggctggaccgaagcaggcaggggcgaatggtcggatatcctctgcgaacggcagatggctaggactggcctgaggcctcccgctcgaagacacggttcacatggaggatcagataggcccgctcctcttcgtcgagcttcgcatccaggctcttctccaggaagtctgccacagcatgcccgcaggcagagacatatggatagccctcttcgagcacgggcaggagcgctgcggcacctgacgagacatactcacccaagataagcctgccgatgaggtagcgcatgtgggttgcaaagcgggcgtagtcgaaggaattgcgcccgaccgtgatatggagcttttcctctacgatcttcgtgctgtccttgatgagacgctctgtcatcttctggcgctctgcgtcgtgtgcgcttgcggagatggcgcagctcacgatcgagagggcgatgccgactgcttcagtcttgggaaggcgcacattgaacgtgcgggagataccgtgcacggccatctctttgatgcgatattcggtggggtagctctgctgcacatcgtaggcaaggggcatctcgacgaccgtatgcccacgtgtacgcttgatagcgaaagcgatgtggttggcaagcgtgacaggaaggttcggcgagatcgtgcgggcagggtctgcgagctgtgccgcaaacttaagcacgtcttctgaaagttcactcgccagtcccaaagacttaggatcgataccgtagaacgtgcgcctgatgtcggagagcagaatctcgcgcggtatcgtgccgaagccgatgccgagcgcgatgagctcgtgccctttgccatcggcgcagatggcagcattgttgtggatgctcttgataacgcgcatggagcttctcggtctgacaacgatggctcctgcattgtagcgaaggcccttgcgtgcggtgggagagcattctgctgacggcatcaggactctgttggagccttgatgccggactgtgtctgatgcaaacgggcggggattttaccgaaagcttcccgctctctctgcctacctaccacatgtaggccggctcgtgcagaagatatccttcaggctttctgcatccttgaagggcacccagccattgccctgggcccatttcccgagattgactccatcgctcgtgatcatgttgcccgaagccaaagcatcgaggaatttctcgtagccaccgaggccaccgacatcttcgggaggtgtttcgccttgggcgttcacgatgtaggggagcttcgaggcatcttcgagcctcaagtttgaagcggtgagagcaagggcccagccatcgccgtagtcgtagtggtagacgaggccaggacctgaaagctcgatagcggagaggtcttctggagagcagctctttgctttggcgagcttcctcatggtctcatcgcccataaaatagcagccaagcattgtttgctccggcagggtggcattcgggcaatcgataaggtcgggatcaggatcgtcgaatagccccaggaagtcgtgatagagccagcgggggctcaggtggcaggtcttctcgaaggcagccgctcctccctcgtagaatcgctccggattgccgccccattcctttatgcggtctatgccaagagggagctcggggaagaaggcccagaaggcatcttcaagcgcgctctgagctgtcctgtcgaggagctggaaattatggaggtggtagtcgtaccagcgcatggtgcgctgcagggcatgatggagccagaagaggcttgctgtggcaggaacggcaatatcgcggaagaaggcaccatcgcgccaaggctttcctgtgtactcgtcgagaagcgtcgcgtgcagcgtaagcgtcggcaccatgagaccggcaacctcgctctgtgccttcgcatgtgtcacctcgagtggtatgacatagccgcccttggcagtcttgtcgctcaccagataggaggcaatcacccaggagtcatggtaatcgacgagctcgttcgtgcggtcaaggatcctgtccacctgaaggcacgcaagatgttcacgcgccatattgagggcggacgtcgccttcctgttgccgttggggacaaggatgacagatgagccagcagagccgtcaagggcttcatagccgagcttcaggtccttgcgcatctggtacatggtctcgaaacagcgcttgagatggaggtcgatagcctcgggcacgatgctgagctcgccccacattccgcggatgaaggagccgaaggtcttgtccagatcgaggaagtcctgcggcgccagcccttgtgctatcactatcgatctcatcgctgcgttgtagagataggccgtgcggtaggtattcgtcagtgcgggcttgccggcatggagcggcaaggaatccatatcgaggttccagagatagggcacacgctcggggtgctcgtcgcaccaggcccgaacgcgcttgatatcttccttgctatcgacgatggcagggaagaagcgatccttgccgatctcctgagcaagggcttccttgataagcgtcagggatctggcagagcagaaaacgatcatgggtgctccttcggctgtagttatccgtcccttcagtatatcttctcatggtgaatggcgcagcatgaagggaggagccttcgatgggaaagagcgaaaaagttgtccatatccagtatggacgcactgcgacctatcttctggaaggcgcagaaggctccgcgcttgtagatacagactgggctggagcgcttggctccttcttcaaggctctgaagactcaggtgcttgcggttgaagacatcgggtacgtgctctgcgcacactggcatccggaccacaggggcatcgtcggcgaccttgaacgcctcggcgttgtctctgtcacctttgatgtgcagctgccctatctccacacgtctgacgcggtctttgcaacggatgcaaagcatcgcttcacttctgtggaggatgcgggcatcaaggtcatgccgctctctcagagccgtgcgttctttgcctctttgggcatcgccggagaggccgtctctacgccgagccattctttggacagcatctctgttctgcttgattccgggaccttcttcgtcggtgacctcgcaacgcccgatatggtggcagcctatggagaaagcacaccagagcagcttcttgctgactgggagcctctgcgttcccgccatccccatcgcacctgctttgcgcatgcaggagagcttgcttgctgaggttagattctcttgctgaagagccggacaaggaaagggagcggaaccatatggctccgctcccgtgcatccaggtgtctgcctaaagcctgaactgggcgctcttccagcgcgctgcttcgcgctcgtcgatgtctactcttgccatgcagaagtcggcatgtctcgcttcggcgctgctgccttcgggtatgctgttgccgtctggatcgatgccttccactgccgtggggctacaggtctcgctcgaggcgccgggcacgcggaaggtgttcacatccagaggctcgatgcttgtctcttctggcttctcgagctgcggcacccaggagtaggggatgcggtaggcgcggtagaccatgttcgtcgagaagccaggcgcgaattccctcgtatagggattgatgaattcccagacgatctcatggttcggcgtgacctcgatgatgcggccatcggagccttcggtgatgagggcattgccgttctcgaggcgctgggcgcttgagatataggaggaatagaatttcgagccgtcggagaagggcatgaaccctgctttgaccggcgtgtattcccatacgacgtcgaaggtcacggggtcgaattcgaggacacgcgaatagtctcgcctcaccgcgctcacgccgtcgggagacatcgcgttgggtgcatcgtagccggccgtgccgccattgtcgaagacgaggagattgccggcaccgggaagtccctcaggaatcatgtgcaggtggtgctggccgatgatgcagccgagcttctttgcgccttcgctggcattcggtccagcgtagtcggggccgacctgccagacaatctttccagtcttcttcgagatgatcgcaaggatattggcattgcgggaatcgaagatgatgttctttgggtcgaagcgctcgtcccctgcatcgaagaagcggttcggtccgaggtaggagatgctgttcacgtgcagccagtcgccacctgccgtgcccctcatggcaggattggcacgcagtgccttcttggcagcctcggagaatccaaattcctcgaagtggtctgcgcagcgccactcccagaggatcttgccgtcctagctgacctcgacgatcttgtcgtcgatcaggagcttgtccgagatctcgggcttcagcgtgttctcgtgggtcaggatgagagtcctgtcgttgaaagcgcttggctcctggccaggtgcatagtagccgacaggcgacccttcgagctggaagtcatggtgctgccgtgccatccatctcggctctgtgccctcatcctccacgagctcggtatggtcccgcttccagacgatcttcccatgccagtcgacttcgataaggtcgagctagtcctggtaggcagcctctcctgtgtgcctgcccgagctgccgaagacatagccgcctggtgccatctttgctgggaagccctggaggcctgcccagcagtggacctcgcgcccgttcatatcgatgaggaggacacccttggaggtggggaagagcgtgtagccgctccaggcacggtccttatcgaagatggtgacgccggtcggatagatggatgggtatcccatggctgctcctgttctctgcatgtattggggggggatgctcagcctggctgccctgaaagcagaaacctgctgaatgtcattgtcggcattctatatccagaacaatcaattcagttgtccaagatatagataactgaccatcggaaagaggtaaaaagggaagcttcctgctgagcctagactgaatcctatgctcgaacagagagccggatagcagtatttcagtcttgccgacggaaggagagaagatgctgggacgcaatgtgcatacggcacagcggacattcacgcgcagagaggccctcgagggcatgggagcctgtgccatgatgctggctctctccggatgtggcaccggtgcacttgccgaagcggcatcctttggcagcagtgcctccgcctcctcctctgcaggcgagaccgtcaggattggctttccttcgagcggacagagcttcgatgcggcaacgccgcttggcatagcggaaagcaaaggacactttgcgacctacctcgaacctctgggctatacagtcgagacgtcgagcttcgtgggggcagctcctgcgcttcatgaggcactgatttcgggggacctcgacctggtggactatgccggctttgccggcatcctcggcaagtcgaagggcatcgatacgacagctatcgccgtcacgcagtggggctcgggctagtcgcttgccgcggctccggatatcgcctccatcgcagacctcaaaggaaagaaggttgcctatcagcgcggagcgacaccacagatgttccccatcaaggtcctcgcagaaggcagcctcacgtttgacgatgtggaggccgtgaatgcgaccgggcctgatggactctcgtcgctttcggccggtgctgtcgcggcgaccgtctgctcgtcgggacaggagcagagccttgtctcccagggccttgccaagacgcttttccgtggcagggatggaaatccttccatctacttcgagccgttcacgctcgtggccaggaccctgtggctgaaggagaacgcagacgctgccgttgcggtgctcaaggcctatctcgccgccaaggcagagatggtggcagaccctgatgccttcatctcctacgctgccgcacagtcgggatagagcgaggatatggtcaggtcctggcaggacttcgacgacttcggcgcgaactatccgctgagcttcgatggcacctatctcgatgcgctctcgagcatccaggacttcgaagtggaaaacgacatcatcgccgaggagatcgacatcgcttcctggacagattcctcctacctcgagcgtgcccagcaggaatttggaaatggggactagctgtgaaaaagaaggtccttcatttcctcgagatgctgattctgcctgccctgatcctcgtgctgtggcagtgggcaactgtctcgggggccgtgcctgcaatcgtgttgccgactcctgctgccgtcgtatcctccatcgtctcgcagcttgccttgggcaggctcgagaacgatgttgcaatcagcgtctcgcgcatcctcaaaggctatgcgcttgcggtcgtcttcggtcttgccttcggtgtcacgatgggcatgagcgagcacgtaaaccgcttctttggaggcctcttcaaggcaatccgccagatcccgatgattgcctgggtgcctcttcttgtcatgtggttcggcatcggcgaggagtcgaaggtggctgtgatctttatcgctgccttcttccagattctgctcaatacgatcagcggtatccagcgcacggacaagaagctcgtcgaagttggaaagatgtaccagctctcgaaatggtgtctgttccgcgagatctatctgccaagtgcgcttccttcgattttcgtcggccttaagcttggcctttctgtctcgtggatggctgtcgtcggcgcagagatgatcgcagcgagctccggcatcggcttccgcatcaacgacgcgagagcgctgcttaactatccggtcgtcttctccggcatgatcgcgattgccgtcgccggtgtcctcatggacctgattttttctgccatcgcaaagggctgcatgccctgggaaaggggcgagaagcatgcctcataagctgagcatccgaggtgtgagcaagtcgtttgctgcctcgttgggcacgctttccgtgctcgaggatatcgacctttccgtggcagacggcgagctcctcgtgatcgtcggccacagcggctgcggcaagtcgacgcttctgaagaacatcgctggcctcgaggaaccgacgaaaggtgagatcctgctcgacgggaagaagatcgcaggccccggccctgacaggaccatgatcttccaggagcacaggctcttcccatggatgacgatagaggagaacgtcgcgtttgggctccatgaccgtccgaaggcagagcgcagggaccttgttcggagctacctttcgctcgtacagctcgaaggcttcgagcatgcctatccccatgagctctcgggcggcatgagccagcgcgctgcgatcgcacgggcacttgcaacgaagcctgaggtgctgctgctcgacgagccgttcggcgccctcgatgcgctcacgaagatggacctccaggatgaactcttttccatccgcgaccgcgagaagacgaccatggtcatggtcacgcacgatatcgaggaggcggtctatctcgctgattgcatcgtcgtaatgaccgaacgtccgggaaagatcgcggagatcgtgccgattgagctcgggcgtccgcgcgaccgtggcagcgccgacttcgcctggtaccagaagcggattctttcgcacttcgtgaagccgaaggagaagcagatcgactacgtgatctgacggcacatcatgaagcgggatgcatcttcgggccggaagctccagtcctcctctctgtcggcccatctcttgccgctgacctcatggcgcccgccatggcggcggcatatggagcatgcatgctattgcatccgatctgcatctgttccttccgatgggggttgctgaccatcagccttctatataggaaacgatgaattcagcaatctgtcgaagcgatagccaagcataggaaagaggtagtagaggcagtcccttcaggcgcatatactgaactttatgaccagctctgggttggagaggagcaaggacatggcaaagatcgacaatgccgcgctcaagaagggcggcttcatggcacagaagcagaaggggctctactcgctgcgcctccatatcacggcagggcatctgacgtcgcgtcagcttatcggcatctccaaggtggcagacacctttggccacggctacgtccatctgacaagccgtcaggccatcgagattcccttcatcaaggtcgaggacgcagacgccgtgaaggcgatgctggctgagtacggcgtcgagccaggctgctgcggtgcccgtgtgcgtacggtcacaggctgtcagggatcggctgtctgcccctcgggcaacatcgactcctatcgggtagccacgatgctcgacgagcgctacttcggacgcgaccttcccggcaagttcaagttcggtgtcacgggctgccagaacaactgcctgaaggccgaagagaacgacttcggcatcaagggcgggcgcaaggtccaatggaagcctgatgcctgcatacactgcggcatctgctcgaaggtttgcaagccccaggccattacggatgatggggagaagatcgtcgtcgactatgcgaagtgtgtctcctgcggcaagtgctcgcagaagtgcccggtcgactcgtgggactaccagacggtctacaacctcacattcggcggcctcttcggcaaccacataacgaaggggaggaagatcctgccgccggtcgagtccgatgagcagctgcttgccgtggccgatgcgacggtccagtggtacgacgaccacgcgattgcaggcgaccgcttcaagttctgcctcgaccgcgagggatgggagagcttcgtccctgtggtcaggaaggcctacgacgaggcagcacctgagggctgccccaaggcggattccgtagaggtcgagccgccgacaccggcggcacagcagtaaggagagagcaatggcacaggagccctatgaagtcgcagataccgtcgatatcacgaatctggtgtgcccgatgaccttcgtgacggcgaaggcagcgctcgccgaactcgagataggcgaagtgctgcgggtgcatctcgcggcaggcgagccgatggaaaacgtgccgaggagctttgcagacgacgggcagaaggtgcttgccctgaaggaagcagacgatggcgcctttgacctcgatgtgaggaagctcgaagacgaatagcgcatatcggtaccttggataggcaggaaggatagccatgaacatcacagtgggcggagagaagaggagcgtgcccgaaggggagaccataggtgcgctcatcaatgccgagaaggtggaggaacgcggactatgtggacccgtagacgtgaatgaggtcttcatcgaccgcaaggacttcgcagcgacaagctcctccgaaggacgatacggtcgatgttcctctatttcatgggtggaggccgctgagatggcatctcacctgacgagctcgagcgctattcccgccacatatctgaaggaggttggcgtcaagggccagaagaagctcgtgctgccaaggtcctatcatcggtgctggcggcctcggccggctccggctgccactctatctgagctgagcagggcgtcggcacctctgggatcgtcgatgccgcagacggtcgagctctcgaacctccagcgccagatcatccacggcacctcggtatatcggcaagcgaaggtggaagcgccgcagagacctgcacgatatcaaacccggcgggcgtggaccgtactcggagttcgtcgactcctgaacatcgccgacctcatcgcgactaatgactttcgtatcggcggccgtgacaacttccgacgaagttctgatcaagatgcctggtgatgggcagaaagccttcgtcatgcgcggcatcatccgccttcaagggccactgtcatgacctatggccgggagaggggccgtgctaccgatgcgtcttcccatatgcctcccgaaggatgccgtgccgacctgcagcaggcggcgtcatcggcgccattgcgggcgtcatcgaggtctctcaggcgcttgaagcgcataaaatactgcggcatatggtgagcttctgacgaaggctcctcacgtttcgatgcgctcaaggaggacttccacacgatcaagctgcccacgagatcagaactgcccggtatgcggacgacatccgaccgtgaccgagctcatcgactacgagcagccgtctgctctttggcgagcatggcaccgcgctcgactgagaggagaggcagctccatctcgagcggggacgatttccacatgcatggcagagcggcacagcgctcatgcccaggagccttgcggcttctggcggctatcgccgacgaggaaggagagccttcgtcgagacgtgtttctctgcgagaatgcgacactaccggcagagcactttacgtatctgcggcacgagagcactgagggtcctgaaggaagctcaggagcgtcactggcccatggagatcttggcaacggcactcgctaccgctgagactccgccaagcctatctgaggaagagtcatgacggcttgcccgcaggacccttctgcccatctactgcatccatctcgctcgaatctccgccctgccggcactcccatcggcctatcgcaaaggaatgcgatccgtcgaaatgttcagaggggctgtctccatgacacgtgaagggcgtcgtcctttgcaagctacgggacgctgtagatgaggcgaggcagagcgaattgccccgtcgccgaagcggatgtgaaggcgcgcctttccggaggatgccttgccgacggtctaacaagcgcctgggtaaggggatctcgcgaagcgcggtattgcctccaacgagcctcggtgaggcgcttggtctctctgctgatgaaggcgtcatgaatgccacgatccagccaggctcatcgtctgcggcgatgcggggacaaagctgcagcggaggcgagcagcgctcgctgtacgcttccggaagggctttttctcgcgacgtccgcttctggcagatgatagagaccagaaagaggtcgctttcgtatcgccgaggcattccctgcgcgcctccatgcattcgttgcttgaggacatgggagacaagagaggcgcagatgcgcctacacaggcgttccgtctgcgctccacgaggcaggacgcaccgactttgaccttggcctcatggaggcgcgcccgatccggacgaggccagcgaaataagctcgtacgcaatgacacgcatcggtttacaattgtcccggtcatgtcacggcaggaagccatgtgcgccgcgcttgcgggagagggcgccggggggggggcaaagtggacatcgcgcccatgagcgcggccggcattgccacagattgcacgctggcgggccttggatcccggcgggttgtgagtgcatatttgtccgccatgtcacgggaagcgaagcgactcgctttgagccagacagcctgcatttcatagacatcgatatcgacagaaaaagagagcattcccatgctgtgaaatgacagcgtcttgtgcgtcctgctgcggttggcagcacgctttctgctcgctcgagccttgtggcccttcttgcctgcagccagaccacgtcttcacatcctcgacggacactgcctcgtcgagtgcatccacgcagaggccgacagcgtcacgttcacggacgacctggggacgcgaagtcacgggtctagaatccgcagcggcgttgcctgcaatgggttcctttgcaggagcagggcagcttgcaggcggcacgctcgtcggcgcttccgatgatgcctttgcgcactacggcggcgattcctcggccgttttctgggtgtcggcaagtcggaccgcgccaatcttgagtccatcctacgacctcgatcccgattttcatcatgaccgggcatcttgacggcaagcacctcgacggcgctcgcaggagggacatggagtctcgctcgacgagcagtgggtgccagcgtgccttcttcaaggtcacacggttttgccgactacgagccatgatggggaatctctctgccagatcacgggcagggacgaccctacagaaaaagtggccgatgtgaagagccagacgacgaggcatcaacgcctactctgttgccgacaaggcaccgaccgtgctcgtcgtgagcgctacctcgaaggggcctggttgtgcaagaattctacgggcatgacgagaggaggatcgtgaaggatcttggcggcgtgaatatcgcagacgagaatcgagcctttcttctgaactcagcctgaggcagtggtcgaggcggaccctgagacatccttgtgcttgccgctccgacgacgaagcgacagcgcagaagaagacatgaggagtgcggtcggctcgattactgcctgggcagactgaccgccgtgaaggagggcgtgtcccgctgctcgatgcagcgcattcctctaacaagccgctcgacaaagggaccgagtcctatgaagacgtgggccaggcgctcagcaagtagggatggctgtgggcataacacgctccagcgagaagaaggcagcagggcaagaagcattggcttcggtgcccgtgctgaccatctctttgtccgtgctccttcttgccatgctttgggccttcttcggtgcttccgtggcgtcggtgtgggtgacgtctggaacgtggtagcaggaagagaccactgcgaagggcggggagaagaaacatcctcgctcgatgcacattccccgcgtactggcaggtgtcctggcagggcgctgaccttcgcggtattctggtgccctatcaggaagtgctagcaacccgcttgacaagcccgaacatcattggtgcgaatcgggcggggcaggactcgcgtgcctcaccgtgggtgcgctggcaacggcggcatcacgggcgctgccgcttccggcggcagcctttctgggtgcccttcttgcgtcggccgcgatcttactttgtttcggcccgttaccggagtctcgcggtcacggtcgttcctgcggcgtcgccgtgaatgcgtcggtcttcgcgggccggcatgaatgcggtttgatcatacgcacgaatgctatgtcggctacctcatccatctgtggcgactttccaggcatcgtgttttcgatctcgggcttctgccctcttcttcgcgctcctcggcctgcattggctcatatggagcaccggctcccgcacgtgctggccttggcagccagacggcgcatgagagccggcagtgcccgttgcggctcatgcgggtggtgcaggcctgaccgttgcctcgctgtttctttgggcggtgctgcctgtgagcttctcggggcctcaatcggcttcatcggcctggtaccccatgggcaagacgctgttcggactcgtgacctgatccgcgcatcgtatcgatctctgactgtctggggtgcgcattcacggtctctccgacctttgggcaccgcacgctctttgggcacttagagatgccggtgggatactcatggcgacttgtcggcgcggccctctcgttcctgctcatgaaggaaagggatacgcgatgggtgaaaagtgctcgcgttcgggatatccgttcgctacgggagcgaggaagctcttcgagggcttctctcttgccattccgaggcggcatccaggaacgtgctcggcccgaatggcatgcggcaagtcgacaaggctcctttccctaggcagatgcgggatgctgagccctcttgcggcacagtcctgcttcgggtacagataacgcatgcgctctctccgaaggggggcgggactcatcgcactgcgccgcaggttgcacagaacccgtcatgagtaagagatcctggtagcctgcggccgctatgtgcacatgggacctttcggccagctcgataggctgactgggacaaggtcgacgaggccatctatgatgggcctggactctctggcagagaagaggaatgcggagaaagctctcgggcggcgagcgccagcgggcgtttttttgcaatgacggtcgctcaggagcgcgcacgcttcgctcgacgaaccgacgacctatctcgaatgtgagggcagcgcacgaacctcatgggcgctcgtgagaaagctggctggggataagggcattcaccgtcatctgcgtgatccacgatgtggatctggctctgcgcttctcggatagtatcgtcgttctgggagcgagcgccgacccgccttcttccacagggataccggatgcaattgcagaaagcacggtacttgcttcgtctctcggtgtgcgggctcagcgcttcagcaatggcggggagacagcctatggcattatttcctgccaagggcataaaggcattttgacctgctgattcttcaatctgtaggacttcatcaggctgagatcccaggcattgacctaagatcaatgtgatatcacaatgcaaccagattcagagggcaggctaccaggcaggctcttgagagaggatgctcagccatgagtgtcgagaagaaggcccatgccgcaagcggctagctcattgtttttgtgttcttgcaatgttcgtgctctctgtcgcactctcatcttcgatatcacggtctgtaggagcagatgaagcaagcgtcccgagacgccttcggcatgccctcatgatcattcttttcgtagctgcttgtttccctcgaacagcttcttcttgctccagtcggggacaggcccgtgtctgcgtgctctttggcaagtactcggcacccgtgaacgattgaaggactgagggggccaatcccgactacgcaagaatctgggcctcgttgaggaggactgacagcgagaaagccggagcatgccgccattgcctccaagagcggtgcgtggctctgttcatctcgatgcgtcttggaccttgaacggttgggcgctcaaggtcaatgaataagatggggcaacccgatcgagatcagccacggtgtctcctggcgtgtcgccgatacggccaaggctattttcgagtgtcgagctatgagtcctatgtctccatgcagaccgagacccgccttcgccatgtcgcctctgtcctaggctatgaccacatggaggatgagtctacctcctcgatcagcgctgcgctccaatatcgaagaggtgagcgatgcctgaaggcagatgctcgacagaaggtttgcgccggcaggcgtcgctgtcgaggatggcccgcctcacgcacattgctatgtactagattgccccaggcaatgcttcgccgccagcagccgacgctatccttgcagcacgcaaggagatagtcgaagggcgctgtctccatagtggagatggcggcccgaatcgtcttgccgaaggcggtgctatcgagctcgacgacgagcgcaaggcagctatggcacagaacctcatggtcgtgctcgcggcgaatccgatgcacagctagttgcatcaatgtaggaagcctctatgcaataagggaaagagggtctaaggtgtaagccgcaaagcagtatccgctaccgcatcggtccggaatctgggattgccatacagcaggtgggtagccgatgacatgaggagtgtaaacggacaggtcggatatcttctgcgtgatgccctcaagagggcaggacggctgccgaagaagagcagcccgaaggacaggagaggagagcagtagcagcagggtacctcccagggcgtctcgctgcttcactatcagaagagaggaagagcttttcccaagaggaaatcttcgacagaaagagcggcggatcctacgataagtgtcctggcatgcggataggcaagtgagaaggctgtaagtccgtgcgtattcttgatgcgtccgctctttacctcgatgccgatggaatctgtgccatagcttaagacgaagtcgacctcgtctttgccatctctccaccagttgagcgtgtaatcatattgctcgcagagcgcaatgagataggcaccgattgcgctttccacgaggtggccatagcggtcggaatctttcagcagataatcgcgatagcggccgtaggttgcagtcatgagggcggtattgtgcaccagaagccgtggcgaagagcttttttcgcgcagcaggtcgggatcatatttcttgagtccggaaagcattccagcggtatcaagcagctcgagataatgcgcaatggtggctgcgttgcccttgtcatccaactgccccaggagctttcgataggatatttcctgtgctgaatagggggctcccacatagaagagacgccttagtaatgcgggattgcgcactgtttcgagcgccagaatatctttgtctatggtgggctcgatgatggcatctcggatgtatcgctgccagcgatctgtatccttgatgaggcgcgcagcgcctggatagccgccaaagaagagaaaatcatcgagcgagaatccgaatgcttcgcggcactcctgcaaagtccagtgggtgcagcgaatgatttcgaaacgacctgcaagcgactcatccatgccgcttctcagcaatgtcgcggaagaaccagtcagcactacgcgcagatcgagatcattgaaggagtcttcatcccatagtgccttgactgcatctgaccagccagtggcatactgcacctcatcgattaccaagattgctgaaggcactgtgggggaaagcaggttccgcgcttgctgccattgagcacgaatccagtcgggtgaagccccgtgctctggaacctctgcatagtgatggggtatgtcaatccgcttgaaggcctgcttcacagcggtagactttcccgtctgtcggggcccaagcagaatctggatgaaatgtctaggttcattcatgcggtcgaccagcaccgagacgatatcgcgctcgaaggtcgtgttcatttttctcctcctcttggtgtatttttgtagagctttcctgtttcgatattagcctatctcacaaaattgtgagataggcttctaaatttatgagataggctcacaaatttgtgaggtagatgcctaaatcttgtgagataggctcacaagtctgtggacttgcgtgcaggcacggttccatcagacatgcagcgcagagagaactatatgtcagccagcactgtcattggactttatgaggaactatttccaagcaggaatagcacgtatgcggccggaggtgctcaggatttccgtatcctcctgagtgtgatgatgagaccctcttcgagatggacaatatccatagcacgtttgagcgaggagacttcgcgcctgcgggtctttggatacatcatgtcggccgtgacctgtattgggagatagggctctgtcgcaagcgaatctcctatcaggaaattgactttccctgttgtgggcactatgtgtaggatgtgaccatatccggtcttgtgcctctcgtgcgacgcataagctcgatatagacagcggtcttgagcctctttccaaggtcttgctggcttgcatgcgagatggaatacaccatgccctgatcgcacgcataaaccttgggaacagcagtggtcttctctgcaagtgcgacagagtattcccgcagcatgctgataagataggattgctcgagcagatgcactccctcgttgacagtatcccaggaagtgcggtagccgacgttgcgcagcatttcgaggagccggttgatcgagcgcaggcagtatccctcagggcaaagagggccatctgggtcgctatcgtcacatcgagacggctactgcgttccacgatatcgcgtgcaatcacatcgcgcacgtaggattgaagcatcaaggtgcgggtcggagcattgagcagctgcacgcccgggaaagcctccctgaatgagatagcggtcataagcagattcgagagatgttttcatcttgggagagaccgaacctgcattctcgagctgcccgtcttctggaagttcgatgctgtggaatctgcagcattcggcaaacgagagtgggaacatatggcattcaagggaacgcctacggaatgtgctggcaatctggtctgaagacagcttcgaagatgagcctgtgataacgagagtgatcttctcgcgctcggcaatgcgctggcaaaagacctaccatccatctgcttcctgtacttcgtcgaagaagagataggcaccttcttggcgggcctcgggcacctgccgccaatattaattgagcacgtcgttcagaagggtagctggagctggcctcagacggtcatctgcgaagttgaagtagaagatgcgatcgcgtggcatgcctgcagcaagaaggcactgtatgagctggaactcgtagaatgtcttgtccgaccggcgcactcccgtgatgatatggaccagattgaagggagcaggctcaggcaggcccgagatgatgtcctggcgtggtctcacttcagggaaggggattcgagcgactcgcgaatgaacgctccgtaatcaggcactgtttccatgatctctcacatgccgttacttatttctctgtaatgactgaggacctccagcataaccgcaagaattcctgttgcttccaaaccatacaatgaggatgcaaggttgatacatccgagagggcaaagaaagagatgacgaaggggaatgcaggcggtctgagcaggcacgaatgcaagagcaaagggacattgatgggccttttggagaggttctcagacgaggagtcgtgcgacaggaggctcctcgagaagaagtgagccctgtcaatataatggacagaggaatctcagattttttatgcgatctgcatcacctttggatcgtatgcaaggcctctctcgaaacgctcgaagaactcctgcatcacctctgccggcacgcgatctcctatggacttatgcgggcggaagcggttgtagtatgactcgat

SEQ ID NO: 341 - DNA, 54465 bp, Unknown
  Metagenome-assembled genome
tctatctcgcttgcgctcaccgacatctcatctcttcaatctgttgactgtgctgggtgggtatctggacagagcatatctgctgccagtccctgaatcccactgtccaccaaaagattacagctcaagctcgtctcagagcctgcctaaggcgcccttgtccctgccctgcgtgacggccacggcgcgctggcagtcgaggttggctatgatgctgatgtagctttggttgcaccttttggcggtgtcgtctatgctcacgcgcacgacatccgagtagtcggcggcatccctcgcctcggccacggccttgcccagcagcctccatatgcgcgtgggctgtctcgtgcatcagatgcgctatcgccgtcacgctcattcctgagagcgccatcacttatcgcctgcgccttaaagagcgctgtgaagtgcgtcttcggccgcacctcccagggcatccttgtggcatgcacgccgtccttggggcagtctgccctgggcacggcgcagtgcacgatggtctcgtactgccagatgtcgagataccacaaggtcctctcgcgcgtgtcacaggtgccgcacctcctgtggcagacggggcactcgactgcctggcccttcctgtgcgcgaccctcacatggagctcgtcttgcgcttcctcgcgcttcttaaaccagacgcccgtgacctcccattcgtcgctgagtcccatcgacctctcgaagagccttgctagcatccctgcctgaacatccatatcgcacctccagaacgcagccttctgtcggggaaaatcctaccgtttaaaggccacaccctcaaggggatgcagatatgctacccaccataagtagcgaagagcctaaaaatgcctgctcctttcgaagcaggcacgagacacacaactatttgttgaccagtccgtggcggacgcgccactttctgcgctcgatctcattcaggatacgcttgcgcatgcggacatgcttcggcgtcacctcgacaagttcgtcatccataatgtactggagggcctcctcgagcgtgaaggtacgcggcggcgtcagctgcaccgcaatatccgcagtggaggaacgctggttgcccaggttcttcgtgcgggccacattgacgaccatatcacctggccgcgaacgctcacccacgatcataccctcatagcactgcgtgcccggctcaatgaacagggtgccacgatcctgaagggtacccagtgcataggcgacagccttctccgtagacatggagatcatcgcgccgttggtgcggccaccgatctctccctcataggggccatacttcaggaaggtgtgatagaagacaccttccccgtgcgtcacattcaggatgcggttcttgaggcccatgatgccgcgggtcgggatctcgaactccaggtggcacatagtcttgccctgctccatctgcgtcatgttgccgcccacgttaccgaagagctcgatcactttgccggagtactcgcccgggcactcgactacggcctgctcgatcggctcgaggcggttgttgtccttatctttcttgtagagcacgcgcggacggccgacctggaactcgtagccttcacggcgcatgtcctccatcaggactgacaggtgcaggatgccgcggccggcaacctcaacgccggtcttgtcagggagctcctcgatacgcatcgtgacattgttctcacgctcctgcatcaaacgctgtttgagctgacggccaccaacgatatcaccgtcctgccccaccagaggtgaggtggaaggctcaaagattacggacagggtcggcggaccgatctcgatcgggggtagctcaaccggcttgtccggatcagtgtagacatcaccgatatcggttctgtcgacaccgacgactgcaccgatatcaccggcgacgacctcatcgcactccttacggcccagatagtcaaaagtaaagagctgcttcacctgggcagtggtgcgggaaccgtcgtttttcacgacgaggatcttatcgttttggtggatggtaccggagtacacacggccgacaccgattctgcccacgtagtctgagtggtcgatcgtgacaacctgcatcgcaagcgggccgtcaggatccacatcgggggcgggcatatcgttaacgatcatatcgagcatcgggtacatgtccatgttgccgtcgtccggcttcaggcgagcatagccgttgaccgcggaagcgtagatcacgtggtccatcgtgaactcgatctgctcgtcggaggcgcccagatccatcatcaggtcgatcgagtcatccatcgccttctcagggttggcgccctcacggtcgatcttgttgataacgagcatgatagcgaggctcgcatcgattgcgtggcgcaggacaaagcgggtctgcggcatcggaccttcagcggcatcgaccaagagcagcgcgccgtcagccatcttgaggacacgctcgacctcgccaccgaagtcagcgtggccaggcgtatcgatcacattgatcttgatgcctttatactcgatcgagatattctttgaaaggatcgtgatgccacgctcacgctcctgagcgttggaatcaaggacacggtcctgaacttcttggttcgctctgaaggcatcggtggccttcaggagtttgtcaacgagcgttgtcttaccgtggtcgacatgcgcaatgatagcaatatttctgatttgcttttgaagcatatatcccttccatatttactgcagatagctcattcgttatacagcagtcaaaaatatgtcaccgtctatctatccacacctgcaaatatagtggaagaaaaaacgctgtgtgtgtagaaagtggactcttccattgaattttcggtcttggaagagctaatgcagctacaggaggtcatcgagctcgcctgcaggggccggatcggtccactggaacgcatcccctcggcccctatagagcgagtacgcagagtacgtgtggtagccgacttcgccaaattcgagcagaatcgcatcctgataggcaccttcgtcatccgccaccgcgccctcatagacaagcgcgtaacgctggggtaccccgatgccggctcttttgtctcctttagatctcttcagattctgcacgcaggtgtgcgccccttcgatgcacgcttcaattccatcatcggagaactgataggagaccatatggccttgagggtcctgcaccgcgagcagtaccggcacttccttgccatccgcgagcaggtcaaacacctgtcccatcaggttacaggagagcgcatcgagctctggcgacactccatcttttctctccatcacgaacctcatagcctcaatagtgcactgtatagaaacccagatcgcctctcctgagggtacgggtctgttcgatcaccaagccgtcctggtcatagctcaggcagttgtatgccatcgccggtcttcccgcttccatacccaagagccgggcttcctttgcatcgagctccacgatctccaagtgctcagctgttgcatcgaccactttcccgtagaacccaaacacctcatagagtgagaagacagagatattgatcccctcgagacgggggaaccgcatgagcggcacgaccgtgcgctcataggagagcggcgtcttgttgacgctattcacccttcggatcacgtagagcggatcatggacatcgatcgagaagagccgggcataccagggtcctgcctcccgcttctcatgcgagaggatcctgacgctcggctgcgcaccttcggcgatcgtactctggcggaagctcctcccgtcgccgacatccaaggtgccgagctgatccgcatcgacaaagacccccttgccttgggcccgtctcacaagcccttcgtcttcgagcgctgcataggcattgcgtacggtctggcatgtagtaccaaactcctgcgccaactcatgctcagagggcagcatagtccctacgggatagtcctcatcctcgattttagtgcgaatagcttcccgcagctgctggtaacgtggcatgtgggtatctgtatcagccatttccaatcacccgctccggtattcgttttcctcgggcaaggcccgattgacgcgcatagaagctatacatatccggccgaatgaccgccttgaagtattcaacacacctcaagtcttcctgcttggatacgccggtctggaaatagacgggggtcccttccacaatctgcagatatgttgcctcttgagcatcggcccgcgtgatagagagctttacttccccatggggcagatccacatggtagtgttcgcgcaacgtgtcgacaagggacacatccgtgaagtcatactccgagatgccggggcagactgcagtgttgaggtacaccgtctcgatcatgcagggcttgttgtcgatcttcctcaaacgtctcagctcgaagatagggtcggcgaccttaagcttgagcttgcgtgctacatgctcgtctgccacttcctcacgggcgtagatcacctgggaactcggcactttgtcagccgcgcgcaccgtgtcggaaaagccgttgtagccccggcaatttgactgtgggcgcctcatcgcgacataggtccccgatcctccacggctctccaacacgtgcaggctgatcagatttttgagggccgccctcagggccgttctggagataccccaagctccacagagatctcgttcggcaggcagcttatcgccttccttgaggtggtgctgtgcaagatacgcaaggatattctcatatgccatatctgagggagcgatattctgtgtatccatagtgttactttctgttggtcttctttaaaagcttagcgtatccagcgcgaaattttgccgcagtcactccagcggcatcgcgggccggcaccacgccgtactcgtcggagaccaaaaatacctcctgtgcctcaatacttccctccaggtactgtgatgccagctcatggaccctaagcacggccatccctagcgtcttggccaagtcttcaatcagcgaagcggcaccggagggacgctcatcaggttccgcccccataaggagggtcccgtcccgctgcacgacccagatggtctcaggcgcgatcctcgtctcttcaaactccatgcgggacttgagcgcgcggattgcgagctcacgcgccccggtgtcgtcgagcggcttgtaggggccgactgacatcgccgcctgtcccctatcgtcgacgacgatcatcaatacaccctcaggattgtcgtacgagccgtcctcaagggtccactcaatgtgctgttttgtccactgcagcagtgccccctggagcggcacccctcccagacgcctgctcccaagtgcccgcatatgccgattgagcagcggaagcgcctgatggtacaggcgccagcgacacacgagcaccggtttccccatatggaaatcctttgggatcgtcgcggtacttctgacattggtattgtgtgaggtatgttcaggcattcgataactcctctatgatttgactcgcatagagcttacaactccgaaagttcttacaagtctagaatgtttttcacacagtctcagcacgcacacacagaattgctccaaaaagagaggcgaggctttacggtgacagagccactcaaaggacgtttcgcgccaaccccctcagggcgcatgcatgccggtaatatatgttctgccctactcacctggctttctatacgctcgcagcacgggacctgcgtgctgcgcatcgaagacctcgacccgagggctcaacgcccacctgtcgctgacctcctgatggaggatctcgactggctcgggcttacctgggatgaggggccctacttccaaagccaacgcactgaatattatgaagacgcagtcaacaaactgaccgacatggggctcacttacccctgtttctgcacccgctctgagctccatgccgcaaccgcgccccatatgtctgacggcacctacgtctatccggggacctgccgacacctcaagcctgcgcagcgtgcccaaaaggcagccacgcgccctcccgccacacggttgatcgtgcctgatgcagacgatccaaaagggacgatcacctttaccgatgaggtctacggaccgcagcgtgaggtcttggcaacgcagtgcggagactttctgatcaagcgctccgacggggtctttgcctatcagctcgccgtggtggtggatgacgggctgatgggggtcaccgaagtggtccgcggacacgatctgctcggttcctgtgcccgccagatctatctgcagcggctgcttggatatccccaacctcactacgcccacgttccgctgcttatgggaagccccaccagaaggctctccaagcgggacagagacctcgacatgggcgtcctgcgtgagcggttcggccgtccagagccgctcatcgtaaagctcgcatctctctttgggctggcacaaccgaatgagagactctcagtggaagacttaatcggacgcttctcgtgggccgctattcgagaacatcgtgcggatattgtagtcaatcccgagtttctttacacatagctcttgagatacaccctccaggtggggtatgatgctaaatcaccctcatggagagctgaccgagtggctgaaggtgctcgcctgctaagcgagtataggactcaaatcctatctggggttcaaatccccagctctccgccagaacctgctgagagccgcacattcctgtgcggctcttttcttaccttttgaatcgggcacctaactggcgcttatcttcacatttaaaaatctctacttgactcacagctcaagatggagcatcataactactgctttgcgccgttacctcagctggatagaggaactgactacgaatcagtctgtcataggttcgaatcctatacggcgcaccagagtattccggccccattctttggggcttcttattagctcagcttcctttcccattatgccagacggatcgcgccgccggctttgtcgaccgcgtagtaatcgaagggcacatcgttgaggtcaaggtaatccatcagatcgcagagcatacggtagggcgcacagacaaagaactgcgtgagcgcctcacagatccgctcctttgtaacccccagcacataggcggccgcatcgatactgagcggtttgatcagaatcgattgcttgtacaccggctggtcgtggatagcctcggtgagggcgccccaagagcgctcggatacgacgatgccggaaggtgtctccccaatgctgacacagcgctcctcatcgccttgatggatagtaaacgttgttgtgtgctgtttgagttggtccatggcgtctcctgtccttgcctgtaccctcactatagtacgattctgtgtctaactagaacatatgttcgtattttggagagactgtgaggaaagaccgagccttacagatggttgtgtatccctcataaaaaaaccggtgaccccaacaagtaccctgctgagatcagcttgccgagagcctcgatctatttgtgagcgtatagcctatttgacgggcttgatgacttccatatcgtgcatataggggcgcagtacctccggtacggtgatggagccatcctcgttctgatagttctccataatggctgccatcgttctgccaactgccaagccagagccgttcagcgtgtggaccaggcgggttcccttaaacttggaaggatcacggtacttgatgtttgcgcggcgtgcctgaaagtcccagcagttcgagcaggaggagatctccttgtagttgttgtagctcgggagccacacctcgaggtcgtagcacttggttgcgctgaagcctaagtcaccggtgcacaggttcacgacgtgatacggaagcttgagaagctgcaggcaacgctctgcctcacgcgtcatactctccagctcatccatggaattctcaggctttgagaacttgaccatctcgaccttgtcgaactcgtggacacggatgatgccacgggtgtcgcgaccggcggagccagcctcctcacggaagcagggggtgtaggcggtgtaccacagcggcagcttgcccccatcgagcacctcaccgcggtggatattggtgagcatgacttccgcggtcgggatcaggtacatgcctccactgacgtggtagagatcctggtcgaacttcggcagctggccggttccaaacagagaatcatagttggtgatcgcaggcggccaccactctttgaagccagcctcgatatgggtgtcaagaaaaaacgcaatcagtgcacgctccatcagggcgccggcgccaccgagcagtacaaagcgggtgcccgcaagcttgatgccacggtcaaagtcgagcatgccggtcgtcgggccgaggtcccagtgggccttcggtttgaaatcaaagtgggtcggctctccccagcgtcggacctcagggttgtcggagtcatcgacgccgtacggtacagtcttatgcggaatgttggggatagtggcaataaggtcaaagagatccttctcgacttgtgcacgcttgtcgttgagctcctgaatgtgcttcttgtgggtagctaccttctccttcgcctcctcagcctcatccttctttccatcacggagtagcttgccgatctgctttgagatgctgttgcgctcggcctggagctgttcaacttcagcgatgacggagtggcgctcttcgtcgagctcaaagaacttctcgcggtcccagcggacgttttggcgcgacgcgcaggacttatcgacaatatcggggttctccctcacaaacttgatatcaagcatcgatgtgattcctctactttctttttgtaaacgtttcaaacttttaggaactacatgcaacaacttatagtagagactaacaagctccactcaagtcactcaagtatatacttgactctggtccattctcggtatgtacagaaaggtacagacaatggctgcggttggtggttttttcaattggctctttaatacgcgcccaggcgtcatcaccctggtcgtcggtggtatcctgttcttcttgctcattgcgtatctgctcgaacggaaaacaaagcagcaatactataaccacaagaagtctgaggacgattgggatctgctcgacgacgatgatgagaatgaagacgacaattagggggaaacgatgacttaattcccaatgatgtgccagaaaggcccaagcttacgtggcctttcgcgggccgagcaaggccgttaatcacgttcctagggaccttatcgtatgcagaaaaaaatccccgttggtcgccaacggggatttttacatctcttctggtgcgggtgaaaggacttgaaccttcatgagggaaccctcatacggacctgaaccgtacgcgtctgccaattccgccacacccgcgtgctgtggtattgtacctcacaatgacctataatagcaacactcaaaattctatacttttcacagaaagtcttgtgatctgttactgagccacataggttggtatagcacaggcggcaaaaggaatttaaacagtggcttttgatacacagggagagccttcagatactacgcaaacagtgacgcagggtacagtccctgctcaagcggatatgccgcttttattagggcgctatcgcgtcgtggagaaatgtgggcaaggcgggtttggacgcgtgctggtctgctgggatacgcggttgcaacgccgcgtagccatcaaggtgatccccttgagcctctccggcagtgaggaagccgaggcatcctcactgcgagaggcgcttcaggaagcccggacctccagcttgcttgcccatcccaatatcgttacagtccacgacttcgagagcgccggccgctatgcctatctcgttatggagtacatcgatgggctcaacctgcttgagctgctcaaacgggttgaagggggctgccttacctatgaggagtgcgcacacttgttgacctgcgtgggatcggcgcttcagtacgcccacgagaatggggtgcttcacctcgatatcaagccctccaacattatgattgaccgctccggcatcgcaaaactcaccgactttggtatgtcgacgctcgcctctgcggtgggctacggtggagcgcgcggcggcaccatcggctacatgccacctgagcagatcaacggccagctcgtcgatgagcggaccgacatcttttctttgggtgtcgtactgtggaccgcactgtgcggggtcaacccgtttgaggcagataccgctgaggaatctctcgctaaaatcttacagggacctgccgtttctctggcgcaggagaatctgaccctcaatcaggatatcgagctcgtgctggagaagtgcctggccattaatccccaggaccgctacagttcggtggaatccctcatgaatcacctgataccgctcttaggaatcccgggtgccggacaaaagtcattacagaatcttgtcttgcaggcacaggacgatgagcccaccgaagaggagtggagtgaggtctaccgggagaagaccccggtggccgaacgctttccctggctcgagccgctgatccttaaaagtacgagcgccttagtgaccggtctctgtatctttagtatcgcgccggtactcttcgcttcaaaggcctcgatcgccgccgccgttatcatcgcttccgcgcttgcggcgctctggccaccttcaggttttctatcctttctgctctctctgttagccgccttaggcatcgcccacttcaatcaggcgacgttgctcacgcttgtcgcagtcggagctttaggtatcacatggtggattgcatgcgggtcgacaactaaggcgtcaagtatcgcagcgctgttttcctgtgtggcacatatcccatctgcctcggccaacctgtgcggatttgtcttccgcccgctcacagcctttgtgagcagcgcatttgcgtgggtgctcagccagtttttttctttgagcctccagactggcttcaatgcacccgttgttgtcgacgccttgatggcccagctctcctcacgcgcgcagctgctttcacttgtgggatgcagccttgcgggccttgccgcaagtctgatcggacgcgaccgcggcggctggagggccaatatcgctcagctcagttgtgctggtataataatattctttcaagtgctcgctcatggagtggaaaatagcggcatatggtcggctcaagagatagtgggcctcgtatttgagatattcttaagtattgtcatgtgctttgttgcggccctgaagggccctgtgatagttgaatcagaagggtagttacgtatatgaatttcttaaacgtctttgaagagcgcatcgctgcgatctttaatgcgacaccggaaggctacaccgcccccttctccttcaaaaaacttgccaaacgtgcagctcgggagatggagaacgagacgtttgtgatagacggcgtggacaccgcgccaggcctctataccatcctcgtctctgcagacgacgatgcgtatatgcggccgctctatggcgatctcacctctgagatcgccaagttcattgagggccaggcaaataaaaaaggctatgtcttcaccggaaaacccctggttcgttttatggtagatccctcgctcaaaaagggaaaattttcggtcttcgctgagaacgtggatccacgctcgctcaaccgtctgcgtgaggaagaaaaggtgttcattggcggcatcgctcgcggcaatggtgcccaaccgatcccacgtacccctgaagcggcacctgccccacggcggccccaaacctctgaacgcttccccgaggctgcgaaggccaaggagaactcctatgcagggcttgatgtgatgccgagcaacgatgacctcgatctgtccgcttcagctgcaccgaatcctatcgtgcagcaaccctatccgggtccttcgcaggaaccctccccagttgttgccgggacgtcgacctctcgtccgcgttcggcagcattccgcgagccgagaacaaagttgcggccccaaccggccagacctgagtggcagacaggaaggtcctatgctccttcacgcgaagcctcacgccgccctgctcctgcacgcaaaaatgaggtcacctgcacactgcaggacatgtccaccgggcgtgtctacacggcatatgccccacagacgccgatcgggcgtgaaaaaaactccggtggcatagtactgcgtgaccccaatgtctcccgccatcacgcgatactttcctatgacgggagccactggtatatccaagacctagactcaacgaatggaaccttcgtcaacgatgctgaagttaccgcctgcgcgctcagcaatggggatatcatcaacatcggtctcgagaacctcgagttccgggagagctgatatgatcgatcttgtcttattcttcggccgcatcctcctcgtggtcctcctctacctcttcctcttcgccgccatgcgctccggtatcggcctagtgaaggggcagcgcaccgattcggcgatctggtgcatcgacgtggagaagggcgcgaaaagtctgcgcggccttcacatcgatatcctagggccggttgtcgtaggccgctctccctcttcggatattgtgatagatgaaccctttgtctccgcgacccacgcgcgcttttcgctgcaggggcccgcactggtacttgaggatctccaatcgaccaacggcacgatggtcaacgggcacatcattgcccaaccggtgacgctgcgcgatggggatgaagtacagatcggagacacaattctcaaggtcgggcgtcgatgagacttccctttaaacgcactgctccccgaacaaaacgtgtacgcaagcccaaaccggtgccttcgcccggacatgagccgctgccgatcactgggcgcaaagacgctgatgtagtcaccggacacagtgaccgcctgcggtggggctcacgctcagacgtcggcctcgtgcgcggacacaatgaagactctttcctggtgcaggcaccgctctttgccgtctgtgacggtatgggcggacacgctgccggagaagtggcaagcgcgatcgcggtacgcaccctctcacagctggcgccttccaccgcggatgacgcaatcttgggtggagccgtcgaagaggcgaactccgctatcattgagtcggcccaatccggcgaaggcaaagagggcatggggtgcacggccagcgcgattgtaatcgataaaaaccatatggcggtcgcccacgtgggtgactcccgcgtctacctgatgagcggcggcgtgctcgtacgcgtcacccatgaccactcctatgtggaggaattggtcgacgccgggcagatcaccaccgacgaggcacgggtccacccctcccgctccatcatcacccgcgcgctcgggtcagaccccgatatgtacgcggatcacttcacgctcgaggtccgcaccggggaccgcatcattatctgctccgatggactttcgagcatggtgcccgacagcagcattgagtcgatcgcggtatcctcggcgacccctcaggacgctgccgatgcgctgacctctgcggcgcttgaagcgggcggccacgacaacgtgaccgtagtcgtcgtcgatgtgactgacgacggctcggcggaaaagcgccaccagcaacgtaagaagcaggccctggtgtgggtcatcgcactcgcggccctcttcgcacttgcaatcgctatcggggccaacatgatcaactcttcctggtatctgggaaacaacgagggcacggtcggtatctatcagggcctcaactctgaggtcttcgggatcccactcaaccatctggtggaaaccacgtcggtcgaagtggcagatctgccggacgcaacccagagccaactggaacaggggatcagaaccgacgatgagaacagcgcgctggataccatcaattcctaccatgagcagattgacacccagcgctcacaggcctcatcggtggcctcagacgtcaaatccacaacctcgaaagaggaactcaacaacgattcacaaaacactgaagggacgaacaatctcgatacatcgcagcagagttcagcagcgacagagcaaccagaagggcgaggtgagtgatcatggcaagcgcacaggcaagagcgggcggtaaccgccgcaccacagagctggcgcttctgtttgccgcagcgattccggtcatcctcatctatgccatgtacctgatcaactcaggtaccccggttacgctgagctcgctcgcgatccccatcggcctcttcgtttcctttgccctcgcccacatcgcggttaggaagttggcgcccggtgcagatccggtcattctgccgatcgtctttctgctctcgggcatcggcatcacctttgtgacccggctcgcccccgatgcggcgaaaagccaggtgctgtggctcttcatctccgtgatcgcgatgatcgtcgtcttgttctgcgtcaagagcatcgatgacctggcacgctacaaatataccttcgggactttaggcatcatcttcctcatcgccccgatgatcatcggcaccgagcactacggctcaaagctctggatcgaattcggcggcttctcgttccaaccgggcgagctcgccaagatcctgctgatcatcttcttggcctgctatctcgccgagaaccgtgagctgctctcagcctcaaccagaaagcttgggccgctggccctcccgcaggcacgcatggtcttcccagtcttcgtgatgtgggggctgtccctgctcgtcgttatcttcgagcgcgacctcggttcggcgctgctcttcttcatcatctttgtcgttatgatctacaccgcaaccgggcgtttgagctacgttttcctgtccctcatcctgctcgccatcggctcggtattctgttaccacgccttcggccatgtacagacccgcgtcgatatttggctgaacccctgggcagacccgcagggtgacggctaccagattgtccagtccctctactcactagctgacggcggcttggtcggcaccggtatcggacgcggtcttgccgactatatcccgatcgtcgagagcgactttatcttctccgcaatcggcgaagagatgggcctgctcggcgcctccgcaatcctcatcgcctatatgctgttcgcggtcagaggctttgcgaccgctgcacgcgctaaatccgataactctgcattcatggcaaccggcctgacaactgcgatcgccttccaggccttcctgatcgtcgccggcgtcacgaagcttctgccgatgaccggtgttacccttcctttcatgagccagggcggctcttccctgctctcgagcttcatcgcagtcggtttgctgctcaagtgcggcgatgaggcgaccggcaaggagaaggaactggtcaccgcggccaccgaagcccagaacactaacccgggagtttccaacgtggtccagggcgaccatgcgcgtgcccggtttgagatgacaacaccggaatccggtgtgctgggacgcgttgccttgggcaagcgcctcaccgccctgatcacggtcttcaccctgctctttgcggtcctgatcggcaacctcacctacatccaagtggtgcgggcggagaccattcagagcatgccgagcaacaaccatacgattacaaagagcgcctacgtacagcgtggcgcaatcctcaccagcgatggagcgacgctcgctgagagcgttcagcaggctgacggtacttttgtccgcacgcatccggagggcaaccttgcgatccacacggtcggctacctctcctcgcagtatggctcgactggcatcgagaactcgatgaatgagacgctgacgggccacaccgactacacaacctggcaatccgccctctattcgctggcgggcgtcccacagccgggctcttcagtcgtgttgacgctcaactctcagatgcagcagatctgcgaggctgccctgaacggctggaacggtgccatcgtcgttattgagccctcaacaggcaaggtgttggcggaggcctcctccccctcatacgactacgacgatatcggggatctgctcagctccaacagcacggcgctcgtgaaccgtgcaaccgattcgctctacccacccggatcgacattcaaggtcctaacgctctcagccgcaatcgacaccggcacgtacaacatcaacgatatgatctccgctcagtcggagatgaatatcggcggcgctgcagtcacgaacttcgaccacaacaattacgggacggtcacgctcaagaaggctctctccatgtcctcgaacgttgcgttcggccaagtcggcgtcaaagtcggcgcacagaacctcgtggactacgctaaggcttttggctacggtatcgcaatcggccaggacttctacacgagcgcttccctcatgccggatcccagcgagatgactgggtgggagaccgcgtgggcagcctgcggccagccggtcgggcagcactcaagccctgcggggccacagacaaccgtgatgcagaatgcgctgcttacagctacaatcgccaacggcggcgtcacgatgaatccctacattgtggaccacgtgctctcgccgcaaggtgccactacgaccacgacacagccccgctcactcggccagccgatctccggcaaaaccgcgaatatcgtcgcggacgctatgctcggcgtcgtcgatgatggattcaccgcggcaggggcccgcatccccggcgtgaaggtcgccggcaagacaggcaccgccgaagtcggtggggcagtcagcaactcactctttatcggcttcgcgccgtatgattctccgaccctcgccgtctcaatctgccttgagggcaatggcagcgatatcgaaggatcagccgcgcgcatggggggaagcatcatccggcaatgtttggctgtgcaggcacagggggcgaccacatgagcgatattcgccgtatccgttcccatattgtgaagggcgggccacgcggccttgtacggtacattcagagccgtctcacgcggtatgtttatcatatcggactaatcttacatcagggggtacccacggagtgtatgggggttgttcatggcaaatagagttttcggtggccgctatgccgtacaggacaagatcggtacgggtggcatggcaacagtgtatcgaggcctcgatcaggtactcggccgtaccgtcgctatcaaaacaatgctgccgcagtacgcagctgacccctccttcgcggcacgcttcaaacaggaggcacaggcagcggcagcactccaaagcccctatatcgtctcggtctatgactggggtaaagatggtgacacctactacatcatcatggagtatctgcgcggcactgacctcaaaaacggaatcaggcgccacggggcgctcgactgccgtaaggtcgcgcagatcggttcacagatcgcgcaggcactggcggtagcccacaagcacgggatcatccaccgcgatatcaagccgcaaaacatcatggttcagccggatggcaacatcaaggtcatggacttcggcatcgcccactccaagaacagccacctgaccgcggacaactcagtgctcggaacggctcactacgtctctcccgagcagacgcagggcaaggagttgggaccgacctctgacctctactccctcggtatcgtgatgtacgaagctgcgaccggccgggtgccctttgacggcgacgatgcgatctccgtcgctatcaagcaagtcaaggagcagccaattccgccgagccaaatcaacccgaaggtcgatccaggcctcgaagccatcatcctgaagtgcatgcagaaaaacccggatgatcgtttccagaccgccgatgagctctaccacaccctgcgcgactatctcgcaggcagactgagtgccgtcgatgcggcaacccgggtgatgggtgaacccccgaccagacggctcaacaatgcgagcgccgataccacgcagcggctggggcgtacgacgccggtgaggccggttaagacgagctcacggtcacagcacagtgcagctaaagagaagaaggaaaaggcccatcgccgcaacatgatcatcggcatcattgttgccatcgctgcagtggcggccatcgcatttgccgcggtcaactatatcggtcagctcaatgcacagcaggtggtccccaacctggtaggacttagcgaagacgacgcacggaaaacgatcagtcagaccaacggcttcttcaacttgcaggtgacctatgactactccgactccgtcgatcagggaacggtcattgatcaggacccggacgcgggacgctcagagagccaaggcacgacgatcaccatccatgtttccaagggaaaggagccggcagcctcagttgaagtgcctgatctgacgaacctcacaccgaatgaggcgagtgctgcacttcagaaagtcggcttagtagcccaagcgggtgattcggtctactcgaacagcgtcgcggcaggccacatcgtctcacaggatacggccgctggcacaactgcaaaagcgggcgatacgattacctatcatctttccttgggtgtagagagcgtcacggtgcccaatgttgtgggacaaactgaagctgctgctaccgccgctattcgaaatgcgggcctcatcgcttcaagtaccgcaaccgaatacagcaatacggtgccggaaggatccgttatccgtcagtatccgggctcaggatcagtcaaccgtggcagcacgatcacccttacgatctccaaaggaccggagcctcaacagaacaacaacaaggacaacaacacggacaacaccattacttccggtaacaacacaaacaccggtggcaatactagtggtcaacagagcagtcagggtcggggcaaccagtcagcgccgtcaggaactggatctggctcttcgtcaggttccagctcaagcaccaacggtaacaccggcggtagcggacagtcctcaggcaccaacaacagcacttcgggaaacaacagctgagggattcgggacgagcccaaaaagttggagaacctagaccgctacgtccagaagtgttacctctccaggattatgggtgcacccccgattccgtactgattggttacgtggctgtgcgcagatgcatgcagccacgttttttacccgtcatccccaaagcctcaataactagtattgtttctgaactgtgtcgatatcagcaatgatcaccgcgcgcccagagggtgaatgctgccccattccattgaaggccaccatccagaaccattccgggcacacagctcgagccatccgaacgatcggatatacttgtccctgaaccaacagcgcctctctcatgaacaagaccacatcaagtgtgatctctatatctctcatgctgtgaacatgggagcgtccaaagtatcacatgagctaaaaacgacggcaaagcagcgagaaagacagacagagccagcggtagcggtcccttcacggctgactgtcggtgcagcttggcagcacccaaaagatctatagaggcacactgagcgatgtgcagagccaacgataatcaaaaagcctagcagcaccacaatcgctgccactaggctttgtattatctggtgcccccagtcggattcgaaccaacgacaccgggtttaggaaacccgtgctctatcccctgagctatgggggcaatagcgtacgtattgtataccactcctacgctgtgtgttgaatcttatggctcatccgtagttttcttcttacgaaatctatcaaagaagctcggacgttctgctaactcacggttgcgcttgtcgatgatcgcattcatctgcttttcagtcattgcccacaccttatcgttgtaatactttctcagcttgtggaggcgggcaaaatcgactacgaagccgccgataacgccgacataggcgatgatcagggtgacgatcgcagccattccccagaagcttccgagatcgtattgggactccgggaagaccagaacgatgagccaggagatcaacgtgcagatcaggccaccgatgatcaatgccaaagagacccggtggttcttcttgtacgtcggatcagcctgcagcagtgcctgggaagccagcgatcgtctgtcttcctcatcacgctccttctgacgtgcggcgcgcttctcctctttcgtcatctgtaccggtgctttctgaggggcagacttcttgccgtgagagattgtctcctcatgcacgcctgccgccttctggcgggttggccgggcccgggcgatcgagcgtcgctcaaatcctgaagaggatccttcgtcgttctctttggtgccctgtccggccttcgccttctgctgcacgcgttggttttcctgcgcctcgttacgggcgccggtgatgatatcgtgtaaagacattaacgctccttcatgggcgcaaagggttcaccacagatcagttcatacgcttcgcggtagcgcttggcggtaccgtcgataacgtcctgggggagcactggaggctcgcctttcatgccccagttgttcttgagccagtcacgggcgtactgcttgtcatagctcggctgctcgtgaccctcctggtacccctttgcgggccagaagcggctggaatcaggggtcaggcactcgtcgatcagggtgagcttaccgtcaataaatccgaactcgaacttggtatcggcgatgatgatgccacgggtcagggcatactctgctgcagccttatagatcttgagggaagcgccacgcagctgttccgctacgtcctcacccacgatctgcacgcagcgctcgaaggagatgttctcatcgtggtctcccaccgctgccttggtggacggggtgaagagcggttcgggaagcttgctggcctcgaccaggccctcaggcagcttgatgccgcagacggtgcgattccggtcgtaggtctttttaccggaacccgtgaggtagccgcgcacaatgcactcgatggggatcgtcttggctttcttcacgagcatggagcgcccggccccgatgaacccttatagggagcaactctttcggtagatcattggggcgctacagagatcatatgattcggcataggtccttaaaagcggttgaacaaaagcagagattcgcgtcagatctcacccttatagggtggatctcgcttcggcagaatgtaatcaaaagcaactgatgcgatcgcttgccaccatcagagcgtatcaccaaatcgtaaatgtcagtactgtacctgagaggtcggacgcaattgcatatgctcacctgagacctcatttcatcgcttgtgcaatatcgtagacatacttgaagtatagtgtcagaaggcatctaccacttgcagaggacccttccaaacggaatactccctaaattctaatggttggtgggcgccggtcggcttctcgttgattagtccgccgcgatttccacacgtccaattcgtccctccctgtcaagtgtacggtctcatcctttccaaagctctgatccacacgtgacgtgtaccgtggtgccggtcggagatctcttgggtcacgagctaagccaacgcccaaaccacctgactccatctacgactcgcgtcggacctcagaagatgactgaacgttctggaaatctccttagcgataccatacgagtgtacggtgacggagatcagcacatcgtgtgatcttgggcgattgcgaccagcacccacccaccggagggtggtgttagcgcatcgcggtggacatgagttaatgactgccgcgcagccaggtccgcgatcgacttctgcgattcagatgttgggcttcgggggtgcatattggtgaatcctgaggcttgtacaggacccttatctgagaagagctgccctgctgagggtcacaaggctcttcacgagccacccaaggtcggtcttctttggctgaaacggcgtttgccattctccagacgggagagctggaagcatggctacgacgagacggaaaggtccgcgcacttcgattggtccacgacactccaagtgctgcgcatcggtgggatagaccatctctgcatcgcctactaccgtcgacttgcacgcaaatgacgcggtgtccgctaagttcgtgacggccaatatagtgtgacggccgtcgggtttgatcttccttctccatgaggtggcccagatcaatcgagggttctccccagctgcccgatctaatcgttccctgagcgccggtccgggcagagagatcccatttctgatctggcgagctgtcttggtatcttgtcgatggactgcgccaaacgaccgggagaacagaaaacgatgatacaggagaggatcaccgacaccactgccgaatcaggaaatagctgtaggaagtgctgcggaaattagcatcggagtggtcagggttaaaagtccgtcagggcccacagggccacgtaatagacggttccgacgtctcgccccagtaggcagattgatctggtaccgcatgagccagccccggtgacagtcagtactgatgttgacaacgcagcatgggcgctggctggtgactttcacctactcctcgcacatctttacttcctagccattgtacgagaccctcttcacgccttccccacctggttcccttttctgttccctggccgagcttgttttttgttcgcagcgacgatggagtttggagcacccatcgacgcataactcagggatcgagagctcccaacgccagtcctctaatactttttggaggcgtcctatgtggcagtcgcatcgccagcggctagcatattctgtgggtgtatatgctgaaattgctgttccccacctcacccaagacaatcagaaacaccagagcaatcaccgagtggtagccgcggaaaggcgcgtcatgcgacttgccatagttaggtgctatgttcgtatggggcggagtgtatgatatgaggggctcgtcgtttcgcatcttgagcagacacgccccacaatggtgcggagcgcgtctgatacgttttcagtatctcaattttgcaacgggcccaagtcttattaccatacgcttttttgctctctattcttatcttgtcatgcggtgcctcaaagcggtgatccgacaccgtgggaccagtatagagccagcggggattgtctgggtcgtcacgagctttgcacgcaagttttcacgtgagagtcgatcgtacgatcataaccctcgaagtcatagcccaaaaccttttaaccagctccattctgtgtagacacggccaggatagcgggcaagggtagtcaagcagcttgaactcagagcgggtcaggtctacttccttgcttccacggtcaccttgtgccggagatatcgataacgagatcgccgaagtcgagcactcgagctggctctcaacctcggtttgtggggcacggcggaaagaggcaagtgctggtactggatccaacgcgcgaacgaggcttcacggcggtggttttgagaagggcggcttgatccagttgatctgtcattggtatagcggcgcccagttcaagcccgtgagacggtcctccaaccgccttttgaggcagcattgatgccgcagacggtgcgattccggtcgtaggtctttttaccggaacccgtgaggtagccgcgcacaatgcactcgatggggatcgtcttggctttcttcacgagcatggagcgcccggccagataacccttatagggagcaaactctttcggtagatccttggggtcgatagagatcatatgattcggcataaggtccttaaagcggttgaaccaaaacgcagagattcgcgtcagaatctcacccttataggggatctcgctcggcagaatgtaatcaaagcaactgatgcgatcgcttgccaccatcagcagcgtatcaccacaatcgtaaatgtcacgtactttaccctgagagtccggacgcaattgcatattgctcaccttgagacctcatttcatcgcttgtgcatatcggtaagacatacttgagtatagctgctcagaagaccttcctgcacgtgcagatgagaccttccaaaggaatatccctcaaatctgatggttgtgggacgccggctgcttctcttgattcagtgggatccgaagcgtgaaggtggttccttttccaagctctgattccacagtgatcgtaccgttgtgccggtcgatgatctctttggtcacagctaagccaacgcccaaaccacctgactccatctcacgactcgcgtcggacctccagaaccgactgaacgttctgggaagatcttccttagcgataccgataccagtgtcggtgacggagatcagcacatcgctgtgatcttgggcgattgcgaccagcacccacccaccggagggggtgtagcgcatcgcgttggacatgaggttaatgactgcctgctgcagcaggtccggatcgacttctgcgatcagctgtttgccgggtgcctcattggtgaatctgagctgcaggcccttatcctggaagagctgctcctgagaggtcacaaggctcttcacgagccacaccaggtcggtcttcttcggcctgaacggggttttgccattctccagacgggagagctgaagcatggctccgacgagacgggaaagccgccgcacttcgttgtccacgacctccaagtgctgcgcatcggtgggatagaccccatcctgcatcgcctctaccgtcgcctgcatcgccatgagcggtgtccgcagttcgtgcgccacatcgctcgtgaggcgccgttcgtgtttgatgtccttctccactgaggtggccatatcatcgaaggtctcccccagctgcccgatctcatcgttccccttgagaccggtccgggcagagagatccccatttctgatctggcgagctgtcttggttatcttgtcgataggacgcgccaacgaccgggagaacagaaaaccgatgatacaggagaggatcaccgacaccactgccgcaatcagaatagcggtgtaggaattgctgcggaaattcgcatcagcatgggttaaaagtccgtcaggccccagggcccgtaaatagacggttccgaccgtctcgcccgtaggcagattgatctgcgcatccacggtacggtcattgacaaccgcaggagctggctgtgatccaccctcctctgcattccatccgccatcgtagagaacatcgcctcggctgttctgtacctggacagcgacgtctgaggaggtatttgatgccatcgacgcataactcagggcatcggagctccacccgccgtcctcctcatactttttggagagcgttgtggcagtcgcatccgccaggctctgcatattctgttgggtgtatgactgaaattgctgttcccacacctcacccaagacaatcagaaacaccagcgcacacatcaccgaggtagccgcgaaggcgccggtcatgcgctttgcatagcttaggtgctgcttcgtatgggggcggatagtattgaatgaggctctgtcgttcgcatcttgagcagacacgcccccatggtcggaggcgcgtctgatacgttttcctatctcaaattttgcacgggccacaagctcttatccctacgcctttttctgctctctattcttattcttgtccattgccggtgcctcaaagcggtatccgacaccgtggacagtatagagccagcggggatgtctcgggtcgtcaccgagctttgcacgcaagtttttcacgtgagagtcgatcgtacgctcataaccctcgaagtcatagcccaaaaccttttcaaccagttccattctggtgtagacacggccaggatagcgggcaagggtagcaagcagcttgaactcagaggcggtcaggtctacttccttgccttccacggtcaccttgtggccggagatatcgataacgagatcgccgaagtcgagcacctcgagctggctttcaacctcggtgtgggcacggcggagcaatgctctgacacgcgcgacgagctcacggggtgagaacggcttgatcagatagtcatcggcgcccagctcaagcccgatgatacggtcctccacctcgccttttgcggtcagcatgatgatcggcacattcgaggtctcacggatcgcgcggcagacgcgctcgccggaaagcttcggaagcatcaggtctaggatgatcaggtcgaaggggtgtctgtcaaactcttctacagcgctctgaccatcgccgacgccgcgcacaatgtagttctcacgctcgagataagccgcaaccgcatcgcgaatcgctttatcgtcctctaccaatagaattttcttttcgtttgaagccatagggactccctcatatacgtaagtgaaaagcttagatacgatgtatagtctaccccaaaagtgagtttaatatggagatttgttaaaggtgaaatgtccgtacgctcacggaggcgggatagcctgtcgagggatccttaaccgtcgagaaggtcacaaaggtgtcacagtggccaacgcgcgcagggtattccccgaaatcgagcgcacggttcaccgcagagataacccgatatctctggttgtcggtgtcgatcacatagtaagaggtgcgagctttcacaatataggagtggtctttccccgcaactcccgccatcggctcacggttgataacgataaaggggccattgccgtgcccgatgtaggttcccatccgggaaagcaggctcccctcctcgtaggaagcctcgatcgagaaggcaaactcatccccgatacgcgttacgctcatcggtctcaccgattgaggcagtaccagctgatctatttgggtgttgagatcatcgcccaacgagtaggccacaataccgtaaaaggctcctttatcgttgttaactctgggaacaagggtcacgacaccgtcagagatagtcggagcgcaaccgaaccgcccctgggactccaccacattttgggcctgtgagtcgccagttttccagaggtagcagttggaggaggaacgggattgattgccactggtagcgggctgcacctgccagatcacctttgacctggaaacggcaagcgccggcggatcccaattagaatctgcctcccacagcgtggagggggacccagtcagcttgccatcggaaaaggactgcccatagagcttccagtcatgcgagataaggttgagctcaacccaggcatacgcgtcatccgagcaccgagcatcaaagatctcatagtttgagccatgcgtgatgggcgccggcactaccacctgctggtttccattgtcgatattgaacgcggaggctgtgaccatcggactcgcttttgctccagcagtgatgcaggggacccacgtcccctcccccggtctcaatacactgcccaggctcagggtataggagctggtcggcgtataatccgtttcgtcgtattcgtagctctccagtacattgttgcctgactgctgatccaccacgaccgggtcgctattcgtctgtttgttggtattcgtacagccggaaagcagatgcacagttcctatggcagcaccgactgcagcgctacctttaaggaaaccgcggcgtgttaacggatggattgtacgcttcatgctttccgtgcttactgttgagcgatctcagcctgagcctgtttcagcgcgcgggagagttgatccgcgcacgaggtgggacggggtccacaggtattgccggctaagatcgatgctacgcggtcggtcggctgacctttgatcagcttgccaatagctttgaggttaccgttgcagcctccctcaaggctcacctgctcgatggttttcccatcatcgctcaaatcaacatgaatcgcataggagcaaacaccatgcggcgtaaaatcaaaatgcttcatcgctaatctccgtcaaaatccaactgatcgagacggtcgaatacgacgcctatacgtttcaggaagccccacggatcaaagatagtgtcgagttgttcctttgtgagcgtgcattcgggatccgccaatagtttctctttgaagcttgtacctgttttgcactgctggacttcatgccatgtatccattgcgttgcgttgcacaatcttgtaggcatcctcacggttgataccagtgttgaccagcgccagcaacaccttggaagagtagatgagtccacgggtcttgttgaggtttgcaagcatctgctgcggatacagaatgaggccgtcgacaatgcggatcaggcactggaacatgtggtcaagggcgataaagctgtctgcctgcgccacacgctcagctgaggagtgggagatatcccgctcgtgccacagcgccacattgtcgaaggctacctgtgcatttgccttcaccacgcgggcgaggccgcagactttttcagcggtgatcgggttgcgcttatggggcattgcggaggaacctttctgtcctttcttgaagggctcctcggcctcgagggtgtcagtgcgctggaggtttctgatctcggtggcgatacgctcgcaggttgcggcggtcgtcgccaggacgccggccagataagcatggtgatcacggctgatcacctgtgtggagagcggatcattcttaaggccgaggtgctcgcagacatactgctcgactctcggatcaatggagctgtaggtacccaccgctcctgagatagcaccgaggctcacattctcgcgcgcgtcctttaggcgctggagatcgcggtaaagctcccaggcccagctaccgaacttcagcccgaacgtcatcggctccgcatggataccgtgggtcctaccgacgcagagcgtgttcttctcctcaaaggcacggcgcctgcagatctttcctagctttgtgcagtcatcgatcaggatatcggtcgcctgtacgagctggtagcacagggcggtgtcacccagatctgagctggtcataccgtaatggatccagcgggagggtttctcatggtcctcagggatgtccctgtcgacgtaggaccccatattggtgaggaaggcaatcacatcgtggttggtcaccgtttcgatctcagctacttcatcgacgtcgaacgaagcgtgatcgcggatccacttcgcctcttctttcgttatcccaatctctcccagttcggcttgcgcctcacaggcaaggacttcgatctcctgccaaatacggtatttgttctcaagagaaaaaatgcggcctatttccgggcgcgtgtagcgatcaatcatcgaggacttccctttcctgaggctatcccatgctcttttatagtagcgctcctgcacaacacgagagactagcagcccgtatagaagaaaaagcacagactgcagccgaacagaagggcagcgttcaaatcacgggcagatgcctgattcaaacgctgccacagacgctctatatatgatgaggcaatacccactacttctgtgaggagaggtcatccagtacctcagaatctttgtcaaagcgctcctttgcctcgctgagctgctgctctaccgctttgtcgccggttgcaccataggtgttgcgcacataggcgattcccctcggatccagatcgcgggtgacgtcttcttcgaagagcggactcgccttcttaaattcttcaagtgtcagatcctcaaggcccttgtggtgctgctcacagtagaggaccaactcgcctacgatgcggtgcgcctctctgaaggggaggcctttctttgcgagataatcagccacatccgtcgcagcggtgaatccgagttttgcctgtctcagcattgcttcctcattgacctgcatcgtgtcgagcataccggcgaccacgcgggtgcaatcggagagggtatgcgccgcatcgagcggtccctctttgcactcctgcaggtccttgttgtaggccagcggcagacctttcatagtagtcaacagcgccatcaggtctccatagactctgccggtcttaccacgggtcagctcagcaaagtcaggattcttcttctggggcatgatcgaggaaccggttgagtagctgtcagagagcgtgatgaagccaaactccgtggagctccacagcacgatctcctcgcagaggcgggagaggtgcatcatagagacgctgcaagcgtactcaagatccaagagataatctctatcagacaccgcatccatcgagttgggtgcggtgtgcgcaaagcctaggagctcactcgtgtaggctctatccaaagggtacgtggtaccggctaaggctgctgcgcccaagggattggtatccgccgcatcgtaggcctcgtggagccgcttgaagtcacgggtgaacatccaataataggcgagtacgtggtgggagaactgaacaggctgtgcgtgctgcaggtgggtgtagcctggcataacgacaccctgatacttctctgcctggttgagcaacgttgtcctcaggataagattggcatggagcagctcaacacagaggtctttcgcgagcaagcggatatcgaccgcaacctgatcgttgcgggagcggccagtgtgcaggcgctcccccggagcaccgatctcctgagtcagctcagattcgactgccatgtggatgtcttcgtcgtccacgttccacttgaaggtaccatctttgattgactgggcaatatgcaccaacccttgatcgatcgcctgttgatcctccttggagataataccttgctttgcgagcatcttcgcatgcgctcgggaggctttgatatcctgctgcgccattgctttatcgatctccagcgaggcaccaaactcctgcgtgaatgcatcgacaccttttgtaaacctaccgccccatagcgccatgccgcctgtcctttctgatcagtgtgtttcctcaacacaccagattacaacataaaagagaccccacatctcaggtgtacctgaagatgtggagtcgttgaatcttcaatcagtcgctcagcagcaaccttacttgtcctgattgagctcagaacctgggccctggatacgagaccaggtcttggactgcaggccgtggatcttgatgaagccatcggatgcggtcttatcaaacgtgtcaccctcatcgtaggtagccagatggtaatcatagaggctgtagggtgaacgcaggccgtcgacgaagatgccacccttgcacagcttgatgcgaatatcgcccgtcacatacttctgcgtataggcgttgtaggcatcgattgcctcacggttctgtgaataccagaagccacggtacaccgtggaagcccactcaacatccagcttggccttctgacgaagggtctcagcgtcgagacagagcgtctcgagggaatggtgtgcctcaaggagcagcattgcgcccgggcactcatagcactcacggctcttgataccgacaacacggtcctcgatcatatcgatacggccaaagccgttgcgtccggcgatctcgtccgcctcggtgatgcaatcaagcagggacatcctcttaccgttgattgaggttggcacgccgccctcaaagccgatcacaacggtctccggatctgcggggcagttctcaggattctcagtcatagtccagatgtccgcaggcggctcgttccaggtatcctcaaggacgccacactcgatagcgcggccccacaggttgtcatcgatagagtatggcttgtcgtggctcgtcggtacgggtacaccgtgctccttcgcccacttcatctcagagtcacgagtggtcagatcccaatcacggaccggagccaggatcttaagtgaaggatcgagggcacggatgcaggtctcgaagcggacctggtcgttacccttgccggtgcagccgtgcgcaatgtacgtagcgccgtactggtgggcgatgtctaccaggtactttgcgatgatagggcgtgagagcgcggaaagcagcgggtagatcccctcatacttgccgtttgcccagatctcttttgagaggatagtgtcagcgtactctttacgcatatctactgcctcagaggcgatagcgcccatgtcaagcgccttctgcttgatccagctcaggtccttctcatcctgtccaacgttgccgcagattgcgataacatccatgttcttctcaacctggagccacttgacgatcacagaagtatcgaggccgccggaatacgcaagaacaactctctctttgtccgccataactaaaaccctcctgaaggtttgtcacaacaacgccttcgatgcatgctttcttgacatgcattcacatggagccaattattcagccacgcgatataggtattgtctttttttaacaatagaagatggaataaccactattgagtggttcgtcgtgcgtggcactctatcgcagcaagagatcgagtcgccatcctatacatgaacatacgcttcattagcgtgcctcctctaagcgagtggcgcggaccctattatccgcggctgcagcttgcactggtagtgcagttcacatggtttgcactataggagactttgaaggtctggctacaaaaaggctgaaatctatacggtattgaaacaaatggtccaaaaatgcctacacatgcatgtgtgcatagcatcgaagattcaggcctggtgcaatgcgtccgccgtgacaagggtctcggtttctttaaatgctgttacctgttgcagacaggaggctctgtagatttgaattttggaatccgttcgcaaagatttggtccgcagatgagagatatcgatcaagctgctgatattgctgaatagccgcatctttcgcagtattcagaaatgaaatatgcgcagagggtgtcgcctgtatctcgttgatgatattttccagctcagcgtgcacaccatcaatctgtgccccgacggccgccagatcgctgtagctggttgttccatcttggagagactgtttgagctgcggatactcatcgatgatgggctggatcccattttcgaagagctcattttcagaacttaaaatcgtctgcgctgttgtgacatcgctgccgattccgggaagcgcagcgccaaagcgccacacccatccttgggtctcttgcctcagggaatcagcatcgttactcaaactaaccagattattgtaggctgcatcaaaattggaatttctgatattgctctgaagctctgccgcttcatctctttgtttgctcatgatatcgctgatacggttagctgtttggaacacaccgaaaccaatgaccaggattgcgatgagcagtagggccaagacggtaaacaggacatagtgatggtgctggtgcctggcgctggcagagactttagggtcctgataatcgatcggcaagggagattgtacctgctcaggtgcggtatacggacgtctgactgtcgttgtttcgcgtttaaagcggtgcggagctgtttggttcagctgcttcgaagcacggtcatctgtatcgctcataatggttcctctaaaaaagcagaccggaacactacatccctggtctgcctcctgtttttctggtgcgccgttagggatttgaaccctagaccttgggattaaaagtcccctgctctgccaactgagctaacggcgcaagtatcgacgccttttgacgctcactcattgtataccaaaacacgcgttactcccagatccactgtccatccacaaaaattggagccacatcaccctgcttggtgatgccgtcaatcttgaggtcatcgcttctgatcatgaagtccacgtgcgtgtggctctggttcatgccggctttgatcaggccctttgggctcatatcgtagccgctttcgaagcagtcggggaaaccggcacccaaggccaggcggcaactcgcaatctcatcgtacagtgtatcgtagaagaggattcccttttcatggatcggggtatcctcgctgatcagggcacactcccccaaccgacgcgcattttcatcggtctcaagaatgtggccaaggacgtctctgccggttgcctcgctgaagttcacaaccttttaccgtctttgaagcgaaactagaaatctcgaatcatcgagctatcgcggaccagcgacagcgttgcatgtccaattccgtcggcgcgcatacggtcaggtaaagagaaaacctcctctgtaaagatgttgggaaaataggctctaccggagactatacgagcagctccacctccccaaatgtgatgatcgatcatgctgaggagaaggtcagtgccatttgaagactgatggtggatacggtcaaagtgatgcaaatcgaggacatgcaggttcttttcaaacgcggcgttgtgagatctctcaaccctcttcggtgtcttccccatcggcctgaaaaacttcaagaatggccatccaaagacgagagagtaccccatcggcgctgcactgggaggaaacgcgctgggctcaggacctgatcggagcggcggcaatacacgaagtactgcgccaaaagctcatgccctcgtggaaggccttgagctgcatgtgggagctgcgggcagcaacggccgactctgcagtatcgatgcccttgaagatctctggatcctgtccctcgatggagaggaagcccgagccctgctcggcaagtgagttgagttggactttcctccactctgggaggttctcaaagtttaccaatggctcgttctgataggccatctgctcaatcgaatcatcgtgccacaacgcggccacgtgggaagcaccgcttgcataggcgacgttcacgatctcccgtgcgaagtccacacgctcaatcggacactcaaggacaagctcctgccccggttctagggtgacaccctgcagcacgagcagctttacgtatttctgtacatgggaccacagtaccttgaggcctgctgtacattcctcacgcgtcatggtaagcgatatggagttctctcttccatccaaagatataaagtgctagattgcaaaaagacgagggtcctgctcgccagtttgtgtacccatacagaaggtgcacgcttcacacagatctctcgctatccgatttggatcatccatatcggcttttgggaatacaatggcttttctccagaaggttctattcctcgccataagcgccgagctctcccaaaactggtcgtaggtggagcgcaggataccccgcatctggtaccactctgcaacatcctggacgccatgctctttcagaaaggctttgacttcggagtttcctgccagcggatattcagggataatgaagccttcgtggcgggcaacatcccaaatgagtgtttccgcggcttcaaaataggtcagatcatcgcgacagatctcttcggtaaggtttagaagctgctgtgaggaaacatttttaggaagttgaagtatgccttgcccatcaatccaggattccgtattttcaacgaaatccttaccgagatttacaagcatacgtggcatgagaaacttccacccttagagaaaaccctgagtacgggcccatgatcacactctggagcgggcgacgggaatcgaacccgcatgatcagcttgggaagctggcattctgccattgaattacgcccgcgaggagatttcattataccttaaccccactggattctcggatcttttgataaatagtcttgcccaagcgtccctgtcggggcctctcccttaggctaaattcctatctctagtgcatcagcccttcacacagccctatccgtaagagcacactcaagagcgatatctgtcatattgttggcttttcgcgtatccaggtcagtcagatctgttttctatgcttcacctccctgtccaaacctgtcacaaggaggtaaaccatgggccaacaaggacatgcttatgcacagccctatcggtgcaagcattaccgttattcaccgccgcgggatctcgcggccctcaaacgagggtatcacacgaagaatggctctttgaaccgatcacagggaatgcgacgtgcaggtatcatcctgatcctgatcgctgcggtgctctcactggtcgtgttccaacagacggcctatgcagaggaaggccaagtgaaatggacctgggacccaggttcactgctcagcgacattaggggtagcgatggatcccggggctattgcgctcaggcagaatgtaatgttccagcgggaacttttaaagaatggcactggatttccgatatggatgagcagacattgcggggtgatccccatggctttgcctggttgctctaccacgtctatccgcatacctcaaccttcggagacaaggaataccctcagagatcagcaatccatatctctcaggccgctatctggatgtatcagggcgacatgaaacaggaccgcacaatacccaaaaagcatatgaccgctgactgctccactgaggaagcccaggcagcctggcagcttgcgcaggaagcgcatacgcacgataaggaaagcggaccgtgggaccatgcggcaaagtactgggtttgtcccacgaattttgagcagagtatcgttgccatcccgccgaccggctcagtgaaaattacgaaaagcagcgggaatgctcagctgaccgccgataaccctgcctattctctgggaggggccgtcttcggcatctatagcgacgaaggcgcgacccaggaagtgagcagagccaccctggatgtaaatggtaccgctacggtctctgacctcggaacaggaacctattacgtcaaagagatcagtgcgccagccggttatggagtggacgagacggtccatagtgtagagatcaagtcaggcgatacagcagactgcaccgtcagtgatatgcccctctatggaaaaccggatatagccatagcaaagaaggatgaccagaccaatgatgcgactccccaaggcgatgcgtctctaaatgatgctcagttcaagatctccttctatgcaggcgccactgacaccaacaatcttcctgaaagcgcgaccaaaacctgggtcatgaagaccgacgacagtggaatgataaagctcgataatgaacacaaggtagagggtgacgacttctacaccttaaaggacggcaccgttgtcgtgccgctcggagtgatagccattgaggagaccaaagctcccggaggatatctcttacctgagaatccgcgtaccgctatcgcagtacagaccgatcaggcaaaagatggggtgattacccttcagactgccaactatcctgaacacgttatccatggaggcttggcagtgcagaaactcgatagcgaaagcgcaaaggacacaccgaagggcgctgcaacctttgagggcacgacctttgatattatcaatacctccaacaacgccgttagagtcgcaggaaaacaggtagagcctggcgccgttgctctgaccatcactgcggacaagaccggaagagcccaaaccgaagcggatgcgcttccctatggccactacactgtccaggagtcgcaggccggcaaaggatacctcaccaacagcgattggaagcaaaccgtcacgatcaaaacgaatggcaagatggaggagctgaaagaagataccgggtgcactgatgccgtcatccggggagatctttctctcatcaaagcgaatgcaaacacgcagcagcgtatgagtaagattcctttcaagatcacctcgaagaccaccggcgaatggcatatcgcaatcaccgatgagaacggtgtacttgatacctccgccggagcactctcccatatcaataagacaaactccaacgaccaagccgtcggtgaagacggtactgtcgatatcgataagctcgacagcgaagctgggatatggttcttcggttcatccaacgatacagatgctaacacgatcagtgacgaacgcggtgcactcccctatgacacctacacagtggaggagctcccctgccaaagcaacgctggaaagaagctcgtcacgctttctcttacgatcagacgcgacaactttgaggtacatctaggaaccgtaaacaatgagaatggaccgagcatccatactgaactcacttctgaagtgggcgagcacaccgttccccgcggcacggagactgtggtattggtagataccgtcacctactcaaacctgacgccgggtactacctacactttgacaggtaccttgatggacaaggctaccggtgagcctctttccggcatcgcacctcaaacaatcgagttcgtcccagaatccgaaaacggagagcaggaaatcaccttcatgattgaaaacgtccctgagacctatcatgagaccgtcgcgttcgagaaactgacccaggacggtaccgaagttgcgatccatacggatattgacgatgaggggcagactgtccacttctcgtcactgcatacgatagcaactcaggcggacggcgactcccatatggtaagcgcaggctcacagtgccatctggtggataccgtggaatataccggactgatccctcatgagacctacacccttaccgctacgcttcatctggtcggcgatgatggggaggacagcggtgctctgttggatgccggcggtaacgttatgacctttacccaggagtttgtcccggagaacgaaaatgggacctgtgaggtcccgatcaactatgataccacctcactcgctggcaaacatatcgttgtctttgagaaactgacccatcagggtaaaccggtcggaagccatgaggacatccacgataccggacagagcattgtcttcttagagcactcaaatatccccaatactggtgatatcgcgaactttccttggactgtcggccttcttggaagctgccttgcagccgtaggtggcatcaatctctacaagagaagatagcagccataaaaatcgagcagggggatcatatgtctccccctgctcgccctctgtcgtgttatgactcgcggatcaactcggtaaccaacgccacgatatcggccacttgatccccatcgacgttttcgttcacatcatccaacgtgtgggagtgcgcaggcaatccattctcatccatgcccatgatggtgaccgcccggatgtgcgtgcgtattgctgtcgtcgcgtcggtatccccataatcgtagggagcacggttcagcgaaagtccgagattcttagcaatctcagacagcatgcgcaccaaccggtgattggaatgctttgaggtgttggacccttcccgtgtcaataatgtcggggtacccgcaccgatacagtccaggttgataacgaaagcgccactgatatcttcacgatggttgcgcaagaaggactttataccaccatggtcaagctctgaacctcccgtcgcgacaaaccagatatcatgcgagatgagatcgtcatcgttcatcgagagaactgcgtcgcggagctcttcctcagtgacactcacggtatttttaggagctgcttcctgagcttcctcctgctgctgtggtgctgcagcggtgctctgtggttcaggtacagtttgtacgtcttgaacaacaggttgatgctcttcagaaaccggttcctgaacgtcgagctcataaccgcgtgtctccggcttgtcctcagattcttgctggccctcagactctacagtatggtcacgaaactcatctttcggagttgcacctcctttccacccgttgttcccacgcttagatctcttgtccttaccatccctgtcacccttgtgccgtccacgatcttggggctcctgtgtctctcgagcgatcttctcgagcgactgcggggtaataacgtcaaagcgatgggtgctgccagagggaattaccggctgcccgctaacaggcggatcatcaatcccctttgtctgggttctctcagcgaacggatcatacgatttcttggcaggatccggtacatcattcaggatagcttgacgcgttgcatccggaatctggggtgtgaaggaggatttaccccaattcggatcgtcgggcatctcaggctttgtgtattgcttagccttcatagattcagccttctgctgatcgatctcctttgacttctgctcagtatcgaaggattctaccggctcggtatccgtatgaaaccgtcgctctgtgtcaaaactaccgtccacgctctctgcaggaacatctgaagaagtcttagaggccccagaccttgtctgctgtatagcctcgttaattcttgagtgctgaccagaccggctgacttcaaaccctctatcggtcgcgtgctgtttatcttcgaggcggaccgcagaatcctgcttgcctgtacgaaggttgttggatgcagtctcttcggttggcatttcacggcccaccgtatagttctccggaatagtagacctgaaatcaagctcctgtgaggtctgctcgctaccagcgccaccggcggtcacgccgtcggtaccttcatccggttcctcatcccctactccagcagtttcatcggaaatctcttctgtttcggacaacgctttggattcaatgtccccagcagtacctgcctgcttctcctcttcggagaagtcagcttcggcgataggccttttggcgattggggtgtcgtcactctcgggctcggtatcgttttggaggtcagattctatttcatgagagcccttttcgtctgtctgtgttacagacggctcatcttctatctcagagtcaccctttgctgtctcttcgacttccccggtatcctcattctcatcagtccgatcctctgagacatcttcctcatgttcgcttgtatcctcagcagtgtcattcacctcaggtatctcttgctgagcggtcgactcttcattatcagatgcttccagctctgtggacgctgctccatccgaatcagacttcgagcgatcctttgaagctatcaatctatattcagcattgacggggacctttttgctgaccgcctcccaatcgcacggtatttcggcctgcgcagattgctcgtcaggtttctctgcgggtgcctcttcagcagctccatcggtgggtgcactctcatccgatgcggttccctccgtagaagcctcttgctcctcttcgtcagaagcttccgatggctcggggctcgcaggggtattcgcttcttcttcggactgagcgggttgttcttcatcctgcttcaccacaggagtcgattcctctgtttcttcatagtcagctggagaagtagcttcgctgtcatttgtttcttgtgaaacattctcatccatctgcccagtctcagactgactatcctcgtcctcggagggcagcttcacttccttgtctagggatgccagcgccgccattacacctgagtcatcaaccggagaggaattcttagcttcttcatcggtctcgcctgtaattttgtcaggctccgctttttgagttgtgtctgaaggttcatttctcttgttgaagtgcttatcaaaggtagactcaaccatctgcgagaaattgtcatcctcatcgctgtgagattcgttgtcgtcagattgaagatgcttggccttctcctccgggacagaagtctgctcttcctttccaggcccctctttgtccgttgcctcacccgtcgtttcctcagcagaactattctgtgtggtatcaggtgagtctgtctccccttcttccgttgagggttctggctcagtctctttggacgcatcgttgtgatggaatttctgaacgaacttctgaaacttggacttgcttgactcctcagactgagtggtgtcctcctggtcctgttcctcattggtctctgtcccagttgattcttctgaggactcttcttgattctcttcctgcactgcctcggctgcatcgctctcttgtggagctgtctctattcccgtgttggattcagtggtatcggtgtcaggttcaggagtgattgactcccactcagcgtctagaacattcggccaaagattcttcttgtccctatatttgcctttgggcttctctgtagaggtctcaccctcaccaggctcttcgggagttttctcctctgtctcgatgggagcctcttcggctacctcattctgctcatcaagggtcggcgcagtaaacgatgtggtcggttgctcttctcccggctgtccagctgaagcctgggactcatgttcttcaggctcttcctcttgcgtctgttcacgcttgtccgcttttcgagcctcattcgaacgattaaaccgactaccgacggttggacgtctgagggtcttgtccgcaggagtagtctgctgtgttttttcatcagtctgagcgggcagcacacttgtctcatcagactgcccttcttcctgctgtggcgctgcaaccgccgcttcttctctctcatactctatagtgcagtcttcggggagcatattgagagagcgaagtgtgtctacgccatgccggcgatagtgggagagccgttccgctttcgcttcggcttcccgtttggcttccgcagccttccgccccttttcagcgcgctgcgcttcctctttggctttctctgcttctgtctcgagggcacggtccgtccccgggtgcacattgtttacgatgctcaacagtgcggcaacagatgatttgttgtcgttagccccatcggtgcagtcaccgaagcgcgtcgcgatgtcgccgattgcaagagcggtgggaatgaggcccgcgacaataccgacaatccagatgatggtccgcacgatagaggggataaatccgaagagttgaagcagcgctgcgatcatacttatatagatacagtacgtgcttgcctgctttgccaacacataccatgcggcagtggtcttgttttcaatcagggggttgacgcgcggggtgtcgtagtgcgcgacaatcacgatcggtcggttgcctttaatgactttgggaccggtgtgctggtggaggccaacaacgttttgactcttgcactgtggcccaacccgatcaaacgagatacgaccttggtgatgcaaggttagagtgaccgcaaagatgatagtgatgatagcaccgatgatacggacaaaggagccgatgccagccataatgagaccgacgagcatcagaatcgtgaagattggcacgagcgtctgcgaccctgtcgatgcgctgaactcttcgagttggggatccacgttatggtcctgcataactttagagattgtctgagcggcatcgagttcttcttggctgtttgcaggcgcaatgcctatctgttcctcaagatagtctaagtattcatgcgtctttgacatcgttatctccaccacctgtgtgggtcataaatctgttttgatataatcatgtgttaagtatacttgttagaatctagcttttgtatgctcatacttttcttatagaaacagccatgcattttctccagcttcttcatctctcagcctcaacacatagtctacaaattggtcgctctcgagagagaccagatcaccaaggagtacggtatatgaaacctcaccgtgaagaaaatgtacagttctccgcaaatgatatcagcgcccagcggctggtcacgctcgcgattgactttatcaacagcgcgacgcggctcacctccgagttcatccacaagtagatctacctgagctctcacaccactcattcaacgcgttgcaaaagcgagatatgcggcatttgacactctgtgagatccatatcgtaaaagagtcggattctgcagacaaaaaagtgaggtaggccaccgacgaaagcacctcctgcaccgggaggacttccctcatcggcgaggaagccttacagctgcaactactcttgaagtctatcgttgaagatgagagattcccctactgtacggagctgcacagggcactcttaaagatcgatcatgccttcgacagggaatcagtggtgcgtcaaatcaacccaaaggcaaacagaacctctaactgctccactagggatttctcaaccgccaatttgtgaagattgtccataccgaagctgacggtacggcaaagcccactgtcgtggatccatacggtttcttcaccctacggaatattacgtactgcgtcgccactgaagacagcgacggacagcagatcagcgatcacctgaagaatctatcgggtggagcagctccccaaagtctcactcgtcaatcgtactatgaaatcctaaagtctttcggcgcggctgacttcaaagtgctctcctgccagatcagaacgactattggcacagcgcactttatcctgaagcagcctgtagaagagttgctggagacgctgcagaggtatgcaatcctgaccaaacacgacgcgaatacctatcagcgtgcggttgaagtgagctcgtgaagcgatgctgcaacctaggggctgaagcaggggttcgctccccatccccacaggagctggaagacgaatacgtatcagtcttcaaagaagacttgaacgatgccgagcgatggagccggcaataccactgaacttcgtgaactgattgctttgctctccgccctctccaagggggtgataccctacgtggagacacaatcgcagatcgcatgggtatttcagcccgccatctgttcgaacttttgatcgcatcaggggacaacgacgggcgatacctctcgcttgtgctctcagatggtgagaatgaggtatcgcttgtctttgataacggaatcaaaaggcactcaatcagactgtcactgacagaaaccgatgcgatcctcgcggcactcaaccgctgtggggtctctgacgatgacccccttgaggaagaagatcgtctccaactatgggcagatcaatatcgacgaggagggtatcgaaagacagtcagggccttgagcctcacagcaggctaatacggtgatcgatgctctcatcacagaacgaacactgacattcctctaccaaggcaatactgctacgatggtaaacgctgtttggtgcatcctgaacggctcaagcaggacgaccatgtctggcatatcgaagtgttcgattacacgagacagcaggaccgccagttccagctgagccacatacagaaccttgagccctgtccccttccgacctcagagcaggagaacaggatatcgaacaaaccgacggagaaagcgcagaaggtcaccctctcaccttttgggatccaccgtatatcagcttctttgagtggccgcgtctatgggtgagcaaaggacataccaatccacagcaggaactgcttccctactgcggcacaaagtagcttatacagcgatcgatagcgtgtagggggcaaggtaacctgccccgacaaagaagttcaaaagcaggtttgaacccttacccaacaagatctagatatactcacccaagcgtagagtgctatctacgctcatgtgaggcgcgccacattttgaggtaagaaccgatattcttggtctccaactcagccgtggtatgtgacggcatcgattcgataaagtcccgaccgtatctctttttgacgagacgggagtcacagaggaccaagacgccggtatcggtcttggttctgatcagtctaccggcagcctgcttgacagaaagcaccgcatccggcaactggtagcgccaccaagcccgcggttcacgctcttcacgctcctgtaccagcggatcatggggactggcaaacggaagcttcggtacgaccacgcagcgcagtgtatccccctgggcatctaacccttcccagaaggatttcagcgcaaagagcgaaagctccctgtcccggatgaactgatcccgaagctgtcgaggagaggaacggggtccttgatagatcagctcaagtccttcccgggctaagcggggctgcagctcgttgtagactttttccatctcccgcctgttggtgaagagtgtcagcactgaaccctgcatgctaatatggatgtcaaagagcagatcgtctagggcagtgaggtaggacggattacccggaagcggcagatccttcgccacaatcactgacatgttgtcatcgaagtcaaaacttgaaggtaactggatatccttgtaggactccttgggcagcttatccaaaccgactgcatgattgaagtgggagaaatcgtgctcaactgccatagtcgcagaggtaaagatgacgctcttcatccccggtagccactgagtccccagatcctgcccgatatcgagtttttctgcaaccagcctctctgatctcaaacgtttgttcttactctgctggttggtctgccgatagagctgcgccgaatacacgtatgctggatccggcttgagaacaatcaggttgatagcgttgacgagatcatcgaaggcgatcgcgggatcccccaggatgttgtcgccttcattggtggtcagtgagagtgttgtctgcgcttctttgaggcatttgctcgcctcttccaaactccgtacggcctctgtgcctgtttccacaacagcgcgccaccgcccactggcacgcacctcctcattaatccacagggttgtcccctcatagctcgacttgcccgcaagcgaaatcagatcatggattgccgccatgaactcagacgtcacgagcgacgcatgctgcactgctttagaggctttctggatgagaccgagcgccaaagttgcaccatctttacccacgaccgagttacatgcacgggcaagggcaccctttttggcgtcgcccaacacctcaaagatgtcatggatatccactgctgagatctcagttgcccattggctacgggcctccgattcaaagctatgtgcttcatcgatcacccagtgacgaattggcggcaagatatgtccctctgctagcacattgcgaagcaacagcgaatggtttgtcaccaccacatcgcagccggcagcaagccgccgcgcggtataggctacgcactcatgcgaatagaaggggcattttgtgtggagacactcgtgggacgtgatcgtaatgagctcacgcggcacattcttccagcgtatgcccattgcgtcgaggtcctcatccgcagattccgcgacataggtataagatactgccaaagcagtgagcatatcctgggtaatcgtacgtttggagcttggacggccttgagcacgagagatcactatattgattggtaactcctcttgataggccttttccatgcgatagagacaggggtaatggttccatcctttgagggtatggtaggacaccccgttttctaagacagtgttcaacaggggcagctcatgtgagattaactggtcagccagcgcattcgtcttagtcgccacaccgacgctcacgttgttcttctgggcaaacaggatttcaggaacgaggtaggcaagggattttcccgtaccggtccccgcttcaatcgtgcggtgcgtcgaggtttcaagcgcctcacgcacttcttgcgccatcttcagctgttcgggccgttgctcatagtgatcataagcgcaacttacatcgccaccctcggcaaagattgcgtcgatctctgcaggagaaggcacttggaatggttcttttttatcgttcgcgtcttccctttcatgctccggcacctgtttcagcagttcgttgcgggtatctttgagtgagaacacctccggttctctctgatgcgccagatacgagaagatggggcggtagctccactctacttcggggtgcatatttgcaagatagtccagtaatcccgcaggtaaatctgcaagtccctgcaggatgatcggccataccccacagagtgccaccacatcatcctctgagcgatgagtcaccgaatcgctcccgaagatctctgccagatcagagagccgatgagttgtcagcgaaggcaacgcaatgcgggacagtgcgagcgtatcgatccagttgtcgctgacctctataccacccggaacggattcgataaaggtccggtcaaagactgcgttatgggctaagactacatctcctctcacaaactccgccagttttgcgaccgcctcaggtgcactcggggcatctgcaacgtcgacttggcgaatatgggtaagcttcacaatttcaggagggatcaaaccggttgggtgcacaaaggtgtcgaaggtgtcgaccaccttcttactggagatgcgggcggcagcgatctcaaccagctcacagtttttgaaagacaatccggttgtctcggtgtcgaccgccacgatattgtcttccaacggtccgaaatcggtcttcgcagcacgttccgcaagtgtctgatactgttcacggatatgtttaggggtattcggaaggagtacctcgttgagggttagtagttctttctcactcattacttctcatgtacactttctttgagaccccactctacaaagcgggtgcagagttcagagaatgggatacccgcacgctcagctgagtcaggcagcaggcttctcttagtcatgcccggaatcatgttggtctccaggatgtagggtatcccctctttcgtaacgatgaagtcgctgcgtgaggttcccctacaacccagcgccttgtgtgccttggtagcgtaatcggaagcgagcctggtctcttcgtcagtgagccgtgccggaataatatggtgcagcgaagccggttcactcttgacggacacgtcgtagtaatccgcattgtcgaagaccacctcgacaatcggaagcacctgcgggtcctcagtgccgatgaccggtaccgtgatctcagtaccttcaatgcactgctcgaccagcacacgatcaccttcagcagcggcctttttgatcgctaacggaagctcttcgtgcttattgacgcgggtcaccccatagcttgagccgttcgcggagggtttgacgaagatcgggaacgagagctcttcaatcaggcggtcgatggtctcagagtcatctgcggcactgatgtcgaccgtctcacccctcggcaccggtatgcccgcattgcggtacatgacctttgctgctaccttatcgttacccaacgctgaggcaagcacgccggagaaggtatacgggatatgtatggtctcaaggaagccttggatgcagccgtcctccccgtagcggccatgcatcgtgatgaaggcaaaatcaaaatgtcccgctgagaaccgatcaacaaagtcgggatcggctacgttgaacagcgtcaaatctttgaatcccgcttctgttaaggcttcaaggcagtgctgccctgactccattgaaatattccgctcatcggaccaaccgcctgcaagaattgcaatgtgcaatttgaataggacatcccttgtcatgtgaactcctcttggtcattcctcaggccatccaaaaacacggtattgtgtaattaaccttgttagatttaaaaggatacacttccttaattagctccggaaagaaaaggtcacaacatggctccaaatcgtaaaacgctcacgcagcacaaagggacttcccttcccgatatccatacgctctcacacggacagcttgcagcccttatggaagagctacaccagccaaaattccgggcatctcagatagaagagtgggtttgggaaaagaacgcacatacctttgatgagatgtcaaatctccctaaatcattaagaaatttacttttccagcatctcaccattgggacgccgaaagagcttgctcgacagatatcgctagacggcagccgcaagtatctcttacagtttaccgatggggtcagtgccgaatgcgtcggcatgccgaccaagaaccgcctcgcggtatgcgcctccacccaagcgggttgtggcatgggctgcacattctgcgcgaccggtaaagccggactcacccgttccctcaccgcctccgagatctacgagcaggtccgccatatcggcgatgactttcacacccgtgttacctcagttgtattgatgggacagggtgaaccctttatgaactacgacgaaaccctcaaggcgcttcgccgcctcaattccgataaaggtgcaggtatcggtgctcgacatctcaccgtatcgacatgtggcattatcccaggaatcaagaagttcgccagtgagaaagaacagtttggtctagcggtctcactgcattccgcaaaccaggcgacgcgtaacaagctgatgcccggagtccgtaagtactcactcttgtacctctacgacgttatgggcgaatacgtcgacaaaacaggccgtcgccccacgtatgaatatgcgttgatccatggagtaaacgatacagacgctgaactcgacgcactgtgcgacttctgccgtggcacattagcccacgtcaacctcatccagctcaatgaggttcccggctcacccttcgcgccttctaccgaggagcgcgccaatcagttcgtgcagaggcttggatcagtcggtgttgccgctacgatcagaaatccgcgtggcgcggacatcgacgctgcctgcggtcagctctcacaggcttatacgaagcgttagcgtagctttctcataagaattaatcccctatcagaacatgtgttctgataggggatttttgcattatcctatactgttattctcagtacccaaggctctcccactgtcgttcaacgttttcacgattagcttctgcagcctttttttcctgttcttggttcgctgaatcctgttcgtatgcgacttcggagatcttagtaaatgatgtctttagcgtatcaaacatatgattcagttggtcctttgcttcatctgacagtacatggttgtagagatagtaaccgccagcaacgaagagaccaacttcaatgaagaacgttcttgctgggtgtttcaaaatcactcactcccctctttcttggatctgttccaactcagacacgagccttgttaaatcgtcttcgtctttaaagtcgatctcgatcttattctttccccgtttccggcgtacccgtactttggtattcaataccttacctaaaatatgggctgcacgcttgtagctttcaggcgttggttgccgtttcggtttgggtgatttattgacagaaatcagtgttgcaaggttttctgtctgtctaaccgacaacttctcctgtactactttatcagcgagcttgatacggtcctctttattaggcactgcaagaattgcccgggcgtgtcctgctgtcagctgtcctgaagccatataatcctgaacttccttcggaagatcgagtaaccgtactgcattggttatagtcgaacgagatttagagaggatatgggcaagttcttcctgcgtccagtcgttctgatccagaagctctctatatccctgagcctcttcgattggattcaaatcaatacgctgtaaattctcgatgagggcaagctcaaagacttccttatcgctgatatctctcacaacaacgggaacccttttgaggccagcaagctttgctgcttgatagcggcgctctcctgccacaatctgatatttgtttccccgttttctcacgaggatcggctgcagaataccatgttgctcaatggagctctttaattcctcgagtttgtcctgatcaaagtctttccgtggttgatgcgggttagggctaatggattcgatcggcaattcaacatcgggcttatttgaatgtacttcagcattggcctcccccatcaggctttcaaggccgcgtcccagtccttttctagccacgacgtgtcacttcctttgcgagtcgcatataagccagtgagcctttattgatatgcgcatactgcgtaatcggaagaccgtatgaaggcgcttcggctactttgacgctgcgtgggatcatcgtcttaaagactttatttccgaagcactttctgacctcttcgacaacttgtttagagagtgtggttctgctgtcgtacatcgtcatcaacacaccgaagatctcgagatctgggttgaggttctccttgaccatcttgatagattccataagcttcgttacaccttccagcgcgtaatattcgcattggatcggaatgatgacggaatcggcagccataaaagcatcgatcgacaaaatccccagtgaaggcggacagtcgatgaagacatagtcgaactcgtctttgacctgatcgatgatttccttaagtttactctcgcggttctcttcgtttaccagttcgatttccgctcctgagagttcaactgttgccggtactataaagacattcttttcacaggtatcgcagatcgcatcctcaatagggctttcattaattagcacatcatagatatcgctgtcgatcgtctctttgtcgataccataccctgaagtagcgtttccttgcggatcgaaatcaaccaagagaactttgcgtttattctcactaagtgcagccgaaaggttaatagctgtcgtggacttaccgacaccacctttttgattaatgatcgctatgacttgcgtctttctatcaacattaaaccgtctctgatctttatagctcaatttgtcctcacttcgatccaggatatcttcttcatatctatattacttgcttatacatatgtttcacgtgaaacattgacaatcaaactatcgaggtcgtcagttcagataggagagtttcattcctcgtacctctacaatacgacacttcatcccctataatgcacactctgtataagatagtacggtataagggtagcaaagccgtaagcgataacaatgtttcacgtgaaacattgttattccaaccatatcgcatttttatactaagagtaggggaaatacgatcagataaatctaagtatcatgacactttcttatatacacaattatatacacgatgttcaaatatatctgatattctaccagtctagataacgggtgatagtgtacctacgtcgagctgcgaaggcttgcatcggccaccatcatatggcgaaccactcttgcagtttcaggccacctatcacgggcttggttgacccaaaagagctagacctgccagctaaggtagcttttgcatgttggccttggatatgtcggtgaggtgccagaggtagcgtttgagccacaagcaaaagattgttcaggaaagcccatgttctcaagacagatacgctctgccacatcggccctatagggcttaagaggtcttctactaagccactgtgagcgcgcggcctgtcgtagaggatcgtggcacccttctgagggttctaagggcatcctttagttcttttcgtggatggcttgccatggctacatgctacagcgactgggttttgtgggcatctatcgctaaagcgatgcagaggagctgtgccgacaggctgcgcttgctcgctcgtctgaaggcgtggggaagatcggtgtcagcgatgttaggtctcattgaggcaggcgcgcttgctgaggatgattctgtcttagtagccatcgaccgtcgtaaagactctctgcctttactcccaggctgtctggtgggtgatgcctgacttcctcggctgtgagcccagaggcaggctgtagcgcatgaggtggatgaagaagacccatctcgctagctcatagcaggtgtgcttaaagacagctcccgtaagcgagctgtagctgcaaccgcacgcagggcacttcggatgcatcctgaagctttcctttcgcttcgctgagcgtgcctcatgccaaatcgcatcttagcggctgcgttctcctacggcttggacaagaagcttgaagttgtcggcagacagggcgccggcccgcttctgtaaaggaattctcccacctctccatattcggctgccccatctgccataaggctgccgcccgagacttgtcgccaaacaaagcagacggcaaaccctatggcaaacgctttattcagcggctaaaagcgtggcaaactgcggatgatggccacccatagttcacctgttatctagactgttaggaaaaattattgttttggtacgagggggtggtgctgcgccataccagtgcggcgaggtagcttgatccgggagggacactcttttgtataacatagtatcgtacgagtgccagcatcatgggggagagacaatgtttcatgtgaagcatttttcattcctagcaactcagctgcatagtccccatcatcgtattctttgtctgtcagtttgcctttactgagaatcagggaac

SEQ ID NO: 342 - DNA, 21715 bp, Unknown
  Metagenome-assembled genome
caggtagctcaccgctgaagagcctgcttcgatcagcaccaccccatcagttcttctccgtatcctcgtatagataattccgctctcctccgcatgggaggggcaatacgcccggatatagttcccggccgcctctcggctcactttcttcgagataaagatcaggttctcccggtcaaagtcggtcaccacccgtttgggtctgtgaggccccaggagctttacgatgtcctactgcacacccgtgcggtcaacgccacgcagatcggacggtgcggtaaagtatccacaaagcctttatgtggcgataagcggggcggaagtcctgctccccactgactttacgcagtgcacctcatccacggccacaagcggcgaattcaattgctgtgcgagacacacaaaggtcgaatcattgaaccgttccggcgcgatatacatgatgtcgtacctaccgtccagggcccgctgcatcacgatgcgctgctagcggggattcaaggtactgtcgaggcgggagccacggatcccggcttgcttgagggagtgcacctgatccgacgtcaggggcagaagcgtgagaccacaaggctgaatcccggaaacatacaggctaggatctgatagcagagtgacttcacagctcccgtaggcatcactgccggcacatcctttcctgcaaagatcgcccggatgacctgctcctgtccctttctgaaactgaggtagccaaggtggtccttcagaatctccagtgtttgcttcatagaatcggtgtctgacacgtatgtcccgctttcataccgcagatcaacgtatttagcacagcagtgtgtacaatacaaaccgtgaaccttacccgggagatgccctatgccacaaccacatgtttccgtcatagtccccgtctacaacgcgcataagactttgatgcgctgcgtcgactcgattctcacacaggaataccgtgacctcgaactcatactcgtcgacgacggctcaaccgatgactcaggggagctctgcgacgcggtcacggagcgcgataagcgcgtacatgtgatccacaaacctaactccggagtctccgactcccgcaacagagggatggaggcggcagccggtacctacatccagttcgtcgatgcagatgactggatcacgcctgatgccaccaagctcttggtgcgcagcatcgaggaatacccagttgatatggtgatcgcggacttctaccgagtcgtgaacacccgggtcgcacggaagagcgacatcgataccgataccgtaattacccgtgagcagtacgcggacctgatgatggagagcccctcggatttctactggggcgtgctctggaacaagctctacaagcactcgatcatcgagcagcactccatccgtatggacccctcgatctcttggtgtgaggacttcatcttcaacatggagtatgtcctgcacacgaagaccatctatccgctgcatgtagcgatctactactacgagaagagcaagagctcactctcctcccaaggtgtgaacctcgctaacacgatccgcatgaaactcaacgtaatcgaatactacaagaacttcttccagcagatcatgggtgaggaggactacgaagcccgccgccctgatatctatcgcttctacattgactccgcaagcgatggcggggtactcccccgacccctaagcgccaagctcgggaccgaacggatcacggtcgatgtaaaccctaacctcacgatcaacgcgcaatcagaactcttcttgaccaatcgtttgcttgaccgctacctcgataccaccgcggaagaacacgatctggatttgatcgatgcgcgggttctgctctatctgagggactgcccctaccctaagaccgtccacgagatcagtgagtactgcggcaagaccaccggtcaggtgacgcgttccatccaaaagctcagagtcagaaatatgctcaagattaccacggagaaggaaaagacccttaacaagaaaggcaagaaagtcacccagcgccgccagcgctttactttgaccgatgaggcgcaaccagtgatgcagtctatcgatcaagccttgcaggacttcgacagcgcacggtttgccgatctcacccaagagcagagaagccaagccaaaacaattgaacacctgacggatagggcccttagacaggcctttctccccccagccggggcttgccacatatggtgaaaacagacagaaacgctcctttccgtcacagccaataagtattgggtaccatatcagcacttcgatcacgtacatccctaaaccctaggacggcgacatggaactcagaatcgtgtgtgactcctcctcaaacacctatgagctggaaggcacggactaccgctgcgttcccctgacggtcacgttgaacggagaagactacgcagatgttgaggatctcaacctcgataatttctatgccgcaatgtcactctgtaacggtccgagcaccacgagctgtcccagcccttcgatctggctcaaggcctacgagggggcagaccgtgtcctggcaatcaccttatcttcgcggctttccggctcctacaacaccgcacagctggcggccagcgagtacacggaacagaactctgaagctgaggtagcagtgcttgattcccgctctgcgggcgaagagctggtactgttggcccaggaggcccagcgtctggcaacctctgatgagggctactccctctcacagatcatcgagaggctccatgagtatcagaaacacacccatgtactcttcacactctcagacctctcccacctggcccgtaatggacgcatcaatcccgccttagcccgctttgcccacaccttggatatccacatcctgggcaccggcaacacggaaggcatgatcgagatcctgagaaaatgccggggccaaaaaaaggcgctcagagctgggatccgtgagatacaattgcaccactacaccggcaagaagctctatatctcccacgtacaaaatgaggcgggtgcctacacactggagcacgccctgcgtgaagtgtggccagaggcagatatcacgatccagccctgccacgccctgtgctcctactacgcgaatctaggcggtctcatcgtatcctatgtggacagtaagactgcaccgaagcatccgatcgatcagatgagcctcccgaatctccccatcaatccgctccacttgatgaaagacgacagcgagtagctgcctttctatgtgcgcttcacccctttcgcttcactcctttgataacacgatgctccgtacgacgctaaaacacgttgtgcggagtattttcatattgtctatgtactgctcggtaagggactactgattattgcgctgaaataagctcactctaacagtctagataacgggtgatgatgtacctacgtcgagctgcgaaggctcgcatcggccatcatcatagggtgaaccactcctgcagtttcagaccacctatcacgggcttggttggcccagaagagctagacctaccagttaaggtagcttttgcatgttggccttgggtatgcccgtgaagcgctagattcacccattacctgatatgtagctcttcctgtcaagaggcatgacagccccatcccagatttctccgggctggggctgtcttctatattgtccttcggaagccctgtgcctttatagcgtatctgattcaacgcacgactgcgactctgatatccgtgcgttgggtagcgcactgtgatactttcggctgaggagttccgcacatctagacgatatgacccgaacctatgaacaaggggggcctgccgcctgagttgaagcagggcctctcaaggcccaaaatgattgctgctgcagcaacgagaaccggaaggcccctatggacaagactaccatcagcacggcaggcatgggaacagcatttaggatcgacagccattcgaggacgacgatgctatgcgccctcatccttaagacggaagagactgcgctccttccgcagcgacccgtattctgacatcgaggcatggatggcgcatgagtgtgcttctgaaagcctgccatcggcgtcttgcgaggcaggctgcacaagatttgtccctgcacggatgctcaacgaccaaggatgtaaaggtcgtgagcatagcgccctcgaggatgcccaccttctgccgacttccgcacgaggaaaaacgacaggaacgactccatgaggctcacaagacatggcagatgcaggctccatagagtgcgggtgcccacacaggagatagcagggctaaagggacgcgatgtgtgccctcggcgaccttaaggcagcagcagaagaaggcacaccagcgcgtgctcgccctgcttgccgccacgggatcgtctgggaggagaggatgcccgcaggcagacaaaaagaagctttagggcaatgactttctgggcatggctgcgtgcccacgcccttatcaatccaggcttacaggcgacagagtcggcagatgcccgctgcgctgcgatgctggaaaggatacattcccttgcatccttatgcacgctcgcccctgcccttaagacactcctatgcctttcgggcatcggcttcaggtgcgcctttaccttctgcgcaaagatgtgtgacttctccaggctctgttcggggaggaaggtcacatcctggctggggctcgccccgtcgcagtcgtcaagcgccgcctcccgcaggctgactgatatatccaagtgcgcgcccaggctgctagggaaacgatgattaattcgcctcgatgaggtcactggggttgtacactgtatgacatcggctcaaaatgtctcgaaccacacagtgcccatacccacatagatgcctatctgccttctggatatggtatagctacatccacacattccagcatatccaaaaggaagatatgagcagccagatgagctttcaagaccttaaatcctaaggtctaaggagaaagatcaggcaagaggcacacctggagcaaatggatgcaatcgttgtgtgggatagctagattgcactggtagataccagctaccactgacaggctcttgtcaggcatgtgcgcactgcaaagacaaagctttaggatgtatcctgctttaggtcatgtttgctctcttaagacgagggaacttaaagatgctatcctggattgccactcctggcagcgcttctgtgcacgtagacctcatgcaggcgcaggtgccagatgcgacgacacttgcgaagatgcgccatagccttaaagcagcagggactcggtaaagctatgcttcacgacctgaacttagaacttaagaaggcagggatcacggcgcggggcggctctattgtggacgcgactttcacctgggccctaaagcttaacgaagaacaaagaccacacacgtaacccttaaagcgcaccagtccaagaaagggaaggagtggcgtatctgatacaaggcgtatatcggcgtggatgccgcaggtggccttgtgcatggtgtggagacgagcgcttagaatgtatccgacatatcctgtggcacacacactcgtaagggagtatgacaggttctgctgcgcagactttaggctatataggtatagcgaagcgcccttaaggacgcataaagacccacacctctcatctatgcgctaaagcgttgctaaggaagccttcgactagagagggccttgcctgtgcactcttgtccgagaagggcatcgagtccaggaaggcatccggccgcttaaaggtagagcatcccttccttatcgtgaagcggcgcttcgacccccttaaggaagcgctacaggaggatagagaagatgcctgtacactcgagtctgcctcgcccttgcaaaccttacccatgtgcatcttttgccggcaggctgcacctcccggctcccagagtcgcctgatctgtcttggagccttattgcggtgcatggggcaggacagatgtaaggatagtggctcctgcacgtgctggatgagcatccttccctgcctttcccgcattccggcctagaaaggccgtgtggtcggtcccctctgacacgttatggggcattaatcatcgtttccctagacacaaacagatgcatagatatcaatatgctctgtggattgcgtttgtaagaacattacagggtgtgatgaccctcccggcatgcggaggctgtactgtgcaacaagcacggtagttgcctggacatgcctcaattttcaggaatgtggagtgttgcatcccttttaatgtttcaggatcgaactcgtacaccggctgtatccaaactaaactttaggcaaccggaaaatgactatgatggaatagaaaaaacgatagagacacggtttgtgcctacgtaagcggaagattcgagaataggttttcagattgccgagttggaacattcacaccgctcatgtggagcggctgcttcgggaagcggacgctttgagcttagggatccgcgatacaaattgctttctgtttgggaactttgttcccgatatctatgtcggttggatggtaccggatatctcccacaagatcgattactgtaccacccattgggcacatttgacctcgattccagtatcgagctaccagagcttttggaatgcctacattgcagggcatgagcccagtgaagtcttagatgtgacgcttggggcgtgggcacatctcgtatgcgatgcgggctacaacgctgccacacgacactacatcgccacgatcggcgtgaagccctctgatcagacccgcatcagaaaagagaatgattttgaactatatgggcggacctacaccttgcatatgggcgtgaaactgaccgatgcactcgtgcaacaatgtgcccgtttcccgcaatacactattgaaaagtctgatgttgtcaatactgttgccgtagcagacacgatcgtcgagaaaaacaatgcggagcatctcaatcaggtacctgcctacgatatgctgacgccagagttcttcaagacgaccagtgatgcggtcaatacaactctattggcagggctcaagaaaatcgggagcggtaagaggattgagcgtgttgatgttccaaaaatatgaaggcgtacccctgcatgtacaggtcgcggactttgcgcgcgacaagatctattcgagagagtggggtgtcaacgaaccgattccatcagaacatgaattgatggacatgctccatctgtcccgtggcacggtccagaaggggatacgtgccttagttgatgaaggactactcgtacaacagcgcggacgcggtacctttgtggtcaagccggtcgtaacgaatccttcaggcaaccgcctgctttcgtttgcagagtcgatgaaggcgcggggtgtcgaatatacgacgaaggtcgtcgcgaagcggactgaacctgctaaagaggcctgtgcccatgcgctgggtatcgataaaggggataggtacttctatcttgcacggctgcgttcggtgcagggtaaacccgtgatgctgattgagagccatctaaacctccagcaagtcccgggtatcgacaagattgactttgagcaccagccgctctttgcggcggtcgagcagagtaccggacactcgattggtcgctcagatcaggtctactgcgcctgcgtggccggaaagatgcgtggccactggctcgagtgcgacgagaaggcgccggtactgaatactgagcagtgggtcacgctagacaatggacatgtgtttgagtgggacctggtgtggatgcctgccaaccgttgtcaaatctcggtcagaaccaatcggatgcactaacacgggtactgccaatagtcttgcgcactttcagctagcctgtccatcactcgttaggcgtggttgagcgtctcttacgcttcttggagcgatagtgtcagcaatgttggttaatgccccatcctgtccggggtgaggaggccgtcctggatctggaatccctgggactatcttatgccgactccatcccgtccgcaagctcaaggctggcatctatcgccttcctggcgagctccctgagctctgccagcttctccggcgtgggaggcagtgcgggcttccgcttctcgaagagctctgcgatgaccttctcagagaagtagcgctcgcctgcctatatctcgtcctgctctgcgagcactgcgcccacaagcctcatgagcgacttctgtgaggggaacacctgcacgaccttcgtgcggcgcttgatcttgtggttggtgcactcttgtaggttgttggtgcgcaggcgcttccagtgggatgcagggaagtccagatagacaagggcatccgcctcggcatcctcccagatctttgccgccttgggacagcacttctcgagcatcttagccgtaaggtagaaaagggtgcgcacctggttggcgtccttggcacgaaagacgggctccatgatccttgccaccctcttcttcaggctcctggagcctgcggcggctatgcagtgagctgtaatcttttggtggacagtgggattcagggactggcaacagatatgctctgtccagatacccacctaccaacaccaacagattgaagagatgagatgtcggtgagcgcaagcgagatagagaaggcaaagtcccgcacgaagccggcaccgcccagacactacactgaggaagtattgcctcgaggctatcgactactacaggaaggcacgtaaggccaacccgaagaagagcatcagagaatgcgccgcaaagcttgaggccaacgacaagaccttaaacgactggatcatcaagcactcaaagaccaaaagggtgacccaggaaaggaccgaggagcacaagcagctcgacgcagtgaacaggcgcatacacgagctcgaaagcgaaaataagttcctaaaaagtggcagccttcttcgccggaagcctctgttgaaggacaggtcttagctcatgctggtaaagagggcaacctacagcgtctcgatgatggagcgcgtactggaggtgagcagggctcacttctacagatggctcaaggccaaaggcggtaaggacctatggggtcctatcaaggaagccatctgtgcgatatgggaggaaagcgacaggcgcttcggcttccgcaaggtatggaccaagctcacaggagatccaaagttacgcaaaatttacaggcacgacccgctaccgcgtgcggaggtgcatggctaagcttgggcatctgatccaatgcctccaagaggacgacgctgcccgcacctgatacccccgagcgcagcgccctcacccggcgcggcttctcgtgtcccgttccgacagccaagctcgtgggcgacatgacctatctcaggaccacggcaggctttatatatctcgccgtcgcacacgatctgtgcacacacatggtggtgggctggagcatacaggacaacatgagggcagggcttgtcgtctttgccctgaagatggcatattcgcgcggatacgtggccggaggggccatattctaagcagcccaggcagccagtacataagctcagagctggctgcctgctcagccgtacccgacgtgaggctctccgtggggagaaccggaagctgccacgacaacgctgtagccgaatcgtttttcgccacgctcaagaacgtgtggtactaccataagcgcctcttagatgcatccacgaccaagcacaaggcacacgagtttaatcgagtcgtactacaaccgcttccacccgcataagtccataggagatcgcgtaccggcagaggtgatgcaggagttcttcgagcgtttcgagagaggccttgcatacgatccaaaggtgatgcagaccgcataaaaaatctgagattcctctgtccattatattgacagggctcaactcgtcctgggctcatctgcgctccttaaaccagacatcgaagagctcccttccgtccctaatctccatgggacctcttagagagtcttgtcagcatgcgttaccttaagcatccatatcgcaccttaggatcgcatccgtcgccaaaatccttccgtctgggtgccacgtgctcaagggatgcaggagtgttacccaccataagtagcgaagagcctcattagagcgttcatcacaaacggttatcaggaattccgtgaggtgcacacgtagcctccccgcacactacaaaagaccgtaaatcgaaaatgggctgcccgaagacagccccatactcataccaatgattcaattgctaactgatcacactgccggcaagaaggtagcggtagtgcttagcttctcacttcaccgtggaccgcacgcgtgaccttcttgatcaggcgcgcatgcgccttctcgacttcttctgaagtgagggtacgatcctttgcacgataggtcagtgagaatgccatgctcttcttgcccgcgcctaaacgctccgggtcccgaaagacatcgaagagcctcacgtcactcagatacttgccgccagcagactgaatgcgctgctcgagcatctctgcagtgatcgactcgtccaccacaatcgccaggtcgacactgacgcccggcagtgatgggacctcctggtacggaagctcacgctttgccagacgcaaaagggctgccaatgagagctcaaaggcgacgacgccctgatcaacatcgaagttcttgagggagagcggatgaatgttgccgacccagcccaataggtctcccccatgtgcatagacctcagcggcacggcccggctgcagccagctgtacttctcaggatctgccggcttgaagcgcaccttcgtgatgcgcagcacctttaagagctcttcgacgacgcctttggcgtcgaagaaggagagtctcggatacttctggttccactgatcgtcatcccaggcgccagaaagcacgccggcgacgaagcgcggctcctcaggctgtgacttgtgctcattcccgtagaagacgtgcccgatttcgtagagtgccacgttgtcgacaccgtgcgagaggttgtaagcgacgctgcgcagcagacctgggataatggagcggcgcatctggctctggtctgccacaagcgggttgatgatctgaaccgggactccacggccctcatcgctcatattgagcttcttcaggtcgtccgcatccgcgaagcagtaggtctgcgtctcggagagcccacaggcgcgcaggaccgaaccaatctttctgacgcgcatctgctcggtggtgaggccacccgcgtggttgcgcgccgccggcagggtcgctggtacctcatcttcgccccacatacgcaggatttcctcgatcaggtccgcctcacgggtaaggtctggacgggtggtcggagcgacaacggtgaagctcttgccaggctccttttcggtgaccgtgcagccctcgcgggtcagcttgtcctgcataaactccggagtgatcgtgacgccgcatagctggttgacgcggtccacacgtagggcgatcgttgccggctcaagcggcaccggatactcatcaatgcagccctcacaaacctcagccccacagcactcctcgaacagggctgctgcgatgtctgaaacgcgcttgcactggtttggatcgatctggcgctcgtagcggattgaagcctcactcatcagatcgaggttacggctcgttcttgagatgtggcctgcattgaaggaagcgctctcgatcaggacgtcggtcgtgttctcatcgatctcagagttgaggccacccatcacacccgcaagcgcgaccggtgtctttccgtcgtcggtaattacgatcatgtcgctcgtgagtttgcggtcgatgtggtcgagcgtcgtcacgtgctcgccatccttggcagcacggattacgatgtggcgcttgccatcacgctctttgaacttgttcaggtcaaaggcatgcagcggctgcccagtcagatacatcacatagttcgtcacgtcgaccacgttgttgatcgtgcgggaacctgcagcctcaacgcgacgtgcgagccactccggggagggaccgatcttcacattcttcacgacatgggcggtgtagcgcatgcacagctcaggatcgtcaattgtgacatcgacgagatcagagctcttcgctgcaatctcccgtttgatctttggctcttcgatatgtgtgtcgtggtcgaggatcgcgccagtctcgattgccatgccttccattgacaggcagtccgggcggtttggggtgatctcacagtcgattacagtatcggcgatcccgtagtactctgcgaagtcgacgcccactggcgcgtccttcgggagaatcatgatgccggagcgatcggaacctaagcccagctcacactcggagcagttcataccgaacgactcggtgcctctaagctttgccttcttgatgtggacgtcaccgggtaagtgagccccgatcattgcgacgaccacatggtcgcccgcctcgaagttctgtgcaccgcaaacgatctgcagcggcttcggtttcccgttctcgtcgacgttcttctcccccacatcgatggtggtgatccacatgtggtcagagttggggtgacgctccttcgtgaggacctgaccggtcacgacgtgatccaggttcgcccccaagcgactgaccgcctctacctctgtgccggtatgggtatagcttttgaccaggtcctccggatcttctggcacatcgaccatacttgaaagccattcatatgatatgcgcattgtttgtatgccctctcttattattacgcaggcgttcccaatggatacggcaatcgattagaactgcttcaggaagcgttcgtcaccggtcatcagcatcctcagatctggcagattgtagcgcagcgcggccacgcgctcgacgccgatgccgaaagcgaagccggagtactcctccggatcgatgcccacatacttgaagacgttcggatcgaccatgccacagcccaaaatctcgagccagcccgtgtacttacagaatcggcagcctttgccgccgcagacaccgcaggagacgtcgacctcacagctcggctccgtgaacgggaagaagtgaggacggtagcgggtcgcacggtccttaccaaagatctcgtgcaggaagtaatcgagcgtgcccttgaggtccccgaaggtgatgcccctgtcgactaccaagccctcaacctgtgtgaactgtggcaggtggttcgcatcggcggtatccggacggaacacagtacctgggcagatcatatagataggtggtttctgcttctccattacgtggatctggacgccggaagtctgcgtacgcaacaacacatcggactcccccagcacgtgctgcgtcttgccctcaggcgcattgtcgaccacgtagaaggtatccttggagcttctggaagggtgatcctccggagcgttcagcgcggtgaagttgtagtaggtggtctccaccaggggaccatcctctacggtgtagcccaagccgcagaagatgtcctcaatctcctcacgaacctgggagatcaggtgctcagaacccagggtacgtacgcggcccgggagggtcacgtctatggactcctggttgaagcgctcctgcatcacggtcttggagatctcgacacggcgcttctcgatcgcggcggtcacctgggcacggacctggttagccatcttgcccatcgctggacgctcctcagggggcacctttcccatcatatgcatcagctgtgtcagtctgcctttgcggcccagaaccgaaacccgtattgcttccagctcgtcaggtgtcagcgctttgcgcaatccttcctgcacctgcttctcaatcgctttgaggtcatcgctcattgccatgcccaaaacccctttcgacaaaaaaataaccgccctcaagcacaaagcccaaggacggatgaattccgcggtaccaccttgattgacacatcacaactcacgtcgcgagcgtccactcgttgagtcccgtgccgtgggacgtacggcttccctactgaaagaagcgttccctctttcccgttcaggtcgcggctggtgaagtgaacgttgccttccttacttgtacaggagcctctcagccacgagctccctctctgttaccggtaaaacgcgaaaagacaaaccctctccgtcaaagccaaagaacagcttagcacagatatttgccttctgaggagacaaatgaaatcaaaatcccctcctgcaacgtattgataatccggctgtcgcctattcgtctaagcggagcctctatctccagcagtcacggcatccaagcgtattcgggaaagacactgcctgggcaaggaccatcgctgccttctagagcctgtcttcggcagatccatcatggtcaagaagagatcgagccagcttgtaaggctagagctgctgaaagccggtgtgggtatcgaagacaagcctcaagaggaagcccagagcgggttttcactgtcgacaagcttcttgatgatgtaagagccgcaggcctcacttgtaagatcgagcttcctcacgatggtgctgtaagagtacttcttgtcatagacgagagtgaggccctgtgtgagagtggagcaataggtgacacaggcgcactcaccgcttggcttgccctgtcttaagccatgcagaaggtcgacgggccctctgtcttgctccttataagcaagggtgatgtgcaccgtaatcttttggtggggcgaattagcatcctgagtgcgacaggatagcgccaggcagaggtcgtggcgcactcccgaaagctgcgatgttggctgtataagtcatcatcgaacgtcgagggagaaatgcatcactacacttatcttagcgccgctgagcacaacaagatcgcaaagatacacgtcaggcactactcacccagcagcatcgcaaaggcatcagacaaaagacagctccagtgtgagccgcaagcttgaaaggaacagcccacaggagaggctatggtgcctgcgcggccccaaaggagggcaagtgcgcaccgtgatgcctgcagggcgtacaagaggctggctgcacaggtgaggccgcttcatcgtagatgagcattggccatccgagcaagtggtgggcaggatcttgcatcgtgagctttgtgaccatctagcgcgcgactttggtgccctggactctccccgcacccaaccaaacgagcgactggaaggggaagcacccacaaaaagggcaagatctaggtctcccagaagctcttagaaaggctaagagaggtcttctaagcgcttctgtctgggtaagtgggcaaacgacactgtcgtggggccaacctctgcgtgcctgtagggtcctgcccgagcactccttgtggctgctcgtgggcagcaagggcgtgtgcgatacccagctcagcgtccttgagaggtcctcgctcaagacactcacgcctggttgcgccaagcaactctcccggcagggctaaggtcgcaaaagccctgggaagtgtacagttttgcttctgcgagccgcaccacctgtggcagaagccgatagttaagaacaccgatgtcctcatctgtgaggtcttcccataagggcagcgacttttcctgagtctcacataaggaggtgcaacatgtcttcaatctgatctgcgacaggccaaggaaggtattaggctacaggacggccaacgaggtctttagggagatggtgcactcagcttgacaatctaccagatgatttacacatctcctacgcggtgaaaggccatctgccctgagcgagctcctcgagcgctccggccactgcccttccgcgcacgagccgatgtactacttggctgccgcagaggcttccagtgtggcattgaccaccaccactgagttctcgaccacatcgagcatcgtgagatcgttacccacatccccaaacaccacgacttcgtcggtcgagcagccgatcgcctcacagagcagcttgatcgcatgctccttgctccaaccatggggtattacattcagagagccggtaaaagccacatcaaaatcaaggtcgctgtagtgcatattaagcagattagtaaactctctgatccggttctgatcgacatccaagaaaacgttggccttcatgatccgttccctcggtaggtgcgtcttctctaccgcacagcgcacataggtggggaactttttcgctacggtcgcgtgcatcccacagatcagatagagctgatcgtcgacaaaacacagaagacctgcatgcaggatatccaccaggtacctctacagctcaatcagcgcgtcacagttgaagtattcgtgatggatcaacgcgtcgttcagatacacttccaatccgttgctggccaccgccgtcgcggtacaggccatatcgccaccgaacatggaaggaattcagtaacactcacgaccgccgacaggaccgatcgggatatgggcgtcaagtaccttgtgaaaagccatacgagtccgttccgaaacctgatgggcaccccagggtaggatcgtctgatctatatcggagagtatgagtttgcagctgtgtccgttcattgtcgtttggttttccatacctcactcgcctccctatgagccagatctgatgttatctattctagggtataccgctttggttcttatcaccgctaaacctcaagggatggtcaaactcatgcacctacataccggatatatgccttacctcgggcatcagacctactaccgcgttgtggagcccaatgctcccgattcacaccataagcccctcgttttgctccacggagggcctggctccacacacaactattttgaggtgttggatgactttgcagataaggatcaccgcacactcgtgatgtatgaccagatcggctgcggcaactcctgggacgactcactcaaagggcgcgacgacctgtggcgtaacctctccacctggaccaacgagctcaagaacttgcgcacctacctgaagctcgaccactgccatctgctcggtcaaagctggggcggcatgttggagctcgagtatctgctcactctgaaacctcaaggcattaactctatcatcctctcttccacgctcgcctccagtcccctgtggggaaaagagcaccaccggtgcctcaagtacctttcaccacaagaacaggccgccgtgatgatggctgaccaaaccgggaactacgacaccgaagagttccgcgccgcagaggcccactttatggacctcttctgcgaaggacccctcaccccgaactcccccgaatgcctcagacgccccacacgctcaggacgggaaagctatctggccactgaaggggacaacgagatcaccgtgacaggtatctttaaagattgggacgtgagcgaccgcctcgacgagatcagagagcccgccctcgttatctccggtaccgatgacctgtgcaccccgctcgtcgcaaagcagatatacgatgggatcaaagactccgcctgggagctcttcgaaggctgccggcacatgtgtttcgtggagaatactccgcactacgaggaggttctgcagacttggctcgatgcatacgactagtacaggccgaatccagacattgcgcatgccccagcatatctggcaatcgtagcactgaaatatatatcagctgttcgtataaagcacagggatgattgaagtggtcgaacctgtaagatagggaaagtctgatcctttctgaaccccctcccgcccggacagcactattgtagggctatgcagcctcgcagacgatgctcctgtaccattgtgccggtgtgtcgcagctaagcacatagtggattcgctcttcgttgtaccatgtgacgagcttctcgatggttacccttaagctctgcaggtgtgctgtactcctcatgccgcaggcatttgcccttgagcgtcttgagccatctttgcatgagggcgttgtctctccatctaaccctttctgcttaaagttcatgatggagaagtggagtaacaacccttcttggagacatcctcttcagagactgagacccgccttcctgaaactccaccggactcatgtagcccagcgtcaagtgcagcctctcgttgttgtaccaccacacctaagcgccaagcttcacctaaaggtcgcagagaccttcgaagcgcttgtggtgggcgaactcagccttaagtgtcttatttgctctactcgtctatggcactgtcgtagtggcagcccctcatacaccgcaacctcactatctagaaggcctccagaggctcgtctatggcggctccagcgatcttaaagccgcacttcgtgtggaactcacccttgtcgaagagcgaaaacaccacacatacgaatactgccttggccagccctgtgtccttccttgccccagacgtgtggctggctatctttcggctgtacggatcgacgagcaggaagatgtagcacctacactcccagcacacagacgtaaggtaaggactaaggcctctctggatctgtcggggtacgccttgaacttcgccttggtgtggccactcttaaggccacactcccttatggctgcggcgaggtgcctgctgctggagcagatcttgcacttggccagtgcccccttgtgctctgggtcccgtgatacccggtacttctttcctcgacggcgccgacgagaggtccctgtgttcctcaggtccgggtgtgccacgcaagcctgcagtaggtcgacctcggagtagcgagctgcttacatagagctgataagcagatagagtccggcactttccgctatcgcggctacctcagtgcgactatcagtacagccgtccttaaaatgtcgagctccatctttaaggtgcttgttcttccttgtaagatcgagggtacactcctgcttaggtgtgtggctgtttgaggcatgggtcgagttggcgatatcgttgtcggcgcctatctctgggcggactcttgttattgtcgttaagctcaacgatctggcgtttgatctctcctgagaacttcctggagtgcttgaggtccgccatcgcggccccctttcccaaggcctcagtctctcatgggcttgtccctttcactgtagccactccatgtcttcgcgagcaccatcttaggtcgtgcgggggtcgctacttcataattaaaaaatccctccttgcagtctggaggtatcctcactccgttgacctgggtttcacgttgtagaagctgcggaatctgagcgttttagggcatcgcattgccctgtcgagcacgaaggcggccttctccatcctgtctttgggcgggttcaagatcacgtagaacagctccagctacccctgcaggtcgcccctgtcgaaccccggatgagagccgaggaagctcttcagcaggaagcatgctcagctcaccgggcacaacgggttgaggtcatccgagatccccttcaaaagcttgggcattgtagcttttcgctcgacaggcccaggtcctccatgtcgtggagcagtgtcgatcccctctcgatgcgcataccgaacgtggcgcgcgtcttggccttgctggtcttgccgaagccctcgtggaggtagatgaaggttcccgagtcgtccaccccggctcctatgcacatctggttggccgaaagcccccaaagcagcttcctgacagcgtctttggcggtaagcggccagtacgtctcgtcgatccagaccctgcccgacagcacgatgccctcctggacaccctcgagcacggcgaacagctttcctatccaatagggcaaggtggcatcagacctcctttcctctctgctcattgatgcgaagctgtcacaggagaatacctggagcaggaaatcgaagcacgccgacagcgggagcttgcggtcctcgaagatcgtgcccgtctgcgggaagaacgacttcttgcaggctgagcaaaaaatagcgctgggcgccggttgcgtccttgccgcgcttagacacctcggcgctgtcgcatcttagacaggcgcgccgttcgcatcgccgttgaggtggcaatgcctgaacgagtacatgcttctatggctcgcgtccacgagcgcctgggctggtttcaagctcgctttctgcaaggccgtcccaaggcgtgaccgaaacggcgagccttcgcttcgcgtgtttaccctttgtggtagtctttggcggcccggaaggatagcggggccagggctaccacatccgcaagaaccccgctgcctatccgggctttcttgtggatagatgagcaattcccatgattatagacctgctcttattaatgggctgcccagattagacctccagactgcaaggagggatttattgatttttcttacactctgttagaccacaattgacctgagaaggacccaaaagtgtccggacctttgcctacaatgcatgtcatcaaacaaagacatcgagaagcggaagggccggactcaatgatactgcagcgcgtagaagagatagacatcgcaaagaagcgcgagctctcagagaagctcaaggccctcatcgctaaggagatgggcggggtctgcgcttgcaggtaaacccaaggggtgcccaagatacgaatcggccgacttctgccgcaagggacatatttgacatggcctccaaagatagaagtgcaggtcgtgcggaaggaccttcttagccaagacagaatccgccatctcggcgtcgaagcccttcgccaccacagggaccacgtatgcaaaaggcacccttgcaggcatgacacttaaggagcttgcctttgtctgccatgtgagccttaaggacctcgtaggttccatgcgcatcaggctcttcgaggtgatgcaggcaccgcttcagtcacccaggagcgcccatgccgtctgtcgccaggcaggcaggctctatctcggcgagtcgtttgcggacaacagggaaaggtcgcatgtgcagataccctaaaggcacacaggccatggccatgctgtgtattcgtgcgcgatatcgagcgagaaggtctgcgcagcgtgtgccacagatgaccttagagacgaatatacaacgcttcacgggaggggaaggcccacccgatgcgtaaagctaaaggctgccctttcaggcatcactgacagcttctgggtcgcagccgacaaccatgcaggatatgtgcgtatcctttcctcactcgggatcacgaagcctgtggccacacttaccaaggagtccaggcacggcgagagcagccttaccaatgccatgcagcgaaggctcaggcaagttcttgctcccattccatggggtgtcgacaaagtggctgcagtacttgcctcgcctgcttcctgtggatagagcaggcgaggcatgctacgcaggacagcaaggcgatcctttccggccagcttgcggaaggcagctatgtacacacgaggcgcgcttgtcgacaggtcccagcccctctgggactggcgggaagcaagggccgaggtcaatcgtggtcttaccgagagttttcttattgctgattaccgctctttgtcgagcgcgcacatcgcggcgccgtacatgccggcctggttaccaagtgtggcaggcac

SEQ ID NO: 343 - DNA, 10433 bp, Unknown
  Metagenome-assembled genome
aaagggcctccaggagacgatgcagcggttgaactgatcgatgacggccaccaaggtaggtgtgccttcccctgtctggatgtaggtgatgtttgtggagcaaacctggttggagagaaggacctcttgcccttcagcaggtacgagacccgcctcgactccctgctgggtgcgagagcaggcagcaggggcagatactatgagctttctcagcctgtaagcgggtggcgcatacctcaacctgcctttagcatcctcgtgccgaatgtggggctcacgatatggatgtggttatctcggccgcgcgccgtcgtcctttacagaccatatatccgcgccgtgccttcttccactgccatgtcgcgctaggacttaccctgctcacgccggatagcttgcaggagagctgcctgaagaggccttccggaagtctcctgttgcctcagccttggggttctatccgttcctgtcgcaaaaccgctagagggaagttgtgcttcaacggtagagctgcccaacggcgtcagggctttatcgtatcgccttcgtgcggtcttcttttgctcttccgtcctgttgaatatggtgtaggcagcgccaagcagctcgtctcttcgtgagggtgtaagcaacgggttcacgtctgtgctttacggcaacctgtaagagtgtcttttgctccttcgccacctccagcgcgactgccatcttgaagctcgcactgtatgtctgtctttcttatggtcttctacatccttgccgtacagtctgtgtcctttggagaaatctttgcgggatttgaaaggatggtcaaatcgatgtctcagaattaccggccaacactcatacggctgtgggccctgtcttacttgagcaagacgatacccaccaactgaatcgctgcatgttcagtcaaacaacctatcacacacctatggttctgacgtacgagagaacctctcatctattgcagaagaacaacaagcgcttctggccacttgaggaggagattgtgcgaaattaatttacatacaaaaagggctttacttgtctatgcaggggctataaattgaaaacaggtaaaactccctaaatacagttcagagcaaacgaagcgattttccatatagcattgaaggccgctctggatgtgccgacgtgcgaggaaagttgccgcgcggggatatctgagaggaggcacagattcatgggacaggatgctgcaggcgttctgcagaggcaggatgccgggtcccgcagggcagaggggaagcatcccggatctgccctgagatatgcaagcgaagaagatggacagtacagctgcctggattacgaggcagcagctgctgcaaagaagctcgagggccgctatggctaccgcatcgcgaagcgtgccttcgatatcgcattcagcctcctctggattgccctcttcggttgggtctacatcattacggccatgcgattaagtgtgatagcgaaggcctgtcctcttcaatcaggaacgcatcgggaaggatggtaagcccttcaagatgtacaagttccgctcgatgtataccgatgcagaggaaaggctcgagagtctcaagggcctgaatgagaaggatggaccggtattaagatcaagaacgatccacgcatcacccgtgtggccacttcatcaggaaggaccgcatcgacgagctgccgcagttcttcaatgtcctcaaaggtgacatgtccatcgtgggcccgcgccggcgcttgcccgcgaggtctgccagtacacgccctaccagcaccaggtctctcatcaagccgggtatcacctgctactggcagacgcgcaggacagagacgacatcagcttcgacgagtgggttgggctcgatctgctctatatcaagaagtgagcgcctggtcagacatcaagctcatcgttgagacggtaggtgccgtgctgatggcgcagggaaactaggaaatcgaaaagcggaagtcgtggatgacttcgcttattttaggctcttcgaactttagtgggtagcacgacagtgccgcattgagttcgcaggcccccacggcagtatttccccaacaggcggttcttggtggggaagtcaaagatgaatacacaagcaggatatgcagcacagctcttcgagcgctcgatggagccttggagaggagtggaaggtctgcgatgtctggtttaaggagcgcagggacacacccgatgagctccacgtcagggtcgcccacaagagaatccaggctgtgaagtgtcccgtccgccacagaagctgcactacctgtgatacccacgagaggacctcatggtacctcgacatctaacaatacgatcccatcgtgcacggagcagtccccagagcagactgccctgggaggtagcgtccctactcccacatcagcgccctctttaaggcccagctgatcgcgatggcgctttttggcatgagcgtcacggcgataagctaagcagctcaagcagtccgacagccgcatctaaacgatgctcaggtgcgctgtccttaaagcaggcagtccttaaagactacttagatgtcagcagggtcagcctcgacaaagaaagggtggtagccatcattgaaggatcagccacgatatgggctaaggcctactcccaaggggttggcaagaagatgcccaatgcctctcaaagcggcgagcgcttctatgtgatgcagctcttctcaagggccacagacaaagtgaggtgtgcagaaaggcgcaaggcagacgagaggcgtcgtatgcttacagggaccgactacgtctggctcaagggcgaggagaacctgacagagcaccacagagccagcagctcgacttaaggaggagccacctgtagcgtgtgctcctgccagatgacaaaaggtcatgcacgtctgcgtattcctaaagcgtgcatctgacaccgcagctccagacaagcacatcttttggatcatgcactccaacgtggagcagatgaagatgctggccaagaccctcagaaaaagagcgcgagaggatcttaaactggtgggacaaaaaactccaccaatgcgatcctggaaggtctcaactcccctgtccagtccatcaagcgggcagcaagaggctttaagaacacgtcctactttgagacgatgatcttgctcaggctgggaaagctcgacttcttagctcagacatccctggcctgtgctgcccactaaaaacgcggaaaagtcttattgcctactcaaatcatgtttatttgggatttgagttgtgatgtgtcaaatgcgggacccaggttagagcctgctactcctggtcggtctcgttcgcgatgatgttgcggttgtagacgagatgcaggtacatggcgtcatgcgcagcggtggaatcgtgcgcggcgatggaatcggcgatagcgcggtgcgtgcggatcgtctcggcgatgagctgctttcccgttacatcgatgaagagtggcactgagtacttgaggatgcccatcaaccgggggattaccatgttcccgcagctttcggcaatggcagagtgaaatgcggtgtcggcggcagagtagtcttctccggccgctgctagcttctcggtctcgtcgcagagctttttgatgttctgaacctgatcggcggtagccttttcagcagccatgccagccatctggggctctatcatgaagcggacttcgagtagatctcgtgcgagacggcgcttgtcttcgatgaacgtgaatccaagaggatcgccggcaattcctgggtttgatgagacgtaggtgcctgagccttggcggatgctcacaatattgcgggaccggagaagcttcatggcttcgcggacagagctgcgtcctacgccaagcttttctgagaggacggtctcattaggcagacggtcgccttgcttgaggccttcatttaggatgagttgaatgatctgtttcgatacttgctcggggagtccagattttggttgagccattgtgtcgccttctccgtttgaatccatcagagctatcttacggcactagtaggcggttgcctgccaaatgatgtgttgtatataccgtttgcagttcaatacctaccgtagacgagaaaacatcagatgaattagaccaaaatcacggttttaaatatcaaatgattctattcccgctataatcatcagacgaatttaaaaggtctgatgactttggaggagacatggcagaccctgtattcgcggctgatccagccaggctcgccgtttcagcggttgtcggcatcgcattgctgcttgctctgatcatcaagttcaagctgcacccggttctttccatgttggtctcggctattgtcattggcataggtgctggaatgccgcttgaccttgtggcggaggccgtcaccaaaggcgtgggcacgaccttgcagaacattgccctgcttattggcttgggttctatgtttggccagatcctcgaggaaagcggtggagcgaaggaaatcgctcagacgtttattaggaagtttggtcagagtcactccagctgggcacttggcattaccggcttgattatcggcaccaccgtattctttgaggccggcgtcgtcgtgctgattcctcttgccttcagtattgctgcgcagactaagaagtccacactctactacgggattgcccttctggctggacttgctgcgggctatgcgttcgtgccgccttcggctggctcggtgctcgttgctgacacactcaacgtcgaccttggtacgatgattcttgtcggcattcccactgcattcatcgctacggctgctgcaggtatcgcatggggccgccatgtcggtagtcgcatcttcgcaccggttcccgagcacatcaccgcagctgaaagggtgggcgacgagaaggagcctccgtcattcggcatggtcatcgcgatcgtacttacaccgctctgtctgatacttcttggcacgctttcgtcctgcatcgcgatgtctgagactgtagcgtctgtcctttccttccttggtaagccgtttgtcgctcttacgattgctacgctcattgccatgtatttcctcggcgctcgtcgtggctactctggatctgagctcagggaactgctcgatcgttccctcaagccagttggcatgattcttcttgttattgcctgtggcggcgttatccgttggatgctccaggactgtggcttgggccagatcatagggcccctgctcgaaagctctccgcttccgcttgtcgtcgtgggctttcttatagccgcgcttgtccgtgcttccgtcggtagttcgattgtagctatgaccatggcatctggcattatggcggcaattcctgcagtttctggcgcttccgtgctcatgcgcgctgctatctgccttgccatctgcggcggcgctactgcgctttcccatgtcaacgatgcaggcttctggatgtgctcttcgttcctagagatcgacgaaaagacgaccctcaagagctggacagtcatggagacgattatcggtatcgtcggccttgcctgtgcgctcgtgatttcggtctttgcctagcggcgcctgcccgcattgtgctctgttttccattgaagtcatcggttagcaaacaagctagagaaagaggagagaaccatggaagaagaaacgaaatccaagattcggcaggaggctgctgacctggctacaaagcttcagccgcgttctggaaagttccgcaagataagccccgagatggatccgctgcgtctgggaactggctggactgtcgaggatctcgacaagccgcagattatcatcgaatccaccttcggagattcgcatccaggctctgagggcctgttcgaactcgtcgaggaagtccgcaaaggtgtcgccgaggctggcggacacggagctcgctatttctgcaccgacatctgcgacggcgaagcccaggggcatgacggtatcaactattcactgccgagccgtgacatgattgccaatatgatcgagattcatgctaaggccaccccgttcgatgcaggcgtattcgttgcgagctgtgacaagggcctgcctgcaaatctcatggctctaggccgcatcaatatcccgtcgattgtcgtcactggtggcgtcatggatgctggtccccatctgctcacgctcgagcagctcggcgccatctccgcccgttacgagcgtggcgaaatttccgaggaagaattcgagtttgccaagcacaatgcctgtccgagctgtggtgcctgctcgtttatgggcacggcgtctaccatgcaggtgacagccgaagctctgggcctcacgcttcctggcacagcgctgctgcctgccacgagttcggatctgcgcgagttcgcccgtgcagccggacgccagtctgtctggctctctgaacataatctctgccctcgtgatatcgtgaccaaggagtccttcgagaatgtcatcatggtccacgctgccatctccggatcgaccaactccctgctgcatattcccacaattgcccgtgaattcggcatcgagataactgccgatgacttcgatcgcctgcaccgtggcgctcactatctgctcaatgtccgtcctgcgggtgagtggcctgcacagttcttctactatgcaggcggcgtaccgcgcatcatggaggagatcaagtcgatgctccacctcgatgtcatgaccgttaccggcaagacgctcggcgagaatctcgaggatctcaaggccaatggttactacgagaggtgcgggcactaccttgagaagtggggcctcaagcgcgaggatatcatccgcccgtttgaccaggcattcggtaccgatggttccatcgctatcctccacggaaaccttgctcctgatggcgctgtcgtgaagcacactgtcgtgccgcgtgagatgttcaaggctacgctcaaggcacgccccttcgactgcgaggaggatgcaatacatgctgtgcttacgcacgaaatcaagccgggcgatgctgtgatcatccgctacgaaggtcccaagggctccggcatgcccgagatgttctataccactgaagccattgcaagcgatcctgagctcggtgccagcattgcgctcatcactgatggccgcttctccggtgcctccaaaggtccggctatcggccatgtttcgcctgaggcagccgtgggcggtccaattgctcttgtcgaggaaggtgacctgatccgcatcgatattcctggtcgctctctcgagatcgtcggtatcgccggcaaagagatggaccatgctgaggtcgatgccgtgctcgctaaacgccgcgctgcttggaagccgaagcctaaccgctatacctccggtacgctcaagtttttcactgagcatgcggtttcggcaatcaagggcggctacatggagtagttttctattgtggttgtggggcatagcatggagaggtgaccagtagggacttccgagcttaaaggctcggaagtccctgtgctgagcgatgctgatatcatggcgggctggattccgaatctggtaaagttctctacaaaaggtttgtctgggtttgctatgtgcaatccagcgtttgcttcgtttggaagagttctcattgatatgctttctcctgaaatgggatgcatgccggtttgctggctagagtgtccagattgcttgcgcaatgcccatcggaatatggtatagctacatccacacattccagcatatccaaaaggcagatatggacagatagatgagcttttaggaccggcagattgtcaagctgagtgcaacatctccctaaagacctcgttggctgtcctgtatccaaggaccttccttggcctgtcacagatcagctctaccgcatgctgcacctcctcgtccgtgaccttgccgaagtcggtgcccttaggagaagaactctagcaggagtccattggtgttcttaactgtcggcttttgccatagatggtgggggtcgcagaagtagaactgcacgcctcccaaggcctttgtgacatctgcatgccctgcgaactccttgcccctatccggggtgagcgtctcgaggggacgtccctgcagcagcccgacctcggccttagagacgctcccgctgtcgtggtggcatctctttgcgagaagcagcctcgatgccctgtcggcaagcacaagcaggcacacgggcccggctgccacgaccgtgtcgtcctcccagtctccgagacgagacctctcatcggcctgctttggcctctcctttacggtgtgcgagatcctgatcttgcccctgatcttaggcctcttcctgcggacctgcttccccttcctgcgcaggtggcgctgcacctggccttcggggccggcttccggcaggtcgagggcgcctgcatggacttcccggtaaatcgtcgagaggctcaacgacgcacctgccgccaccctcgagcctgagatgtcgtctatctgctcgggggaccagtgtctgtccatgatgagtaagcgcaccttctgtgcaagcgcagggtctgaaagccgccttttcgccctgcatctcctgcggcgctcatccgccctccttttgggcagcacatgccttaaagtgtccgtggcgtgcgttcctcttgagcttgtggcagacgctggagctgtccctgccgatctctgccgcgatatggccgattggccttcccttgtgccacacagtacggctatgcagtccctctcctgggggctaagatgtgtgtagtggcacattccttttagctttcaacgttgacttggacaaccaacatcatagccttccggagtgtgccacgcttgcattcagcgggctatcctgttgcactcagaatgctaatccaccaccttaaatcctaaggtctaaggagaaaagacccggcgagaggcattcctggagcaaatggatgcaatcgttgtgtgggatagctggattgcactggtagataccagctaccactgacaggctcttgtcaggcatgtgcgcgctgcaaagacaaagctttaggatgtatctgttgcaggtcatgtttgctctcttaagacgagggaacttaaagatgctatcctagattgccactcctggcagcgcttctgtgcacgcagacctcatgtctgagcaggtaccagatgcaacggcacttgcgaagatgcgccatagccttaaagcgagagggactcggtaaggctatgcttcacgacctgaattcggagcttaagaaggcagggatcatgatgcggggcggctccatggtggatgtgaccttcacctgggccctaaagcttaacgaagaacaaagaccatgcgcgcgacccttaaagcgcaccagtccaagaaagggggagcctgacgtatctgatacaaggcgcatatcggcgtggatgccgcaggtggccttgtgcatggtgtggagacgatcgcctagaatgtatctgacatatcctgtggcacacacactcgtaagggaagatgacaggttctgctgcgcagactttaggctatagaggtatagcgaagcgcccttaagaacgcataaagaccaacacctctcatctatgcgctaaagtattgctaaggaagccttcgactagagaaggccttgcctgtgcactcttgtccgagaagggcatcgagtccaggaaggcatgcgtttgctcaaaggtagagcatcccttccttatcgtgaagcggcgcttcgaccccttaaggaagcgctacaggaggatagagaagatgcctgtacactcgagtctctctcgcccttgcaaaccttacccatgtgcatcttttgccggcaggctgcacctcccgactcccagagtcgcttgatccatcttggagccttcttgcaatgcatgggacaggacaaatgtaaggatagcggctcctgcacgtgctggatgagcatccttccctgcttttcccgcatgccggcctagaaaggccgtgtggccggtcccctctaacacgttatgggacattaatcatcgtttccttagatggactgtcgagctcaagaatccgtctgggggtgcaattagctaacatggcgggctcctgtcacatccagatggactgtgatttctggctctgaggacgggaaagtactcgtgtcagcgagggtcacaaactgtcatgtgaccccatctgcttgcgagtttacgatggtttgtgggagcagtataatgaatacgacataggggagctggggttatggctcggccgagaagtggaccttctgtcgtggcccaattacctgaaaaatcgtttgattcacaggtgttttcttgtaattatgcaaaaatatgtacagactagtactctataattatgttcttgcaccgtgtacatgcaaagcatgaagagaggacgga

SEQ ID NO: 344 - DNA, 4977 bp, Unknown
  Metagenome-assembled genome
ttcagagcctggcaggtatatttcgatgccagagcagaggcttttgaatgctgtctgctactttggagccaaagcctcgatatacgtgttgacgctttcggtcctgccgctgtctgccatgctgctcctatctccggtgggtggtaacgcaagtccgtaccgagcatcaccgtttggtacggatttgcgttaccaccccattacaatgagagatctcctcttggggacttcttcgagctttggggttttcgacaatgaagtgcctgcggattccctaaccttgtagatggccctgaaaggggctgctggctaacctttcccggacagccgtgtgcccctgcctcttgcgaaggcctgaggggatattgctgccaagggatggtggttttgtccgagaacggctgatagggatgtgccacacgataagcagggcagtgtagatgtccgcccctcagacacgctggccagccggcctaagaggagattaccaccatggaacgcaagcagaaagactggttcgggccgcagcgcttctatctcgggatagacgtcgggaggccattcctccgggcagtgggcctgaaaccgggtggcacaatcgagatcagctacaggcaggacaggtgccaggaggatgtcgaggttctgctcgacgaggcgggagagggcgccctggtcaattgtggaccagaagaacaacatcggctcgcttatcgtgtacaggtggtgcgcgaaaaggatcgacattggataccttccagggaaggcgatgaagtacgcctgcgagatgtttcccggaaccgcgaagaatgaccgaacagacgccgaggccatcgcgcagatgggcataggcagcaggacggccatcaggcccatagccgagacagacgagctggacgcctgcgtctcgctggttgacctgtatcgttttttcagacagtgcagcttgaggaattatgaggctcctcttaactgcaagacaagccgaccgaaaagactacaggtggcaaacaatcttgctaccaaatacagcgatgagtagcgcctgaaaacagctgagtgtgctatctccaccggcaagcctaaaagccaccttaccaccgagttagggctaaagtcccaaaacacagatccgctgggtaaaagatcgtagagataggctatcagctgcttaagcgcagcgaggctaaagaggcagattgtcaagctgaatgcaacatctccctaaagacttcgttggctgtcctgtatttcaggaccttcctcgctctgtcacagatcagctccctgttggtatcacggtcggcgtctttgtcggcataatcgtcctgcacttcatgcggccgaagcagaacacgatgagggtttatctcgagaactcccgccgcatgctcgatatcgtgggtaagcttatcgtgctcctgacgcttcttgccatcctgggctccgtcttcatagccacaggcatcggcaccgtcatctccgatatcgtgggcgccatcatcccgcagggtaacatggtcgtcggtatcgttgtctactgcgtcggcatggccctcttcacggtgatcatgggcaatgcctttgctgccatcacggtcatgacggtcggcattggggctccattcgcgatgcccctcggcgcagatcctgtcattgtcggctcacttgcccttacctgcggctactgtggcacgctcatgacgccaatggcagccaactccaacattgtctctgtcgcaatcctcgagatggacgacgagtacggcatcatcaagaagcagatcgtccctgccctcatcatgcaggccttccagatcgtcctcatgatctgcctggtcacgctgtaggatgcgccgcatctgggtagagagtgagaaagcagagaagagagcataccttcgggcaggctcttttgggagaaaaggattgaagtggagaagattctcgtgactggcttccagccgttcggcagcgagaccatgaacccgggctgggagactgtccgcaggcttcccgacacgattgccggcgcctccgtcacgaaggtcgaaatcccggttgtctttggcaagggacccgaggctgtggatgtggcaatcgacgaggtccagccgaacctcgtgctctgcgtcggccaggcaggtggccgcgcgaagatcacgcctgagtttgtcggtatcaactacgctgatgcccgcattccggacaacgacggcaaccagccggtggcagagaagatctcggctgacggccccgatgcctacttcgcgacgcttcccgtcaagtcaatggtccaggccatgacagaagcaggcatcccggcagaggtctcctatacggccggcacctacgtctgcaatgacgtaatgtattcgttgctgcacacgctggcaacgaagcatccgggcgtccgtggtggcttcctccatgtcccgtatgcgacggagcaggcctgccatctgccatccttgacgccgagcatgtcgctcgatatgatgacgcgcggcatcgagctcggactcgcagctgccgtcgagcacgaggatgatgtgaagacggctacgggcacaacgcactagcacctcatctgtgaagcatctgtgggaagtcccggagattcgctcttccggagcctccttcgtcttccgggctctgcatcacccctgctcagagcttcaaacagacagctgtctcgtctgggacaggcgtcccaatcatgggagatgggcaagggattgcacatgcatcaggtagaatgaatttgaaaaatccatctgacaagagactctccaggaggctgctgtgggctatacggaacgcgagcattggtgccagcgcgatgacaagaagatctacgggaagctcttcctaccggatggctgggatgacggaaggccgcgcgctactgccatctttgcccatgggctctcgacgaaccatggggatatggagccgtatgcaaggtgtgccgccgagcggggcatggtgacgtatgtcttcgacttctgcggtggtggcagctactcaaggagcagctggcaggacaatatgtcgctcttcacggagcagcatgacctcgaggcggttgcctgggagctctcgcgggagtcctatgtggacgagcacaacctcttcctctgtggcgcctccttgggtgccacgatcgcgctcatggcagcgagggcgaacgtacagctcgtgaagggctgccttctgctctatcctgccttcaacctgtacgatgcggtgcacagtgcctgtgcgcggagggaggatctgcctgagcgcttccacgttatgagcatggatgtgtcaggagatttcctgcgctcctgctgggactacgacttcttcgagcacatcccggcctttccgcaggatgtgatcatcttccatggggacgcagatcaggtcgtgccgctctcgtactcccagcgcgcccagtcgctcttcccacactgtgagctccatgtgattccgggcggcggccatggtttcgtcgacccctactactggcaggtcgtgaacgaggcagcggagtggctccgcgcccatatctggcgctagggaaacgatgattaattcgcctcgatgaggtcgctggagccacacgctgtatgccacctgctcaaaatgtctcgaaccacgcagtgcccatacccacataaatgcctatctgcctgcggatatgttataattacagcaacgtattccagcatatccaaaaggaagatatggacagatagatgagcttttaagaccggtggatcagcattctaagtgcaacaggatggcctgctgaatgcaagcgtggcacactccggaaggctacgatgttggttgtctcaatcaacgtcgaaagctaaaaggaatgtgccactacacacatcttagcctacaggagaggaactgcatagccgagctgcatggcacaagggaaggccaattgcctatatcgcggcagagatcggcagggacagctccagcgtctgccacaagctcaagaggaacggctggcacggccgctttaaggcatgtgctgcccaaaaggagggcatggcataagggcgccgcaggagatgcagggcgaaaaggcggctttcagaccctgcgcttacgcagaaggtgcgcttactcatcatggacagacactggtccctggaggagatagacgacatctcaggctcgagggtggcggcaggtgcgtcgttgagcctgccgactattttaccgtgaggtccttagccgtcgccctcgacctgtcgggatccggcccgcaaggccaggtgtggcgccacctgcgcaggaagggtaagcaggtccgcagcaagaggcctaagacgaggggtaagatcgagatcttacacagcgtaaaggaaaggcccaagaggccgatgcgaggtctcgcctcgccgagtgggcagacgacacactcgtggcagcggggcccgtgtgcctgctcgtgcttgccgacagggcagtgaggctgcttgccgcaagaagatgccaccacgacagcaggagcgtctctaaggccgaggtcgggcttttgcagggacgttcccttaagacgctcacccctaagtggggcaagcagctcgcagggcatgcagggctcacaaaggccttgggaggcgtacagttctacttttgcgaccctcaccatctatggcagaagctaacagttaagaacaccaacgggctcctgcgggagttcttcccttaagggcacagacttcagcaaggtcacaaacgaggaggtgcagcatgcggtggagctgatctgcgacagggcaaggaaggtcctgaaatacaggacagccaacgaggtctttagggagatgttacactcagcttgacaatctgccgtccgaaatattgacacagggcgcacatcgcgcagcggctcgctgagatcgtggaggctgccttccgcatggaggtgcgccgctacaatccaagagaggatgtagc
